United States Patent 9,328,346 (POLYCOMB-ASSOCIATED NON-CODING RNAS) - sequence listing, part 154

SEQ ID NO: 192682 - RNA, 315458 nt, Homo sapiens
cccggggcagcgcaaccgcuggggccggccucagugggcugaguggucggggcaucggggcccagagagcggcuggugaguacuuggucggagcgcgcugugagcgcccggccccuguccgggaggcccugaugcagccggguuccccgcccacuuuccuucuuuuuaggggacuggaauccacgcuacaguucaguccuccaccucuguuaguugaacccagggaaccccugcuucaaaaccccagcugagucacuacccuuugucagucucuacacuggacaucuaagugacuucacacccacuccccguuuugagacuagaaaaccaaauaccgcacguucucaccuaugaguaggagcuaagcuauugcuacgcaaaggcauccagagggguauaguggacuucggagacucagaaggggaagggugggaggggggugagggaugaaacaacuacauaucgcuugcaauguaugcuaccuggaugacccugaagucucagacuucaccacuauccaaugcauccauguaaaaaaaccaccuguacccgaaaagcuauuaaaauaaauaaauaaauaaauaaauauauauauauauauauauauauauauauauauauuuuuuuuuuuuuuuugagacggagucucacucugccgcccaggcuggagugcaguggugcgaucucggcucacugcaauuucugccucccugguucaagccauucuccugccucagccucccgaguagcuggggcuacaggcacccgccaucacgcccggcuaauuuuuuuugguauuuucaguggagacgggguuucacaguguuagccaagauggucucgaucuccugaccuugugauccgcccaccucggccucccaaagugcugggauuacaggcaugagccaccacgcccggccauauaccuauauauuuuuaaaaauucaaaaauaaaacaaaaaaaaugccucucccuccggcuuauuucccguuccucuacccuucucauuccccucuagcccaaaagucucaucacugaauuuaccacuuuucccaagauaguugugccucuuuuugcuucucugcuuuuguacgccacuguucccaccuucugccuauaauguuucucucucccauccucuccugacaacucuucuuuagacccgacucgggugguaccuucuccgucaaguuuucuuucuuucuuuuuuuguuuuucagaaguuuugcugccugcuaagcucucuuagcccuucguuaauucaccugucauugacauugaccaucuuguguuguauucaauagucugucacaccaauuugauugugcauuuugcuuuggagaaguccuuagucuuuuauguagccacaguggccagacaugcagaagacguucaauauugcugaaugaacuaaugcauuugggauaggguuacagaaaugggugcaagagaaaagggugugguugaauuggcuguacccagcacacagguaugcaacuugcucacuuacuguaguauuccuaggaggggaggaguucaacaccuggaaaugcuccugaaaauaaccaggaugcauuucuuguugacuuugcagaaguucacugaauccuuaaaauuuaacuuaagaagggauggugggaauugaaaaugauugcauccagccugggcagcauagugagaucccaucucuacagaaaaaccaaaacccaaaccaaaaaagaacagccaagugugauuguguacgccuuuaguccuagcuacuugggaggcugagguaggaggaucgcuugagcccaggaggugaggacugcaaugagcugugcucacaugacuguacuccagccugcacaacagagcaaguugucugugaaggagagaaggacccagagaaagugaacaaguguugaugccacauucacucugugugcuuugcaucagcagaaugugaaugcuuggggguagauucguagggaauuucaggucuuauuuauuuauuuuuuaagauagguucucacucugucacccagacuggagugcaguggcgccaucuuggcucacugcagccuugaccuccugggcucaagcuaucuucccuccucagcccucgaaguagcugggacuacaggugcacgccaccacgcccggcuaauuuuuugcauuuguugucaagacuggguuucuccauguugcccaggcuagucucaaacuccugagcuugagcucaggaguuuguauguuacaguauaugauaugcacagauguaauacaacuaaaauguacacaugauuuuuuuuuuuuuuuuagaaaagaaccauacagaaaguuaggaaauuggaaaguaaaaauucuucuucuacuucccuucuucaauuucuuucacucagagugauucuuauuaauaauuuauuguguauucucccuagaaagcuuauaauguacuuuaucaaaucuaaacuauuacugauuacaauuuuuuugcaauucuguacaugcaaauuagguauuuuauguaacugcauaaagaaaaaaaugcugagaaacaaaaaaaugcugcauauuaaaccuucuuaaaguaugcaucuuagaauugaugaaauaccguauauacacauauacacacuuuaaaaauuuuaugcgagugguguuauuaugcaaugugucuugcuuuuuauguaacgaugugucuuggagaguuuuacauaucugcauauauagcucuaccucauucuuuguaucgcuaaugaugcauuaaaauuuuauugaacaaggguaguacagaacaauuagugggcccuucauuaagggacaucuugguuguuuccaagguguggguaugugucuguguguuuucuugcuuguuuuugcuauuacaaacauguuguagugaaccaccaaccuuguguguaugugugucuguauauauauuguauaucuaucuauauauaguugguaagauuuuuucauuuuugcuacaguuuuuaggaauuccucuauauaaaguaguugcauacaucuucuaaccuaaaauuaaauaauugcaucacucuuauaaguugauaaguugaucuuuuaguauuuagaguuuguuaccugccaagcaauauuugacacucaaaaaccauguagaaaaugcaucucaaauuacaguauuucauuagagggaaaguuauaugauuuccuuaaggaaaaucucuccaaaauggcaguggucauguauuuauauauuuauuuugggaaucuuagcuauaugaucuauuuuaacaaaauuuaaacuauaacaaauuauuuauaauuuauuuuuuucugagucacaauagggauuaaucccugauuaucaauuuucaguguucacagacacuuguauucgcagaaacagagucuguaugucaguguucacagucacaaaagucugcuuguauaaaaaccacauuuauuauuuaucuuaacagauucugaauccuugcuguuuguggucuuuuggaagaaugaauaugauaugaugucguucuaaacuuuuuuucccaaccaaauuuucccugcuuugaccuguucauagcuuuuuauaguuuaccucuuuacuucucuguuuaaauuucuucccucugcuucuuguugacuccuacuuauccuuuaaggccaacuaauguucaaauccuccaugaaauccucuuugucuauuuuguccacguuucucucuuccuucuuuaaauuccuuuuucagcagaacaucacaauuuaacauucuugauugauucauauagguuacuuuaucuccuaaaugagacugaauucuucaggaauucuugucugggcuggauuucaggcaagacaucuagggggugcuacauuagcugugguugcugagcacuuguggcuugaaguagucuuuuuuucugacuuuuauuuuggauucagaggauacaugugaagauuucuuacaaagguuuauugcaugaugcugagguuuggaguaugauuaaaccugucacccagauagugagcauaguacccaauagguaguuuuccaacccuaacccccauccuucccuuccccuucuuguacccccagugucucuuguuuccaucuuuauguccauguauccccaguguuuagucccuacuuauaagugugaacaugagguauuugguuuucuguuucuguguuaguucacuuaggauaauggccucuagcugcauacauguugcuucagaggacauguguuuuuuuuauggcugcauaguauuccaugguauauauuucuucauccaauccacugugaaguuguauucuuaagacaagaggcagggcuucuccagagaccuggaggggguguagcuaaugcagcugaucauuacagcucauucccucuagcaucagaggaaugccugggcugcuguuucacagauagacgccuauucugcccagcauuagaguugccaccaaagauuuuuacugcgaaugggcuaaccauuaagcugcagcccuaaaacccuaccaagcucaaaaaugcacccugacauuguguuucaaaaugguggcacagaagcaagcuggcuguuucuucucccuuaccaccagaaaauggaaacaaauacacaauguuaagauuaucaccaacaauaucccaaaacucagauauaaggaugagaucauuuccaguaccacagagaagugaaaaaaccucuaagcagaugguaagagaauuggacuuucauagcaugacacuccuuaccucagucugccuggcaccaggcaaauggaaaauuucucccagucuuacgguuucucuaaugggaaaagugagauugaaguggacaaccaacuuuccuaccauccuggguuucauggcaggagaccuguucuugccucaaaccacaggaaguaucagcagugcuaaagggagaaauaucccugaggacagccagagaugaaggagggagauaggacuaccauccccauuccuggaaacucugcucuguaacuuggccaaagaagacaccaaaucagaguugcuguuuggcaguaccaugcugugggaagcucaucccacaguucccuuaagcaugaaccccuagccagcauucccacacugcugggauaauccuuuuaggacuucccccauuuuggaugggcagcaaucugauuguuuacuagaaccgaggcaaacccaggcuuaagccgacaucuagugcuggaaaugagucagugaccuagugaaaaacaaaagaaaaucuacagguaaauuguaaagacucucuaagcagacauauccaauaaaaaccaaaaccagccagacagagaagacuggaguaaauaauuaauccuucaacacaaagacauacacauacauucacaggaaaaaauagcaaacagaggaucaugaccucuucaaaaggacaaagcaagaaaccagugacuaacccuaauaagaaggcaauaugugaacccucucaccaagaauucaaaauagcacugaggaagcucagugaucuccaagauaacacacaaaaaaaauucagaaauuuaucagagaagguuaacaaagagauugagauuaaaaaacccagaaauuuuggaauuaagaaagagauuugcugagcuaaaaaacuuauuagagguucucaacagcagaucaagcaaagaaagaaucacugaacucagacagguuguuugaaaaugugcagaggagacaaaaggaaaaagaaugaagaugaacaaacuuauagaaaauuaccucaaacgaccagauuuaagaauuauugaguuugugaccagucugagcaacagagugaaacccugucucuaaaaauaaaaaauaaaaaaauuaggcauguaucguggugcauuccuguugucccagcaacucagaaggcugaggugggaagaucacuugagcccaggagcuugaguacugguacuguuuggcaguaccaugagaccagucucagcaacauaaugagaccuugucucuaugaaaaauaaaaauaauaaacaaacaaacaaacaaauaaauaaauuagccaggcugguggcaugcaccuguagucuuagcuacuugggaggcugaggugggagggucacaagccugggaggucaaagcugcagugagcuaugaucacgccacugcacccuagcccagguggcagcgugaggcccugucacaaaagagaaagagagagagagagaggagagagaaagagagaaggggguggggagagggaaggcuaaaaaaacccugcugauaauuugggaacaaugguucauguugacacauucuaggggacaguggguggguaaacugguuaacuagcagcuaaaagauaggucaguuuguccuugaguaggccaacuaaguguaucaaacaaacaauuauagcuguuuaugaguucucuggaaaacuuggagagagcaguuguggggcauaggugacaggcuggcucuguguaguaucuacuguugacccaucauaagaagcuccaucuugcuuaggccaggucugcaucuguguccucagaauuucucacuagaaaccucuuuuucugucuucuuacguguuugggaauguauccuuuuguucuccaaguauuuacuauuauucugguuucuggauuuuaaccacauccugaaaacauauuuauuugguuggaggcaucauuauuguccuacaauaugguuuuugucuguaacugacaucuccuuuuccacuggcguccccuaauuuccaugguuaugugcucauaacuucuacacuucuucauuauuagagcuuuucuguuuaggcaggcuagauuuaugcucucuauaguaccauugccucaauaaauagucacaaucacuuuucagugugaacuuucuguuuggacuugggguuauuuauuuuggcugcuaagaggauguuuuaugcuuuuaugguagaugagauggcagacaguagaaugucugauuaaugaacuguauugcauuacauaguuccuugaagcaaggaaccuuuagaguucacgaaguucuuugcuuggucucuugcacagugaguaccucggcagugaucuacagucuguccucuaauucaguggcucucaucuuuuuuuuuuagcccuaaggcaccuccucaggugcccuccaaugaauugcugggguuacuauggcagggaugggauguguguggagggacaguccccuagagccauaacauaaucaggaggagcacuuaaagucugaaaaagcucccaggugggugggggugugugugugugugugugugcuguccucacuaaaaauaucaccucuccagccccauaaacuaagcuuccuuagauaauauggcaagggagaacuuaaugauuuugcuacuugucuagcuaaaaggggaguaauaaaaacguacaacacucaauuuacuguaguuuuaaacgaaccuauguuauaauucuagguuucgaaguauaaagcauuccgcacgacgggggauggagaaggaugcugaagauggcgccccuucugagggagcagaggcuccucccucuacggaagaggcugccccuccccguucagaagaggaagaggccccgcgcccuccgacaguggaggccccggcagaagaugguuucucuccuuccgcagaagaugcuguuucuucugugguggauuaucgggaucucauuccuucugaagaagggauaguucuuccagaugaucaugaagcggaucugaauagaguucgacagaggcuugcaccgcgaccgguucagucagugauuucggaagugcuguccuugccgucuucccggagguccuccagauaccgccggaguaugaguggccuucccaaucuacaggaaacauuaaaagagagacagguuugcuucuaauacgauuuuucaugugugccacuuuuccuuaucaaauacgaaauacuuuuacuuuacaaaguaugaaacaguuugauauuuuuucuucagaauugcaauuuuugaacuugguuuucauuccuuaggcaagauuuagagaggcaagggaaagccgaagacugaaaauugacccuucauacaaauauauauuugaaauucuagcagaaaaucuuggccuggacauaguaacuguugaagaauuaauuuuggauugcccaucuguaaguuuaagucuuaucauuauauuuuaauugcccuuugaguaagugauuaacuuaagaaaauagaguugucauaaacagcaacaacaacaacaaaaaucauucagaaagacaaaguuggggcagggcacaguggcucaugccuguaaucccagcacuuugggaggcugagguuuggggauugcuugaggccaggaguuugagacuagcuugggcaacauagcaaaacuccugucucugcaaaaaauacaaaaauuagcugggcauggugguccguaccuguggucccagcuacucaggaggcugaggugggaggaucucuugagccugggagguggaggaugcagugaguacuccagccuggcugacagagugagaugcugucuaaaaaacaaaaaagaaagaaaaaagaaaaagacaaaaguuggaauuuuacugacuagaggagaagguuuaguuuauauaauuauagccaguugaaugguauuucuuuuuaaauuuaauuaauuaauuaauuaauuaauuaauuaauuuuuugagacagagucuugcucugucaccaggcuggaguggaguggcaccaucucggcucacuaaccuugccuuccggauucuccugccucaggcucccgaguagcugggauuucaggcacgcaccaccacgcccagcuaaauuuuuuuuuguauuuuuaguagagaugggguuucaccauguuggccaggauggucuugaucucuugaccucgugaucugcccaccuuggccucccaaagugcugggauuacaggcgugagccaccgcaccuggcccaguugaaugguauuucuaaucagguuuacuguuguggaggaagaagagaaaaguuagcaacuagaauuuuggcuaaacuucuaauucagaaugaugucagaaguuagaggcauaguugaguggugacgguagguaauauuuuacaaguacagguuauaugaacuacauaugcaaaucacuuguagagaaaagcugcauaaauaagucaggaaacagugacuauuguaugaguauacgguaguagaaauagugaugugauugcaggucagguuacuauaugucucagugugccagggacaguucuggauuauaccuauuuuccuggcaugauuaacaguaccuccugacacuacuaacaguuuuggaugauaaauugaugcggucacccuaauuauaguaauguaugauacacuugugucauagcuucccucgcgauagcucugguucuaagauaauuuucaauaaaacuaccacuagguucuugggcuuuuucugaacccuaggaguggacugggcugguaugccagaaagaccagugagcaggugcagacugcuggugagcugauugucucacugaaugcacuggugagagaguuggggugaggugggguuguggugagguugucaccaugggggccauauccccugcuuuuauaggggucaucaaacaugggcaaaacucuuuagcuugcucuaggagccaggguucuauggaaccgugccuaaaagagcuacucccggccgggcgcaguagcucacaccuguaauccaagcacuuugggaagcugaggcgggcagaucgccugagaucagaaguucaagaccagccuaaccaaaauggugaaacccugucucuacuaaaaauacaaaaauuagcugggugugguggcaugugccuguagucccagcuacucaggaggcuaaggcaggaggaucgcuugaaccugggaggcagagguugcagugagccgagacuguaccacugcacuccauccugggcgauagagugagacuccaacucauauaauaauaauaauaauaauaauaauaauaauaaagagcuacucccuugcuugauacagugcauugcuaaauucugcaaaauugucugcgcuucaugucguccaguauccuuauaagaaugugguccuggcaguucucugacaguaugaaugggauugcucauuuucuugguccuguuguguagcuguaacagugagauggggaugugauugaugcaaagacuucaauagcucuaagcuauuauaaugacaaaguauagagaaugcauggagauguguacguaaaacaagaggugucacagcaagcaaccggaaguagguugugguuucccaggucaccaaaguuccccgcuggaauuuacugcuguggucaaggcuggcuucauggauauauuggcuguguaguuacagaggccccugugcuuagaaugucacuaugcuugguuugaugaucuuuugucaccauuuugaaguucuugauaauuuuuugguaaaugucucccauuuucauuuugcacuauguucaucaaauucuguagcugguccugacuguggacaaugccaaccaaauaguaagaggauuuucuuugccauucacaaguuggguuuguuuguuuaaugguuuccuuuccccagugacuauucuaguuucuguggugacuuuggcuacaugucuuucuagccucucuaagcaauuggugcaaaacaaccuuauacacaucccugagauggugacaaugagaggaagggaaggccaauuucuaaaaagucauuucuuaguaggcccaggcuuuaggccugucccgaggaucaguccugcauuuggcuagggaggaagccagaugagugaucaauuuuguuucaccugaaaauugcugggccacagauuuggauaacaccacaacuggaaucccuagaccuucugcaaagaguauaggcauaggcauugcggccugaucacugccuucaugaaaggguaacugcuagaacuaagaugugggggggagaugggcaucugcagaacugguaguccaacuuuaaguauuugccaucuguauuucuggguugguauucucuguuuggaggaauucuuacuggcuagcaugcuagucaggaaguagaagugcuaugugccuacaaacccuucuauuugcuauuccugggguaugucucagacuuuggguccaugugguuagauucuaccuuuaaggccauuaugguccaggacugacacugcuuaggcugcaaggaaugggaaauguaggcauuaaggaagaaucaagcugcaaaagguauuuccuuaagaguugcuugugagugagcaaagccaugguggagggaaaaucguguacccaguagggaaaccagugucaaaaccugaaagauuagaauguuuauuugguugaggggaaaaggcaaggauauaugauagguuggaucaagguuggugaccaggugaguaaagagauggaacaaggaacaagggguggcaugauuugguguggugcgguuuaggaaauuggggguauauggaaaaguauucuuuaguuuuuuuuuuuuuuuuuuuuuuuugagacagagucuuccucuguuacccagccuggagugcaguggcacgaucucagcucacuguaaucuccaccucccaggcucaagcgauucuccugcuucagccuccugagcugcugggacuacgggugcgugccaccacacccggcuaauuuuuguauuuuuaguagagacgggguuucaccaucuuggccaggcuggucucgaacuccugaccucaagugauccaccagccuugaccucccaaagggcugggauuacaggugugggccaccgugcugggccuggaaaaguauucuuuuaaugugaagccuggcaugcaauccaggaugaaagcagcucaguaaaggcaccacaaaaaaguggacaacagaggguaugaugguuacuuuguuugccucuggauccauucucccuuugucucugcccugcucuguggcauagaaagcugaacucuauggaaucuaucaccugggcucccuuguucucugguuuacacuugguucagccacugggaggcacagcaggaaaugggagggcagaaggggagagaagcuccccacuuggcccuguuccugacugugguucucugcucccauaguuauagcucccugagcagccugcaucuccaguucucaaccuggcccuagucauucuauuuccucuagcucucaacucuucaguccuugggggaucacgguucuccguuguugcuagucccauuguugcugcuagugcugcagcuucucuuaauccuccucuggccucuagaaauagucuuuuauuguauaaauaaaauagccuuuuuauuuauaaaguuuuuucaaacaccccuuugggugugacuccuuuucuugcuaggaccuugaccaaugcagauguuucugcaacauuggcacuuuuaccccuucccacuuuccugcccccuucauucagcacugcucaagauagucucuuuucuggcuuacuggcaauguuuuccagugacuggguggcaggguugugguacauggaaggagcacaaauuuggacacccaaagcugagguccaaucccagguucugugcugugcguguguguuuuggguccuuaaguuaauuuuuuuuucuuuugagacagacugucgcucuguugcccagucuagagugcagugguaugauuacagcucacugcagccucaaccucccagacucgggccauccuccgacuuuagccucccaaguagcugggaccauuggcacauaccucuaugcccagcuaauuuuuuugguauuuuuauagagaggagauuucgccauguuucucaggcuggucuugaacucuugggcucaagcagucugcccaccugggccucucaaagugcugggauuacagaggugagccaccgagccuggccuacuuaaagucuuuuuaccuuaauuuucucuucugcaagaaggguauaauaaugccacuuuaccuaguugauacucagauuaacuguugguaaaauguuauguaauauaagugaauuuuuaaugcacagucaugauuuuggcccaugaucucacauuuacuuugcuagucucaugaguacaauguaucuaaaaugcaaggauucauugcauuugauauuuugaugucuuuuuauccuagucaugugcacugcuuuugagaauuuguaugauuucaaagcuaaagggucagcaagaaaguacugauggagcugugcaagaacuauguggacagcuuuugucccuuuuagguggcaauuaugugagacccaaguauauacgggagguggaagaguagagaacaaagggcuagaguuacgcacaucuugguggcucuguuuuaucucccaggguggugguucucaaauguggucccaggaccaguugcaucagcaucaccuggaacuugauaggaaugcaaaucauuuuguguuuuuaaaaagcccucuaugugauucucugaugcacacuaacauuugagaacacuguccuaggaggaguggcuuugcuacacuugggauacuuccgcuaggcagucaguaaauuaagagauacucauggccaggugugguggcuaauaccuauaaucccggcauuuugggaggccaaggcaggagcaucacuugaggucaguucaagaccagccuggccaacauggcgaaaccccaucuuuacuaaaaauacaaaaauuagcugggcgugguggcagaagccuguaaucucagcuacucgggagacugaugccggagaaucucuugaaccugggagguagagguugcagugagccgagaucgcgcuacugcacuccagccugggugacagagcgaaacuccgucucaaaacaaacaaacaaacaaacaaacaaacaaacaaacaaacucucacuacccaagagaaagccuucuguaugggaauaagugggauuaggugaauggguauaugacuuuguauuucccauaggauauuucagggcuuucguuuauguuaucuauuuaguuuucuauuuacuaagauauuacacugacuccuaaguaauugaauaaaaacuucaugcucauaaauauggaagaaucucaguaugauaauguguuuuuacuucaguuugguacaauacaggucaaauuacaauagcuaaaaacauaauugcucaaauaauuggucaacaacacaguuaaucaauaggcaaguuuucuguuccccaagugagcuuuuaagaauaguuuaucuuaauaauacuucuuuuuuaaaaauauuuaccucaaguuggacucaccuauuuaaccccuauaugauucuguggggcagggucagguaaguggcugcccaaaacuauauauguaggucauuaauguagguucagaaauauaauucaaccauuacuauauugcacaguaauuuuggaguuaaauuaguuuggguucuaaucuugccuuuauguaccuuugaauaaacucuuugagcuucaucuucuucaucugcaaaauacuaagaauuuuuccuuagucguuugauuaucauuuucucuuuuauuuaacagcuggaagcauuuacuaauuuuuuugcgaaagaugguuguaagacacugaaauuuuuguaccaagaaggagauguaccugguauugguaagaauuuucugagggcagugugccaguaauuaguucaugcacguuaaagugcagcauauuuuuucucuuauacauagauaauccuuuauuuauaaagaaaauguuaccagaaguuuauguauaagaaauauagugucucaagaacaauacauucucagcccaaauacauauuucaggccuugcuauaaugucuucaggagaaaacauccuuguagaaaucacuggccucugcugggaauacacauuuucauuagaauuuaauugcauuuuccccgaaacagguggagccauuuuguccagaugauuagaagugguggugaaaccacuccagagcccugcagcuacccccugugguccuaucucagcaucuugugccugcugcagcugucacuuggaauagcugguuuucccuacugugcauauuaugccugaacuaauuaacaugcuaccagcuuguuaaaacuuuguuuuaauaacuagauauguggguuucccuuuuggucugagacuacucaucaucagaguccuguggauuuaccuucaacacaucccucccguugcuucuuucucacuugguuccucugcugccuuaggcuaggccuucccugguguuccagauugaaaaccaguaucucuguaaucagauucucccucugaaauucguacuguguauuccugccaaguauaucuuuuauuguucugcuguuuauuggauuggguccacaucucauuuauucaaggccugcugucaucuggacacgcaguacuugucuagucugaucuccuacucuuccagaugugaauuugcugcuccuuuuaagccccucuucauuguuuucugcauacuagaguuauuucuuuucccuuucucuccucaccuggcuuuuucagauugccuuucuucucuccacucagcauccccuacccggcuccuucagaacaccuccagcagagcccuucccaggguguuccaacccauagccaucacuguucuccagaucccuaucucauuuacaguauccauguaaauauaguacuugauuguguucuucuaccuuccucuaauuguuuaauauaugucuuguuucuucgauaaaauauguaaacucgcaaauagugacuagguuggcuuuguggauuuucugucucucacaguuccuauuguaggaggauuauuguguggucuauauuuuuauaacuuguuaaaaauuaaaacaauagcugaaaauuauagaaagauaaaauaucuauaauuagaagcaaaauacaguuccacucaguuggagaaagcacuguuaacuccuuaaugaauauuucucuauaacugguuuauauacauauuuuacaaaaaugggauccaauucuacauauuauucuauaguggcuguuuaauuuugauaauauugucuucuuuaugccaauaaauacauuuauccaaucaaaauguuaacaucugcauuuuauuucauuaggcugauauaacuguaauuuuccaaacugaucucucaguagaauuuagguuguuuacaacuuuuugcucccugaaacaaugccugagugaauauuacugaauacaaaucuauguggauuaggaauaaauuuuaggagaaauucucagaagggaaauugccagagcaaaggguacacauauuuuuaaucauuauuuuugcuacuuacaaaaguacauuuaucaguuugguaaauauucaucuacauuucuuuguuguugcuguuguuuuuguugaagcagagucucacucugucacccaggcuggagugcaauggugccaucuuggcucacugcagccuccgccucccggguucaagugauuuuccugcuucagccuccugaguagcugggauuacaggugcacaccacugcgcccagcuaauguuuuguauuuuuaguagagacaggguuucaccauguuggccaggcuggucuugaacuccuggccucaggugauccaccugccucggccuuccaaagugcugagauuauaggugugagccaccacacccagccuacauuucuuucuuaugugcauguguuaacauguaaaugcuuauuaucaguuaaaaaugugguuauauaauacauuuuauucuugacuugguguuugcauuugacaggguagccuagacauuuuucugugucauuacguaaagauuuaccucauucaaaaaauucguuauaguauaacauuccauuauacagcugcauugugauuuuuagaaaucauucccuauugauggucacaucucuccucuucaucaggaaaacuuaagcuugucuuaugucuuaucagacagaacugugucacauggcuauccugggggccagggaggcugagagagcaguuuucuuucuagggaugaacacaaugggacaaagucagguuuucuuagcaaagaaaaaggggaggguaguaaaucccuguggagccucuaugaaugggcauuugggcucuuauauugcuacguaccauguaucaggguucuuuggcugcaagcaacagaaauaggucuggcuuauaugaguggaaagcaguguuucgggaggcggaagguggauaacaaaauuuagaacuaguugaacaaucaggucucgggaaggacaagaauagagcauuuccacagauuucagggcaguuucuuuaggauucaucaguagacuuccaucucucaaaucccuuuuuuucuuuauguguauucauucaagguuuauauucuuguagagucuaauuagucuaguucuuacaugcccaccuuuacagagcccuggcacucguauccuccagaaucacagggcaggaggaaucucccaacccccgugaaaaagaaaggcugggcagacaaaacauuucuguggcuuugugauguggauuuucuauuucuuuccuuuuuuauuuuuuuuugagaugggucucacuagguugcccaggcuggagugcaguggcaugaucauggcuuauugcacucuugaucucccaggcucaagugauucuccugccucaaccuccugaguaguuaggacuacaggcacaugccaccacaucuggcuaauuuuuaaaaauuauuuuguauugacaaggucuuacuguguugcccagguuggucucaaacuucuggguucaagcaauccuccugccuuagccucccaaagugcugggauuauaggugugagaugcugcaccuggccaauuuucuauuucuuuuauuacauuuuaaauuggcuauugcugcaaauagaaggcuguugauuuuugcaaauuaauauugugaccaacuaucuaacauaauucucauauuuuuaauaguuuuucuaauuaaaaaagauugauaauuaaauguuuaauuuucauggaaauuaguucaaggagggauuuaauagaagguggauacaaugaguguauuugguacaggaacuggaccuucuugggggagucagugaaggcuuccugagaugguggcauuucagcugagaucugaaagaugaguaggaauuuguagguaaaagguuggggaugggauaggagaacagguuguauaaggcccugaggccaggccaaaaggaacagaaguacagaguucagggaaagguacccagaggaggcugcaauuuaagauacaauuauuagcugggcacgguggcucacgccuguaaucccagcacuuugagaggcugagccgggcagaucacuugaggucaggaauuugagacuagccuggccaacaugguaaaacccugucucuacuaaaacuacaagaauuagccaggcaugauggcgcgugcuuguaaucccagcuacuugggaggcugaggcacgagaaucgcuugaacccgggagguggagguugcagugaacugagauugugccacagcacugcagccugggagacagagcuaaaaaaaaagacuccaucuaaaaagaaaaagaaaaaaaaaagaugcgauuauuggccaggcauaguggcuccaucuaaaaaaaaaaaaaaugaugcaauuauuggccaggcaugguggcucacaccuguaaucccagcacuuugggaggcugaggugggcagaucaccugaggucaggaguuugagaccagccuggccaacagugaaaccccgucucuaagaaaaaauaaauacaaaaauuagcuggaugugguggcacacgcauguagucccagcuacuugggaggcugaggcaggagaauggcuugaagggagguggagguugcagugagcugagauugcacuacugcacuccagccugggcaacagagcaagacucugucucaaaaaaaaaaaaaaagauguaauuauuggcaucuucuaguagacccccccccaaaaaaauuauucuaugaccguauugaaaacuucuuacaauaaaguaaaacaggaaacaauaguguaagagccacaguaacuuaucucauuugauuaguugugugauuauacgcuaaguucuugacuuuuguuuucagaauguggucgaacuauugcuggagcaacuaaaggggcaaaaaugaugaaauuguauauagacaaugcagccccggauaaacuaaaaggacugugcauauuuuuuguucguugccguaaugauguugcuauaaauguuaaaacuauucaagagguauguuuaaaaauuuccccaaauacauaguuaaacauugaauauauuuuuguagucacacuuaugcuuuacuuugcuuucccuuuuuaaauauaggacugaauugaguuccaagaaaauaaauguauucauauauuaaaaaaaacugagaaauugacuguaauagagcuuaguuauauugauauuuuagauacugcuuucaauuucaugaaaauuucauuucuugauggugugcaaauaacacauuuaauuuuguugaugcaaaguauuaguuacuuuauuuaacuuccucuucacucaauauuuuaacucuuuuauaguuuuaaaagaagaagggagaguuguccuagagccuggacauugcuaagcuaguucugggaaggcaggaugauggaaugggaaaagcaagaauuuuagccagagagaccgaaauuugccucuuagcuucaccacugacuaaucacuuaaauguguccucuggaaaguugcucauccuuucugcgacuuagaucucuacguucuuaaauugggaauaauaauacacaccuggcaagauuguagugacacuaaaugauaauauaaauaaauucuuauuauauugccugacauacaguaggcucucgacaaauauuaguucucuuuguuauucuuagagagucuuaauaccuuuuacaaugggaaagggaacugaagucuaaucuuguuccuuuucuguuaugauaaaagauugcuugaagagagcuuguuuagcuugguuuaagauuuuagguuggcaguuauuuuucccugaccccuuguaaauauuucaugguauuucuuguggaugaugagagcacuccuguuaguguaauucauagguaaucugucuuuuuuucuuucuguuugcuuuugcuuguugucuucaaaguccuguaguuucaccacaaugccucuauguauggauguuuccucaaucugccuuccauuucauuaauucuuucuucaacuuauccaugauuucauccauucauuuuuauaauuuagcuuuuguuuuaguucaguuaugugugcauauaaagagagaaaaaguccuuuuaugaaauaguauaagucuuucauaaccgaaaaacugacuucuaugcuauucuccagaagcaacuauuaaacccuuuuaauggauucuuuuauuuaccuguauaucucuaaauaauaugcucagacugcuccuuuugucaguuuagacauuaucuguggccagucgcaguggcuuacccuguacucccggcacuuugggaagcagaggcaggcagaucgccugagcucaggaguucgagaccacccugggcaacagagugaaacccugucucuacuaaaauacaaaaaaucagcugggugugguugugcacuccuggggucccagcuacuugggaggcugagagaagagaauugcuugaguccccaaggcagagguugcagugagcugagaucacgccacugcacuucagcuugggcuacagagugagagaaaaaaaaaaagacauuuucuguggacuuuucucucuggaaggugauaauuucgcucuuuuucugccuucugacccuuguuucuccaucccucuauucuuccaacguaguuauauucuaguuaacuuagcuaaauauuuguuuacaucauuagaacuaaguaaauguaaucacagaugagccaugugguguaacagugguucuuaaagucaaaccuauuuucaucagaauacuaagaugcuaguugcccuuuucaccaauguugacauuugacugauggcgcagaagcaauggugggaaaaacuacugauaccuuaacacgaaucaagacgacaccaaacuguaugaguaguaauuuuauacuucauugccacacacucacaguuaaaaaaccagaaaucauuuuuuuuugugacccuagacaaguuuuuuaaucuuaauuuucuggcuugggauuucuaagucacuuaagauguaucaauugaaaggucacgcauggguggugggcuuuugauuucugggcuuuugguuucuuacggcugguaauuuauuccaccaaacuucuaggcaagggcuuuucaccagaaaaaaaaaaaaucauggacagggcaacuuucaacggaggauuuucuuuacgcagguuugguuccacgucccucaccuugaauaggcuccaggcuauuguuccuuuccuaugcagaaauuaaagcaucaaaugaaacaucacuuugaugagcaaauaugggaauaauuaaauugggggcagaauauaaguuuguugacuuuagaacucuaagguucauaaccacuuaagauucccuaauaguuuauaaaauguauuaguugucuauguuuauugcaauauaaaacagguuaugauuuuucaguucuuuagugggauuagcauguaaaauaacauuuaaacuccacccuuucaggaagcgcucuuuacuguucuggaugcgucgaaaggacucuuaaauggaauuagggauauguuggcaaauauauuucuaccagcuguucuugcaacaaacaacuggggugcuuuaaaccaguccaagcagggagaaucugaaaaacauauuuucacugaaaccaucaacagauaucuuucauuuuuagaugguaaguauaaaauuuaauguuuagcaaauugcaaaaaagaagcaaauuaacuaagauauuucauaaacagagaaaaaguuucuaucuuaaaagauguuaauccaaguaauuaugagacuuagaggcaagaaaugaaaucauuagaacucauuuuugaggaucuuugguggaguaagauauauuuucuuuuuaauuuuacguuauagcaggaggaaucucuuucuauaauauuaaugaaaauuuucaccauauuaaaauauauacuuuauuaugaacucuuaaaaaucuauacuuuuauuuuuucauauuguuaaaauguacaauuuuaucaguaaauuaugaagucauaaucuaaugauuaauuagaauuauauuucuguaaaguauuagaucuuuaacauuucaguaauuagagcuuaaaaguacacauugacuuuuaacacauugacauuaaauacuucuuacuauuaaauauuauuuaauauuuuuauuaauauauuuaaaauauuuaauauauaaauuaguauuaaaugucuuuuuuuuccuuuuuaggugcuagaauaaguauugagggaacagugaaguuaaagacaauagacaauguuaauuuuuccaaacugcacaccuuugaagaaguaacugcugcagccagcaacucagaaacuguucaucagcuggaggaagugcugaugguaugguacaaacagaucgaacaggugaauugacucaaacaauugcaucuggacuaguaguuuucaugugcauccuagccauuguauuuugucucuaacagcaaagggaagaggugucuccuuugacuuucuuccagaaucuaguuugaaacucagccaauuuuugggucuagagcaaaaucauucuucuuuguggaccauuugaaaucaauuuuaagauauuucucacuucaaggaagaaaccauaacaauauggguugagaaugaaagaaugaagaaucaggaauagccaacauuuauccccaauaauguuuaaauuguugauacucuccauaaaagagagagggagaggacacagugaagagccagagugcuagacacuaaauaaguaccucuuguucgaucaguggaguugucugugcugucaaagaaguucagacuaggcuguuucacaucagcaucacaguggcaagccugcagcucuauggucaaauuuuuucuggcaguaaggaaaguagugauaggaauacaacauaugucaaaauuaugagaggcuccaacuuacacuauaaacacugugaaagaaaaucggauauuacauaauugcccuaaacagaaagaggauucuaggaaccgccccccagaucucuaguucaucagcacaggacagcagaacuaaacaagaaaaucuucaguuaugugaggaucaaggggaaaaaaucuugaccaggcaggagguacagaaaagcguuuccaguuuuaccuuucuagaacuauguuaggaggagggcugugcaguuagaguggcaaaaauuggaggacuccccuagggucuagagugcuggccacagcauuugcuuccaggugucacuagauuauugaaauggguaauugcccacuggauaacucuugcagccaccgugcccagccaagacuuccuauuuuuuuuugaaaaaucuuugguuacacuuggaauugucagauuuuuaauuguugccaauauguugagugugaaaugauaucuugguuuacuugguauuacccuaaauacuauugagguugagcauauuuaauggcuauuuugguuuccucuguguagaauugcuuguuuauaucauuuaccuguaucauuuacccauaucauugccuguucauaucauuugccuauaucaucccuuuauuuuuuuggauggcuugauguuaucauacuacauuuuuggagguuaaauaauauuuuccugauauuaauccuauguugguccccauugugucauguuucauuugguauagugccuuuagucauguggaaauuuaaguuuuuaauguagauaaauauauuaauuacaaauguuaauccagccucaaccuagcuauccccagugacuauaaauauaaacucugugcuuuuuguauuuuacuuauuaaaugcuuuccuacuccaguguuacaaaggcauucucuuaaauucuuuauuuauuuuaaauagugaauauaacacaaaaaugaauaugaugaaaggaacaaacuguaaaaugaacaccuguguaaccuuugcacaaguuaagaaauagaacauggcuaggcaugguggcucaugcuuguaaucccagcacuuugggagcccaaggcaagaggaucgcuugagcccaggaguucaggaccagccuggggaacgcagugagacccagccucaaaauaaauaaauaaagaaaagaaaaaacauagaccauuaccagcgccuuaaaauguccuugcguuucucuucccaguuuuaaacagcuuuucuucccccuagugguaacuauuaucuugauaauuaugcuuuucaauuccauguuuuucuuucuaguuuuacccugucuccuacauuuucuuuuagaaauguuaccauuuuauuuuuaacauuuagguguuuaauccaucuggaauugugcguguguguaugaugggaggcagaaaucuaauuuuguguuuuucauguaccuguaguuagccaauugucucgauuuaagauucucuguuaaauuguuuaauaguccauuuuuuucuaacauauuuguaauauaaccucugucauauauaaaguuguuagacccuuuuguuugucucacugguguauuuauuuauuuuuuauacuaugcuguacugcuuuaauucuguagcguuuuacuaaaccaacauuuggcaugccaagucuuuucucuguuuuuccucaaaauuacauugacuguugcaggcuaauuguuuuucaaaauuaauuuuaagacuaauuuuuaaaguaucaugaaaaacccuauugagauuuugauuagaauuucauugaauguguacaugaauuuagagaaaacugccaucuuuguauaauugaauuuuccauccaugaacaugauauaccuccccauuuagguaggucuucuguguguguaaaauaaguuuuaaaauucucuccaaaaagguuuugcauaucuuucauuagauuaauuucuaguuaucuuaucacuguuuuucuuugcuguuguaaauuguaucuuuuuggaaauuaaauuuucagauugcaagauagcuuguaaagaagugauacuaauuuuuauguauagaucuagcaacuuuacugaauugcucacguuuauuaauuguaaaaaguuugucuuuagucuuuuuguuuuuuuuucuuuucuuuuuuugagacagggucucauucugucacccaagcuggagugcaguggcaugaucauagcucacugcagccuccagcuucugggcuuaagugauccuccccgcucagccuccugaguagcugggacuacaggcaugcaccaccacauccgacuaauuuaaaaaauuucuguggagaaggggucuugccuuguugcccaggcugaucuugaacuccugggcucaagcaguccuccacuucagccuuccaaagugcugaaauuacaggugggauccacugcucccaaccuuagauaugcuaguuuaaaaauguagcaaacuauaucaucugugauuaugccauuuuugguuuuuuauuuccaauucuuaaugccuucuguuucuuuaguuaccuuguucugggauaucuauuaccagguggaauagaaguggguggugauuguggcaaacuuaucauguccuugguuuuaaagugauauuuucuaaaaugucaccuuuggccagguaugguuacucaugccuguaaucccaacacuuugggaaacugaggcaggaggaucgcuucagcccaggaguuugagaccagcugggcaacauagugacaugcuaucucuacaaaaaauuaagaauuagcugucugugguagcacuugcccguaguccuagcuacucaguaggaugaggcgggaggauugcuucagcccaggagguuaaggcugcagugcacugugauugugccacugcacucuagcguaggcagcagagcgagacccugccucaaaacaacaaacauacaaacaaaaaaaccccaaaaccaaaaaacuaccucccccccgaccaaaaaaaaaaacccaaaauaaauaagagaaacugucaccuuuaaauauuauguuugcuggagaauuuuaguagauaguaucuaucauauugaagacauucuccucuagucuucauuuacugagaguuuuuaaacauuauuugguauugaacauuauuuauacuuucagcugccuucaaaaagaugcaaucagauuuuaacaaagaagaauguaacauuucuauauuuuauaaauuuuuuugacugcagguacuuauugagagugagcagaugagaaaagaagcuggugauucagguccacucacugaauuggaacacuggaaacgcaugucagccaaguucaacuauaucauugagcagauuaaagggccaaguuguaaggcugucauaaaugugcuaaauguugcacacuccaaacugcuaaagguaaaaggcuuuuuauuuaaaguuugguauacuucagaacaagcaacuagaaaauuauccuauugaacuacuucuuaguauaauauacuggaaucguguuuagaaguguuagccuuugaguaaggcuuuuacauauaucacaguuauuuccagaagaggaaaugaagauuuauuucucaggauuucgcagaccaauuuugaccauacuacuauggggugauuuuuaggaaagugaucaucuuuuauuuuuaaauuguuuuugaaauuguaaaucaaugaagaaaucaauauaggcucacugagguaaacaacugcauauagagucaaaaguaaaguacaucucauccccaugauucuaccuccuuuccuagaggucaucuuuauuuacaguuuggcuugauucuagauucuuuucuuuucuuucuuuuugaaacagggucucguucugucacucggguggggugcaaugguguguucacagcucacugcagccuccaccucccaggcucaagcgauuaucuugccucagccuccugaguagcugggacuaacaggcaugccccaccaccacgcccggcuaauuuuuguauuuguuguagagaugggguuucaccaaguugcucuggguggucucaaacuccugagcucaagugauccgcccaccucagccucccaaagugcugggauuacaggcgugagcaaccgcaccuggcuucuuuuucuuucuuucuuuaaauguauuucuuucuuugcacagaaaaauaaacuaauacuuuuuugguaauagauuuaagcaguacgaauaaaacaagucucucuuaaucacauacccuuagccccaccacccacaacucuguguccugaauaguaagcacagaaagacaacugcacuuuucuauuuuauuuuuuccucaacaucuucugugguauguaugugugaguuuacuaugcacaaaugacauaguuuaguuuuguguuucuaacuuuuaaauuaaauaaaugucauagcauaauauuuuucaacuucccuuccccaccccugauaguauaucuuggagaguuaugccuguuagaucgagcuugagcgguaugguuuuccaaaaaaauguuguuguugugcuuuuuuuuuuuuuuuuuuuuuuuuuuuaaagacagaaucuuacucugucacccaggcuggagugcaaaggcaugaucacggcucacugcagccucaaccuuccaggcuuaagccauccucccaccucagccuccugaguagcugggacuacugucauaugccaccaugcccgacuaauuaaauaauuuuuuaaaaauguuguccaggcuagucuuaaacuccugggcucaagcgauucuuccaccucagccucccaaagugcugggauuacagguguaagucacugugccuugcccaaaauguuaauguagcauauuagguuuuaucugaucauuucccuguuuguggaccaauuuuccccuuucuuuuuuugcaagucugaguuauaauucacauacuauuuauuuuauccauuuaaagugaacaauucagauauuuuuaguguauucauaguugcacaaauaucaccacgauccaauuuuggaacauuuucaucaccucaaagagaaacucuauauccuucagcucucaccuucccauuuccaacauucccccuuccccccagcccucugucuagauuugccuauucuggacauuuuauauaaauggaaucauagauucuuugccuuucguuacugguuucuuucacuuagcauaauguuuucaaguuucguccauguuguagccuguaucaguaugucauuccuuuuuauggcugaaucauauucuguuguaugaauauaccacauuuuguugaucaguuuauggacauuuggguugucccuguuuuuuuggcaauuaugcauaacgcugcuaugaacauucauguacuguacaacuuuuuguguugauauauauugucauuugucuugguuauuauaccugggguggaauuucugggucacauguuaacucuaugcuuaacuuuuuaaggaaaaugguuccuuuucuauguguuuauaaauauugcugcaguugaagcuuuuauauguccauaugcaaauauuuccuuagguuggacacuccacaacuuuucaguacuaauuaucaguuaaguuauuauuauuauuauuuuuuugccaggcaugguggccuacaucuguagugugagcuacuugggaggcugaggcaagaggauugcuugaacucaagaauuuugagcuguagugcacuauguugauuggcuguccacauuauguuuggcaucaauauaguagugaugucccaggaguggggugaugagggugccuaaggagaggugaacugaucagggucagaaacagagcagaucaaaacucuugugcugaucaauagugggaucaugccuaugcauagccacugcacuccaggcugggcaauguagcgagacccuaucucauuaaaaaaacuaaaaaaaaauuuuuggggggccaaccugacauauggagaauggcuuguuuuauuuuguucuuuccuuguuaguagugaaguuguucaguuuuugcugcuuacuggcuauucauauuucuuuugugaauuuucuuuuuguaucuuucccuuauuuagaaaaauucagacauuguuuuguacugauuuauaggaguucuuuauuuuuuauuuuuuuugagacaggcuucucuucgucacuuaggcuggagugcaguggcacuaucaugauucacugcacgcucgaccucccgggcucaagugauccuccugccucagccuccugaguagcugagacuacaggcaugugccaaugugccuaacuaauuuuuaaacaauuuuuuuuauagagauaggaucuuacuguguugcccaggcuggucucaaacuccugggcucaaggaauccuccugccucacacucccaaaguguugggauuacagacgugagccacugugccuggccacuuggaguccuuuauauaauauggauauuaaucacucguuauauuuguuggaugaaguaauucacuaugacuccugggcaucucugcacauuuucacuauauaugaaaagaaugcaaggcccauacugcucuuuaucugaacaucucucagaguuguguuugcagugagcaaccuugaggggucaguucacgugucccccagacaaagagcagaauuacuuaccgcuuacuguaaaaaggauaaauuccccuaaacucaguauuccucaccuguaacacaaccuacugcaggugcaagcaucaguguguggauauuuagggucaugggggaacaaaugcaacuuaaugcucaugccauuugcugugauguaauaaaauccuugucucugaacccaaaucucauguuuucucccuucauccauaaaacaauaaaaggcuaaugcauuaacuucuaagcaggguaaaaucccagacccccauaugcacuuugacaauuacaaugcaaacuuuuuccuagucuguggcuuguauuuuuuaaaacuucaacacuugaaaucauuuuagacuuauggaagagucaaccaggauaguacagagaguuccugccugcucuucaucuagcuuccccuaauguuaacaucuuaaaacuauuguacaaugaucaaaaugaagggguaacauuaguacgauacuauuaaugaugcuacacacaauuuauacuucuccagguuuuccacuuauguauuuuuaucuguucugggauccaauccaggauccuauuuacauuugacugucaugucucuuuagccuccuccaauggaacaguuccuuagucuguaguuauacuucaugagcuugauacuuuugaauaguaauggucaguuauuuaggagaaugucucucaauuuggguuugucugaugguuucucgugaauacauugagguuaugcaucuuugguaagaaugccagaguugaugugcucuucccaguacgacuuaccaggcgguccauuauauugaugugccuuauuacuguuuuaaaauugaucauuuaguuaggguggaauuugccaggucucuguacuguacacguaucguauuuuguggaaaauaaccuuaaacuacaugaauagcuuucauaggugggucuugacugcggccgucauuacuguguuaugccaauggugguuuucuaguucccucauuccuuccacguuuauuaaucagaauucuuauguaagaaaauguugucucuucucucacuguaguuauguauuugaucguuuauuuucauuaauauagccucauggguauuuauuucaugcuuuugguuauaaucgaauacuaucauuauuuaguuuguugcucaaauuguuuccucuuuggccaucgggaaaucuuucagguuggcuuguguguuuccuucugauucccuuacucuguuuggaccacuucuuuacucucuaacacuagauaaaugcuuaaggcucauuuuguauuuguucugcccuaguccugggaucagcacuucuccaaggauccuggguuuauuuuauuggagaguaguauuuaggaaccaaaaucugguugccagaugugcuuauuuguugcuuguauuuuaauuuuuuuuuaaaauggaaucauuuauaaugaauuuuuuuauauuuagaugaauuaauuuuuucagccuuuuauugcuuuugucuuucauguauuguuuaaaaauaccuucuuaagaagaauaaauugguugggcgugguggcucacgccuguaaucccagcacuuugggaggccgagguggguggaucaccugaggucaggaguucgagaccagccuggccgguauggcaaaaucccgucucuacuaaaaauacaaaaauuagccaggagugguggugcaugccuguaaucccagcuauucgggaggcugaggaaggagaaucacuugaacccgggagguagagguugcagugagcugagauugugccacugcacuccagccuguguguugggagugagacuccaucucaaaaaagaaaaaaaaagaagaauaaauuaagguuaaccuaaauuuaaaauagaauugcccuuuucuucuauuucuaggguuuuauuucuuuauacuuuauucuucaguuaacuuggaauuuauuugugugaaucauguaagauuuaauaauaaugauaauaauagcagcuaacauuuauugugugcuuacuaugugccaagcguuguguucaguaucuuaccuauaacauuucauuuaauccucacaucagcuggaucagguggaucuuauuauuaucuuccccauuuuguauauagaacagugagagauuaaguuucuuguucaaggucacagaguuaguuggaggggaagcaggauauaaggucaugcacuuaccucuugagcuagcauucuuuuucccaaauggcuggcuaauuuucugggcacuguuugucauuuucuuuuuuucuuuuucuuuuuuuuuuuuuuuuuuuugaggcaaaaucucacucuguugcucaagcuggagugcagaggugcgaucuuggcucacugcaaccuccaccucccagguucaagcaauucuccugccucagccuccugaguagcugggacuacaggcacaugccaccauacccagcuaauuuuuguauguuuaguagagacaagguuucacuauguuggccaagcuggucuugaacuccugaccucgugaucugcccgccuuggcugcccaaagugcugggauuacuggcgugagccaccgcgcucagccacuguuugucauuuucuuguaaucaucauaacuuuuguacaucuacucuuuguucuucuuuuccagauuugucuuaacaauuccuauguuuucauccuuugguacacauuuugaaauaaguuuauacaguuuuuuucuccaaaauaccaaauuuugagacuuaguuuuauauauuuuugaaauguauguaaauggagucauaucauauauucugcaaucaacuuuuacucaacauuauuugugagaauucaucauguuaaugugugcauuauuauucauuugcuaccuuuguuuuuauugcuguaucauauucuguugcaugaaugcaccacaauuuauuuaucuauuaucccagaaucgacauuuggauuguuucuaguuugggguuauugcaagcaaugauucaaaggacauucuuauucaugucuccuggugcacaugugugagaauuucucuaaggcauauuccuaggagaaaauuuaugaauuuguggaucaaaggcauauacaauuuaagcucuuggagagaggucucuaaugaucugccauagugaccuucagacauuuuguauuaaaaauauuaaucucuagucuuuagaaaggauacaaagcaaaugugguagcaaaucuaugaaugacauugaggagggagggaaagaaauauauuggaugacaauguaaagauccaagaaggucuucagugguaagagugggggugccauacugauaucccaaccucuuuguuggauggguuuguugacaaacuguuuggcucccauuguuuuucaaaaugguuuuguucagagcauauuauuucuguuuuugcugaguagaccucuccauuucaugcucucuucaucucugaccaauucucaagcaggcacuugauuuuaucaucccuaguauguaagaguggucaguuaauaauaagauaacagcucacgccuguaaucccagcacuuugcgaggcugaggcaggagaauggcgugaacccaggagguggagcuugcagugagcugagaucgugccacugcacuccagccugggugacagagcaagacuccgucucaaaauaauaauaauaauaauaauaauaauaauaauaauauaacauuuauugagaauagguuaaaaauccugaaagaauuugaaggagagaaauugaucaacuuuggauaaagacuuaacaguuuuaguugaauccauugauagaaugauauuacugaugcaagucaacuugauccuaggcugcuuuaugagagguauaguuuccaggaaaaaggaaggugauguuuuggcuuuucucagcauugaccagaucacacugaaggcuuccuuucauuccugaggcauauguauuuagagugauguugugugugucccaaguagaaaggccaagagguugaagcuauuaagaccauguccuuggaaccaacccaaaagcucaucaaugauagacuggauaaagaaaauguggcacauauacaccauggaguacuauauggcuauaaaagggagugagaucauguccuuuacagggacacggaugaagcuggaagccaucauccucagcaaacuaacauaggaacagaaaaccgaacaccacauguacucacucauaagugggaguugaacaaugagaacacauggacacagggaggggaacaucacacacuggagccugucagggggucagcggggaaaggggagggagagcaucaggacaaauagcuaaugcaugcagggcuuaaaaccuagaugagggguugauaggggcagcaaaccaccauggcacauauauacuauguaacaaaccuacgcauucuucacuuauauccuggaacuuaaaguaaaaaaaaaaaaaaaaagacaaugucuaauuaaaugacuaaaggcacacagauugcucaucuuugaauaaaagacuuagugaugauaugguaaaugucuucaaacauuugaaggguugcuguguguucacuaggcuccauuaugcaaaacuauacagaugagcagagauuacaggaagaacuuucucauaaucaguuauuuaagcagguacuauuugaugaccacuuacaagaaacuguugauuucagauugacuucacuuugcuaguaagguuuuguuuugaauaauguucuuuuuuauuuuuuauuuuuuuugagacaaagucucacucuguuguccaggcuggagugcaguggcgcgaucucuggcucacugcaagcuccgccucccggguucaugccauucuccugccucagccuccugaguagcugggccuacaggcgcccgccgccacgcccagcuaauuuuuuguacuuuuaguagagacgggguuucaccguguuagcuaggauggucucgaucuccugaccuugugauccgcccaccuuggcuucccaaagugcugggauuacaggcguaagccaccacgcccugccauaauguucuguuuuaauaacuugacccauucuugaagacccagaguaauauaaugucacaaauaauuaaccugaaaaagucauuccuguuagaagcagguccaguucaagccuacagacaggauuuuaauuacaaacagaaugagucuucaguuuuaguaauucauuuaaggugcuuguuguaacuuugucucaaguauuauaagaaaaacauauauuaaucacacuuaaauaucuaccauuuuaguauauguaugauuagggaagacugaauuucccgaguaaacuuuagcacacugauauauuuggauguuucauagaauucuuauaccuuuuuuucuuagaauuggcgugauuuggaugcaagaaucacugauacagcaaaugaauccaaagauaaugucagauauuuguauacuuuggaaaaagugugucaaccucucuauaaccaugaccuaguaaguaugcuuuuaaaguacaauuuuaaacugagggcaguggcucgcaucugugauucuagcuacucagaaggcugagguggaaggaucgcuugagcccaggagugcaaggcugcagugagcuaugguugugccacugcauuccagcuugagugacagagcaagaagaccccaucuauauaaaaaaaaauaguacaauuuaagaaacugacuuguauaauuaaugcauuaaaaaucuuuaauauguguauauuggggaaaaacauccugccaaaaguuauuuaaaauauacauuuuccucuuauguguuuaugaagaaugauaaacuauauuuaauauuuuaacccauauuuaaauauauagugaaucauuaauauaguaugugcaagacaaauauuaauauauuacuuauacuuugcugcauaacaaauaaccucagaacugaguggcuuaaaaacaaugagcauucaucaugucagaguuucuguggcucaggaauccaagcaaggcauagcuaagagcuucugcuucaaagucucucaugagguugcccacaggcuaagugggggaggcugacuggggagagucuucuucucaguucacucaugugguuauuggaaggccccagucccuugccacgugggccucuccaccuggcaacuugcuucccuuggagugaguguuccaagagugagcaagagaaugagagaacacccaaguuggaaucuaccuucuuuuaauaaccuaaucucugaagugacagcccaucauuucuguuguauucuauuggcuagaagcaagugaaucugguucacucuggguggguaggggaguauacaagggugugaguacuaugugggugagcaucacuggggccaucuuuggggcugccuaucaagguagauauuuccccauuuacagauuaggaaaccaaaacucaucauggugaggugacuuugccagcaucacucagcuaaucagggaugcaggacagaacccaucuucuaauuucuagccuacucuucucauaauauuuccauagagauccuuuaaagaacauguuagcacuaccauuugcuuuuauuuuuuagaaguuuauauuaacuucaaauuuauaaucugguauuucauaauauuucauauaaaauaugaaaauuaaaaaaaucucuauccuuuauuuaauagaaggagaagucaaggaagcuaguaguuauugagaacuuagagcaggauuuccccauuuuuccuggauauuacuucuuuuguaaaucauuuguaggcaggagggcugcccagacagcugcauuuuuaaagauguucccaggcuugagaauccuugaacuuuuguuauaggcauugugcuacaugcuuuaaauauguuuucauucucuaugcacaaugacccucauuucaaagauuaggaaaccgaguuugaacauuucuaugaugauccgugaugggaccaaauuggaaucuagcuaucuguagcauuauggguuguauuauuuuuccacuuuacuauguugcuucuucaagguauucucuaaguugaaaugcuuccucuuuccuuccuccccccaccccaccaccccgggauggagucucucucugucacccaggcuggagugcaguggugcuaucucugcucacugcaaccuccgccucccggguucaagcaauucuccugauucagccuccugaguagcugggauuacaggugcaugccaccaugcccggcuaauuuuuguauuuuuaguagagacaagguuucgccacauuggccaggcugcucucaaacucccgaccucaagugaucugcccgccuccaccucccaaagugcugggauuacaggcgugagccaucgggcccaacacuuucaaauuaauuuaauuugugucugauaucugugucaguauucuucacucuaauuuuuuaagaaguagucaaaucuuccauauagguggcagcacuggccacaugguuuuguugaccaaccuucuugggucaauguagguuucaucccagaggcagggagaaggaaagagguuauggccuauaucacuuagacuuggagaagaaggagguguaaaggcaguuuauaaucuuuccaagagaguguuaguagucaagaaguuuaauaugaaaggggagggaaaaaugucaguugagagucuuggacaagugcauuucuuacugccaugaggaauccauuauccaucagggagcaccaugagaggggacaggaagacuuuagaagcagagucuuuuaauugaguccauaaagagauugucgauuuuauuuaaaacuuauuaguauuauuugcaaagagaugacuuuuugaaaaauuacagcuuuauuuuagauucggggguacaugugcagguuuguuacauggguauaugacaugaugcugagguuugggguauggaugcugucacccagguagugaguacaguacacaauaggaaguuuuucagcucacaccucucucccuuccuccccaccaagaauuaugacuuucuuaaacuucauucuucucauuuuuaccccugcuacuaguagcuggacuuguguugugaaccuuuguaaaauuuguuuaauauaagaacauuuauacuauuucuuagguauuucugugcacgugaccccaaguaaagaaaaucaaauuguauaugguguuggagaaguaaggccuuugcuuggcuuacuuggcagcucaaugacuuaauuccccaacuuuacaaugugagcaauuaaaauuucuguccaagaaaaauuaaaauuauuacaugucacaagcauuucagauugcucacaagauuugaagaugcaaauaugaaauacacauaauaccuaaagccuacuccagggcuaccgcaaguagcucuugaugugaaaaaauaauagaugaagugaauauggcacaacguucacguuugucaaaucuaaugaugggaguagguggucauuauauuuuucucuguacuuuucuauauauuuaaagcuuuuuauuauaaaaaguaaacuugaaagaaagaauacucuucauugcuaucaagacuccaaauuuuaagguauacugauuucaacuucuugauucaaaagacuuguuuuaauucauauaauuuaaaaaucauuuaguucugauguuuuuuucauccuaguaauuuuaaaaagcuuuguucaauuacucuaaccauggaugugccuuauuauuguuauuuuguuguuguugagcuuuuuauauucucugauguaggaagguuucaagcaucaccuuuugaaaugacagaaguacuaauagcauugagucauauaauugcuucccacucauacacccacuauaucuguacuuucaacaauuccuuuuucccccucauuuucuuuauucugauuaaaaguaaccagcaauugcuguuuaguuuauaacugucauuuggguaggaaaagugcaggggauucaugcuuccauuucugguucauaaguuuuauguauguuucauuuuuuuaaucacccugguauugugcuuuaggcauaucuuacuauuauauguuugacauaugagauaucugagcacuguauauagauggacaagaacagugcacucaaggagcuacuauuguaaauaaugauguuuaaaguucagaugaaggacguuuuccugaaggacccauuugaugccaucccugagcccucuuuauuggaguuuagugguacuuuguagacaugacuuaggaaggguggaagggacucuuucuaggcauauuuuuauuaggaucuuuuugaucuacagauaccauauauaauaugaauucuggccuagaagguuaacuauaaaguaaugguguuaauuuccauaagccacauaaaacugauuuaauuauuccauaguuauaccccacaccuaggacauaccguacaguaaucgguaguuguuuuucuuggcuguauuucuuccaucaccauuaaaaacacauuuuauauauuuuaucuugucuuaucaauuaaaaggaaaguuccuugaagggagggaugccauuggcuuugucuguucuccuguagugauuugcaucacgguuagaagcagggucucaaaaucuccacuauguaacuuacagcuguuggaucuuaggcaagggacuuaacuucucuaccucucuguuuucucauuugcaaaaugggaauaaugauaauacuuuauuuuauagauucuaagacuuuuuuucacauuuuaauaucccugaacucaggacauacuuuagucaguuagguuuugugaaucauuguggaugugacuugauacuaccuuaaauuauuaguucucuccuugaggguguuuuuuuuguuuuguuuuguuuuugauuuuggugccauucguaugaauucagacugcaguugaguaccugugcauacauucucaaagaaguuugauuucuuuccuccuccugguagcauguacauuuuguuucucucuuuuucuccaugguugguuuauuucauguuuaccuuaacagggaggacccacugguggccuaguauuauguaggaguuagauuccucaucuugggugucuuuuuucuuucuuaauagcacagaaaauaauggugcaaucuuacaauccgugauguuuuauaucugauguaaucaaaccuaccuucaaggguuguugucagcauaucuuagaauaauaugcuaacgcucuuagccuagugccuggaauauaguaagcagucaguuuauguucaggauuguuuuauauccuuguuguacuuguucugcuuugcucuaccuuuuucuacuuguuuuacuuguuuguguuuaucucuucugcucuguugugagcuacucaugaauagguuuggauuucuuccaauaucuucagagccuaauggcacuugguaggauugcuaaaacacgaacugaguugcauaaaagaaaaugaaugcuagucugauuucuauuuuagcugggcuuaugaccuuaagaaagucacuuuaccccucaagguaucaguuucuucaccuuuaaaaagagcagaaugaacuauuaaccuuaaaauggcucucaccucuaaaauuuaauuuuagauaaacuuuuaaguucagauuuacagaaaaguugcaaugauagcacagaauucucuuuacccaguuucuccuguuaacauccuguauuaccuuaguuuguuugucaaaacuaauguccuguuaucuguuccagggucuagucuagaauacugcauuggauuuaguaaaauuugacuuuaagcuaaaaaugcuauacuauuuuguguaccuuuagaguuuugaguauuauagaauauugguuauuaaaacuauaugcauaugauggaauucacuuaauuuguuucaauguuagguuuccauggcacauggaauacaaaauuugauuaaugccaucagaaugauucacggugugucaagguauuauaauaccucagagagaaugaccucauuguuuaucaagguaaguuucugugggaggaaauuacaugucauccugugaaaaaguuagcaaaucuuuccuucugagcccuaggaagggaauuuggaagccuaagugccucucagaguuuuaauacuuccaguggacaagaagagaaaggcguugacuggacucaguuguacuuaauugaagggaguaauugguacuuuucuguuuaucagauguaagccccaauacuuaaagaaaaugugccuggugguuuuuuaauuuauucauuucaaauaguuuugauucuacccaagagauaggagugugucuacuauuaacagugcuucuuuagcuacucccaugaacacuauaguuuguguaaaauuuuccuguguagcgccgcaugguuaauuauuuaaaauaauuuuuuaaaaaugauuaaacaauauauauuuaaauuugcuagccaaugucauucuuuuuuuuauuauacauuaaguuuuaggguacaugugcauaaugugcagguuaguuacauauguauacaugugccauguuggugugcugcacccauuaacucgucauuuaacauuagggauaucuccuaaugcuaucccuccccccucccuccaccccaugacaggccccagugugugauguuccccuuccuguguccguguguucucauuguucaauucccaccucuaagugagaacaugcgguguuuguuuuuuuguccuugcgauaguuugcugagaaugaugguuuccagcuucauccaugucccuacaaaggacaugaauucaucguuuuuuauggcugcauaguauuccaugguguguaugugccacauuuucuuaaucccgucuaucauuguuggacauuuggcuugguuccaagucuuugcuauugugaauagugccgcaauaaacauacgugugcaugugucuuuauagcagcaugauuuauaauccuuuggguauauacccaguaaugggauugcugggucagaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugaucgccauucuaacuggugugagaugguaucucauugugguuuugauuugcauuucucugauggccagugaugaugagcauuuuuucauguaucuuuuggcugcauaaaugucuucuuuugagaagugucuguucauauccuuugcccacuuuuugaugggguuguuuguuuuuuucuuguaaauuuguuugaguucauuguagauucuggauauuagcccuuugucagaugaguagauugcaaaaauuuucucccauucuguagguugccuguucacucugaugguaguuucuuuugcugugcagaagcucuuuaguucaauuagaucccauuugucaauuuuggcuucuguugccauugcuuuugguguuuuagacaugaaguccuugcccauaccuaugcucugaaugguauugccuagguuuucuucuaggguuuuuaugguuuuaggucuaacauuuaagucuuuaauccaucuugaauuaauuuuuguauaagguguaaggaagggauccauuuucagcuuucuacauauggcuagccaguuuucccagugccauuuauuaaauagggaaucguuuccccauuucuuguuuuugucagguuugucaaagaucagauaguuguagauaugcggcauuauuucugagggcucuguucuguuccauuggucuauaucucuguuuuggugccaguacaugcuguuuugguuacuguagccuuguaguauaguuugaagucagguagcgugaugccucuagcuuuguucuuuuggcuuaggauugacuuggcaauuuuuugccagggcucuuuuuuggugccauaugaacuuuaaaguaguuuuuuccaauucuaugaagaaagucauagguagcuugauggggauggcacugaaucuauaaauuaccuugggcaguauggccauuuucacgauauugauucuuccuacccaugagcauggaauguucuuccauuuguuuauaucuucuuuuauuuccuugagcagugguuuguaguucuccucgaagagguccuucacaucccuuguaaguuggauuccuagguauuuuauucucuuugaagcaauugugaaugggaguucacucaugauuuggcucucuguuugucuguuauugguguauaagaaugcuugugauuuuugcacauugauuuuguauccugagacuuugcugaaguugcuuaucagcuuaaggagauuuugggcugagacgaugggguuuucuagauauacaaucaugucaucugcaaacagggacaauuugacuuccucuuuuccuaauugaaugcccuuuauuuccuucuccugcccgauugcccuggccagaacuuccaacacuauguugaauaggaguggugagagagggcaucccugucuugugccaguuuucaaagggaaugcuuccaguuuuugucuauucaguaugauauuggcuguggguuugucauaaauagcucuuauuauuuugagauacaucccaucaauaccuaauuuauugagaguuuuuaucaugaaggguuguugaauuuugucaaaggccuuaucugcaucuguugagauaaucaugugguuuuugucuuugguucuguuuauaugcuggauuauguuuauugauuuguguacguugaaccagccuugcaucccagggaugaagcccacuugaucaugguggauaagcuuuuugaugugcugcuggauucgguuugccaguauuuuauugaggauuuuugcauccauguucaucagggauauuggucuuuuuuaaaauaauuugagaaauuacucaagcaacacaugagaccaggcauggugguucaggcuguaaucccagcgcuuugggaggcugaggugggaggaucgcuggagcucacgaguuugagaccaaccugggcaacauagagagaccuuggcucuacaaaaaaaaauuuuuuuaaguuagcugggcaugguggugugugccuguaguccuagcuauuccagaggcugaggcaggaggaucccuugagccugggaguucaagaaugcaguaagcugugauaacaccauggcacuccagccuaggcaagagagaaagacccugucucaaaaaacaaacaaacaaacaaacaaacaaacaaaccaccaccaacgaaaaaacccacaugaauagaauuuauuuguaaauuauucaagcauaacgaaauauauaaagucauagucacauuuuaaguuuuuuuaaaaagcaaaguauaggcuuaaucacuauguccuaaauacgacaagacucucagaauccuuccucuuuaccugucucucucauucuugccauauaugucccacauugagaucauuuuuaguucugacaaugauucuuugcuuggcuucugaaucuucugguaggcccaccuuugcacuuucuagugaaaucuaguuugagcaaagaacccugcuaagucaguuuagcaagaaccccccauucuugauaucugaugacucuagauaucugaucagguuuucauuccccccaaccccccagguguugucugaucacuuuggccugucuucagcaagaauccuguuaggucaguuuaaccaaaaucccccuuaccucugauguuuccucuuaauaauuuuccacccacugacucccauccugccccuuggcuauacauuccugcuugcccaugcuguguucagaguugagcccaaucucucuuuccugcuacaagaucccauugcaguggucccuauaccuaucacaaugguccugaauaaagucucuugcuuugcaaguaucacugaauaauuuuuuaacaguuccauauuauucuuaacauuuuuuucaacauugugaaucaacaaguauucagacuaaaauccaaguauugcuaauuuauuuaucaccacuguuuugugauucccacaucuuuuuccuucuuggauucauuauuucuuuugcugaaaaaauucuuucagagagguuucaggguggugaacuuccuggauuucuacaugucugaaaaucacuuucauuuugucugaucacucaaaugcuagugugacuuggauuuuaaauucgacaucauugucuccugggaaguugaagauauugcucaaucauugucuaguauucaguauuguugaggagaagcuuggugcuaauaugauucuuguuuccuuuguagguaacuaguuuuauucucccaggaagcuuuuaggauuuuuuuucuuuaucuuugaauuucuaaaaucucaaacuuuuuuuuuuuacauuuaucuuguucuacacuugcugaguugucucaauccaaagacuuuccuuucucuuuauuccugagaaacaguccucuuuugccugggauuauuucuagcucacugauaugguuuggauauuuguccccuccaaaucucauguugaaaugugauccucaguguuggagauggggccuggcaggaagugucugggccauggggguggaucccucaugaaugguuuggugcccuccuugugguaaugacuucaugcaacagcugauuguuuaaaagauccuggcaucucucucuugcuugcucucauaugaggccaguucccacuuugcuuucuaccaugauuguaagcuuccuggggucgucaucagaagcagaugccggugcuaugcuucguguacagccuacagagcugugagccaaauaaaccucuuuucucuauaaauuacccauucucagguauuccuugauagcaauguaaauggacuaacacaccuacccauucaauuuauucucuccccuugcaucuaacuuccauuucucuuaauuuuuuucuuccaucuuugcccuuuucuggcucacucauuugcucuucauuuuuuuuuuggauuguauuuuauuuauuuauuauuauuauuuuaaauuuuauuauuauuauacuuucaguuuuaggguacaugugcacaaugugcagguuuguuacauauguauacaugugccauguuggugugcugcacccauuaacucgucauuuagcauuagguauaucuccuaaugcuaucccuccccccuccccccaccccacaacaguccccagagugugauguuccccuuccuguguccauguguucucauuguucaguucccaccuaugaguguugcucuucauuuuuguaccaauugauggucaguucaucaauagaauuuguuuuaaaauucugacaaugaaaauuccaauuucaaguucucuaguuuuuuuuuaauguuauuauuauuauuuuuuauuuuuagagacagggucucauucuguuucccaggcuggcuuugaacuucugggcucaaguuacccucccaccuuggccucccaaaguacugggauuacaggcaugagccacugcacuuggcccauagguuuauucuuuaucauauuuuuaugcuugugguuugaaauuuauauauaaauguuauuucucuuuuuacauauaauuauuuuguaccuauauuuauuucagguaacaaaucaaaugguaacagcauguaaagcauauauuacugauggaggauuaaaccauguaugggaucaggaaacgccaguuguacuaaagaaaauucagguuuguagaaguacuuuuauuuucauaaacuaaaucuuuucccauccugcccaauuuuacuuuguuuauucacaaaauauguuaacugaaaaaacuuccuacagaguaguguugagaauauaaaaagaauacaauucuuauuaucuauuucccuuuauauuuagugcuucucugaggguaaaauuuaauucucaucuccuccauggcugccuguguuagacuccugugugccauuucauacgcucuggccccuacaucucauuccagccuguuacaauuaaaauuuuugccuuuuuuugcauugguuaggauuaccauguauccuuaaauagacaugguaguaguugccauccuaauuuugauccugguuuagaagacaauguuucuaacguuucccccauuuaguuggaugcuuuuguaagauuuaaauauaucuuugaucagauuaguuuaguaccaagagauauuuuuuaaaguuaugaaugggauuuggaaaauuuucuucugcauauauuuauugagaugcuuauagaauuuugcuccucagucuguuaaugugauagaugacauuuuuagacuuucuaaaauuaaacuguccuaacguuucuggguaaacucaacuuggucgugguguaauuaucuuuuuaaaaaacacucaaauucaguuugcuacaguuuuguuuaggauuuuuggaagcuguauuggugagagagagaaccuguaauuuuccuuucuuaugcugaccuugucuguguuuuggcaucaaugucucagaauaaauggaggguggggggaaguauuuucuauuuucugaaaaaguuuguauaaaauuaaagugaccuguucauugaaaguuugaaagaaauggccacagcaggaaggcuccaucuggaagugguuauuggucaucucugugugcagguucccuggucuucguagugccaagguguguggcuugaacagggaggucaaguuugaaaaguggcccagugcccuccacccaggaugggaaccauuauucccacaggccuggugcugaccugccauccuggccagggcacugcuaucacccuugcucugaccucugaacuggaggauaagaagaggaagaauugcaguuaguguuucucaugcugaaaacaguugaucccaaggacuggaagaaucaggaucauuaugcaguucuuggacuuagccauguaagauacaaagcuacacagagacagaucaaagcagcucauaaaguagugguuuuaaaacaucauggaaagcagccagugaaccaauaaaagaaagggauaaugacuacuucacuugcaucacugaaauuauaaaauguaugacccagugaaaagaggagcauuuaacaguguagaucauacauuuggaaacucaguuccuucuaaaagugaagcaagggauaguuucuuugaaguguuuuucccacuauucgaaaauaauuccagaugguccaaaaaaaguuucuaaaccugguguuaugaauucaucauuuuauuccuucugguauaguuuuuaugcuuggacagaguuuucuuauuuaaauacagaagaaaaaaaagcagaauauugugacaagagagggauugaaaagaagaacagagcaacaagagcucaaagaaagaaagaagaaaugaauugaaaacauuaguugauaauacacauagcugugauacaaggauaaaaaaauucaaagaacagaaagccaaggccaggcauaguggcucaugucugugauucuugcacuuugggagaccaagacggguggaucccuugagcccaggaguucgagaccagccugggcaacaugaugaaacccugucucuacaaaaaacuuagccagguguguuggugcgcaccuguagucccagcaacuugggaggcugagguaggauaauugcuugagccugggaggcugaggcugagugaggugagccgugaucacaccacugcacuccagcuugggugagagcaagacucuguuucaacauuaaaaaaagaagagaaagccgagaaagaagcaagauggaagaagcgagaggcuaaagaaaaacaaagacaagcugaauuagaagcugcuugaauagcuaaggagaaagaagaggaaguuaaauaaggagcauuguuggcaaagaagggaaaagauauccagaaaagaguuguuaaaaggaaaagacaaaccuucaaaauucaaggaagaccugaaaucacuuuuucugacaauaaguggagcagcuuaaaaagguggaagaaguggaaaaacuuugugauaggcuucaacuagcaaguuuauagcacuucagugaaauaccucaucuacaaaaacacuaggaauggcugcucuccuaaaaacggaagaaauaaaugagccaauuagaacagagaaagaggaaggggaggcuugugugugacaagcaucuaagaaugcagagaaaucaacugucgaagguggaaauggcaguaaaaauuggucagaggagcauuggucugcaguuacuaauuaaagccauaggccccuuuucugcaugaacaaauucaauaugggaaguuauuaccaauuauaugaacacacauucuuuuuuuggagucaagagaacuuuuuggcaaagaaaauugagccucuaaaaacuugacccucacaaaaaaaagaugacaaaaaaggcuuuggauaaccuuuaaaagaacauggaauagucucucaaguacaugaaguaggccuccuucagauguaccugaagaugaggaaaaauagagggagcagugccuggcaggacaaaagaggaccucaggaaacaauauaaggaaguuguugaggugguaaaggcaaugaaaugcccaggagcaacugcugaaugcaaauggagccgagaaaugacuuauggacagucuuuguuguguaugcauuuaaaaacuaaaacugauaauuggagaugcuaagcaccuuuucaaaugccugcuggcuauuuguauguuuuuuuuuugagaaaugucuuuugagguccuuuguccauuuuuuaaauguuuuuuuuugagacggagucucgcucuguugcccaggcuggagugcaguggcacagucuuggcucacugcaaccucugccucccagguucaagcaauucuccgguuucagccuccugaguagcugggauuacagaugccugccaccaugcccagguaauuuuuguauuuucaguagagacaaggguuucaccauguuggccaggcuggucuugaacuccugaccucaagugauccuccugccucagccucccaaaguguugggaucacaggcguaagccacugcgccuggccucauuugcucauuuuaaaaucagguuauuuauuuucuuccuauugaguuguuugaguuccuuauauauuuugggaauaaaccucuauuagauauaugguuugcaaauacugucuuccagucuagagguugucucuucacucuguuuucuuuucugugcaaaagcuuuauaguuugauacaaucucauuuguuuuuuuuguuuuuguugccuguacuuuuggggucacguccaaaaaaucauugccaaguagcuuuuccccgacauuuuccucuaguaauuuuacaguuucaggucuuaucuuuacauguuuaauccacuuuagguugacuuuuguaugucauaugaaacgaugguucaauuuuauuguuuugcauguggauauccaguuuuccuaagaccauuuauugaagagacugcccuuuccucauuguguguucuuggcaccuuugucaaagaucaguugaccauaaugcauggauuuauuucuggguucuccauucuguuucauuggucuaugugucuguuucuaugccaguacuaugcuguuuugauuacuauagcuugguaguauauaaaaauauacuacaguauaaaaucaggcagugugaugccuccagcuuugcaaauuaaaaaccacaaugaaauaucagcucacacuuguuagaaugccuacuacagaaaaagacaaaugauagcaaguguuggugaggaugugcaugcucuugguaggaauguaaauuaguguagccauuaugaaacauaguauagagguuccccccaauauuaaaaauagaacuaccauaugauccagcaaucucauuucuggguaaauauuuaaaggaaaugauauaacugucucaaagagauaucugcauucuuauauucauugcaacauuauucacaauagccaagauguggaaacaaccuaagugccuguugacagaugaauggauaaagaaaaugggguauauaggguauguauguauauauguauguguuuguauguguguguguguguguuuguguauggauacauauauauaauggaauauuauucagucuuuacaaagaaggaaauauugucauuuuugacaacauggcugaacuuuauuucauuaugcuaagugaaauaagccaggcacaaagacaaauacugccuuuuuucaccucuauguggaaucuaaaaaagucaaacucuuagaaguggagaguagaauggugguuaccaggggcuggagagggauggcacaaugacgagauauuggugaaagaguacaaauuuucaguuaugcaggaugaauaaauucuggagauguaauguacuguaugaugacuauaguacacaauacuguuuuguuuuuguuuuuugagacaaggucuggcucuguugcucaggcuggagugcauuggugccaucucagcucaaugcaaccuccgccuccugggcucaagccauccucccaccucagccucccuagucacugggacuacaggcaugcaccauguauuguauacuugacauuugcuaagaaaguaggucacacccccaaccccaaaaaguaauucacaccccccaccccaaaaaauaacuaugugaagugaggaugugcuaauuagcuugauuuuggaacauuucacaauguauacaucuuucaaaacaucauguuguauaccuuaaauauauauaauuuuuauuugucaauuauaccucaauaaaacuggaaaaaaauaaaacuggaaauacugaacaaaaagcaagucugauagaaaucaucuguuaagcaucuaggaucgacauuuucuuugugaaaagauuuuuaauuuccugcuucucuuuuuguauaauuaaaaauuuuuaauuaugauaaaaauagcauaaaauuuacuauuuuaaccauacaguucaguggcauuaacuacauucacaguguuuugcaaccaucacugcuauccauuucagaacuuuuucaucauucuaaacugaaacucuguagccauuaaauaauuccccaaacucaggccagacgcgguggcucacgccuguaaucccagcacuuugggaggcugaggcgggcagaucaccugagguuaggaguucaagaccagccuggccaacauggugaaacaccgucucuacuaaaaauacaaaaauuagcugggugugguggcaggcuccuguagucccagcuacucaggaggcugaggcaggagaaucacuugaaccugggaggcguagauugcagugagccgagauggcaccauugcacuccagccugggcaacaagaacaaaacuccaucucaggaaaaaaaaaaaaauuccccaaacucucugcccuagccccuaguaacuuguauuuacugucucucuuuaugaauuugccuauucuagguaccucaaauaaguggaauuaaacaauauuuguucuuuugugucugguuuauuucacuuugugcaauauuuucaucuacguucuagcauguaucagaauuugauucccuuuauagcugaguaauauauuccauuguauguauaguccauauauuuuuauccauuccucugcugaugcacauuugguuuguuacuaccuuuuggcuauugugaauaaugcggcuaugaacauuugguguguaaguaucuguuugagucccugcuuucaauucugcuggguguauuccuagaagggaaauuguugggucuuaugguaauucuauguuuaacuuuuugaguuccugccaaacaauuuuccacaguggcugcaccauuuuacauuuccaccagcaaugcaggaggguuccaauuucuucaucuccuugccaacacuuuuuauuuucuauuauuuugauaagagccauucuaauguguauggagugaagugacaucucauuguuguuuugauuugcuuucccuaguggcuagugauggcugagcaucuuuucauaugcuuauuggcccuuuguauaucuuuggagaaauauuuacucaggcccuuucuccauuuuugaauuggguuguuuggguuuuuuguuguuguuguuguugaguuguaggauuucuuuauauauucuggauauuaauuccuuaucauauauaugcuuugcaaauacacuauugcuuauuugucuauuuauuuauuuugcuuguucguuuugagacaaagccucacucugucacccaggcuggagugcaguagccugaucaaguucacugccuccuugaccuccugggcucaagggcuccuccuaccucugccuccuaaguagcugggaccaugggugcaugccaucaugcuuggguaauuuuuuuauuuuuguagagacaagguuuugcuauguugcccagguggucucaaacuccugagcuuaagccaucaucugccuuggccucccaaagugcugggauuacaggcaugagccaccacacccggccuguuuauuaaaaaaaaaacuauuugacuauacuuucuguuucuucuugagucaguuuuaguaaguugauauucuuggggaauuuccccaauuugucuaaaauuuguaauuuauugacuuauuguugauaauauuaucuuacuaaacuuugucuuacuauauaagaugucuccuuauuuacuaauauuauuuaucuucuuucuguuuuccuaaucauucuugcuccccucauacccagauucaaaacaacuuaucaucuuccuaggaguuucucauuucuguuguuuuuauugcuacuugcaggauuccauguuuuccucuagagcuucucuuguuauuuuugggaauaggagucagaaauuacuccccccaaauuugccaauuggcaggaaccauaacucuuuacauagaauuuagcaauguagucucauuauucuuuuaagguccuaaagauuacuagccauuuacugacugaauuagaaaugggaacuugguuuucugaauucuaguucaauguuucuauuacaucugaaauguuuucaggaaacuuucaguguauacuuuuuaggaauaauuuuuggaugaguuggaggaaacaaugagaauuguuacucagaaucuuaucugagaacuguuauucagagccaacucauuuaaaaaaauuuuuuuauuauacuuuaaguucugggauacaugugcagaaugugcagguuuguuacauagguauacacgugccauggugguuugcugcaccugccaacccgucaucuacauuagguauuucuucuaaugcuaucccuccccuagccucccaagccagcucauuuuuguugaaugagugaaaaauaaucagagaccucaaagagagcaaugauaauuguuuuggagauugugauagaggaaagaaugaggccaauuauucucagaucugaauauuuauaggaaucacuauaggagagcuaguuaaaaauauagauuucuaagucccacuugcagaaauucugauuuaguggcugcagugggcagaauaacggcccccaaagaugucugugugcuuauccucagaaccuauccauagguuauguuacauauggcaaggggugauuaagguugcagauggaauuaaagugcugaucagcugauauggggauuacccaagugggcccaauguuuaaggguucuuaugugggcaagaggaggcagaagagucagaaucugagaaaugguguuaugauaaagauuugacuggguauugaugguuucaaaaaaguuuaacauuaacaaaaaagauuugguguuuaggaaauguuagcuugacauaauaguuaauuccuacucuacccagcaaucuuauucucuuuuuuauuucuauuauguucacaaaccagaccaguauaucuguagucaaauauuaggauuucagcaauguacucaucaaagacuuuaugacccucuuuuggaaaaaugauugucagaugauagcuucguaugacagaaacuucauauuuuauauaccugcgcauaaagaaugcugauucuaagauggaugcgaacugaauagagaugucuugauagauaauuucuggaccucuugggaguucuaauugucaugaaaauguaaaaacaaauaguauaugguaugcuuugauguaggauaagaguuaaaggaaaacaaugaggaugaauaaaagugagguugaaaugaggaugaaaauaugguauaaauaaaaaaaaacuauacagauuuucacaguuugaucaguucugugugaggguagaguuuuugaauuuucgauuccugaacaaaugucucacuuucuuuucccuauuucuuuuacuuuucucauaggacugcauuuuucuauucaaggaauaucaggcaucuuuucauaaaacaaggaaacugauuucagaauccucaggggaaaaaucuuuugagguuucagaaauguauauauuuggaaaauuugaagcuuuuugcaaaagacuggagaagguaagcauuaugcagucaucguaccccacuccacaccacaccuuuuuggugauuuuguacuuuauguagugccauugagaauuauuguuccugaucucuuguccacuauuguuaugacuugucuaauauuacuuauaggucacugcauuuuauuauaacuuauuuuuucauuccugguuacugccuucugccaguaacacaaacgcuauggucaacuuucacaucucucaagaccucaguuuaccucuaccuaugaaacuucaacuuaaaaggcucugcuuuuaacuguuauauuaggcugagaaaaaguaugagaugaaauaccugcaaugccugauagaagucaguaguuguggaaucuccggauguauaagcauguccucuuucugagccaguguauaugguguauacaaaaacauugugcgggugauaucuuuucuggacagacauagguuugauuaauuuauuaggacugguugggaaggagugacauuuuuuugggggauauaggccagcccauaucagagacuucuuggagucauccuuugaaaagucuguaaagaucucauuuagguauucuucccccaacuucgcuaauucccuggauccugcuaguauuuagaaucuuguucaucauuuguuggaaaguaaugcggaacauuacauagguugaagaccuagacauguuuggaagccuauuuuuauuaguaacuuccugaucaagccaggacaggaaaguaugaguaaugaacagaaccaaguugcugagugggauccuucauacauacuucuuugaagcuguuuuuuaaauuuguuucuuuaacagcuuuauugagacauaauuaauauacuauuuacccacuuacaacuguacaagucaauguuuucuaguguauuaacaggguugugcaaucauuaccacaaucuaauuuuagaacauuuucacucccacuaaaagaaaccuuauguccauuaucagucacaccccauucucuccucuccccaguuuuaagcaaccacuaaucuacuuucugucucuauagauguaccucuucuggacacuuuauauaaaugaaaucauacaauauguggucuuuuguggcuacuuucacuuagcauaauguuuucaaagcucaucuauauuauaccauuuuucagaacuucauuccauucaucauugaagaauauuccauuguacggauaauaucaguuuauuuuucuacucaucaguugaugaacauugggauuauuuccucuuuuuggcuauuaugaauaauguugcuaugaacauuuguguacaagaguuugugugggcauauguugucauuucucuuggguauaugugcagaaguagaauugcuaggucauauggcaaauccauguuuaacuuuuuguugauaaccccaacuauuugccaaaguagcugcaucauuuugcauucuaacagcaaaguaugagguuuaugauuucuuuuuuuuuuuuuuuuugagacggaguuuugcucuuucgcccaggccagagugcaguggcgugaucucggcucacugcaagcuccaccucccggguucacgacauucuccugccucagccucccgaguagcugggacuacaggugcccgccacuacgcccggcuaauuuuuuguauuuuuaguagagacaggguuucaccguguuaaccaggauggucucgauccucugaccuugugauccacccaccucgaccucccaaagugcugggauuacaggcaugagccaccacgcccagcugagguuuaugauuucuucauauccuugccaacauuuguuauuaucuguccuuuugaauuuagccauucuacuggguaugaagugguaucucauugaaguuuugauuugcauuucccugagggcuaaugauguggagcauauuuugauguacuuuugcccauuuguauaucuucuuuuaaaaaacaucuauucagauucuuugcauauauuuaacugaguuauuugucuuuuuauuguugaguuguaggaguucuuuauauaugcuggguauaacuuccuuaucagauauaugauuuacacguauuuucucuuauuuuuggguuaucuuuucacuuucuugaugguguccuuugaaguacgauaguuuuuaauuuuaaugaaguucaauuuaucauguuuuucuuuuguuuucuuuguguuuuuaaugucauaucuaaggaaguguuguguggggcuguuuuaugcacaauagauuuuuuuaaacauuuuuauuuauuaaauuaaaaaaauugagaugggguccuguuuguguuacucaggcuggagugcaguggcaugaucauagcucacuucagccuugaacuccucagccuucugaguagcugggacuacaagcauauaccaccaugccuagcuaauuaaacuuuuuuuuuuuuuuuuuuuuuuuuuuuguagagauggggucuugcuauguugaugagcuggucuugaacuccuggccucaagcaguccuccuuccucagccucccaaagugcuggaauuauaggcaugagccacugugcucagccaauagggauuuuuuugggggcaaauguucaguuaggcuacuagcacaagucaaauuaauaaauaggucucauuggucaggacaaagaugcuuaauguucugacuccacuagagcaaaaaccuggaggugggucucaguuaccccuaccccuauuuuccuggagccagaacccuugcccaccugggugucgcuuugaaauuuguaguuucaggacuaaaccuuauuagugguaaagaucuuugggggugggucuaaugcugaguagaauggucauccaucugugaaauagcagcccaggaauuccucugaugcuagaggaaguggucuguaaugaccagcugcaucagcugcacccacucuggucucuggagaagcccugccucuaguuugaagaauacaacuucaagccacaagugcucagcaaccagagcuaagguagcacccccuagaggccuuaccugaaaugcauccugauugcuagguuaucccagcuccucugugcuaagaacgacagaccggcaucuuucccauuggauaauugguggauauugguguccagacucucaaagguggggcuggcgaacuuaacccugaaguauguccaggauuuuacauaauccacaagaggugguuacugagcugcccaggugggcuuccucugaugagugggguacggaaggggcaacuguuugacuacccuugugaacucuugcauagaugaagaggagagccacaagugugcacuaagagccuauuagggaaggccgagauucgaaguuggaaugaccaaguggcaaagucgaagggcagacaagacugauguugggguuggagagcugagauuucagaguuagacagauauguuggggcccuucgaggaguaagugaagaaggcucuagugugucaguguuaggaugccugaaacacaucuuuuuauggcagguauagacuugauggugcacugaauccuaaauagcaagaacgaaaugugugcaacagucuuugcuucuuccucuuccugccauguaaauuuuggugaauauugguguuucccagagcucuaucuucaguuuuguuuucuucucacccugaacauuugugggagagaagagaaaagguggagagcugguauugcugggggagauuugaggaucuggagcuaguaggugagguagggucuccacucauggugaugcugagaugagggaaucacagcaagucgagaacuggaaagggugcaagguuggugagccggaggagagacucugcauugguggugaguacugagagauugaacauugauagagagauguugaaaaagccagggccaggacaaacuagcaggagcauggucuugguugauucccacagcuggcuuuauguugcucugugugguauggggacagaggguacacuggcuaaguuugaagggcaagcaugggacugaccaccaugucugccucagaugaccccucauccaaccaaucaacaaaauagaggacauguuagugacaggaauuuuguccuagucucuggcuguuggagccaggugguagaguaaugagguaagggguaaaggaaacagucuuagcagguuagaauaacagagcaagccaguaguaguuugcuuuugcucuuuaaaguaggugaguggaguauauguguuaggaggagacccagauaguuccuguguuuauauagagcaugcgcagcaugcuguaaaucccaguggccuguauuuccuccauguuuggaguggcuucuaggaugauaaugguuuuuggaaguguauggaaauaguggaguaagagcaacaguugcuuugaaaauaguccuucuggguggccauacacagggauucauaugaauucugcuggcuauguaggaggaucagugguggugucuucauggugugugugguauuuggaagauucucugaaaauagguuuauucccuuucuggccauuggaccagcccuggagagcauugagcauuguucucuaaagcagaagucaaaauggggaagcguaaggaaggaguagccuguggacaugaauuuuuuguuuguuuguuuuggugaaguagguggugucagguugagacaaagacagccauuucugaaaugaaguccacugugaggguuucccaggucucaucaggggucaggaaugauugcugccauuauucaagcuucuuggaccagucuuuuaccagaacacaggcggauaugugcuaauguuaauugucagaacuauagugagggccaaacagcaugguggagcuuuugaguccaguaauccagugaaaugauuuucagaaaauccucaagagaccacaggaugaagcuauuuagucaagcuccccgccacccuugaaagacaagcugauugaacucugaaaaagguugugaacucucucuggauaugauagaacaucuucugucuuagucuaagaguaagaaugacgggugacagagauuugucuucuguuuuaucuccucugguugguuuuagcgaaauuauucuaggcccuguuuaaugguuuguguuuuauaucaaugauucauuaagagcuuauuuuagggaaguugccugcuaucucauuuaaaaaagcaaaauaacauuucucuuuuuaagauuacagaaaugauaacuguugugcaaacauauucaaccuugaguaauucuaccauagaaggaauagauauuauggcaauaaaauucagaaauauauaccaagggguuaagaaaaagcaauaugacauucuggauccaagaaggacagaauuugacacagauuucuuagauuucaugacaaaaaucaaugguuuagagguaaguaauuauaccuacuuuuacuuaguaaagcugaaaaguagucaguaguacuaucugguacuuuuuguaaauauucacauguaguaaguguuucuauauuuaugauuuaaguuccucuuucacauugaccaaacauauuugcagugugaguaacuuuuaaacuacuccacuaaaggauuuuuuuuugaaugaauagugagcauauccaauaaaagacaucagagaguaacuagaagcccaaagggcuuuuauagcuaggauucuuuuuuuuuuuuuuuugugagauggagucucacuccauugcccgggcuagagugcaguggagcgaucuugguucacugcaaccuccaccucccgaguucaagugauucuccugccccagccucccaaguaacugggauuacaggugugugccaccacgccugguuaauuuuuguauuuuuaguagagacaggguuucgccauguuggccaggcuggucuugaacuccugacuucaggugauucacccaccucggccucccaaagugcugagauuacaggcaugagccacugcacccagccucauuuuuaauauacauuaaaauuuguauuugcuucuugugccuaggagcacaagagagcauuuguaaacauuauucuuuaucaagugugaugagauuugagaacagauuaggaagauggaucacucuuccuguggccuuaugcuuuaugccugcauucucucugcagcuauagagggcagcucugaagaggcauucauauccugugugucauagauuaagagacaccagauggaugaaggguagucagaaaguaugucagaugagacuguaagauguuuuucucucaccuuuugggcuauaugaccucaguuacucucuacuguuaacugaaacuacuguuaaccuacguuuagcccaagggaaugguuuccucuugcugcagaauuuccuggagacacaagcagggagaagaauauacuuuguacacuuuuuaagucugauauccuugccaugaaagugagaaaaaucagauguuuuucucaaguauuuaaaaaauucuuuaaaaacuacauuacacguaaccugggcaauauaaauacauaagaaagauccuaaaauucuaccauucuaacgauaacacuuuuuguguuuuggcauagauuuccuuucaguuuuugaaacuuagacucuuugauaugaagauauauuauauuuuaauuauuacuuuuaguguuuggcugguuagguaggguggaguuuacuuccaaaaugcuucgaaaguuaaaucuuuauggcaaugggaauuuuugaaaaacuuguuaucucuuaaauuauuuuuaugauuuauuaagaaagauuauauguuauaaaggcuuuauuguggacuuagauucaaauuuuagcuuucaguaaauuacagcaauauuaaccuuuuaauaguuaaauaauuuacuugaggcaucaguguuuuaauuuuaauuuuucuucguuuuccaauguuugauuuaugggugugguauauauuaauagaccauaccaauaugaucuauacauacaaauaauuugcaaagaaugguucaguuccaucuuuuggguaccgggaguuuggaguucacuguuagggauggugggaauauuuauuuauuuuuauuuuuauagagacggguucuugcuauguugcccaagcuggucuugaacugcuguccucaagcuauccucccaucuccccccacaaaaggcugagauuacaggcaugagccaccacucugggccaauggugggacucuugaaagaacauuuucuacuucuuguacguccuuagcaguggcaaagagguuucugagagcagcaaugucagaaaaugacaucugcuggcccuggugucuauagcgucacuacacuacucuaccugaaguucuauauaucccaaagaaaaaugcuuguaagggaccuucacuccuuuuguaaauucucuagaucagaaauauccaauugguaaugaccugcaaaggcaaaccacaugucacuuuaauuuuucuaguagccauugaauaaaaguaaaaagaagcaggugaaauuaauuuuaauaaagacucuauucaacccaauauguuaaauauuuuaaugucauuaauaugaaaucuuuaaugagauauauugcauucucuuuuuuguacuaagucuuugaaaucuggcauguauuuuacauuuauagacaucuugcuucuaaguagugacauuucaagugcucaguagccacauguggccaaaguccaucauacuggacgaugcaguucuugaugcuuagaugguagauguguuugaggcuugaggcuaucuuaauucuguaggaaaagcauuaacuguuguuaaacaaaaccaaucucuuuaacaccaaaaaucauuuaaauauuaauauuuuauuuuagguacaaauacaggcauuuaugaacaguaguuuugggaaaaucuuaucuucucagcaggcucuucagcuacuucaaagguauucauaacacuuuaagcagaguaguuucuggggggaauaacuuuaaaucuaaaaauacaauuucaaauuaggauguuguuggaaaucuguccuacauaaaccuuaaaacuuacaaacauaaacuuuucaauuaccacuaaauagacugguaaagauuugaaauaaagaaugauauguucuaauugcauuguuuugguagcagaaagucuuucaacaagaaaaugaaauuauuucucauguuuccccucccugcccccagccaugucauauguuugggguuaauuuuauagguauuguuggaaagggaacaaauaauguuuacuucuacauacugaaagaauuucugaaagugagauuaucuaagaauaauagauuccaaaacuuuccauuuucccuccugagggcuccugcaccuuaaaagaaauuguguauacuuaagguguauaacaugauauuuuuaaauauguagugaaaugguugcuacaaccaagccagauaacacauucaucaucucaccgaguuaucugucccccacauuuuuuugugguaugaacagcugaaaucuucucuccuuuagcuuccuuucccucuauccuaacagcacuacucucucaaagggcgaggaaucccagauuagagggcugagcgggacuagaagccuuucccuuucagcacagggagggcucaagaccugugucagggacgcuuguggaacucuucccugagagccagcggaucuaguguugggucuggcuuugcaugguuccacggcuguaaugauggagaccuggugagaccauuguaaaaaaagucaaaacagaaauaacauaauuuugacaugugacaguacugcacagauggcagguaccauuuucuuggcgacuucugucucugucucucuauuucucucugucucucucuuucugucucucucucucucuuuuuaccuguaguaugcugaugucaauucauuuuauuaccagaauguuguaguuuuuaguauuuccugugugucauucagucucugaauggaagugacauuuagcugacaaaguuguuuuugugauuaugguuaaaugguuauauggaauuauauggaauuaacacuggcagagggagagucaauguguucucuuccaucuuugcuaagccaucuccucacucaucuuguaaucuguuugucauuuucucagggugucuuacuugaauccccagacuugucuaggucucucuuaguuauaggcauuucugacccauuuguaauuuaaauaauuauuuuuguuacucuuggcagaugucugucuuuuccauaagauaauuguggguuccaagagaaccaggacuguaccuccuaucucguucauugcuuuguccuaggacaacgaaugagggcugguaugaauauuugucaaaugaaugaauggaugguuaguaugacagcaagucuuaaguauauuucucauuuacuuuuuaaccauucagcuuugauuacuuuuagguuucagaagcugaacauucccugucugggauuagaaauaaaccacacaauagagcguauucuucaguacuauguggcugaacuugaugcuacuaagaaggcaagugucauguuuauaaauaaaaugguacauuagcacaaaaagaaaaaaaaucugaaaauauuugccaucauugucucaugccaagcuuuucagagugauucuuucucugcuaaggagcauugacgcucccuucugugugggaaggugcuugacaguguauauugcuggacagccagauuuacuccucuuugcugugaucuuaccaguuaucccaccauuauuuauugaguaggaaguccuuuucucauuguuuguuuuugucauugcugaguauguacccaaaggaauacaaaucauucugucauaaagacacaugcacgcauauguucauugcagcacuauucacaauagcagagauauggaaucaacccaaaugcccaucaaugguagacuggguaaagaaaaggugguagauacaccauggaauguuaugcauccaaaaaaaaaaugaaugagaucauguccuuugcaggaacauggacgaagcuagaggcuauuauccuaagccaacuagugcaggaacagaaaaccgaauaccacauguucucacuuauaagugggagcuaaacauugaguacacauggacacaaagaagggaacaguagacacuggggccuacuggagggugggagaagggagaggaucaggaaaagcaacuaauggacacuaagcuuaacaccugggugaugaaaaaaucuguacaacuaauccucaugacacgaguuuaccuauauaacaaacaaacaaacaaacauguaacccugaacuuaaaauaaaaguuaaaaaaaaacuaucauauugcccccguuuucugguguguguauagcaaagcccguuuaaguuaguauuuuugccuauagaaauaugggcucuagauacuauuaugacagauauuaauauguagcuaugugcuccguuugaauaccuccuugaaauuugggauaagggcagaaaaaaaauacauguaauaggaaauaaaggugaagagaaaauuaagugucguauauggucaacaucauuguuucaaaaucucagguuaccuuggaugugcauuuacauauuuauugacuaccuacuguauauaaaacaugaauaaugauaaaacaauacaaauauagcuguauauauuuuuugccuucucccuuguauugaauucaaacauuaacaucagauuuuuaauuacagcuuuaucauucucagaaagaugaccccccucuugcucgcaacaugcccccuauagcaggaaaaauacucugggugaggcagcucuaucgccggauaagugagcccaucaauuauuucuuuguaagccaagaauuaaauuuuaauauguggauuuuggugguuuuaauauaacaaauauaucauauccuauaauauuugugugcauuaaaguagccaacaacgagccaauucuuuuaccaggcaaggaaaauuuaguuuauaaauauacuugagagagacaaagucaauuccuucagguuuaguagauaagccagucuaauuacaguuaucucaaagucagugaaucuuauaauuuuaugucuuuuaauaacacaggacacuuuguaaagccuuuuaaaaaguaaaaauaaaaaauuugaaaacaauaaaguacaggccuagcacagaagcuuacuucuguguaugggcagauaggucacugauacauacucagugaaggugaagauaaagccaaagaguguauuccuguaugaagaacugccacugagagcggaauauaauacaguugauucauucucuauguccuucagauuauuagauuucugaaaaacaggacagucuugggcccuguuggcauucugaaauugccaguuugucuuuucuuuguccuuauuauuuucuuaaauuuuauuuaagagacagagucacaagguggaguugguuugcuugaucucgugcccuuugcugaaauauagaacaauauaacuacaaaacaguaguuuugcaaguaauuguauuauuucagcauuauuaaauaugaagauucuguuguuucucuuuugcugccaucauuugugucauuguucugaauaucaaaaaaaaauuaaaacccugagucccuacucgggggacucaguugcugauugacuuuguggugagagggcagagauugcccuguuugacaugugaaucgaaaccuaaaucuuuugauuuuuaaauaaagaaauuuuauuuauuuuuuaaauauuuauuuauuuauuuauuuauuauggaguuuugcucucucgcccaggcuggagugcaguggcgcagucucggcucacugcaaccuccgcauccuggguucaagcaauucuccugccucagccucuggaguagcugggauuacaggcacccacuaccaugccuggcuaauuuuuuuguauuuuuagagagacagcguuucacuauguuggcgaggcaggucuccaacuccugacuucagguaauccaccugccuuggccucccaaagugcugggauuacaggcgugagcuacggcacccggccaagaaauuuuauuuuuaucguuugauacaugguuaccuuuuuuugcgugcuggaauuuaggaauuugcccuguuauucaugguucaaggaacaucagucaauuauaucuuguccagaacagugggaugggaucagaaaaggagguagagacacugaaugccuggggcaggcuguggggcuggaggccucucucuuucuaaacccuuuguuuccuuuuccagucuucccucuauauacugauaacguuucccuacuucugcuucuugcugauauggccuuccccaucucuguuuuacugugaggcagaaucuaaacugguagcauaauuauuugauaucauuuuacauauaaguacuuucauuauuuggauauaaaaacauucagcagucuuuuaaaguaaaucuuuucccuuaaaaaaacagaaaaacucagacauuuuaucaaguccggacgguaaagcugucauccgucaguauaacaagaucuccuaugugcugguggaauucgagguggucuaucacacagccuggaucagagagauuucacaguugcauuacgguguguauaacacugccaugagccuacaaaguagggauuaggugauuuugaaugaguucauaguucuggagaacuuuuuccaucccuuccacauaaucuuaggauaguuacaauuuagauuuagggaugcuacagugguuuauuuguuuacaguuguuaauaauauucugauuuuauaagugaaaaugaucaugaccuugaagaugacauacuuaacuuaggacuuucuaccaaaaaccaguauuugaaaguaaaaauaucuuuagggauauuucuccagacuuuaugaaaguguucauauucaguuguaucaugauauagauucaaaucucagucccauucuggagagaaaaaauugcauccugccuucuuuccucucucccugcuucccuuccuuccugugucucuccuuuacuuucucccuuuuuuauuacugaauuuaauuucagguuugagcuccaguaaaugaagcguuuuagugcacugugucugcgugccucugaggggagggcuuauguguugccaaggcuuugggcggaguuaaaugugagacgggaugguucuuagccauuauccagcccuccuggauguuguuuuugugugggcucaaugguuggucaguucagauuccugcuuugucucaucuuaaccuuaaacucuuaguuauaaucucaacccuaaacucuuauacgugaccuugguggaccccuuacugggucccuugguagaaagguuucucccucccaaaccagcgucuccaccucagcagagcacagcauugcaggcgcaggaagcacaaguucugcagguggguugcuggaacgguggugagaggagucacuccuacuucugccucuugguuccagaacucauguauuuuagcuguguggggacacagcacuuauuuacaggccauugauucacagcauaccugcauccuagaggacagugccccaacccccgcagggugucgucccuaacaggaaccguagguaagccuuuaauaagccacuuuuaucaggccagcuguuucugggugcugugcuauaugguaggacccuguggacucuaaagaaagccuguuuauggagcagaacucucaaaggagcuucgagaggagcuuaaaacucagacuauggaaaaaggcaaaagagaauuuuuaacaacugaagcauauacugguuuuguuuugguucuacaaugccgcgcacuuaauuuucuuuuucuccuggugguuuuucuacccccaauacccuuucucuuaucugcacauauucaaaaacaagcucuacagucaccuguuucauacagccuuuccuuauucuuccuggcagaaaauaauaauuccuccagagcccaccauauacuuuaucuguagcucuuucucaggacacuuacugcuuuauagaucuaccuuguguccccuacaccuuccaagguuacccucuaugucuguuucaucugauauccuuuaaaaaauggucauagcuaacauuuauacagugcucaccaugugccaggcuuugucucagcacauuacauguauuaugcaaauuacuuuaauccuaacagcaaaccuacaaggaacuauuauuagccuuguuuuacagaugagaaaacugagacacugacacauuaaguggcuugcccaagaucacacagcucauucaaauucagauagucuggcuuccaaauccguucucuuaaccauuuaaaauacuguacuguuucuaacagugucaagaaugaugccaggcaugcuugggggcucuuaaaauauuuuaaaaauguccaauaaguagacauuagacaaucuugaugaguaauaauuuuaucaaguuuucagaagaguuuguuccccuugagaacaucaguuggccucuauugggugcacuauacucauugcaguggauugauguccaggagaagugaucacauacaaacaauaugaaguagaauucuuucauacuuucaauaugaaguagaauucuuucguguuuuuucacaaguaaaacaaacagucaguagaauucuuuaacuucuuucauuucauuucagaaaugaauugcucuggaaggcuuccuuuguccuagugaugugacuguacuuggccacauaggagcuucuaguaauaauuggauauguagcaucagccuccuuuaguugguugcucaguaaaguuucucugauggugguucacauacgaugaaaugcuugucuuguccuggagcagacuuccugacugucauuauuggucuguuuuaguugucuugaccuuuuugucuuuucaagcaagcucaguacaguuuuaaggaagacagauuuaaauguucaaaaguucuuuuggaauuuccuugguaggauaagugauuuauuuauuuauuuauuuuuauuuuacuuuaaguucugggauuucugcaccuguccaccugucaucuagauuuuaagccccgcaugcauuagguacuuuguccuaauacuuucccuccccuugcuccccaccccccgacaggcccuggugugugccguuccccucccuguguccauguguucucauuguucaacucccacuuaugagugagaacaugcagugcuugguuuucuguuaggauaagugauuucuaauccaucuuaaaaagauucuaagcgaguuggauaaaauuuuaaguugaaauugucauuuagcuugaaaaccugcaucauuaagggccauaucaagacuaauuuuaucugaugaguaaaagucaacuaacuucaaagagauauacaaacuauuuuauuuuacuagaaguuugauguggccacauucaacaaaacaaugugagguuuggaagauuugguaauugugauaaaauucucauguuaguaguguuuguuaauacaagauguaauucaaacuagcacaugcuugucuauaauaaguguuuuauuauuaugccuguagaaguucuucauguuaagcuaacaaauaaucuaaggcuacccaguaagaacugcuugggcuuauguauuucaauucauaauaaaauagauaucugaaaaugcuuguuuauaugaaugauguuuaugugagauguaguguaaaacaucuucccuccuuuccaggauuucacaacucaaugguauuuaauaaauauuucuuacugauuuugagccuauuuaucagaaauacaggauggagauuuaauuuaaauaagccucuuuaaagaagacaguuuggggucugagugggaaagaguuugaaaugagguggggcaucuuuugugauucuaaccaucuucugguucuuucucaggggugaagucauaauccauaagauaaacugacauagaccuauucaacccacucagaaaaauauugcaauucauagcacaaagcaccauucuuggucaauguuucucucccuggaucugauuuuguggcuuugcagacacucuucauucauuuaucuuaguuuugaguauucacuaugugccagacgcugugccuuagcaccuggggcauccaaaacauuuccuuugcccucaagaaguuaguaauccagggggcaagacagaaauauaaacacagcuggaagcagaaaggaaauucagaaugaguaaugucaaucauuauuuauuuguagcuuuacaagccacgcuuuuugugcgacauccagaaacagggaaguugcugguuaauuucgaucccaaaauuuuggaaguuguucgggaaacuaaguguaugauaaaaaugaaguuggauguaccagaacaggcaaagagauugcuaaaauuggaaaguaaauugaaagcagacaaacuguauuugcagguaagauagauuauguuuucuaauuauuuuugaaggaguuuuuugguaaaaaaaauauguauauauauauauauaucccugcaguuaugcuucauggcauugagggaaaauuuguuaauauguugauucuugauagaauuaaaauacugacuugcaaaccaaagaaaagauuggaaauggaaagcaaaaagugagaagauuaucagaaaucagauuuagguuucuggauaaugacugacgaaauagcaaguuucaaaaacuauucuuaauauaauuuuauagaucuugugcauuaaauuuuauaauauacuuauccuagaauauuuauaagauauaaauuaauaaaguggggugacuauacaauacaaguagaggugauucucaacauuguggggcaaaaaggagcauuauuucaauuaaaguucacuagugcggcaaaguaaaaucuaacaaaaugaaaaugguaggcaaaaacugacauuaacauguacugccgggugcaguggcucaugccuguaaucccagcacuuugggaggccgagguggguggauaacuugaggucaggaguucaagaccagucuggcuaacaugacgaaacugggugugguggugcacgcuuguaaucccagcuacuuaggaggcugaggcaggagaauugccuaaacccgggagguggagguugcagugagccgagauugcuccacugcacuccagccugggugacagaguaagacuccaucucaaaaaaaaaaaaaaaaaaaaaaagugccaucaaagguugaugauugauucaaucuuugauucaaaggucgaaucaaaguauauucagauccuaacacauuguuucuaaaauguuugacaagaguuaaguaacaugagaaauucuuuagaaagccaguuaaaacagcaagcugcauuaacuccucuucuuugcuuuucuuggcaggcuguggacauguauuuuggaaugcaggaaaauauauaaaugcaaggacauuuuuuuuccaguacaauuaguaauagcaaaagacuggagucuaacuccaacaauacagaacugauuaaauaugaguuauaagauaacuauacagacauuaauggaacagcugauuauucaaugagaaaaugaacucuauuccugugguacaacauuuauaauuuuauaaucaauaauauaauaaauaaauuucagacuuuuccuguuuuuuuuuuuguuguuguuggagucuugcucuguugccaggcuggagugcagaggcaugaucucagcucacugcaaccuccgccuccuggguucaagcgauucuccugcuucagccucccgaauagcugggacuacaggugugugccaccaugcccagcuaauuuuuguauuuuuaguagagacgggguuucaccauguuggccaggauggucucgaucucuugaccuugugacccacccaccucagcaacccaaagugcugggauuacaggccugagccacugcgcccggccuauuguuugucauuuuuaugauagcccuccuggugagugugaggugguaucuccuuuugauuuuguuucauuucccuaauggcuggugauuuuugagcaucuuuucauaugcuuacuaaccuuuugcauacuuucguucagcagcaucuauucagauccuuugcucauuuuuaaauugaguauuugucuauuuuuuuaguuauaaaguucauuuuagguuuuaaauacuaucccuuaucagauauaugauuugcaaauuuuuucucccauucuuuggguuguauuuucauuuucuugaugguguucuuugaagcacaaacauuuuaaauuuugcugaaguccaauuuaucuacuuugucuuuuguguuuuuggugucauagcuaagaaaccuuuuuugaauccaaagucaugaagauuuguggcguguugucuuccaacaguuuaauaguuuagcucuuaccaaaauaguauuuaauugucuuuuuuuugaaaaaaacuggaguaacguugguauuguggaaacuggauuuggcaucaaaagccaugcaugagcuuuuuuacuggcuagcugugacuuuggaggauuagguuuaaauguacuguuauaaaucgaagcuaauauaguuugcauuacaucuugcaagauuuuagcuaguauugaacaauaucaagaaagucaaaguucuuuagccagugucaaguagaaauaaaacuucaacuacaaguaauguauaaaggggaaagaggaaucaagagcuuugaaacuauuagguaaaaauugaaacaguuugaaacaguuuaagauuauuaauuuggagauaaaguaacucgaaucugcauuucccacaccacaguguaguaaauuacaaaauaguaaaaaauugaucaucauggaucaucucuaaaacaacaucuaagagauaacauaaaagcuuauucuguuuguguggaaaagcuaaauuuauuuugacucgagaaagcaaguguggcaucagugauaagaugaggauguuuuaaugugucagaagauaaggaacaaaagaggaaauguguaaugacagauaucacaaaaagauaauaauucaaacuacuuaauauacaucuagaaagacaagugauaaauaugaaaaaugaagauguagaaauugcuacugacuuguuuaaaggagaugcucagguaauuuacagguacagagaaagugugguaaaucagcauaaguuuaaaugggcagcugucaugaugacaggacuacgaggaaacugggauuaugaaaccuuccuggaaugaaucaaaaugugacugcuacuuuaaaaugaauuaaaauaaaacaugccauuucaacuuccuacagggucuucugcaauauuaugaugaguuaugucaggaagugccuucuguguuugucaaucugaugaccccaaaaaugaaaaagguugguauugcugaagguuuguauugauuuuccuguuauuuaaaauuagauuucgguucuauaaacuauggauuuuggaacaucuauucuucuuuagacccuccaucuuucuaguucaauuuuauagcucuguuuuuuuuuuuucugcagaauuucuugucuaaguuucguugccuuugaaaaaacaacuaaaucuaaaucaugagcauuuuuucugaaaauucaugauuguuuccuggacagccaaagaugguuaaaaauaaaaagucaucuuuauuagguguaauagagggaaaauacauguaagaaaauauaacauauaauauuuguaggugauaaauccucuucuauaagugcagaugcuccuguugauaauagaagcaguuguguuuuuaccguuucuagguggaaucuguguugaggcaaggacucacaguguuaacauggucgucuuuaacacuggaaagcuucuuucaagaagucgaauuaguuuuggauauguucaaucaacuuuuaaagaagguaugaucuauacauuuaaaaagcuaucaacauauauacucaggauauaaguaauaguuugauuauuaugaaagcucuuuaaaggguaugacuuuuaacuaaaaggacauccguuagguuuaaaauaucauguuuugggcugggcacaguggcucacaccuguaaucccagcacuuugggaggccaaggcggauggaucacgaggucaggaguuugagaccagccuggccaacauggugaaaccccgucucuacuaaaaauacaaaaauuagcuggacaugguggcgggcaccuguaaucccagcuacucgggagucugaggcaagagaaucguuugaaccagggaagcggagguugcagugagccgagaucaugccauugcacuccaaccugggcgacagggcaagacuccgucuaaaaaaaaaaaaaacaaaacaaaaaacuuuauauuucuuuuacuggauuggggucuucauuuaaguuugcuuuauucuuaucccugaauuaccuugcauuuaauauguugaaaugaugguucaacuucacacuguagcuuagaauaugggguaauuauagacugucaaaaguggcagaggagagugcuuaaauauuaauauuaauguauuuaauauuaacuagaugagaugaucaucaaauugaagauugucuauugauuucugacauauuggcuacauagaacaagccugucauuuuagaugugcuggucugugugucauggcagcaugguguaguaaacaaacucagaggcuuuggaguuagauaaaccuggguaggauucucugccuguuacuagcuauguguuccuucccagguugcuuuacuucucagagccuuggugucuuuaguuguaaaacugggauaucagugccuccugugcuggaaucaggauuaaaggagauaacacaaauaagguuauggcacauguuauugcucaagaaaaauuuaguuuuaugucaagcuuucuuugcagauguccuccuaaaauguucaccaaauuaugcuuggcucaagaugcaaguuucuagacuuagccuucuaaauuaauuuauaacucaagccucuuuuggaugaaaaccuagcucuaaaggaaagaagaguuuuuuuuucuuacauuuuucuuccuuguagaucagugacuugugugaaaugcauauugauacaguucugaaggagauagccaaaacuguguugauuucucugccugaaaguggugcuaccaaaguagaagauauguugacccucaaugagguaugcauuuguucauuaaauuagaaucacaaaaauauuggccuauaaaccuaaaaugugaaauuucagucuaaaaguagaaaccugggucaguagcauuuagacuuuuuuuuuuuguuuuuugugaacauucucugcuccaaggacuuucaugccuucaauagcaagagcccuggccacaaccuagacuaacauuuuguugauauccucagccuaaugcuggcguuuccuggggcucuguaagugguucacagcucucuuccacugugcauggcuaccagggccauaucauuuuucucauggcuuuaacuccaacauacuuucccucuaagucacucagaaaccugggaaucaucuagacuucuuuccucaccccuucauuuccuauauccagccaguccugagaggcuuagccaggacuuuuuuuuuugagaggaaguuucacucuugucacccaggcuggaauacaauggugugaucuuggcucacugcaaccucugccucccggguucaagugauucuccugcuucagccucccaaguagcugggauuacaggccuguaccagcacacccggcuaauuuuuguguuuuuaguagagaugggguuuugccauguuggccagacuggucucgaacucccgaccucaggugauccacagcuuuagccucccaaagugcugggauuacaggccugagccacaacucccagccuaggauuuuuuucuuacuuagauuuugcuugaguuucagccuguucuuucccuuucuaggucaggucguuacugcucauuuugacuuuagcaauucauuuggugauccaacuggucucgcugcuuccauguuuacccugacacauccauccacauugccaucaaaucugauugugaaaugccccagcuuaaauccuucuuggcaguggcacauaguccuugcaggauaaaauguaaccucuucagcauuguuauguugaaacuauuuagauaccuguuuauccuccauugacucaaaagcacaaagacaggaacccugucuaaacauuuucaaggaccagcacauaaugcaaccucucuuauaaauucaagacauacauuuauguuuugaacugaacucuuucuuuuuuugagacagggucuugcucugucacucagguuguucugcagugguguggucauggcucacuggagccuugaccuccugggcucaagugaucuucccauuucagccucccaaguagcugagauuacaggugcauaccaccacaacuugcuaauuaaaaacauuuuuuuuguagagacaggguuucaccauguuacccaggcuggucuugaacuccugaacucaagcgauccacccacuuuggccucccaaagugcugggauuacaggugugagccaccaugcccagccuuaaaauuauuuguucucaguuuuggggucuugacuauaacugagacaacacuaaacaacccauuacauuaaauuaguuaauuaauuuaguuuuuugagaugaggucugccacccagccuggagugcaguggcaagaucauggcucacugcagacuagaauuccuggguuuaugugauucuccuaccucauccucccaaagugcugggauuauaagugugagccaccuugccugugagaugacccguuuuaacauccuguucuugguguguucaaguuuaagaugauuauaucuucuggauuggguguuccucuaucauuauuaaguuuuuuauccuuaaguuauuuuguuugauauugauguaauuauaccagcuuuuuucagguuacuauuuuucagaugugucuuuuuccauuuuaugacuuucguccuuuuuggauucuccuauuuuagauuuuguucuuguaaagaacauuuaacuguguuuuauuuuuaaucuauucugaaagucuguuuuuaaaaaacugguaauuuugaccuauuuacauuaauuguaacuauuaauuaauauuuuuggaaauacuucuacucccugcccucuuuuuaaaauuuauuaacuuaucuauuucuagauguuauuuuauauucuuuuucaaauauaugugaucuuuuucucaugucuuuauucuauuuuucuuuagacauuaaaaaauauuuuauauuuuacaacauaauuucacuaucugaaaaaaaugggggagucuaauucugcucugugcuguuucuaccaacucuugcccagaguggcuuguuucuuccuguuuuuuacaguuuuggauugggagcuaaugcacacacaucuauuugugggaaugcuggacagccuugguugagaaccuguuucuuuuuauuuauuucuaugugaugccuaggaguuuuaccaaguugggacaacuuuauguugguuucucagaggauagaauuucuaaagcuucauagauuguauaaacucaagccccaaaccuauguaaggguaaacuaguuguaaauucccaagggagaauuugcuccccgccagcccagagccucaaccaagguagcugacuuuccuuucucguccacucuuucccugagggccuagcccuugauuuaccugauauuaagcaaggguggggaugggguaggucucauuucuagccucucacccuugugagggauccaaggccuuaauuuuuuuuuuuuuugguuaugaaaaaacaaagcccauagaagcuaugguuucagguugcuuuuuauuuuaguuucuaugcuuuaaaaaaauugagauguaacauauacucagaaaagugcacaaauuuuaagugcaccauucaaugaacguuuacauaugauacacccuuguaacugucuccaugaucaagauauggaacacuuucuguaucccaagugauuccuuugugcuuuacuccagccaguuacacuuccuucccaccccuaaaaguaaucaccauuugacuucuaucacuguauauuaguuucgccuguuuuugaacuucauguaaauggaauggugcagaauauauucucuauuucugacuucuuuugcucaguguuauauguaugagauucaucuuugcaguugugacacauucguucuuucauuucaacuucucauugcuguauaguauuacauaauacggauuuaguacaguuuauuuguucauucuacucuugagggcauuuagauuguuuauagcuuuugguuauauacuaagaauucuuguaaauuuuuuuuuguggacuuaagcacuaauuugguggauauauaccccaaagggaaauuguugagucauagauuaugaauauauuuagcuuuaauagaaauugucuuuuuagaguuugucucugaacuaggagccagacaaguucacgcauuacauuugauugaaauaucucuuuaaguuuuaaaaaucauuucccacuccccacucuuuguuuuggcugacaacuuuuuuauugugauaaaauauacuaacauagcauuuaccauuuuaaccauuuuaaguguacaauuuaguggcauuagguacauucccaauguuguauaaccaucacaaugaucuauuuccaaaacuuuuucaucaucucaaacuaaaacucucuaccaauuauacaguaauucuccagugguagugcuaagacucaagaguguaaguugcugggcacgguggcucacgcccguaaucccagcacuuugggaggccgaggcagguggaucacgaggucaggagaucgagaccauccuggcaaacacggugaaaccccgucucuacuaaaaauacaaaaaaauuagccaggugugguggcgggugccuguagucccagcuacuugggaggcugaggcaggagaauggcgugaacccaggaggcggagcuugcagugagcugagaucucaccacugcacuccagccugggcgacagagcgagacugugucucagaaaaaaaaaaaaaagaguguaagucaagaugcaggaggcagaauucugaagagcaugcuugucaagcaguaugcccagucacuugcccuggagugaucuaagaucuaguaacaguugggcugucuucucacaaaccuaccagcaaguggcguuauagugaagccagaguaugauuuguaaugacagggcaaguuggaucacacuccugacugcaaucaguuuuggaaacacaauauauguaacauuaauuuuuugagacaaaguugguuugggccaaacugugguuucagaucguauuugggaaucagggcuauuugcagucagggcaguguuccuugucuuggcgcauccaagggugguuuaggacagauuaugcgaauuauuaaaaagcuuucuucuguuaguuuccaguuguucuuucuguccugugauccuagggcugauaguacuuuccuccuuggccagcugggucccuuuuaggauuuaccaaugggugugcuagaaggaugcuggaggagagagaagggacuugcucuuuccugauuugccuccuguuccugacacuacugcacccacaacaacucuucacucugccaacagcacuuagucacagcccuggcuuucccagcccuuccagagccagccccgugugccuuucacgguaccagcaucaugaggucccucucugagcuccugagauagcagugcuggcugggcagcccccucacuucucugcuccagguucuaauaacuccauccucaucccaaguccuagggaugcuagcuucuuccugcuguaacuguuauaucucugugugccgucagugucccuguaagcauuuuggguccuuuuaagggaggagaccaccccucauauugucuuaugcccaauuucugccuccaaagaaagaaguaaaaacuaaaaggcagaaaugaaauccacaggcagacagcaugcaccacacccugggccugguaguuaaagaucgaccccugaccuaacugguuauguuaucuauagauuccagacauuguauggaaaagcauugugaaaaucccuguccuguucuguuucguucugauuaccggugcaugcagcccgcagucacguacccacugcuuguucagucaaucacaauccucucauggggaccugcuuagaguuguaagcccuuaaaagggacagcaauugcucacucggggagcucgguuuuuggagacaugagcccgccgaugcucccaguugaauaaagcccuuucccuccacaacucggugucugagggguucuugucugcggcuuguccuguacacuuuaacuguguuuaacccauccuccauauuaaauucucuaauuuuauuuguuacaauagcuggugugucuuccguuuuccugacuggagccuaacugauaacuucugucucgauagaucuaccaauggaauagaaaaucaaggaaauguuaugauccaaguuaaacacuguuaaauaauuaaugaguauuagcaauucugucaacaaaaucaacuuggggcuggacgcggugacucaugccuguaaucccagcacuuugggaggccaaggcagguggaucacuugagcuuaggaguuugacuccagccuagccaacauggcaaagccccaucucuacuaaaaguauaaaaauuagucggggggcggugguggugcaugccuguaaucccagugaaaggagaggccagcuaggcuucuuaagucgaguaaaggcucagaaagcugugaaacucacucauuuccugccucaagccuuacuuuaguccuagauaaauaauagugaagauauaugcuuaaaauauuccuaacaccaggguuugugcauguuuucuucccuaagaaagcuauaaacagugaaaauuuugcuguaagcuucccuguguccucucucccucucucccuuuccccuccccugaaacuaaaaggaauuuuaauugcccguuuguuugugaccagcagaccuuaucuaugcuuccaauuccaauuccuuguaaaaauacugugagauccugucuccuuuacuacgccgcugcaaagucauaaaguagaugaaaccuaaguugcaauucagguuuuccucaagaucuaagacauguuaauugucuuuguuucucacucuaguaacaucuccccgcugcacauauuucccaccuuaaaaaguuuaaaaagugaucaaagaagguaacgcuggcuaccggcugaagaccccuuccacgcuguggaagcuuuguacugucacucugcucaaucaagccuacagcuuuuuuucucuuagucggugucuccaucacucgcagcugccacgccaauucuucggcuuggcuaaggcaaaaaccuuuagcauuacaccagcuacuugggaggcugaagcaggagaaucgcuugaaccugggaggcggagguugcagugagccgagaccguguccacuccagccugggccacagagcgagacuccgucucaaaaaaaaaaaaaaaucaacuuugcucuauagagacaaaagcacauuagugguugccagagcuguggagauggggaaauggggugacugcuaauggguauagggaugcuuucugaggugaugagaauauuauggaauuagauaguggucaugguugcacaagucugugaauauacuaaaaaccaguaaguuacacacuucacaagguuaauuuuguagaauguggauuauaucuuaauuaaaacaaaauuuaaaaaucaauauaacugucuccuagucccuggcguaccccuaaggcacuucuuuaguauucagucuguuucuuacugaguuuuaagaauggucuuaguccucaaggaguagcgagucuucucaagaagagauggaguccuuauuaggacaggaugcuuuacuuuguguggccucaacuguucaugacguguuauagagguaguauuugcagugacauuauuuugccacuuguugaacauaagaggaagguggcugagccauuggguugccagcugacacaggacaucugugcaguggaauguguaugucuaaguuucuuacccuugguauugauggcagugugggucguugugauuaucugaaguggcccaauucagcaaggauuaaugaaguuuguuuugcacguguucuuugaucagaguucagacacaggguuggaguugaggcacagggauuguguaugggacaguaucagugaagaucccagcagggugagauaccgcaggagucccaguggugggaagucaucaccaccacuagggcugaagggaccagggaagaaaauugugcuuucagagcccaguaaaagcugaagccauguggcagggcucuaccagagaugcagccuccaagcaaggagggaaugggaaagaaauaccccaccuucucucuccuauagcucuccugucuucucuuggugccuccucuuggguuaaacccaacuggaagucagagaaugagggagucccacaacguagggcguggcagagaaaaguagagaaugguuggcaggacauggagugucuggcaauauggcuuugauggagugacagggauuauucauaauuaaaaucauguaaauaauuuccacaaucagagcucuuggcacauugcugacugcugcugcauccauuuuuccuuccuuuggguucuauggagaaaguuuccaccucucuucaaaacugagguccuccaaaugggcuguugauuccaugccuaccugucuucucggugaccuuguuccgccaguuuuccuuucuccuguauccucagcguuguccucuccacuggguccuucucuccagcaguaucauaugcucucaugcuuuccuugccgacagacacuuucccacuucuuccuuugcuucucauuuacaaccagacuucuccaaaugcucgcacaugcuaucuucacuuucccaucuccuauuaauuuuuguuuccccaauuucuggcucaaauuauuucuggcacaaauuauuauuuuuuagcagccuuauugagauaaaauucacauacccuacaauucacccauuuaaaguguacaucucaaugcuuuucaguauauuuacagaguugcacaaccaucacugcaaucaauuuagaacaucuucaucacccaaaagaaacuucguccucauuagucauucuccauuuccucucaacccucccagccccaaggcaaccccaaauuuccuuucugcuucuauagacaugccuauucuggacauuucauacaaauggaaucauacaauauauguucuuuugugacuagcuucuuucucuuaguggaguguuuucaaaauuuauucauaguagccuauauaucagaacuuaauuucuuuuuuuucuuuuuaaagaaacaacaaugucuugcccugucacccagacuggaaugcaguagugugaauauggcuuacugcagccucuaauuccaaggcucaagcgauuccccugucucacaaaacuucauuucuuuuuauugcugaauaauauuccauuguaugguuaugccacauuuuaucuauccauucaccaguugauggacauuuggguuguuuccacuuuuuggcuacuguaaagaaugcugcugcgaacauaagugucuauuuuuuuuuuuuguggacuuaaguuuucauuucucuuggguauguauaccuaggaauggaauuacuggcucccaacuccauguuauacucuuugaagaacugccaggaugcuuuccaaagugacuguaucauuuuucauucccaccagcauguaugaggguuccaauugcucuacauccaugccaacacuugcuauuauuugucuuuuuggugacagcuguccuggugagugugaagugguaucucagggugguuuugacaaauguuucccuauuagcuagugauguugagcaucuuucaugugcuuauuuuuauguuuuugagacagggucucacucugucccucaggcuggagugcaguggcgccaucuuggcucacugcaaccucugccuccuggguucaagcgauucuccugccucagccuaccaaguagcuggaauuacagguaugugccaccaugcccgguuaauguuuguauuuuuaguagagaggggguuucgccauguuggccaggcugggcucaaaccccugaccucgaaugaucugccucccccucaagugccucccaaagugcugggauuacagacgugagccaccgugcccugccuccugugcuuauuaaccuuuuguaugcuuuccuucagaaguagguauucagaucauuugcucauuuuaaaauuggauauuugucuuuuuauuuuugaguuguaauaauguuuuauagauacuaguuccuuaucagauauaugauuuacaguuuuuuuucucccagucuuuggguuuucuuuucaauuucuuuaugguguucuuugaugcacaaaaguuuuuaauuuugaugaagucuaauuuaucaauuuuuuucuuuuguuguucugcuuuuggugucacaucuaagauaacuuugcguaauccaaggucaugaagauuuaugccuauauuuuccucuaagaguuuuuuuuaguuuuaguucugaaauuuuacgucuauaauccauuuugagcuaaucuguuuguaugguguaaggagaagguuccguuucauucucuugcaaguggauauucaguugucccaguaccaguuguuaaucccauuaacuuuacuauuauaugguauuggaaacguauggaaaaauuuguaugacauucucccauuuguuuuguggguauauucuuuucaaaagauuacuguauguuauuuugucgagguuucuggauauaucauggggaugccaagauaaacauguguguucauucugccaaguuaauuagugugucugguuccugaggggauuucaaagcugggauguauaaacacauauguccaaucugccaugaucagcuggaauugucuacuugcuuaacacuuauuuucccuguuagacugaaguggcuuccagccuccguuaccauuccaguguuuagcacugcauugaauaaauugaaaaggacaaacugaaugaaugauggagcaaggucagaagagucgguggguguggagaggaucacagaauauccuuggauagaaggagggacaccaugucuccugggacuaaaaaaugaugagaaugcauucagauacagauuagacagucaagaaaggaacacauaacacaugggggcaaaacauggggaauaugggacuucccaaggcuuuucuggagagaaguuugcauggacagacuugggauccucugcaguuguguucuugaaggcccaaaguggcugcuccuauguacauuuuuuuuuuugagacagggucuugcucuguugcccaggcuggaaugcagugaacauggcucacugcugccuccugggcucaagcaauccucuugccucaaccuccugaguaggugggaccacaggcacgcaccaccaugccuggcaaaauucuaaaaaauuuauuguagagauggggucucgccauguugcccaggcuggucucaaauuccugggcucaagcaauccuccauccucagccuccaaaaggguuaggauuacagguaugagccacugcacccggcccugauuuacuuuuacguuuuuuuuuuagagaugaggucuugugcugucacccaggcuggagugcaguggcgcgaucauggcuccugcagccuugaacuccugggcaugagcaauccucuugcuucagccuccugaguagcugggauuauaggcacaagacacugcauccaacuacuuuucuuuguccuaaaaugaguguauuuugugggcaugucaaaagacuuauugaacuuuauaaacuaguuuucuuuucugaauuugacuaguucucaacuucuuccuaaagcauuugcuaguagaagaguuuagaaagacaaagugcaggcauuuugaaucagacaaaacugguuucaaauaguuuuuccaacuacugugugaccugggaaaauuucuuacucuuucugagccucaguuuucucugcugugaaauggggaccauaauauuacucaccccauuacucaucccaagaucaguguuuaacuaaaugaguuaauauguguaaagcucuuaaauugaugccuguuauacaacaccaugcucaauuaaaaacuuuaucuaauuuaacucuccaaaccaauacucuggauugucuucuuuugaaaccacaucucaguuucaacuucuggcaucaucuucucuccaccccuucagccuucuuucuuuucaccuaugugaauaucaagguagauuucuaugugugauugagucagggauaggucaaagauggacuuuuucaucuuucugcuguucuuugggccuuagcagcuaugcuuuuagccauugacaauuuugaaucugaagcauuaugccauuuucagcuaucucuagcuuuuuuuuucaagugaaguuaauuauaguuuuauaaauuaaagucauaggacuaauuuucacaguguuacuuuuaaguaucuggaaaauaauagucauuucuuuauuuaacagacauacacaaaagaaugggcugacauucuaaaccacaaaaguaagcauguggaagaagcugucagagaacuuauaucaauauuugagcagauuuaugaagugaaauacacugggaaaguaggaaaacagucagguaacuuuucucguuacuguguuugaauuacaagaucuacagauucguucuuauguaagcaccuucugcuuagcagguacugaauuccagacccucccuuccccagaagcaaagaagguguucagcauaaaucacauuguuuguaccaacaguuuaagcccagagaguucuuuuuguuaguucgggaauggugggaaccccucucaaauccaaguucccaaccccgguccagcguugcaaguuggccuuccuauggauagcagucucaggccugcuaugcuaacucuauuuuuuuuuuuuuuucuggugcagcauucuuaucaagucacuuugacuauuugauuuauuuuacuuuuuuuuuuuuugagaaacauaaaccaggaaaagguaaauucuauaauuuucuugaaucuggaaaacuuaaucugggugaaaccauguuuuaagacuuuuuuuuuuucuuuuccuagauccuucucuguguagaguaagcuaugaauuccuacuuacaacuaucuuugggguuuggguacagauaaaugguacccaguugaagagugcacucucaaggaagaaaacaugauauggaagcauguauucuccaccauccauucccccucccaugauuaaaggaugcccuaaaaggcuccuaacuuuugauucugcccacacccucauaaccuucauucaguuggcuugacugggacuaagagaaacuuccuuacuucaucacaucuguucaggcaaauuuguaugacaaggugccugcauuauuuaaaguggaugaaauaauuuuuacccuauugaauuuccuguuaucucaauagguucuaauaguuucaguuuuauuaauaagcccgagagagaagcuguugaauuugaauccccuuuaucaggggcagggaauuuuaagaaaagauucccuaguaggggaguguuuugcuuccuagauuaugguuuaagaacacgggacuuuuagcuuugcucagauuauuguccuguccuagauauaacaaaucuuuggauaaauuggaagagaaagacauauuucauuuuaaaguuuuguuuucaagcucuaaauaagaacugauuagguaaaacuuuguaguuggagguuuuacuuguuaguauuguaaggggaugugccugucagucacgaucccuguuuacuacgcaccugcucuucuccccagcugcugcucagggaaguagugugaggcuggcuucgagcaaggcuagccauugacugcaccaguaguaggucacugacacagagugugccacccagacucucgaaggagaccugagagauggcacugccuuacagggaugaaguuaauuagcuaauuaccaacauauuugaaguagggaaucugugggaagcuggcuuuuuggagugagagaacauuccagucaagcagagaucccaugaaagugacauagcaagaagagagagagagagagagagagagagagagaaagagaaaacugugccuggaacagugguucuuaaugggacuggaagggauuuugcccccaagggaauauuuggcaaggucuggagacauuucaguugucacacaguguguguguguguuggggguggccgggggggaggggguggguguugcuacuggcuucugguggauaagggccagggaugcuguuaaacauccuacaggacagcccccagcaacaaagaauugacccacccaagaugucaguagugcugaggaugagaaagccucagccuagaaugaguaugcacaucacaucuuuccucuuagaguuuuuccacuuaguuuaauuaguuucaucacaagcgucaaaaacacaaaaauauuauuucagucaaguuggaaaacucaaaagauagacagauaauuuacaaagauaauagguaaaacucucuuaaaacuuuucugaauucuagauuguauauuuacagaguguauuucuuaguagaaugacaauucuauugagguggauaauuuaaauugaauucaaggaugacuccuagaggaacaaaugcgaaaagcauuuuucaaaaaacaguuuuaaaaguaagagcuuuuuaaaaaggaacuuccuaagaggauuuggccauguagaauacagacaaugcuaaaaagucaaauguuauauuuuuguuuugucuuuugucuauagaacagcggaaacacguuguuuuuggaagugaaacaggagagggugaaaacaaugacuaugaagcuaauauugugaaugaguuugauacucaugauaaagaagaugaauuuaaaaagguauuuauuguggaacaacuucaugcaauucacagaauuaugguuuauaggauuauagauaaccccauauggugcuuuuuccaggcaguucugcaaccaaucuaauuucuaacaaaauacagaaaguauaauuuucaauuuuauacuguaggaucaggcaauccuuuaaguuuuccccaguaucacagcuuuugaugugauucugucaauuacaguuuauguagucaccucuccucauugugauugaccauguuuucucauauaguaaaugugacgucagggauuggagcagcugauccguuugacucagaauggagaacuuuguucucaguuguuguguuuaaugguuaucuguauugcaaguccagauugugguucacuuggggcucagggaucugcauuuuaaacuagcauuauggaugaccacucuggacucucccccaggagaagcccuagauaggcagauuuucacauugaguugaaauguguugagaaugaagguucagaagggggacugggguuucuuuuuccuucuuaguccucacccuucuggucaugcaugagcucugaaugucacugucacauuugcacucauuccugcuuucuccuccccgggucaguuuucuuuuaauccuucauacccaccuucuuuucauucuuuuucuauuuuacccacuuuuacacaaucugaugcaguuuuagaaauaaacagcacccauuuauuccacuuucaccuucuugcucaaggaugauauugccagauaauugggaaacacuuuucugcagcaucuagauuucugcagaguuuaggcuucucaguaccaugcaccaggcagcuguuagcaaccagcaggugucagcuggagcacuccccucucagaagugccugucuuucaguugcauuaccuuuugacacuggcugaaguccuuagagcaugacugaguacccucagaaccucuccaguugggggaucacuggagcugugcuaguggucaccucauaaauagccucugccucgcaaauucaucucucacauugcugccagaacggucuaacauaaaaaucugauuauguucaggaggaugaggcaggagaauggcgugaacccgggaggcagagcuugcagugagccgagaucgcgccacugcacuccagccugggcgacagagcaagacucugucucaaaaaaaaaauaauaauaauaauaaaaaucugauuaugucacaucugugcuuuagcuugauaguucacuagcccugacuguaccccacugccacauggaaaaucuugauauuccucuuuguucaugccuuauuacucucucuucugccucaccaacccagucucagaggggccggguucuagagcagugaggaacaguauggccagagccuugccccgauguaugacucauuguguaagcaagacaugggcccacaucucugccuaccaggcucaaaaccuguccugugcucugaucaauaaacuuggcuacuucucccaagggaaggaaggguguggagagagggucaaaccgcugucccagaggguggaauuuucaucucauauauuugaguauugcacauuuuaaaauacauuuauccaccaagcugagcuucuugaggauggagacuaguuaucuucuugugcccaugccguuaaucauugagaaauguaccacauuuaaagugcuucaauuuuguuaggugaaaauugaguauugagcaagccaggauuacucugaacauacuguuugugaauuuugguuuuugaauaagucccucugguuugcuaggguguuuaugcaaacacauuuuucauguauucuuauuugucuaaaaaaaacagacaaguaauuuaggacugaauuuauuucuacaauaucauugaaauuguauaguuuauuauuuguugccuuucacaugccacaucuaauauucugucauuguuuuggggaugcucuagguuuuuuggaggagagauaccaaauuuaaucugauuucuuauuacaggaguguaaagaggucuuugcuuuuuucucucaucaauuacuagacagucuucaaaaagcuacacgguuaucucuggacacaaugaaaagaagaauauuuguugcaaggcaaguugaaaauaugcuaauuaugucugguaaucauacuuauaaugugaauagcaccucuuauaaauuuauuaauuaaaaaaacuauaaaauuuaaaauauagcauucauuaaaagacuguaugaaaguauuuguguaauacugcaagaacuguaguuaaaugaacacccauauucccaacacccugccugagacaaaaaaaggcuaccaguccccucauggguccucucccuucucaccuaaaaguaaccacuauccugaacuugguguuuaucauugucuugguuuucuucacaguuuacuaugcuuuuguauccccaauccacguaucauuuaauuuugccuguauuugaacugugcuugguauaauguuuuugagauucauccaugggguauaguuuuuuacacuucuauguaguuggaguauacguagucuguuuauccauucuacuggugauggugauuuggguugcuucaguuuuugcuaucaugaauaaagcuucugugaguaccugccaccuguugcaccugcuaggaguggguuugguggguccuaagguaugugcaugccucauuuuaccaggcagcacauagugagaguacccauggccccucaucccuacagacaguauuauucgguuaaaaaauucuugccaacauacagggugugaaauggcaucucaucaggauuuugguuugcauuuuccugguuacugaugagauuaaauauacuuucuuguguuuaugggccauuuguuguuucucuuccuuaaaaguuguguuccuaguucaaccacuguggaagacaguguggcgauuccucaaggaucuagaaccagaaauacuauuugacccagcaaucccauuacuggguauauacccaaauaauuauaaaucauucuccaauaaagacauaugcacacguauguuuacuguggcaauguucacaauagcaaaggcuuagaagcaacccaaaugcccaucagugauagacaggauaaagaaaauguggcacauauauaccguggaauacuaugcagccauaaagaagaaugaguucauguccuuugcagggaaauggaugaagcuggaaaccaucauucucagcaaacuaacacaagagcagaaaaccaaacaccgcauguucucacucauaaaugggaguuaaauaaugagaacacauggacacagggaggggaacaucacacaccagggccugucaggggguguggggauaggggagggauagcauuagaagaaauaccuaauguagaugacggguugaugggugcaguaaaccaccauagcauguguauaccuauguaacaaaccugcauguucugcacauguaccccagaacuuaaaguacgauuaaaaaaaaaaagaaaaaaaauuguguuccuuuuuuggccuguuuuucuaucgaauuggauuaauucauaaguauucuuaguauauuacauuauugaugauaauauaacaaaugucuuuugucaguuuugccuuaucuuuucauuuucuuuauuaauuuucauuuuccauugcugaguuuuaaaaauauucaaauuuaucaguuuuagugauuugugaucuguuuaaagaaaccaacucuucccuacuucauaaugucuuccaaaacuuuuguaguuuugaccuuuauauuuaggguuuuaauuuacaugguauugauuuuuaugcuuagugugagguagcaaauuaauauauuuuuuuccauaugguuaauuaguugaccaagcaaaaguuguugaaaaaucaacuuacuugugaggucaggugggggaguuauuuaaguugcauuguaucuauagaucaauuugaagagaauuagcauccuuacaaauauugagucuucuauucagaauuauguauuaccucuucauugauaugucuucuuuaauaucucucugugacguuuuauaaaucucuguguaaagguccugcacauuuuuguuagauuuauuccuuggcuauucauugcugauuuuuaauuuaauuguacuguucaauucucccagugugauuguggauuuauuaaacuuuccuuuuguuucggucaguucuuguuuuauguauucuauggcuguguuguuaggugcauacaaggucguaguagcuaaaccugcuuaagagcacuuuuccuuuuauuuuuauuuggcaaaucccuuuaucuguauuaauucugauuccucacaauuuaguuugucauuacuuuaccaaccuuuuuuguguaauuguuucagucucuuuacuuaagccuuucucuguacuuuuuaguuuuaccucuuaaaaauauuuuauaccugauaauuuuccuucagucucauuauuucugucuuagugaguucaauuuguuugcauuuauugugauuuuugauauaguugcacuuaauuuaugacauuuuauuuuguguuuucuucucaacauucuuuuucuuugauucauuucauuaugacuguugucuuugcgguggauaauuuucaccauuuauucucuuuucuguacuucaguucuuuaagugauuacccuuaacuuuagaaugcacauauuuugcuccaacuaaaagaaguacuggccaggcgcaguggcucaccucuguaaucccagcaccaugggaggccgaggcaggcgaaucacuugaggucaggaguuugagaccagcgugaccaacauggugaaacucugucucuacuaaaaauacaaaaaguaggcaggugugguggugcacgccuguagucccagcugcuagggaggcuguggcaggagaaucgcuugaaccugggagguggagguugcagugagucaagacugugccauugcauuccagccugggcaacagagugagacuccaucucaaaaaaaaaagaaaaaagaaaaagcacuguccuuaguuuugcaguuuucuagucuuauuucugacuacaagggccuuggcaggcuuuacucacugaacuguacauauuuuauuccuguuugauguuuuaguuuuacuuuuuuguaaacacucaaaaauaauauauuaaaauaauuuauuuacuggcauaauuuauuaaaaucuccagguucucauguaguuuuuuguaucccauugguucuuuagugaggaucugugagagguagacucuuuuauccuuuuuuguaagucugaaaauguuuugcccucauacuuucauaacauuuuggcuggauauaaaauuuuucuuugucuuuuaguacuuggaaaguauuucuucauuuuuuucugaguuuuguugcugcugaugagaagucugcaagagucuaacugaauauucucuuuuaauccuuaauguuucugcaguuuucuuuaccccguguggauuugucuuuauuuaauccugcuuuguucucagagugcacuuucuauuugaggguuuauagcuuuccuuaaugcuagaaaaaaccucagcaauuuucccuuuaguuauugcuucuaggauauucuuucauugucuucuucuggaacuccuauuaauugaauguuggguagaaugaccacauaacuuauuguuccaacuauggaacuuuugugagugaaggagcacuguccagaugaggugccaggacacagugaaucuggaacuguccugggcacacuggacaugugguuauuucauauguuggggcuucucauucucuucucguugucuccuaaugacucugucaucuauguuaucuuuuugccuuucugaacuacauuaugggcaguaucucuguaucuauucuaaagauuuugucaucuguggcaucuuaaauauuucaagaaaaaauacuuuuuccuuauccuccagauaugguauuauuucugccuuuuuaguuuagcaaauuuuuuauuuuuuuggaagagucuucauauaucacugaacauuuucccuuacuuuagagcuuguuaucuggacauuaauuuuuaucuagagugaguuucuguuucguuuuuggauuucguuagcucucuuucuuacccuuagacauauucacgcauacuuggguuuuaaugugcaggcucucuuugagcgagagcuuuguuuuuguguuucuuuuuccuucucucucucccuaucuaugaguuucacuuuugccucuaaaugacacuuggaacccugaguacagaaccaggucuuauuucuucacaguuacuggccccuggagagauacuggggguauggcagguuuggcuagggagcacacggguagccuaacuuaguuacuuaucagggaauuuguggaugugcuucuuuugccccaggucugcaucuccuggaaaagccauagcugcaggaaguaaguugacgcauuuugucuugcagcaucaucugcaagacagaugggagagcaucaucuuaguuuuuggccuuaaguagugaggcuggccgaggccccaucccucauugaguccuguccauccucuauauuccaccagagccaaccuccccacggucacugccucuuuccagcccggaacccuggcuaggcuguccuugaguuucucuccauuucuacuucauggagaugcuuaccuuguauuugagcauucucauguccuuuaucucccauccaugauugugaugaguuuggcaaaaagaagcuuuuuugaaguaugaacucacuaugcuacauugauuuacaaguucugcggcaauuuagcaauuuuugaggaggcauacaugaggauaguacuaaaaacccuuacuugucuaaaaugucuuucucuuaugcccacacacgaacgcuagcuuggucuucugggaucagaaucccuuucugucacgcucuacagaggcugcuccauuggcuucuuugguuucaguuuuuagaggagaguucugcugcgaauccgauuuuccuuuccaacuaacaacuuguauuuguuuugaugcugacaggauuucucuuuuauucuugaaauucacaaauuguauguuuagaugcagguggauuuccccccauuaauccugucaggcaccuagagaaucucuugaagaugaaaaaaaaaagccuauucuuaagguuaaaggagugcuuugcuuuaauuucccauaucuacacaguauucacgugccguaucuagguaguaagcaucucugagcggagugacucucuggaaauuacuuagccucucccuaccuugguuuccuuaucuacaauauggaaagaauaauaaucguagggucugccucacagaauuaaugugaacaugaacugguaaucuauggaaaguggcuggcauacauuaaaacauucaauaaauguuacuuauucuuaccuuuucucuaaguauuuucucucucuuuguauuuugcaccugaaauuuuggagaauaccuucagcugauucucuaauuugcuauauaagguaccaaaugaucuagugcacuguucacugccuuuauuauucaacuguuccuuuauacuuuaugaaaacucuuucuuauucucaaauuacacacuuugaaucaaugcccacacuaauuuuauugcaacaucuugaauuucacugggacacuaugaauugagggguuuuguuugcuugcuuucuuuuuguucaguccuuuccaauaauacguuuaucugggaaccauuggcccugagugcuaaaaguugggucuucacuuuugaacuguggccucuauguuucuugugauccccucccaccccccaucugcuuguauuuagaaauggagguguaaguuuucaguaaugacgguauuucuugcacucccagagaaaaagagaauggacaguuuacauuuauuauaauuuugccugggauagggguggagguuaagacagagggagcuaugcuagccagacuaauuugcagcucugcauguguccuucauaacuggacucaggcgucugugcugcugucugugcaugagugauauuguuuaacaacgcgguuuuuggaaagcauggaccagaaacuuccuguuuaaucuugugaaaauauagauaaagaagcauauaaaaguauaugcuggugaucucaucuuguaucuguugcagggcugggaacaaagaaugccuuuaguaaacauuguuaaagguuauuacugagaaagaacaacauuaaaauaguagaaaauguauaugagauuacuauuuuacuucuaagacuauugggucauuguauuuucuuaguucucugcaauuuaggguucuguuauaaguaauauucucuuuguguaauuuggccuuuuaaaaaugaucuuuauuguucggacugaauuuuguagcauaauaaacuaacaaugaaauuuuaggguaagguucaucagcuaaauguccaucucauugcagccuuuaugggcgaaagcagucagaagauauuauuuccuuuauaaaaagugaaguacaucuugcaauuccuaaugugguaaguauuauuaaauacacugauaauuugauaaggugcuuaagaaguauaguacuagaacugagcuuucauuuagguaacauuuugguccuaugucuuuuuucacuuucccucacuauuuaacaaauuggaaaugucauuuauaucuguuaugaaaaagcuacuucugggaugggugcaguggcucacgccuguaaucccaacacuuugggaggccaaggcggguggagcaccugacgucaggaguuugagaccauccuggccaacauggugaaaccccgucuccacuaaaaauacaaaaauuagccaguuguggugguaggugccuguagucccagcuacuugggaggcugaggcaggagaauugcuugaaccugggagguggagguugcagugagcugagaucaugccacugcacuccagccugggcgacagagcaagacucugucaaaaaaaaaaaaguuacuucuguauuagcucaugauguauugaaggacucgugaaagaauugaguuaggcaucuguucugccagcaguuagcaagcacccuacaaauugccuugcuuuuucuuacuucagacauuaaauuaucuaaauaaaaucaucacaguuguccagaucccuaccucaaacacaugacugugaggcaacgcacuaagguaaggauggcagaagagaaagacaaaaagagccugugcccugagcaucugaaucacccgugucuucccauggcacuuaucuuuacaacuaccccagcugcugaugggcaucuggaacuccaagccacaugggauggcugagcugcauucugcgaugggucaaaggauaaggccaggcagaaacgguccgugacucaccuaaaaccaccuuuacauggucugaccuccugaaggauaccuucuuagcuuauuuggcacauuucaaagaacugaggucagaaucuuggugguguagcuucuucaguuacuuuguuucauagaucucuaacacauagucuguaauuucccacugcauucugccacccucauggggaaaaggaugacaaguacuaguuugaccuuuuuaacaaaaucaaaaugucauuucuaucuguuauuaaaaaguuacguccgcauuagcucgugguguaaugaggcuugcaggaaucgauagcgggaaaacuucaggauagagaaaaucugcauccuccccaucuuccucuaucauucucccccucaaaucagccuugcacugggccagccgaggcuugccccacucaguggggaauggagguggugaaaauugagggauggacuguaugugccggcaguauuacacauuuguuucuucuuuccacaggugaugauuccuaguuuggaugacauucaacaagccauuaaccguaugauccaguuaacccuggaggucagcagaggaguggcucacugggggcaacagcaaauccgucccaucaagucugucauucccagccccaccacuacugacgugacccaucaaaacacaggaaaacugcugaagaaggaagaaaguaagaauguaaaauuagucaaugaucuuacugauccuuuuuggauuugauagcauauagauuuuuaaauuauuuuauauguuugauaccuuuugcauuuaaaaaauaguauguuucaucuuaaacauaacgugcaggcauuuuuuccuggcuuuggguggugggugaaaaggauuuuuaaaucacuuuucuacuaugaugaucuuaaguuaaaaauuaaaauaaaccuuagcacuaauuuuacuuucugcaugauaguagguuggauaaacuuaagguaaacauaaauucgucacuuaaguaguuaugaauaugauaugauagugacccaaaauguuaugaacauuuuuuugacacuuccuguauagaaagaaacugguuucuuuuuuauuuuauuuuauuuuguuuuauuuuauuuuauuuuauuuuauuuuaguucuaggguacaugugcaggauguguagguuuguuacauagguaaacaugugccauggugguuugcugcaccuaucaacccaucacauagguguuaagcaagcaugcauuagcuauuuuuccugaugcucucccucccuucacccccaucccccaccaacaggcuccaguauguguuguuccccucccuaugucaauguguucacauuguucagcucccacuuacaagugagaacauguaguguuugguuuucuguuccugcauuaguuugccaaggauaauggcuuccggcuccaucuauguccuugcaaaggacaugaacucauucuuuuuuuauggcugcauaauauuccaugguguauauguaccacauuuucuuuaugcaguuuaccauugaugggcauuuggguugauuccaugucugcuauugugaauagugcugcaaugaacauaggcgugcauguauccuuauaauagaaugauuuauauuccuucggguauauacccaguaauggaauugcugggucaaaugguauuucugguucuaggucuuugaggaauugccacacugucuucuacaauggucgaacuaauuuacauucccaccaacaguguaaaagcauuccuauuucuccacagccuugccagcaucuuuuguuucuugacuuuuuaauaauugccauucugucuggcaugagaugguaucucacugugguuuugauuugcauuucuguaaugaucacugauguugagcuuuuuuuuauauauguuuuuuggccacaugagugucuucuuuugcaaagugucuauucauguccuuuguccauuuucugaugggguugagaaacuggucucuucaacuggucucuuuaacuuuuuaaugggguugagaaacuggucucaaaacuaugucacuuccacugugaugcagggaaaggcaaauugaaaauaacaagauaccagguaaggcccagugugguggcucacgucuguaaucccaacauuuugggaggccaaggcagguggaucaucuuaggucaggaguuugauaucauccuggccaacauggcaaaacacugucucuacugaaaauacaagaauauuagccgggcauggcggcacacaccuguaauccuagcuacuggggaggcugaggcaggagaaucacuugaaccagagacagagguugcagugagcugagauugcaccacugcacuacagccagagcaacagagggagacuccaucuccaaaaaacaaaaaacaaaaacacccccaagauaccagguaagcuacacaaccagguggcucagaccccuauggcaccuuucuauguugcacuaacauugcuuucucagcuuacaucuguggucucaugggguguucccuacaaccagcuaauaaaggaugaaaaaucucaggacuggucuaucugaauuggcuugauguguuggugucagcugaaaauggacuucuguuucacuacagcccacucaggaguggcccuaaaggagagugaaaaggggaauuccccccagagggcagagcuucaaguaguauaccuuuuuuauaaggagaguggucugaagcaaagauauacauggacucuugggcagugacgaauggcuggacugaucauucaggaccuagaaagagcaacuuuggaaaaucagaggcaagaagagcuagggaaaaagcauguggauguaucuaugaauuuacauaaaauaccugggaagauaaauauuaguuccuucaagggcugaucaugaucuugaaagacacaauccaaugccauaaucucaaauguugaaaucccaaaagaucaaaauccaaaaaauauaauucuggaaaaaauaauuauuauuuuaauaaacaguucuuuuaaauauauuuauuuacauuuuuaaagggggauuugauuuucagaauuuuagacauggauuuuauacuuucgggauuuagauuuuagggauuuugagcuuuugggauuucugagauuaugguguuugggauuguguuuucugagauuaugaaucaaacccaguucuuucuucagagagguuaaauaauuuuuccaaagucacaaaccuaauaagagggcugggaauuaauccauacaagaagaucaguaucuaauuuuuuuauguuuaguccaauguuugccauuauucuuuauucucucccuaguccauucuauauauuuuucuauuauuguagcaggcuaaacauaaaacuauaaauuguuagaugcaaaaaucuccuuggacuuaucaacaaucuugcaaauaagaauucuauuaucugcaaaauuaucaaccaaguacgauguaaauagacauuuucagacaugcagugucuuuuaaaauguaccaucaacacaugcuuuuccauaaaguuacugaagguuguagucuuccaaaauaagaaagcaaaagcaaaagcaaaaaaaaaaaaaaaagaagauaugggauauuggaaacaggaauaaaacacagcagacaggugaagggaauuucaaggugaauguugaagggugauugugcagugauaguuauguucuaagcauagagggcaaccagugugacuuaggaaacaggugaguuuugacugcucucaacaaaugcuggaugccguuauauauacugucuuuuaacuugaaggcagaaugccuggguaaaccuggucuguauucuugucuggacuuucuuauucucaccaugugcugaugaaguuguugcucuacacucauugcucugggucagcugaggaaacuuauucauuccucagaagcguucugccuugaccaacuacugagaacuggaggcagguaauugugauauaaggaaauagagauuagcucacuauccuggccauuuucuugcuggacauuuauuacucggcucacaaacacagugcugccagaugcccugauugucaugacacauauauuuucuaggacuuauuuaugauccugccccauagcuucccccacaaagggcuuuuguaaacuuguagaaaagaugaagccagaccagucccagagacucuuuucuuguaggagccuucgucucacaugaacaauuaauguucuuuccuuuauggcuaguuuugugcuuacugcucagcuuuuaaaagguguuuagggauacacauguugguuuauuguaaaguuuaucuucaaagaaaauucaggauaaugguugccucuggggguaagggcagggaaugggauuagagagguaccuagagaggacuaaucuauugguaacauucuauucuuaacuugguggugaguacauuggaauucauuuuucuucuuauuuaauauacauuuuaccuauuucuuguguuuuauauauguuucuguaaguauauuucacuuacccacacauagacuuaaauacagccuccuaucaaacuaggaauaagacagauuuuccaauaaugucaucuguaaaaauauuuagaaguauugcauuaucaauaaaaugaagaauaaagaaggaagcccacuauuaucauuuuuauuugauaguuuacuagagaucuucauuaugaaauaagacaagaaaaaaugagaagaauuggagaggaagacugagauuguccuuauuuaaagauuauauauagaaaauccaggaaaucuagaaauaauuguuacaaccaauaaguucaguaauguuuauguauaaaagaucaacauacaaaacccccaguauuuuuacauuuaccaguaauacaauuaauguauaauagaaacacagauuuuuuuuauuagccacaaaccauaagguauuuaacaaauaaauguaaaaaaaauuugcacagcauuuuuggagaaaauauuacugaaugagauaauggaagacaagaauaaguccacaucaugaagaagucaauucuuugauuaaucuauaaauguaauacaauuccaaagaaaucauaauagauuuuuuucuguugucaacuugauuuauaaauuugauuguaaaauuauauagaagugaaaagaguuaaaaauagcugagaaaaauugguguugaagaaaagcaagguaggggguccugcccugccaaauagcaaggaguguuacaaagccaggcuaaugaggaccgucuuuuagugauccaaagauagauaacauacagcagaacaggacagagggugcagaaauacucauguuuaugaaaauauaugguauagguggauuuacaaaucaguggagaaagaauguacuauuuaauaaauguggcuaaggauuuguuuccauguggaaaaaacuuacaguaguaucuugaauuagauacacaucauacccgcuauucuauauccuauaacacuauuccaucuauuuuacaacacuuuuagaauaaaacagcacaauauauuuaaaccaccaggguagggaaggauucucaagacauacaaagcucaaaccauagaagaaaagauguuuaaauuugacuucuuuauaucuaaaaacaucuuuaaaggacucuuaaauuuaaaugaccaugcugaaguccauaauaaaauguuagcaaacugaauccagcaguguauaaaaaguguuguauaguuugaccaaaugagguuuaucccauaaaagcaagguugguuuaacauccuaaaauacaccauaugaauagaauaaagggaaaaaacucaugauuaucucaauagacauagaaaaaauauuugacaaaauccaauacccuuucaugauaaacaugcucagcaaucugggaauagaauugaacuucuucaaccuuauaaaaggcaucauacuuaauguugaaagccugaauuuuuucccccuaagauuaggaacaagucaagaauacuagcucuuaccacaucuacucgacauuauaguggaaauucuaucaaguggauuaagauaagugaacuaaauugaagauacacagaugggaagggaaaaaguuaaaccaucuuuauuagcagaugauaugauuuuguauguaaaaauaaccuaaggaaucaacccucacacacacaaaaaaaccccauuagaacuaauaaaugaauucaguaagacugcaggauacaggauuaauauacagauaucaacuauauuucuaaauauuagcaaugaaccaucugaaaaugaaauaaaacaauuuaaugcacaaaagcaaggaagaauaaaauacauuuaacagaaguauaaggucuguacacugaaacugcaaaacauugcugaaaguuauucuaugaagagauacaucaugcucauggguuggaagaucuaauauuauuaaacuggcaguucuucccaaauugaucuacagauuuuauacaaucucuaucaaaaucccagaagacuuuuuuugcggaagaaauugauaagaugauccuaaaauuugaauagagaauaggggaauucaaaggaccuauaauggccaaaaaaauuuugaaaaagaacaaaacuggagaacuuaccacuacuugguuuuauuuauuuagagauggggucccacucuguugcccaggcuggagugagguggugcaaccucagcuuacugcagccucugccuucuuggcugaagcaauccuccccuuucagccuccaaguagaugggacuaccggcacgugccaccaugcucagcuaauuuuuguauuauuguggagauaggauuuugccauguugcccaggcuggucacgaaaucuuggacucaaacgaucuccccgccugggcuucccaaagugcugggauucuaggcaugaaccacugugcccagccagcuggagucaaaauuuaucuucaaaagauguauuuucaaguuagcccucauuauuagaacugaugcuuaguccacaugucuccugucagccuggccacaauucuuguauuuuggauucuuuuaucucuauuugaauaugcauauagugaauauacauauagugauacacaggccgauuccuccacuggccgucaaacagcuaaaacuauaggugaaauucucuuuuagguuacugugaggaggggcuuaucucuauuugaauaugcauauagugauucuucaccaagaaucuuugggaucuaauuucuucaaccaguuuauuuuagggucauuuuuagaguagguggaucugccuaguuuucaauuugacacccuagaaaaauaaaagcauuggugacuauugaagacuguaucaaacugaacagucuaagaaaacuacacaaauacuguaucaguaaaaauaccagguuuaacaagcaggaagccaagaugccagaugcugaauaucuacagcgcugaccuuuaaacaccccagcagagguugucucauuuaauucucacaaguauauccacgaagacuaaauacuuggcccagggucauuuggauaauaaauguaaugucucuccuugaaccacugcgcuauuccucaggguggaaauuucaacgcuuuuaaccuuuucuuaaaggacuuuaacauuuugggguguuuuaaucagugucuuucaguuauccucuccgaauaacaguucuucuagauuaaagaaaucuagagcucaaaaucugacaccauaguuuaaugagaauacaugaagauagcaagagaauagcucuuaauuacucaaaauagcucuuaguuucuuggagggagaaucuuuaagaaaauacaguuugaaaaagaaucacaaauauuaaaacugauaauauuuaaaguugaauauagaaguuauuuauaguguaaaaacaucuguuuucaggaucuuuugaagaagcuauuccugcgaggaagcugaagaauuuuuacccggggguagcggagcacaaggauauuucuaaguugguccugcuccuuucuuccucuguaaauucccuaagaaaggcagcucaugaggcccugcaggacuuucagaaguacaagacucucuggacagaggaccgcgaugugaaagugaaggugucuuucugcuacuugugauguuguuuggguuuuguuugucucuaauucuugaggguggaccaggaaaauaucagggauaaugacaggaacccaugagcagaggccaagaaucuauaaauaccaagcaccugucaccuucuagcugguguaauucucacauggacacacugaggcaauugauauuacugaggcucagacagauuuuguucaauuuccuuaaacaauugaguaccaauuaugugccaccacggacuagaggcuagguauucaagggugcgucacacuuauguagacccagcuguauuucgguuagagacgcaagggaacuuuagaacucugaauaaccaugcccugcagacugugaaauuccucgcuuccugguggacacccuauuucuuacccagccacuggccccauugcacacacaaguguaaauguguaugagcaaaugcaauuuucuaauguaacuaugguaagauuuauacuguuaaaaaauuaaaauauugacuauuuucuuaccacaggaauuuuuggcuaacaaccccucucugacugaaaucagaucagaaauucuacacuaugcuacuuuugaacaggagauugaugaguugaagccuauuauuguuguaggagcacuugaauuacauacagguauuuuaaaaauguuuauuauguaaaguaucuguacuuucacaugaaguguuacuuuauuuagcaagcaguuauuaaguuaucuugguacaauaguauuauaccaagauauaauaauaauaauauaccaagguuauaauaauaguauuauaccaagauauauuauaauauuauuauaccauuaaaaguaauggcaaaaacugcaauuacuuuugcaccaaccuaauauaaauguuaaauaguucugggccauugauauucuuuauacacacauccguagacacacuacacaggacgauuccuccacuggcagucaaacagcuaaaaguauaggugaaauucucuuuuagguuacuguaaggaggggcuuguauacaugagaugggacucaaacaguuugaagucugccaagaaguugauccauuugggauuagaguaucaaaggaugaggagacaaucauuaaugcuugaaauagaaagaugacuuuauugcuugcuguagugacagagagcuguacuggucaggcacaguguaccuggcagggcagacugcuagucucauacagggugucugggcagcauggaguugaaggacuguggacguagacagguugacaucaucuguagaaggaugcuuacucaggugagacuguuguaggcugauuggcacucagaggcggguuuauuggaguaagucuuucuugacuaguugacauucagaagaaagggccuggcacugauaggguuguacacauaugagaacugauguugacuuggucuaugguuuggguuuaaagcugguugugguggcucauuguuaccaugguuacauaacaaucagucuuauccuaaguuuguggaaagauuuuauucucagacaauauuugaaugagguauuuuacauccauuauccaccuuaaguagauuuucaggucuguuaucaagaaguuaauguaacuguggcucuugaauuuggccacuuggguuacuugaccucuuuaaucuccauuuccucugcugaugaaaaugacaguauccaccucacgaaaugcuuuauaugagacgcuuagcauaguaccuggcguaugauugauguugaauaaauauuaaauauuauuauuauaucuaccaaggaaguacuugugauucucugaggaagaaucacaaguaccaaagaauuacaaguacuuaagggggacuauuuaccuggaaaucagaaacuaugcaucaguggcaauaauuacaagaacuucuguagcguuuuggaaacuguaucuauuauuuuuuaaaaguucacauuugucuccucauaaugguuagcacuaugauccacaauacaaaaagcaacuguaguauacagacagagugcgcuggggagcuuguuuuuggagaguggcaucuaaaaauggaagaggugaugguaguuauaaagagaggggagggugggcugaaucccuaaggccugagggaaaaggguccccuaggggaucucaugagauaugaucucacagccucaaucaccagacuggcugcaugguuguucuugggccacgcuuucuccucagcuccacaggccucuuaaguuuaaugguuggaaggcaagagcggugcagccauguuucaagcuuggcagaauuggggaguguagggguacugagagguaaaaggggaaggauugauaaggcagaguugacuaguuagagcuguuuuguuuucaagaaauagaaacacauuugagcuauguuaagggagaaaagguuuaucccagaauccagggugcaacugagccuucagaauagaccagaaucagggacaguauaggaagcugaggaaguucuuucucuaugccucucguuucuucuucccucugugcaugaguuuuucugcuucccagacuauguggcuccuccucaagccucauuucaaacucucaagaaaagacucugauugguccauaauauaggucauguugaccugggacaacuggcuagguccaggguccagggucaggguagacggauacucugaccauguggaugauguggugaguagaaaagcaagaaaccugugaagucauggcuugacacacaaaacaauagauuucacuccaccucaugggaucucucgagaaaaaugcgagaaugaaugagggccgcuaaugggauggucagaagaagugcaagggucacacagaacagugauagaacuaauuucaaaaaugcucccccaugggcuguggugucaaacucaugcacauuuccacggggauacaugcucugugggacaggaauuaagucuucaaaaucuaguaaccuuauagcacauguaauucauacuaaccacauuucaaguguucaaaagccacaugugguuagugacuacugaauuggacagagcaauuauagaugcccuuauaguuucagaaugccaguuauauucuaauuuaauuucuucuugucuucaucagagccgaugaaauuggccuuauccaucgaggccaaggcauggaagauguuacucugucgauaucugaaugaagaauacaaaaagaaaaugucauacaugauagcauuuauuaaugaauacuugaaaaaguuaucuagaccuauucgugauuuagaugaugucagauuugcaauggaagccuugucuugcauacgugauaaugaaauucaaauggacaugacuuugggaccaauugaaguaagaaaugauugcauuuuuuuuucuuggaaugcuuuuuuguuuuuuaaagaaauagagacacacuaagaaagugauucuuuaacauauucaucuauuauguagcacagucugccuauuucucgucucugauguugaugucuuugggagaauuuuggcaauuaucaacagugaacaguauacaaaagacacuguuguaauacaaaggaauguuaauauauuaauaaugcuauagugggguagguaguguuuaauuuuugauacuggcaccaacauuuuguggaaagaaauaauugucccuugucaugucaaucccaacauguuaggcaaguucucccaagaucuuuggcuugccuuagaaaccaauuauaggucucacucaugaacggugguguaccacaggcaguauggcagaaacaguucccucaggcuccauaguaaacuguuggaacuuacaucaaugaaaaauguuuuuaggaaacaguaugaguuuucuauugcugcuauaacaaaucaccaccaacuuaauggcuuaaaacaacacagaucguuuauuuuacaguucuagacaucagaaguccaaaaauggaucuaauggggcuaacaucaagaugucagcagggccauguugcuccuggaggcucuaggggagaauccauucccuccuuuuucuagcuucuaggggcugcccacgugucuuggcucaugguugguucccuucuagugaugccaucacuucuacccccauuucugucauugugucuucucucacaccuacuuuccugccacacucuuucucuuauguggacuuuugugauuacaucaggcccgccuguuaauccaggguaaucuccccauggcaagcuccuuaacauaaucauaucugcaaagucccuuuuaccauauaagguaauauguucacagacuuuggggaucaggacuuggauagccuuggugaguuugucuauuacuaauauuuagaauguuuuaggacuaauauuauuuagaauuucugauacauggugauaaaaaucaagcuuuugauucuuuuuauuauugguuuuguugucuauaaacaaugcacugccucauugccuacaauaucuggggaauugacaccacuacugccucuuuaugguacccaauauuuaugacuguuuuaugcuuucuugaacccauugagaguuuauacucuuugguagcuaaugaacuuuuuacuuuuacugcuuuaaaaaaaucgugguauuuggggauuuuggaugcugaccagccagacuucaagauauaauaaauuauuauaucaaauuuucccugacugcaaaagcuuaauucuuuaccaaacuuuuuuuuuuuuuuuuuuuuuuuuuuuuuuuuuuuuuuggugaagacaauuacuggucaucccuuggagccuggaucauucaaguuucuuuucuuuggaguaucucccacaucauuucauucuguuccuuguauagucaaccccuguuuuaauacagucuguaucuuacgugguguugacauagggucaaggaggaaaaagagacauauacaucuccaucagaaucaccuaggugcuuauuaaaugcagauuucagagccugugauccagaguuaguaucugguagucagaaucuaaaggugcuuuucauacacuuuuaauuuuggaaaccacuuuucuagaacaugcugucuucuucuaagacauaggaauguguuucuagaaggcgucuaaaucauuuggcaauggcuuucccuugugauauuucuaaacuccaccuucauccugcaggaagccuaugcuauuuuaaacagauuugaaguugaaguaaccaaagaagaaucagaagcaguugauaccuuaagauauucuuucaacaaauugcagagcaaagcuguaaguaugaauuuaacuacauuauuuuuucuuaagucacuaucuccagaaaaaaaagguauuuuauaccuuuuuaaagcuuaauauacagucaugugccacauaacaauguuucagucaacaacagacugcauauacaacggugaucucauaagauuauaauacuguauuuuuacugauccuuuucuauauuuagauacacaaaugcuuaccauugucuagaauugccuucagcauucaguauaguaacaugcuguagagguuuguagccuagcagcaauaggccauaccauauagccuagguguacaguaggcuaucccucuagguuuguguaaguacacucaaugauguucacacgacaaaaucaccuaaugacacauuucucagccuauuaccaucaucaagcaaugugagacuguaaauuauuuuaauggcuuuauugagauagaauacacauaccauaaaguuuaccauuuuaaagcauacaauucaguguuuuuuaguauauucacauuguugcuuaaccaccaucauugucuaauuuuaaaacauuaucaccccacaaaggaaaccccgugcccauuagcaaucacuccugauucucucucuugccccagcccuggcaaccacuaaucuacuuucuguuucuguggauuuuccuuuucuggacauuuaauguagacuaaaucauacaauauauggucuuucguaacuugauucuuucauuuaacauaauuuuucaaaguucauccauauuguccaugugcgaggacuucauuuuccuaaugccuaaugagauagagcauguuuucauguggccauuuuauuggucauuuguauaucuuauuuggagagaugugaauuuaaauccuuugcuugauuuuuaaaaauuuuguugucuuuuuacuuuugaguuguaagaauucuuuauauauuauggauacaaguuucuuaucagauaugugauuugcaaauguuuucucuucuguggguuaucuuuucgcuuuauugauggugucuuuugaugcacaaaguuuuuuacuuugaugaagucuaguuuaucuuuuuauuguuguuguuguugguguuuuugguauguuaucugggaaaccauugcccaaucuagaguuacaaagauuuacugccauguuuucuuaugagaguuuuauaacuuuagcacuuaaauuuugauuucugauacauuuugaguuaauuugugcauaugguauaaguuagggauucgacuucauauaaaagcauguagauaauccaguugcauugacauuguuuacugaaaaaacuauccuuucaccaacaaauugucuugguagccuugcugaaaaucaauugaucauagauguaagaguuuauuucagacucucaauuucuauucuuuuuaucuauaugccuauccuuaugccagcaccacacugucuugauuauaguagcuuugugcuaagcuuuaaaaagaaaauaguggcaaaaugcauguaacauaaaauuuaccuucuuaaccauuuuaguaguguuaaguauauucacauugcugugcaaccaaucuccagaacuugcaaaaaaucuugcaaaacuguuacucuauuuaaacaacaacucuccauuuuccccuaccauuucuagguugccuguucacucugcugauugugucuuuauaguccuuucuauuucuguuaggcugguagugauguccccuuuuucauuccuaauuuuaguaauuugcaucuucucuccuuuauucuuacuuaguuuagguaaagguagucaauuuugucagucuuuucaaauaaaaaacuuugguuuguugauuuucucuauuguuuuucuauucucucuaccauuuauuugugcucuaguuuuuaucauuucuuuucuucuugcucuggguuuaauuuguuccucuuuguuuaauuugcaaaguugagguuacugauuugagauuuuuuuucuuuuaauguagaacuugauagcuacaaauuucucuaagcauuuuugaaguugauaaacauuuauacaccaaaauuagacauuaaaaaugaacuccaaggggccaggcaugguggcucaugccuguaaucccagcacuuugggaggcugagguggguggaucacaaguucaggaggucgagaccauccuggcuaacacagugaaacccugccucuacuaaaauuacaaaaaaaucagccaggcaugguggcaggcaccuguagucccagcuacuugggaggcugaggcaggagaaagacgugaacccaggaggcggaguuuccagugagccgagaucgcgccacugcacuccagccugggcaacagagcaagacucuaucucaaaaaaaaaaaaaaaaaaaaaaagaccuccaagggaugaccuacauccuuuaauuauacugaauuuuauagaauauuaauuaaauuggacauuggcuuuaacauuucuuauuuauggaaauauuugucacuuauacugaagcaagacauaacagcaaggagacacaaaacugaagcugaggucacagcuugugacuauagcuccacuaccagucaacuggaugauuuuaugcaaguuaauaacauuuguuucucaacuucuucuuggggucauuuaggaaggauaauuuuuuuaugugucuaugaggcuuacuugagguaauguauauaaaauacuuuuuugaaagaaauaaacucauguuuauuuaaauucauauucaauauuaacuaauagcuuacuccucuugcugguuagucagaggagcgagucuuagaaaagaaauaggaaaucucuguugagguuuagugaaacccaguuuucugcuauuauaucaauggaaaagauucauggcugagcaugguggcucacacuuguaaucccugcacuuugggaggcugagauggguggaucacuugagcccaggaguuccagaccagccugggcaacaugucaaaaccuugucucuacaaaaaauacaaaaauuagcuggaaauggcagcacacaccuguaguccuggcuauuugggaggcugaggugggaggaucacuugagccccagagguugagacugcagugaacugagauugugccacugcacuccagucuccagccuggugacagagugagacaccaucucaaaaaaaaaaaaaaaaaaaagaaaaaagaaagacucacuuagguuguuccucuaucucuuuaaugguuaguguuaaacccacuaacccauccuuuagcagaaauagauuguucuauacuacagucaccauuaaacuugagguaauauauguuccaaucuaaagauagcugcuauuguugagagcaguuaauagcaggggcccuggaacuacacagccagguuuugaaucuugacuuugccugaugcugguggugggacuuuggagaaguuacuuagccucucuguaccucaguuuucucaacuguaaaaugguaaucauauuagcauauuacaauuuucuucauaggguuguuacaaagauuaaaagaguuaacauauauaaagagcauggcagauagcaagcauuauuuaagugcuggcaauuauuauugaagguuuaagcagaguauuucaggaccauuguguaggguauuugcuauuuuuuuuuaauaccuagaguaauaucacuuucuuuuaggaauuugcuccaaugacugcaggcaugugaccuuauuagagauugcuaaucccaagucuuggccuagccccacagacaacaugugacccagaccaugccaauaauaguaucugucucccaugucacagugauggccugaacuggaucaaccagaaacaguuacagagaaauuggcuuugccucuugagucaggcuagaaugauuugagucuccuguagguucauuuggguuauuaauauauuuuauuacaagcaaacagagacuuccuuguucauauaggauaucugugagauacacuuguuggaauagaauuguaauuuuuguuuuuaauauguuacuuucacucucagguugaauauucuuuuuuauuguagguuucaguacaagaggaccuaguucaagugcagccaaaguuuaaaagcaaucuacuugagucuguggaaguuuuucgugaggacgugauaaacuuugcagaagcauaugaauugguaauuuaaguauuuucuugcuguauguugaaauguucugugauguguuuauaugaaaugaaagugaugaacccugaggaauagguacguugcauguauguggcuauauuugcguauuugcagcuaucagaaaaaggggauagcuaauccuuuaaaccagggauguccaaucuuuuggcuuccuuggccauauuggaaaaagaagaauuuuucugggccacacauaaaauacgcuaacacuaacgauagcugauuagcuuuuaaaaauugcagaaaaaucucauacuguuuuaagaaaguuuaugaauuuguguugggcugcauucaaagcuguccugggcuucauguggccugugggcuguggguugggcaagcuugcuuuaagcaaauuuuauagagaaagaaaacagauuuuacuguuaaaaggagcaacaacuuuggagauuguggaaggaacaaagggucugguuuugucuuuucucgggggcugaauucucaugguagaaaauguaauauaguuguuggaaggccgugagaaacuauaaacuucuaauaccaggauauuaugccauugauuuugcauucucacuaacucuuagagaaccaaaaaggucccuaagaauaaauaauagaugucauacugggucagucccguaugcuacucaaacugguauucugacugauaauguugaccuugaaguuaaacucaagacugaauauguuccccugaaauauucuuucuuuuaguggucacaguggaucuguauucauaagaugauuuaagcccuuggugcuacuuauauaaugcuuuuuuuuuuaacaugugcuaaacauaucuguugauuugcugccucauucuauuguuaaaguaaaucuaaaauggagaccaggucugaagagucccugaacagacacagccagucacuuauauaauguuuuuuuuuuaacauguacuaaacauaucuguugauuugcccccucauucuauuguuaaaguaaauuuaaaauggagaccaggucugaagaaucccugaacagacacagccagucaggcuucuuaaguuaccuugcccuuccacaauuugcagacauaagcaaaucugaacacacuauuucuuauaaaugccuauauuagaaacagcuuaacuaaucagaagccgcaaacaagcccauaauuauauaacuggggacuuuccagcagaauagaccaaagaagacaacuuuauaaaugaaaccaauaaaauguuuucuuugcauuacuucugugcucacucuguaaaagccuucugcaguggagacccugaaccaagucuaguugggaguuucccaauuuaugaauuacugugugcucagauaaacuuaaaaaaaaaauuauugggccucaguuuacuuuuuaaacacuauuauauugggaaucuagucuauuauuuaguauaucuaucauaucaugauugaccauguuaauauacuuaauagccuucauuuuuccauugggaguagccccuguuauuuuaauuuguugcuauaaauucauuuauuccuuugcuuauuuuggggaguguuuuugaggauuauuuugcaacuguguucugguucauagccaccagacacugcuuucugcuucuuccaaauauucaauuuacaugugucccuauuuccauauugggcugaacaguuauuaaaaagaggauguucucagaacucuguaucaguuauucuaaugcacaaacacagcaucaucauuuguaaucauaaaugaaauuuggcagagcccuugggguacacacuccauauagaauguaauuuugucacauuuuuuauuagcucugucaagguccuuuaaaaaugaauggaagauagagugaugaaaauguucuaaaugauuguggucaugguugcacaacccugugaauguacuaaaaaucauugacuuguacacuuuaaaugaaugaauuguauaguaugugaauuccaucucaauaaagcuguuagaaauaaauaaaagcuucaaguacaggacacaauuaaauaauuuaaauuaaaaaaaugcuuguuuacuuaaauggaaauaauagauaaacccaauaaacugacaaauacauaugauuaagaaugaaaauggagauuauauucuuccuuacaggaaggaccuaugguuccaaauauaccaccccaagaagcuagcaacaggcuacagauauuucaggugaaaccacauuuuuuuuguuacaucgacaauguguaauuuaaaaaauuauuuuggggaaagauggagguuuuacuuuuuaauagaaaaguuuguauuucaaguacaucaguccuuaauuguauucuaaucugcuaaaugaugcaauugacuccucugucucccuccaugcuccucuccacagaauagcucucuguauuuuuagagaauaagacugauucucaacuuaagaauauaacuuauuuuaguucuaagcauuucauuugauauguaaaguaauaagaaaucauaguauaguaaaauuuaucaaaauaauauuuuaaauauuggcaaauguuuucccucuguauucauuauuuugucuuccuuuugcauccaucucuuuaaguuucccuacuucuuuguccuaucuccucugccuguacaauacucauuggaucaggccaaccauucaccaucuuuuucuacacucggauugcugagcgcgucuagagaaaguucacacauccacauggauuaauacuuugcaaauucauggauuccuaugugaacuuccuccucaggagcaucaagcaauucucuucuuugcuccugcucuuuuuccuguuucccacaguggcugaauagugugauuaguucuuuucauguccccuuucccaccugcauucuuaguaaucaaaaaaaaaaaaaaaagaucagaugccuacuguguggcuugcucaggagaaauuugaugaagaagugguucuuaccucuaagcugcuaaaaucugauagagagauagcaagcuagagagaaaacugcaagugcgaugagagcugugaccuagguaugugaaauuguguaauggaaacagaugggcuguuagagcagauggagaaggcuuccugaaagaggaagaaucuaagcugcaucuugaaggacuaauuagaguuagccaggggaagacggaggggaaaaagaaaguuaggcagaauuugcagcucauacaaaggcccggcagagaggaaacuaguagggcaauauggggagauguaaggagugcaggguggggucguguaccuuugggaugcgguacuaaagaggauaguggugaggaacgaggugacagagugggcagcgagcaccaguggagggcccgguaggcaauaauaaggagucugaauucuaucuugaggguuggaggguucuaagcagggagugauaugaucauacuugaauuuuuaaaauaguugguuuuuuaaagauuuuuagugguacuaauguagagacugguuuggagagaggaagaucaaacugagggcaguuuugguaguaaaagcaagaaauuguaaagagggagaccaagcaagugacaccuguauaaugaagaaaauuggauggaucaugaauuuauuaacgaagcagaauugacgggccugaaaccugguuugagggaaaaaguuaaagguuuccaacuugggcauauugacgaagguagaacuacuuaucgaaggagggcauguaguaggaggaguagcuuuggggcuuguuugagcggaugaccuuguuuucaaguuugcagagaaaauuuagggcaugugauguaaaccaacugauuagucagcaacugggacauuaugugccaagauuuuacccaggggugugguugcuaauguagccagguauuguggcaugugccuguaaucccagcuacucaggaggcugaggcaggagaauugcuugaaccugggaggcgaagguugcagugagccaagauugcaccacugcacuccagccugggcaagagagcaagacuccaucucaaaaaaaaaaacaaaacaacaacaacaaaaaaacccaacaaaacaacaacaacaacaaaaaaaccaucucaaaaaaaaaaaaaaaggcaauguagggcacaucuuuugccuuucuguaccuucuguucugccugucucucgaggugugagccaaacaggcuguuuggcaugcacuucacugggauaugugacuugaggucagauuuguagacacaacccuuuucaaaaugagauguacuccaacccccuaaaaaaaacaggugccaaaggcuggaugugugaaggcagaggugccuuauauugggccuuggguccugauggugcucucucaugcaaauuuauuuuggggaguucuugggcacccugcuggccuguugacaaagcugauacuuuauuccuguucagcugaugcuguggguguuuuuauguuacuugcaaccugaaggaaaaaaaaggugagugauuagcauccaucaauagucuuuacacauugaugaguuuuuaaacaccauuauuuuaauguauucuaacuuuaguguuauuguuuauccuuccuuaguguucacauagucccacucuucauagugaagaguccuauggacucuucauucaguacauuuauugaauaaccaccaugccaaccaccaaggaauacacaaaguacaaaauauggcacuugcccucuaggaacuaagaguucauucgaguucaccugguaucuucaugccuuccugaucuggguccuguaaaauauacuaacguaucugucagaucuguauuuuugucuaagccuugugaggucugaugcuggauauucuccagggcugggaauuuaggguucucgggaauaugcuguaccacuuacacagagugcucauauguccucacagauggguuacuucuguuggcauuugugcuuugaacauugcuaauauuuagcaucccaaauauaggauauucaaaucccaauucaaaaggaaaaauuaaaagacaugugcauuaacuuuggugauuuaaguuguuagaauuauuucaaaugguguuaaaauuggaucuucuuuuuuauagacucuucauugcauguacagaaaacaggacugaauggauuagacuaacacuuugcucauuugagcccuguaggauagagauggccagucuaaauuacugaaaaauccugaauuguagaguuuuaaaaaugcagcuuuauuacuuuuagauguacuuaugggaacucgaaauauaggccuucuggagaagaagaagaaauaauuuuauauaaaaugaaugcuuuuagaaugcuugaaagcgaacuuuccuaaguguuuaacuuuuucucugauagcuugguaucaguauaaauuugcuucacaaauccuuauuuuauagcuauuacuuaauaaaccucaaccuagcuuuuaucccaaugaaaauaaauuccacuuuaauucuacugaauuaauuguauuuuaguacaauuuaaaaaccuuuguuacaggccaguuucgaugaucuguggaggaaauuuguuacguauucaucuggugaacaacuuuuuggauugccugugacugauuaugagguuuuacacaaaaccagguaaguuuagaaaauaagcaaguauuacaugcaaauaauuaaauacuaucuauuagaagaaucaugucaccauuaaauccuuuaucaugcagaggacacuacagcuuggagcacaacugaauauucuccuuauuccagcuauucuuuacaaauuggacacacagucuccuauacaaaagaaacguucuaggggaguaaaaaauauguugcuaaaauuuugagcaugcauggucuauauuuagccuaugcuuuacuuuuucuuuugacuguuuuugcauagugucagugauuaugcagaagcacagcaauuuugaguaacuuuuguuuauuuagaggaauaaccuuccuggcuccccuugccuucuuuuuuuuuugagacagagucucgcucuguugcccaggcuggagugcaguggcgcaaucucggcucacugcaagcucugccucccggauucaugcuauucuccugccucagccuuccgaauagcugggacuacaggcuccuaccaccauggccggcuaauuuuuuuguguuuuuaguagagacgggguuucaccauguuagccaggauggucucgaucuccugaccucgugauccgccugccucggccucccaaagugcugggauuacaggcgugagccaccacgccuggcuccccuugccuucuuacuccauuugugguaaaaugcucuuccccauuggguagacauagaauuuauugagauugacguccaaauaagcuaauugauuauaaaccacacauauaaacaaguguauuucaaucaaauuuuagaauauucuuaaagaauuugaaauauaacuuuccuuaaaagcaacauuaauacagugauaguauuagcucauuagagucuuggcuuuagaaaauaaguuuauguugacuuccuucaaagccacaacgugaaaauuucaugaaaauagacaugaaauuuucugaagagaaaugaaugcuucagccauuuaggguaggugguuuguauucucuuucuaaaacagucauucuccaaacguaauccauuagccaauuguguuagaauugcggaugucuggcccucauuucugauuuacugaaucagaaccucugggauugggucccagaaaaucugcauuuuacacacucuccaggugacugugaugcacacucagccugagauccaaugcguucacccucaggcuagcaggagaaaucaucaucaccauuuaccaucuggaccaacagaccauuuucauuuugauauuuuaaauuuuaugaauaauuuuagagaauggugagaauggugagaagcuuugaaguuuuuuuuuuguuuguuuuguuuuuuuuuugagacaggaucucacucuguugcuaguacuggaguguagugguggaaucacucgacuuccguaguucaagugauccuccugccucagccucccagguaguggggauuauaggugcauaccacugggcccagguaauuuuuaaaaaauuuuuuauacauacaggagucuccuuauguugcccaggcuggucuugaacuuuggggcucaagugauccucccaccucggccucccauuguguugagauuucaggugugagcacccgcacccaaccgagaagcacuuuuuuuuuuuuugagacggaguuucacucuuguugcccaggcuggagugcaaugacaugaucucggcucacagcaaccuccaccugcuggguucaagugauucgccugccucggccucccgaguagcugggauuauaggcaugugccaccaugcccggcuaauuuuauauuuuuaguagagacgggguuucaucauguuggucaggcuggucucaaacuccugaccucagaugaucugccugccuuggccucccaaagugcugggauuacaggugugggccaccauguccggugaagaagcacuuuuauuagaagauuuaauaauaauuuaagcagaguaaacucaaacuuuuauucuguaauauccuaguuugaagauguauauauacaaaauggggaccagcacugaaugagacuaacuccucaucggcugucaugugugaaccuggagcauauccaugcuguaaauauggauuucauauuuuaaaucaucuccaauggaucuguggcuuaucauuaauucugacuuuucuugcacuugcauugucaagacucaaagcuguugaaaacucggacagucaucauuuuuuuaagagaagacugucaucuguuuugcuucauaaauauugaagacuuuacuuuuagauuugaaugaucaauuccaagaaauuuuaaauuucuaaaucaucuauuuccuugaauacacaucugacuucaacauuuguccacuuaugaaauguaucaaauacaacuuauguaaauauaaauaaugaaggaacacugucacuuaucuuuuucacaaaauggaauaguuuagguucuuguugcaaaauauugcaugauaaggcccuuauuucuauugaagucuacggaaauauauuguuuacuuauaaauuacuggauuuuauaaaauucaucuagguuaugaucaucugaagacauaguaugagauuucacauauuaaucaauuucaccaucaaaagggaaugcugcuuucucuuuccuguuuaauacuugggaaacacauuucuuugucaauuuucuucucuuuacccuuuuagguagaaaaugaaaaauucugaauucuuaacuguauuaaaugaaagcaacuguauuaaacaagcaaaaaucaaaagacaacaaaaauggugucucuggcauucuuuuuauauacuuuuuugaaagauuuugcaauacuuuauguuauacaguaagaagccuggaggaugaugcaguagucauuuuuuuuucacuguugcauuacccuuuaggcaaugucaucauucucuuuucuuauuuuuuuuagucauuuuuagcauaguugagaauaauaauaagugguaaugaaauaauucuaagaaugaugaaaaaugaaucaagaauugaaaaaauaggacaacuaagaucgcagaaugugucuuagauuuguaaaaucuacuacgccuacaugguaauuacaagauagaaugggcugggugccguagcucaugccuauaaucccagcacuuagggaggcugaggcgggccgaucaccugagaucaggaguucaagaccagccuagcuaacaugaugagaccucaucucuacuaaaaauacaaaaauuagccgggcgugguggcaucugccuguaaucucagcuacucgggaggcugaggcaggggaauugcuugaacccaggaggcagagguuauggugagccgagaucgugccacugcacuccagccugggcaacagagugagauucucucucaaaaauaaaauaaaauaaaauaaaaagauagaacgacuuuuacuucauuacaaaauuuauuuuugguuuuugaaguaucucugaugaagaauaaaaguugugaaugucaauccuuauaaauaaacuugaaaacuaaaacugaauccaguagaaccuuauggcauacuaagggcugaggaauuucugggagaauccacaaauucuguugaguggucaauuugguguuuuacacauuuaagaauuuuccuuuacuuggaccuuuuauucuuguuuuaaacacaguaacuucaucugggcacaugugggauuuuuuuuuuuggauaggaucuuguucuguugcccaggcuggagugcaguggugcaaucauagcucacugcauccuugaacuccugggcucaagcaguccuuucacaucagccucccaaguagcugggacuacagucacaugccaccacaccuggccacaugagggaaaacuucugguaggaauaggguguuuaagcucaaucuuaaaggcagaucagggcuuagucaagggaaauguucucauaaaauccagcuuguauuugaaagaaaaaaaagucaaaugaaaccuuagccgcagcuaugaccuuaucauuaaguuuuggucacauuguuugcaaugauugguauaguaaguuucucauuaaaaaguagcaagauuuuuuuucuuuacagaauaaaccauuugcuaaugucaaguuauagucugacuuggaauauuugggagcaguaaacuuggccuuaaugacagaucuuuaacgaagucuuuguauugaaaauggauauaguuguaugcauuugguaucuauaagacauuguacacgcaauguaugaaauauuugauuggaugaacucugccuuuccaauaauggacuuuauuaaauauuauacaugaugugauaacuuaguuacuuuguuucccagaaaagaacucaacuugcugcagaagcuguauggauuguaugacaccguaaugagcaguauuagugguuauuaugaaauacuuuggggagauguagauauugaaaaaauuaaugcagaacugcuggaauuucaaaacaggugaguuucaauggaauuuuuuauaaugccugucuucuuaggauccuauagguauuucagaagcuaauuuauucccuaauauaauaguguauauacauaaaaccuuccucaaauaaaugugaagguggcauauuuuuuuucucuuucuuucugaaagaugucguaaacuuccaaaaggacuuaaagauuggcaagcuuuuuuggaucucaaaaagagaauugaugauuucagugagucauguccucuacuggaaaugaugaccaauaaggccaugaaacagagacacugggauagaaucuccgaguuaacuggaaccccauuugauguggaaucugauucuuuuugccuuagaaauaucauggaagcaccacuccuuaaacauaaggaugauauugagguacauaaguguauacguucuuaucaaugauccauuaaagaaugucugcuuuuucuuuucugggaguuguacagauauuuuaugagagguuggacuaauugcccucuauaaugcacccucaaaauuuggaaugauccugaacauucuugacuuuuaugaaauaaucuuguaacucaaugagauuauaugauuauuugaaauacauuauuugaaauacauuuguucuggaacccuucaauacaucuuccuuguccccagaaugcacuuccacuuaaaaaaaauuuguuuauuuauguauuguguucuuggugaaucccucugaacuauuuuccaaauuucuaauuuuaugcuuuuuccuguucagucuauuaaguuuuuagaauuuucuauuauuacauuuuuccuuuccaagauuuuuaauucauucuuuuuuguggccaaucuuuuuuuuucauuuuuucauuaaaaauuuucugucccuuuuguagauucuuagaucuacagucuuaaaucuauauauauucccagaucuguagguuucaaaucuauagauuuauagaugucuucgcuuaucucuuugagcauuuuaaacauaauuauuuaaacauuuuucauuagggaaaauuuuaaacacauacaaaaguaaagaucuccuugcucuagcauuuaucaacucauggccaauauuauuuuaucuauacuaucuuuaucuauacuucaacaacuccaaauuaaacauaaagauguuuucagauucuucuuuaagauuaauuucaccuggacugaauuuuugcugugauuguuuuuuauguuggcuauccucugagccuuagauuuuuuucauggguuuuguaauuuuuauugggguggcugggaggacucauuuugaaugggcaggauuucaaaaauucuggcuuauauaauguguuaaaauugucucuguccguuugugucuucguuuuccuugucuaguggcuuugugguugccuccuacacuguccauguccccucagccccaaguugagagccagguguuguaauagcggucuccuuccucuacugugcuguggugugaugauccaggaaugugcugaccuauuucagguccugguuguggggcugguuuugugucaccccaucccccagguccacaguuccauuaaaucuaguugccuagauggcagcuagaggcaguguuuucagccuccuuccaugaauggagggcuuuagaccccagcccagguacuccuuuuccuauagaucauuuuuacucuucuucaccccaugggaaccaaaggccuggccccaguguccaggccucaggccuguguuucagcuccaccaacugguuugcauagcuuuuccacuuuugguucauggauauguuugucuuuuuuuuaagucuggcucuguuugcuuuuuuacuuacuuuaaaaaaauuauuuuauccauuauucuauguuuuuggaguugagaaaaugcaccaugugaccagaaaucucccaaauauaugguuuggguuuucugccuuccccuaccucuuuuuaacaacaugugugcacaaaaagcuuuucuuucaaagcauuuuuguccuauuuguaaauaucacuaagaaacaaagagguagaaacacuuuggugaccaucuccuucuuauaaguagguuuuuauacuuaauaauauagccauucguaggcugugcuuuauuauacaauuucaaguaauuccaggcuucuguuaaugacucuugguacacaaaacagagucuugguacugucuaccccagauacaucuaguugcucagccacacaugcuguaccauuagccaaauuagauuccugcuguuacuggacucacugccucuaaaggaaggcuucccuucaguacagaauuuccucuuccucccagagagucucugcuggaaucucaccuccuccucuacgaagcuguuccuccucagcacagaccucccuccucagaaaucaccaugguucacaucauucuuaggacauuuauuacacaguaauuuguguuaagaucauuuguggaaacaucucacaccuuuaaauucuuuuucaucucugugauucuaacuaugaacacacauugaggcauuguggggaaaauauguuacuuuuauuuucuuucgugagucuuucuuauuaaguauucucaaaaaaaaaauauagaaaaacccauaagaaaaaaacaacugaugcuuaagcaaaugagauauucauauuaggaccagaacaggcagaaauauaguaauaucuauauguuacuugaaagaguucaaaagacucuuauguauauucucauuugaaucucauagcuaaucucugggauaaacagggcagcugugauuauccccauuuuagccaaaaguucgaauugaaaacauaaucugaaaaaugaugauuuaaguuccauuguuucauguaugugguacagaaaaauaauuaguagucggcgauuaguaaauaauuaguaaggcucuagugucaaguugcaacacaaugaucugaagccuuuucuuggcuguaaaaugacuaaaugaacugggugacuuacaggucccuuucaagcaaaaaaaaaauucuaugauuugaugaugcacuuaauuuguaguugaaaacaucaugacauauacuuugcuuuuccuucaaaggauauuugcauaucugccauuaaggagaaggauaucgaagccaagcugacucaggugauugagaauuggaccaaccaaaaucugaguuuugcagcauuuaagggaaaaggagagcuccugcucaaaggaaccgaaucgggagaaauuaucacuuugauggaggauaguuuaauggucuuagggucuuuacucagcaacagguaauuuuauaauuugagagagagauuuaaaugggauauuuaggguuauaaaauucuaaguaaaagcucaguuuuaaagcucuuucauuggauggauucugcacuaaauuugguauuaucuugucuguuccuauacaaacugcccguuuucccuaauaaucauggccuccaucucuucuuuaaugguacucaucuccccuucccuauuuuuccuggugggccccauccuaauuauuccuccccagacuggcaucuuguccucugaaggucuuggcuccccacugagaugaccucuucauuucaucuuuucucuccuuuguuccucugacaucauugaccucuuggcuaauccuguucaaacauucacccaauggcccgggaaaagccugcuggccacccgugagagcaaucuaccacuacagcaaucuacccauuaggggcuuggcacuuacuuagagacuuucauuuuuuauggugaaaagagccugagaccauuauggccugaaugaggucaccuguucaucauugaacuacgaaccagcuuggaggugccuaugaucuugagugcagcuuuaggaaauuccuguaggacucagauuaaauauucugucaggucuuuggcacuggcaaccucuauuccucuggccgacugugcaguaguucucaacuauucuucaccugaacacaccuaagaaauagcuaauaucccuuuuccacguugggaucacugguuagugaguugcaugcugcaugaccucuggcuccaggggcagucuuguauuugcauaaugacaaagcugccaguccagggaguucuggguugaauauauaaaggucaagguccucggaugcauccucuguguucagagaauccuggcaaagaugaccauaggauauucaguacuuccuagacuucaugggcaacugcugcccuaugguucauugcaaauuuugcccaucugacuuccuggaugaugaccucuugaugaagggcuguagauucaccugggcagugucugcagccaagaaauucaggauuugaaggcuuucuucaauucauacuuacuuggacauaaccugaugaguaaaauaccuauuuguguuauuaguaaacucaauguuuacaaacuucuaggcccugccagaaagaguauaaggauagcuaagaagucaucaaauucugggagauucucuuccuagagaacuuugcagugccaaguaggucuggaaagccuguuccagaacuaaccacagacugaccuaguagugagucauaccugcuggaucccuaggacuacuuugaugugacuucagaaggaagcuguaugucuccuucgguaagacuugacuguagguauugccuggauugugacacuucccugguggaucccugauuccaugggacuucaugggccaugguggguuugaccacacaaaguuguacaaugcagguaucuagccaaaggacagaaacuagcuaugcucgauuuuauuucagaucucccuuuuccaucuuuagaaguuauacaccaucaaggaugacucuuuuuuuucugugcagaacaauuuuggccuaucuaguugcuucaucucccuaaaugccugcccaugccauguugguuuacauguccuuauuuggaagauguuuuuggcauauugacugccuuucagcucucgaccaguggccagggaaacagcauaaacugaguauugggaaaaaugcuucuuacugccugaacaacuggauuaccuaccuccuuagagcaauuuauguacaacuccauuuauaacuucauguauaacauaggcuuucagggaaauuaugaguuguauucaggcaucagaccguacccagaaaaaaccccauucuacaugugaaucacucuguccuagaucagaagaaguuugaagauccuagucaacaagugccacucaccagcaaaugucacugcaccacauugaaacugcuugcccuugcuacacacugcagucggcuucuugcucuaacuguagguaguugggguuuuuacccaguagccucccauugcuuccuccauggcauccauucuauuucuuguccuccuuuguugugcucagcuuucuggaccccuuguauucucauaaacacuucagcaagcccugaugaucagaaaacaggagcccugcuauauggggguagcaacccugggucucuagcucugcagaaucuaguuguaguaccugguguaauucucucucugugggugggaagagcacaccuguaagugaacaucagacuucaagcuugacucuggcugugcggucaucuucuccaggugaaccuggugauaccuaacccucuccugaucuuuagggaucugauuuguccugucccuuuagagauagucugucucuugcuggaugaaaccuucaagaccauucauaaaaggaaaaucccuggauaguguucucuuuuccuagauucaguaguuccacagaccaguaacagugucucacauguuacucucacaagcagaccccacuuggauuugguucacagacuuuuuggaaaaccaucuuauuccuugcuuggcauuuacucccagaagcaaccagcacaguuccuuugcuggaccuaugcaccauaaaacuaggcccauucuccuauucuaugacugacacaugggaacaauaaguaaaaucacugcaguuauaugaguuuuauucaugaaaagcaacaguuuuuauuagcuguaugauaucuauuaggaacugcccuuuaaggacaaaacauucauucccaaaguaauauuucuucuggaauuuacuucgguaaggccauacuauuuucugaaucuucuuugaaaugugauuuuuuccguucuuaccuuuuagauacaaugcuccauuuaaaaaaaauauccagaauuggguguauaaauuguccacuuccucagauauaauugaagaguggcucguaguacagaaccuuuggguuuaucuugaagccgucuuuguagguggagauauugccaaacagcugccucagguaaauauggcuuuuguaauuacugauaaaauaauuugguguauguugucuauaugucucuguaaaagucuucacaaagacauauggucaaggcuugacuaugaugggguuuggcaaacuauggcccacuugccuguuuuuguaaauaaaguuuuauuggaacacaaccacauccauucuuuuauauauugucuguggcugcuguagcaccacaacagcagaguugaguaguuauaacugagauuauacggcccaaaaagucuaaaaucuuuacuaucuggcccuucacagaaaaaguuuuuuaggaagugcugaccucugauuagcagaaagaagaaacuuacauaguuuuaaacagugaauaaucucgagguuguuugaggaugugagguacauucaaaugcaguacuauuauaguaguucaugucuucuaagaguuaaccucauaauauuccucugagaauaauauuaaaauuaaucuauauucuguaagcacagaucaacuuuaguuaauuauuacuaagucuacuacuagcagaucagaacaugcuguggagcaagaaaacagccuugggaggcuguaacaaaaccuuuaaaacagcucuauuggggccuuuuaaauaaaugccaauaacuguaauaacugauagguuuagucgaugaagguaacuuugcuauuagaaaauuaagccugaucuuccuaaacuucuguauuuacaagcaagaucuauauagguuaaaaaucaaggauaaaagagguuuuuuuuuugcuuuuuuuuuuuuugaaaauggccgauuuccuuuguacuaauagcacauuuuuaaaacauuaaacugaaauguaucauuuuuguuuuuuaaucagaagucuguauuuuuaaaagaggaaagauuaugccaauugcuagaggcauuuuugcagcuaaguacaaagcuuaauaucauucauaguaaauagaaaauuuucacuugcgaaaauguaaaugaaacuuuguuuuguggcuuuacugucuuuuuucuuuuuuuccccgccuugggguacuauugagcuguaauuauuccaaggauccugagaucaaauuauuuucaugcuucuucaguuugcuccucaaaccaaaacaccuggggugcugaaacacuagauuggaacuuuaaguugauagcucugcaaauuaaucaugugguacuuugaaaaacauguuaaaugcaaugaaacaaauaagcaauaagccucauugugauaaagaagcauuuuaauaugcaguuuuauaacuuuggguuugugucgcucagaauuaauucaaaugaaaaaaaauugucuguuuaaauuaugcagccugagacuaauagaggcugguuugaagaacuauagaaaauuccaaggugaagacuuugcuuuuuuucaauuauccaaaugcuaaucuuuacuggcuauggaugcauuuucaggaagcaaaacguuuucagaauauugacaagucuuggauaaaaauaaugcagcgagcucaugagaaucccaaugugauuaauugcuguguuggagaugaaaccaugggacaacuuuuaccucauuuacaugagcaguuggaaguaugucagaagucacucacaggguaagaguuuaauuuuuaaaucacauaucauuuuguaugugacaguguuuuaucccaaacuuacuaguauugacuacauuucugguuugguagugaugguuaaaguggggcuaggaacuuaaaauuucacauagauugaacuuuucugugaggaagacaccuuugacuugggggugguuaaggcauuguauuaguuucgucaggcugcuauaacaaauuuccacagacaguuggcuuaaagcaacagaaauucauucucacaguuguggagacaagaagucugaaaucaagguguuggcucccucugaaggcucuaagagaggauccucccuugccucuuuuggcuucugguggcucuaggaguuucuugguucaugccuucauaacuccaaucucugucucugucuucacuuggccuucuucuccucuuccugugugucucuuaugacgacauuugucacuggauucagggcucuucaagauccuuaacuucacucccucugcaaaagcccuuuuuccaaauaaggucaugcuucaggauuucagggaauaggaccuggacaugucuuuuugagggcuaaaauucaagccacugcaggcguagaauagaaaugugcacuaagagaacaacucaccaaacucaaauaucauuuuuauuuuauuuuauuuuuacugucacaagaggauggugucaggauaauuuuuuuaaggcaguucauuuucaaucucuauuugaaauagggugauaauacauccugguuuguccaaguuuaugcgucuguccuggcuuaaugguuaguuguccucccuuucacucucaaaauguguugguuuggagauacgguuugugcucccccuggguuuaagccaugagcuuuccagcagucucagaaaggucauaggagggcaucugaugagaaaggagaggacagcagaugauggggcagccuugcucugaaucucuuguuuucccaagugucauccaugguggagcauggacuuugguuuucaccaaacauugcagggguaggugauaagugacuuuagguguuugcuauuaucuuagcaaagauguuagugauuaugucuugacuaaaaaaauaauaauuuaggggaaaaaaaaccacuugguaacauacugucgacuuuauuugaagguauuuggagaagaaacgauuacuguuuccaagauucuucuuuguaucugauccaguucuccuggaaauucuuggacaagccagugauucccacaccauacagguauaaucuaagaaucugugaucuaacuugcuuuucccacgacauacacaaugaagaauaaaagugaaguuaaaaucuuaaaaaugcaggcaggaaagaagaguauuacaaauuacauugaucauaaaauuucauauuuucuguguauuuggagccugucauccugaugcaguccagcaguguuaagugacuaugcacugacuaugccauuccuagcugugugaucuuggcaggcuuccuaauuuccccaucccucaauuccauaucuguaaaaucaggauauuaaugguucucaccucacaggacugucaugaggauuauaugagaucaugcauagcagagucucuagcacacaguauguguuuauuaaaucgaauuuaucauuaugaguauuuuauucuaaauauucuuagaccaaauagggauuauauuuuggauuuguccuuuuuuccuuccucaauacuucucaaaugcuuuuagccauuuccuagagcaauacuuuggaagaggaaaagaaaaaccguagcaaacugagagugggaggcacagaaggucccaucccagggccaauucuggucuggggaucugggaaacggcuaauguaguuuccuuguugguuuccagggacuuguaacaaugagaaaagagaauagaaaggcucugugaaagguggagguagagcuaggagagauggcaggacugagcuguaucugucgggggaggaggggggaggcggugugguccaguccccaucugguggaaggugacaguccuuagucuaaucugcauagcaugggaggggccauuugcaggacuuggagaaaacauuccucuggccuugauuuuaaaaaguagaccuccaagccaguuaagggucaaagcagagucucucucuauuuuuugagacaauaaaguaaauacuuaaccuuuuaaaaagauacaaaauauuaaggcuuuuaaaaacaucucagcggcuuuuguguccagccucaugugugacguuuuccucugucuuacagccgcaucucccugcaguaucugacaacaucaaugaggugacauuucaugcaaaagacuaugaucgcaucauggccgucauaucaagagaaggagaaaaaauuguuguaauuuaccuugcuuuaaauuuuuuuauuagaauuucuuuaaaaacuuagguugaggagaauacaguucucuuacagaaaaaaacaggaggagagggaguucucauucuacagcccugggcuuuguuaaaaacuaguuuagauaaauccuuuaacuucucugagacucauuuuguaauuuaugaagugaaaguuuuggacuaggugaucuguguaguuccuuccagcuauaguauuaggugauuuuacccauauuuaaaauauuuuguauaaaauaugaaacuguuugcuuggcauagggcacuaugauuuauuaagugugcauggaacgucuguaaaaaugccaaauuauuaucaauuuauaauauccuuguaauuuuguuuuaguuggauaauucuguuauggccaaagguccuguggagauuuggcuacuggauuuguuaaaaaugcagaugucaucauuacauaauauaauuagauccgcuuucuaucaaaucagugauucaggauuucaacucuuaccauuccucagccacuuuccagcacaggugagaauacacaaugcuuaaguaauggugaaaagaaauggaaauaaaggggaaggaugcuuagcaggugguugaccugauggugugaggcaauuguagcuuugaauuagguuagaguggccuacucacacucauuuuagccucagcucccaaccaccugcuugucaaccuacaccauucuagaccaacccaucccaugucccagaggaggauaugccacuauuuucccaucaugaaggauacauacauugagucuaauagauacauauguaagcguguguguguguguguauuuguauacagaaacuccucgacuuaugaugggauuaucucccaacaaacucaucauaguugaaaauaucauuaaccaaaaaugcauuuaaugcaucuaaccuaccaaucauaagcuuggucuaguaugucuuaaagaugcucagaacacuuacauuagccuacaguuaggcaaaaucuucuaacaccaagccuauuuuauaauaaaguguugauugucucauauaauuuauugacuacuacacugaaagugaaaaacagaaugguuguguggguacucaaaguacaguuucuacuaaaugcauauugcuuuugcacugucguaaaguaaaaaaaauuuuuaaguuguaccauugaaaguuggggaccaucuguguguaagugcacguguguguguguguauauauauauguauauauauacaccaauucauagauaugauguggauauagauauggauauauguaaagggaaugagcauaccuuuucuugaaaugaaauccaucuugucuuuaauuuucccuucaagcaauuaaaaauggacauaaauuguugagaggcuuuuucaugcaacuaauguuuagaaagugaagaccucaaagaggccaagauuggagcagguaccaaugguuucauuacacuuucauucaagagaaaugaaaagugaugauuugugaucuggccagagagagcaugggauaaaaggcaagagauauccaaggaaaacguaggcaauuuuugcccaaaugguauuucuucuccaacuacuccucccaaccugagcuccaaauccugaauuagugcacacaaaaugaagacagcugaaaugauguaucauuuauucaaaccacagaaggacagagauauaaucaaccuuuauuggagagaauaauauugugauuuuuauauuauauaauacccugggaaacuuuaguauucuuauuagcauuauuaccuuugugauaaagcuuauaaaauacuuuguuaaauugagaaaagaguuccugaaacuaaauccacguauuuucuuucuccagacccuguauauccugaaggagaggcuuggccuaaauuaggcugaggauuuagcauuaaguagagaguugagagcaaguuccaaacaguggugaaguugaacaggauguaguaggaaagaugacuaguuuucaggauuuucucuaguguauguguguauauauauaugaacauauauacacauauguauaaaauacuuuguauuuaauauauauacauauauacauaaauacaaaguauuuuuacaauguauauaauacauauuuuacaaaguauuuuauacaauguauauaauacuauauauauaauacaaaguauuauauacauauauacauauguguauauaugaauauauucacauaaguauauaugaauauauucauguauguguauauauacauguauacacauauauuaaauuuuuuaaggcauuuuuucaaaugacugaaaucucuaacuaucaaguuaauuuaacauuuuuaucugaaauuguuuaaaauuccacuucugcuuucuuuuaaaacauguuuuaauuguuugaaugccauggauccuugcugcaaaauuuuggaaaaugcaaaaaauauaaaaguggaauacauaggugauggguugauaggugcagcaaaccaccauggcacacguuuaccuauguaagaaaccugcacguucugcacguguauuccgaaacuuaaauaaaauaaaaauaaaauaaaaguggaaauaagaauuucccauauuucuaccaccuggaaauuaugacuauuaauauuuuaguguauucccuuccaauacguuauuuauguauuuauugcuguuuucuccuuuguucuuuuuuuaaauugacauauaacaauuguacauauuuauggggugcauagugauguuuugauguguauaauaugucuugugaucagaugagaguaauuagcauauccaucaucucaaacaucauuucuuuguguugggaacauucaauauccuccuucucgcuauuugaaacuauagguuauucuuaacuauaguuauccuacagugguauagaacaaggguccccaaccacccccacccggcccggccacaaaccgguaccgguucaugggcuauuagaaacugggucgcacagcaggagguaagcggcgggcaagugagcaugacugccugugcuccaccuccugucagaucaacggcggcaugagauucucagaggagggcgaacccuauugugaacugaacugugcauuugagggaucaagguugugcgcugcuuaugugaaucuaaagcauccugugacccccguccauggaaaaauugucuuccaugaaaccagucccuggugccaaaaaggcuggggaccacugguauagaucacuaacacuuaguccuccuaccuggcuauaauuuuguguccuuuagcaaauccaucccuauccucuucuccuuacccuucccagccucuaguauccuccauucugcuuucacuucucugaggucagcuuuauuuuaguuuccauguaugugugagaacauguggugccuucucauauuguuuaaugugcuuauuauaggcaucgaguaauauugaugagaaugagcauucuuguuuugcuguuuuguuuuuuaaugagacauccucugguuuucaccacuaagucgcaugccuuuuuagacugaguauaaaaacauaauuuuaagcuguucuuggugacucaagauaaugauuguaaagacuugccuuuggauagacauaauuaugcaguggcuuuuggggucugcuggucuauuugucuuuaagucaggcagccuuacacugcuaugcuuuuguaguuuuucucuuugucuuuccccccuuggaccaucaucugcugcugaccagaaucugcuugcucuuggggggcuuucugacacugcuuguuuucuccagaucccauugcucacuucagccaggugcuuucauuuaucuuuagcugcagcccucaggauuggccacugcucuagcaggaaaaguaucaaagucccugauaaggcagggacagaaagaggguuuuauucuuucuuuucucacuguugagcccaugccaagcaguauccacauacugccugccccgcuuucaguccucuuuuuugguccaaaugauguuggaucugucauucgacucuggaugaaugagagcuccugaagggacaacccuuucagugaaggggugaggguggggcaugcucagaccacuuuuauuaccuuuucuggggcagaaauuguagguuaaggugacauccucucacaguuucuuuaugacuucaucaggauacaaagaauacaagcuucuccccuucucauuuucugucucccucucucuucuauagauaaguauagagacagaaaaguagacguagauaaaaacguggauaucagagagagggagcaaucaagaaaggagauaggcaguguauuguuuuuagaagagcagagagaccuuugggaagcccuguucaagaacaagcagauaauaaagaguuccuuugcuuuucuugagaaagaaaaaucguugcauggaaguauccaauagucucaggcccucuguagaaaaauuuccuaaccaucuucuauaacacacauauaguucaacaaaugguagccaguauuuuaaucaucauuaaucuaucuacuuugaaauaauuaaauauuaacgguuaaaacuuuaacuguuucccuccuuugggagugaagaaaugcaagucaaucucauuuuuaguuuaaaaugugaauaagugaccaccaaauuuuauugcagaugugcuuuaaauauuuggcaaauuuuaauauuuuucugcuggaucuguagguuggacuucugggaauucagauguuguggacacacgauucagaagaggcuuuacguaaugcaaaagaugacaggaaaaucaugcaagugaccaaucagaaauuuuuggauauucuaaauacucucauuagucagacaacacaugaucuaagcaaguuugauagagugaaguucgagacucuaauuaccauccaugugcaucagagagauauuuuugaugacuugguaagguaucuuuuuuuuuaauuuaguguacuaacuaauaaugaacagcuaagaauuguauauguugccuaacuuacaugaacuuuccauuuacuugguccuuuuucauaacuguccaucaauaucguguccacaguauuguauuucuguauuggauggcuuaaacaaccauauuauauauucauuuggcacucugaaaguuuggaaccaacugaugugauaugagccagcuaauuguuccauuaaaccaaauaaccaggaacaugauauaauuuaggucauaagcuaugcugggucgauuggaaaaggagcacagauggaacggaaucaggcuucagagcacucucacggcuguucguccaguugauggugaucaugggcuugauuuaggcaaaguucuguagggugggacuaagaaggauaaguguuugaauuccuuuagaaaugggacucuaaccaguggccuugaccaaggccaacuucuccuaaagcaaggauuuuucuauuacaggugguuuugaaaugccacuauuugauaaucuuuaccucccauuuaacuccuauugcuuuagucuacuugauuugauacauuuuaaagguaucucuuuccuucaucagagacacauaauucaugcagguuggguccuguuuuagagaaugugaucacagacugccuguuuugaaguuuuaccaaaaguucugaucagauaguuuguauuuauugaagauuauuugaaggacauccagucaguccguccaucccccugcaacccagauccuugcuucucaaaguauuacaugcugaccagugcuuugguaucaccuggaaguuggugaaaagagcagaaucuccagccucccuccucccauccaagaccuacugaaucagaaucugcauuuuaucaagauucuuaggagauucauaugcauauugaaguuugaggaaaaacugcucuaggauuuaucucuggauuaagcuacuaucagaaagcugcacacuuauauuguuuuggccuuccacggacuagcuuuuacuaauugcaguuacuauuauacuuugacuuuaauugauguccaccucaagaagcacuaguauggaguucauuauuguaucugcugucagcauacguuugaggauguugucuauacgucucucacuggcuccuaaaacugaaguccugugaaagaaauuucuuuuaaaauuaagugcugagcaaacuuuacuuuacauccagagggauuaaaaaaaauaaaccuguacauaaggaaaacuaugaaaccauuuucuuuuaucuuaaucaccauugaacuguuugcaucccaacuaaaugagaugucauggccaacauauaugcauuuuauuuuuccauguacaauuauuagaacaaccugauauacagcaagaacucaauaaauauauuaacuauucuucuuuucuucuccaccuccuccuuaccaucuuaacagaugguugaaaguagcuggcugagagcauccccauggccuugaguccuguguuacagagcauucccuguggguggggccagacuguguuaccugaaaguaacucaagaugaugaauacaaacugugcuuuaggugggaagccaguccuuaacuagaggaggaagcaagaucauaaccaaacaacaaacaacaauagcaaaaagcaggacuguaaauagcaaggaauauggaggccuggucagauggagaucugaacauuguauaguagccacgaguccauuuuuuagugucaguugaaugaccuggaagugggccuacuggauuuaagagcagugaaggggaccacuugccacuuccuguguugauuccucugaaugggcaggacugguguuucaccaguuucacuggaaagucacgaagcuccucagaaugugguuaugauggaauggaauuccuaaguuugcuuaccugguuucugucucuuugaacagaccagguacuagagcuugcauccauggcuaugagagcccaguaccucuugccucacuuguauaugcugaugacuaggcagauugaguggcuuggcuauagugcuggugcagggagacaugggcauauauaaccauguguuucccugcuuaaucccuuuaguggcuuccgacugcuaugaagacaauuccuaaaccccuucccauggcccugugaacccucaacucucaugcuuucucuagaucccgggaugccccuagcuguacugaccuuuuuucaauuccuugaagaugccaaucagaucuucuagacauuugccuauagcacuuacucuucccacacccucaugaucccuuuuguuccccgcuccugguggcccuggcuaauuccuacuauuuaucuggguuuuaguugagauguuuucuuccucugagugccccucucagauauccuggaguaguuagguccuccugcuccauauauucaugagcccugaauuucggugguggugcccuuuguacuuuauugcaaugauuuguuucacuguuugccuuuugcccuuuucuguaagcucuggaagccuggaaccaucucugucuuuguuugccuagcacagugucaagcauaggaagaaacucaauaaauauuuguuaauaagaaucaguucaucaaagagugaauuuuaaaaacugcccacaugcuuauguuuuaugcuauugcaauucaguauauaauuuuuuuguauuuuauguuuuuaagguaaaaaugcauaucaaaucaccuacugacuuugaauggcuaaaacagaguagauuuuauuuuaaggaagauuuggaucaaacuguggugucuauuacagauguugauuuuauuuaccaaaaugaauuucugggauguacugaucgucuuguuaucacuccauuaacagauagguaggaaacccaguuuucguuuuuuauuuuguaauuuuaaaaugugcauaacauuauuuauaguugaauuugaaauauuaacaaaagcagauuucugucaugcuggguagaugcuagcucauuaaagucagccuaacaaugaaauaaccacuuaaauauacaugugcauugaauuuuuaugaaguagaaaaagauaaaagaauaaaagcaagcuugaauguugacugugagugauuuaauggugaauuuuagauugcaagauggaaaaauauuccuagaaucccaaaagaaguuaaaauugcaaagaaggaaggucccuuggagaucauuuaauuuagucuuuuuuucagauguggaaauuggcaccuaacguacauuuucauggccaauaugaauaauuagucaauggcagaucccgucacaauucuuuccauuauaugacacuaggcaauuacuaggucuuuuuuaucccaugacacccaguuaaguaugcugugcauagaaaacauucaauaaauguuguuagaauugacuuaaauugcguucuuuaauauuaagugcugcuguuacuuuaaguagggcugccuccaggugaaauuauaucaaaucacaucuucagccuccuuuugauuuauugaaccuaucccuuuuauaugcccagugccauagcaacauaaauuugucaguguuuucucuucuauugguguuuacauauuaagcaucgugucucaugaagcuuuacuaagaucuuuacuaaguuuuacuuagauccaaaacaaauacaacagaagcuggaucauggauacaaagagauuuauuauauuaguauucuuugcacuuuucuaaaugagcgaauuauuucauagugaaacuauuuauuuacaguggugugcuggagcugacuugcaucagccuguggugcuuaccugguuucuuuuuuuguuuugagacagagucuugcucugucgcccaggcuggagugcaguggcgcgaucuuggcucacugcaaccuccaccucuaccucacaaguagcugggacuacaggcgcaugccaccacgccuggcuaauuuuuguguuuuuuaaauagagacaggguuucaccguauuggccaggcuggucuugaacuccugaccucaugauccgcccaccucagcuucccaaaguguugggauuacaggcgugagccaccaugcccagccuuaccugguuucugucuaugugcauuuugccccgacuuugugauaucacauugguagcuugccauugaccacaguggaagaauuuauacaauagauauuggcaaacaugaaaaccagguuuuuuuuuuuuuuuucuggagagccaguuguuaaacauuugccagcacaauacugcucauuugguucuccugacuguaaugggaggaaggccugaggguuuuaagucaggguugaggaguuuugaaauuagucucaagaaaucuuugggcucacuguaguacuuuuaaugaauaucaaguacccuaaccuuguuuguucacuucuuuuaugugggcuacucagacucuaaaauaaauaggcccauuccaaucacauuggauuuuugcuugcgccauccuguaacgugucaucccauacucacaaugcuuuauuggaugaacauuugcagaugcuauaucacguuagcucaggccuugggcaugaacaugggaggugcucccgcaggaccugcuggcacuggcaaaacagaaaccacaaaagacaugggaagguguuugggaaaauauguggucguguucaauugcucagaucaaauggauuucagaggccuaggaaggauuuucaaaggcaagugucaaauaauguagauuauuuuaggugaauuuauuuuuauugccuuuuaauguuauuuucugauauaaauccaaagugacgugaucucauauaaucuacauuaguauggguugauccguaugauauugccauuuuucuaggucaaaaauggcuggauaucaacaguuucauaugguucaauacuauugcuaguguuauagucuaugcauggaauguguguuagauuacgaaaauggaaucaaucuauaauugccugaaauaauaguagagaggaucaaaauagcaaacaggggacacauguggcuucccucccacagaaaugaaagaauuuuagaaagcauagcaacacuggaaaauaagaaggggguggccaucagcagauggaaaauuuugagaaaauccugaaagguacguagaacauguuuucagauggacagagaaaaaaauauuugaagacacaucaaccucagagcucaguacuuggcgaucuucucuuuucuaucuacaugcauucucuuggugaucuuauguagguccaaacuuuaaaugccaucuguaugaugacuccagaauuauaucucuagcucggacuucuugaaacucuagauucauuacguacaacuguugauuuagcauguccacuuaaaugucuagcaggugcagauucacuauguuuaaaaccaaacucccggccgggcacggcucacgcuuguaaucccagcacuuugggaggccgaggcaggcggaucaugaggucgggaguucaaccauccuggccaacauggugaaaccccaucucuacuaaaaauacaaaaauuagcugggcaugguggugcgugccuguagucccagcuacucaggaggcugagcuagaauugcuugaacccgggaggcggagguugcagugagccgagaucuugccacugcacuccagccugggcuacagagcaagacucuaccaaaaaaaacaaaacaaaacaacaaaaacaaaaacaaaaaaccccaaaacuccugaucucuaggugcucagacacaacaacaacaacaacaacaacaacaaacaaaacaaccauccccaaacaacuucgaccuauccuuuacuccgcucuuucucuuauacucagauccaaucugucagcaaacacuguugguucuacuuucaaaauacccccaaaauuuguacuuucaucuuagcaguguacuguuuccauuguuuugaugaaaauauacaaauaauuaaaccucucuuuaucacuggaauuaaauauguauuuaucaacagccagauaugaaacuuuacauaaucccguuucaauguauaaugguuugggagcacuggagaaaugauuguuaucaagaagguauauuauagaguaaaacuuuacaaauuaacuguuuuucaugccaggucuugcacagucggguuccuggggcuguuuugaugaguuuaacagaauugaauugccuguauuaucaguggcagcacaacaaauuuauauuguuuugacagcaagaaaagaaagaaagaaacaguucauuuuuucugauggugauuguguugauuuaaauccagaauuuggaaucuucuuaacgauggugagaaaaaaggcuuuaaaugcaauuuaauuaguuuaauuguuacagacauaaauaaaacaaagcauguguuaauggguagaugaccaacuauccaggaguuauaagcuguucucucuuaccauaugauuuuuuuuaugucauuauaacccagacagaagauaaaauaguaauuuuuuucaauuaaaaaaaauucagauccagaccuacagagguaauaugcuaaggauaauaauagauacuguuuauugaccacauaguauaauauguguaaggugcaggcuaaauguucuaugugcuauaucagauggcauaacucaugugguucugcaguaacaaacaaucccuaaaucuuaauugcuuaaagccacaagguuuaucucucugucaugccacauguccacuguggguugacuaggguagaaguaggaggccagggcugcuuuguaugucuuuacucuaguacucggccugacgagguaccuacuaucucaaucauugcucuuugcuguagcaaaggaaaaagagaacaugaagaauugugcucugacucuuagaguuucuuuccagaagugacacaaguccuaagacauuggcuaaagcaaguuucacgaccuaacuucagggggugguggggugggggaaaacgugccauccuaucguguaacuagaaacaggaaggaccugaaauauucucucacauguacacuguaucuuauagcuaugauagcccucugaaguggauauuauauagcugacuuaccugaggcucagcgagacuuaaaaacuuccuaggucacccagccaguaagagaaagaagaaguuguugucucucuaacauaaaaaucugacugcuuaaccuccacacuugguuuuucuuugacaccgaauaaaaggaaauaaaaauaaaauuucugcaauaauuuaacaagguccuauacgaaagaauuguaacaaauucaguuaccaugugauuaagggugagcuuugagauucaguguuguaaagauaggaaaccaaaggcaugaauaaacgggaguuuuuaugcuuuuauguaucaccaguuuuaaagcuuuuauguguuuuccauaaaguuaaaucucgaaguugcaagauaacacaaagcacucugaguuuuuaaauguccccauggauaaagaugauaaauuauaggaagcaaaaucagaaauguuucugauacacuuuauuguaagcaaacauccaguaaagcaguuagggggaaauaagaauaaucugaaguauugauuauaagucaggaagugggaugaagaaauguacucaguguaaaacuguggucuagaauuuuacaaaaagcuuaacaugcucccuggauuaagaauaauauuggaaauagcaauuagauauugcauuaagcugugaguaacugaaaccuaaaaaaaauuguaguuuaacauguaaggauucucuuaagauccuuuuaugguucuacuccaucaugaauuccaucuucaaggucaccuuaugaaccaagaugcuacagaaagcaucucuauuguguugcagccaauugacugagucaacucucuucaaaaaaacaucaaggauauuuaguacagugugccccuuugcaucucgcaguguagaauauaaucacagcagcugcaaggcaggcugggaaauguaguuuuuaaucuagguguugcuguacccagcuugcaggugggcuccuguggcucaggaagguuaagaggaguauugagaggcagccucaauuucuguauuuccagccccuagcaagguaccuggccuauugacagugcccaguaaauggucagggacugaagguuuuuaacaaacuugccuaaaauaacucauuccuguuggccuuacuugucuuugaaucuccaaccuuccuuugagacuugggucugaccucuguucaaccuguugcuucuuaggaggacuucauuuccugucugucucuacuuuuguccauuucaguguuuuucccaucauucccuucuuuauuuccccucacugccaucuuuauuucuccucacuuccauggguuuuuguuagccaaagagcucuguaacuguggcugcaaagaauaauugaagagauggaauaaaaaaaaugcccaaggaagcucaucaguauaaaauccuuaguuuuuuucuucuuucaauaacauacuuuagaccauaauuaucagguaucuauucaguuuucucuuguauuauuucacguucuuuucuauuuuuaagccagcagacacaauuuucuauuuuuuaagucaguagacaauuuugccacacaaaauugugugugacuuuauuaauaucaugaaaauggaaauauauaaaagggcauauaaauauuaauauacauggucuaauacauauuguuuugagaaaacaagaguauuuuaugaaucuaauauuuucaauaccaucuuaaaaucugaauuagggguuugaaauauauuuguauucagaaaugaaaauuguuuuagcaauuaaaaauuaaacauauuuuaacuuuuagaacccuggauaugcugggcgccaggaacuaccagaaaaccuaaaaauccaguuuagaacuguugcuaugaugguuccugauagacagguaugcacuaggauuuaaaagcauaaugugcuuuauguucuuuacuuguuuuucacuaaaguugaaaaaaacucacuauauuaauuuucagaucauuaugagaguuaaacuugcaagcugugguuuucuugaaaauguuaucuuggcucaaaaauuuuacguucuuuacaaacucugugaagagcaacuuacuaaacagguaacuuuauagaucugcuuuccuccuagcaauaguauuugguuuuuuugcuuuguaauuuucccuugauaaauacucaucagugaguuaaaaucucauugacucuuuucuaaaaugcuuuuagaauuaauuuuaccuauugguuguguauuuuuaagacccuuuuauuuugaaauaauuguagauucacaggaaguugcaaaggaauguacagggaggcauguacccuucacccugccuugccuggugguugacaucuuguaacuguagcgcaauaacaaaacuggaaauggacacugaagcaguccacagaguuuaagguuucaucaguuauacaugcacugguguguguauauguguguguguguguguguguguguguaguuguauggaauauguaagauacggcucuguuccaucaccacaagguucccucaugcuacuuuauagccacacccaccucucucccaaaucccuaacccauuaaccuuuucuccaugucuagaauuuuauugcaagaauguuauguaaacggaaucacauaguauguaaccucuugguuaugcauuuaaaaaucuauuguuugggccgggugccguggcucacgucuguaaucccagcauucugggaggccgaggcgaguggaucaugaggucgggagaucgagaccauccuggcuaacauggugaaacccugucucuacuaaaaauacaaaaaaaaaaaaaaauuagccaggcgugguggcacgcgccuauaaucccagcuacuggggaggcugaggcaggagaauugcuugaacccgggagguggugguugcagugagccgaggucccgccacugcacuucagccuggaugacagagugagacuccaucucaaaaaaaaaaaaaaaaaaaacaaaaaagaaacuauuguuuguugcucagacuguaucagacuauauuauucucaaaagauauuuaaggugugaauacuuacuugaucuugcagcuuggauuuucccauggaaugaucauauuucagucaaaggaaaggcaggaaguugagcuaauaaaccuuuguggcuuagucaccccaaaacuaucccauauaaguaucagaaucgaccuauaugcauagagugagccgugagucuauguuuaguuuuucaauuaaaccaucuuuuugcccucuucucccaucucagguucauuaugacuuuggauugagaaauauucugucuguauugaggacucuuggaucucaaaaaagagccagaccagaagauagugaauuaagcauugucaugagaggacuaagagauaugaaccuuuccaaacugguaucuucucugaauucucuucuuuuccacaauuuuaauauuguuucuuucuauuugguggacaaguagagguaggcugauguugagcugugagcacccauaauuacagggauaauaagugugcaaagcuaccacugugcuuccagaagaaagcaaaagaccccaugaccugugugaccaacauggacuauaagugccuccuuuuaucagcugugugcagugaaacaggucaucagugggcuucagcuccaagacucaaccuaguugucuaccauuauucacaaagugacacaaauucucagcauaagaaucuggauucacagggaaccaugagaacuuuuugcuuucucuguaugugacuagcuuaucucagauauaucucucccaaaacauaaacaucauuucuauuuuccaaaaacacauugaaaauuugcuguggagagcaugcugcuuucaugcuugucaugguuacagccugauuuuuuuuuuuuucuuugaaacagacucucagucacccaggcuggagugcaguggugcaaucuuggcucacugcaaccuccucauuccaggcucaagcuauuucccugccccagccuccugaguagcugggacuacuggcacacaccaccaugccuggcuaauuuuuguacuguuuuguagagauaggguuuugccaugucacccaggcuggucucaaacuccuggacucaagugauccaccccaccucagccucccaaagugcugggauuacaggcauaagccaccaagcccagcccagcccagccagguuguuuugaauagcugauggacagguucaugugacauauaaggauuucuacaugccacauauugugcccaugccauggguguacaaaguugaagaagaagugguucaggaagcuacauucuaguuacaaaaacuaacaucuguggaguucauuaguguuacaaagucuuuucagguguaucgucuuauuugagccucacagcaacucuguggggucuggauggcuagcuuguuuauugucacuucacuuauuggggaauggagacuagagguugcaggauucccccauaaucaccaucagcugagaagaggggacaaaaauuuauaagauuuucuggugccaaauccacugcuccugccaguauaccucacugccuguaugaccaacauggacuguaauggaggcuuagacucccuaagucacccaggcuggagugcagucuaagccucccuuagauaaugguauuuuggaaauuccuagacaaguacucaagaaagcaucagcaaagcccuagagaauaaagagaaaucauaaggggucagauguugggaacagggcaaucuaugcauuaaagacauugcaagcaaggauuggagucaguguacucaaaccuacugcuuauaagaaaggcucagaacacugcccugauggacuuuugcagccauuguuggaugaagucaugcaggguuauggcuauuuccccaauuuaaauaaaauauccguucuuuaauuucaugggguugggacuacaaauuaucauuuuuaagguuaaugcaaaugccacugugagaagcaaagauucaugugauaaaguaaugaggucguacuuuggagcaguagacuggggcaggauuguagaacacauugaaugcuaacgaacuuuggguacaauauagauucaguggugauuguauuagucuguucucacacuguuaauaaagacaauuuauaaaggaaagagguuugaugaacucacaguuccacauggcuggggaggccucacaaucaugcugggaggugaaugaggagcaaagucacgucuuuacauggcggcaggcaagagagcaugugcaagggaacucccguuuacaaaaccaucagaucuugugagacuuauucacuaucauaagaacagcagggaaagacuugcccccaugauacaauuaccucucacugggucccucccacgacacgugggaguuaugggagcuacgauuccagaugagauuuggguagggacacagccaaaccauaucagugauauucuggagaaaguacuagagaauacaagccugauuaggagaguaauaaaugguucucuggggaugaagugauaaguacuaugcacaucccagcuagcugauaaauguuuguugacugaaugaguaaauuuauuuuaaacuaugccaccuuagguugaugaagaugaaccccuguuccucagcuuaaucaaugaccuguucccaggacugcaacuggauaguaauacuuaugcagaacugcaaaacgcaguagcccaucagguucagauagaggguuugauuaaccauccacccuggaaccugaaacucgugcagguaaagacauuuuaaucuauuauuaguauaaugauaaguauguguuaaacauuccugucugaauagaaaaacucauaguuagucuuacuugauguaaauguuaaaugaaaacaucauauauacaucauugcaaaaagaauacuuggaaggauguggugguccuaggaagauaguauggauuuacccugccucacaguaaucaagcaguaauuuacugcaguuuuuacuuauaccuggugacaauguugggcggaaauaguagguuauaaaaacucuaggggaacggaacaacgcagaugucuucuugugccaaucugauaguacuggcugcagcugggugccucaguggagugcagagccugaggaaucugggagugcuauuuugcuccugcuuuguguguggacauguuauauccuucaccuacacuaaaaccugaaucuuuugacugcauauguuggugucuuucuguucaucacauuucauccuugugacaaccaucuaaccacuugauuggauuaccaguagaaucaagaacuuguagcagagacacaggauuaaaucucuaugagcuugaugcuuugggaauauuuuccagagcuuuuggaaaauuaaggagcugaaauuguggacauuguugaaaacugcauuugaaauauuaauauaacgauucuuauuuuaacuuacuguucuugccagauuauaagaugugcaaguaucugagauacauccaaaucuuacaaagaaauaugugcaugggggaaaagucuuuuucaucauucauguacuggaaaccauuuuaagaguuuaaaaaauuucugggaaaacaugauuuuauauaugauaugcauacaguauacugaguuuuaaaauucuugccaucucaauggguggcgacuagaauuuuggguucuuuguugaugucaauaacauugcucuugaacaugucaggaacagugccucuguugcuuuuaaacuauaguuuacaaugguaauacauuucuguccaaaauguuaggagaauaacucacucucccucugaucagcugucagaccuuugacuucuuaauuuuuuuaaugagaaaacugcagacgggauguuauagcagcggcuguccaugauccuagcaugucuccucgaaucucuuguaccauuuccacgugccccugcccagcuucuguguguuuucgcuucuaauagcaaaaggaggccuggagccauuuuguuggcaggcacaaagaguaggugcugcacgggaguuuauuucccauccacccccaaacaaacgucucuaagaguugauggaguaggaaagucaagcuugccugguuccagguggagcaaucuuugagguguaaguuacacuccagucucccgagggaucaggcucaagucuguccucuacagggcuuuguccucaaucacaccuugcuuggcuucuucccauuccuguccugcuuuccucuucucuuacugguuucuccugggagcacuaccugaauaaaucacuugcacaggaauccucauucaugauguacuucuggggaauuagaaggccccuuugaaacggaucuucacugugaugcucugcguugcugcuuuccaccacuaaggggcgauaucaucacauuggaugccgagaaaguuugcgcauggaacaacugcugguuauagaccaacaagccaaaaucacagggaaucaucacgcaagaagcaaaaacuagaugcugaguuaauuauuuccaaaauguaauucaagcuccacauuguuauuacuuuagcacauaucguuuuauaacguggugcucauuugcuaugcacaucuaguaaaacaacauuuuuuacaacuuaaaaauagugaacuaguuacguuaaugaagagcuuauuaaagccuuuaaucuucaaguagcuacuaugaaugucagcaagagacucauaaauuacauauuuuaauuuacugguuaauuguguaguuauaugagacgucuuugguacggcauggcuugaugacucuugggcccagugguucuggaaagacaaccguuaucacgauucuaaugaaggcgcaaacagaaugcggaaggccucauagagaaaugcgaaugaauccaaaagccauuacugcaccucagauguuuggcagacuggacacugcuaccaaugacuggacagaugggauuuuuucuacucuguggagaaaaacauuaaaagcuaaaaaagguauacacaaaccuccuuugugaucauuuuuucccugcuagcguauuaacacaguauuuuuuugauuuuuccauuuuaauuacuugcaagugaaaagugauuuucuguuuuaauuauuuucaggugaaaacauuuuccucauuuuagaugguccuguggaugccaucuggauugagaacuuaaauuccguuuuggaugacaauaaaacucugacguuagcuaauggagaucgcauucccauggccccuaguuguaagcuucuguuugaaguccacaauaucgagaacgccucuccugccacgguuucuaggaugggcauggucuauaucagcagcucugcucucagcuggaggccaaucuuacagguggggcagagagaugggaagaagaacccucagagucucuccacguuucacuuucucaauaaacacagauucuguuucuuuguugcaggcaugguugaagaaacgcacugcacaggaagcugcuguauuccugacacuguaugagaaagucuuugaagauacauacacauauaugaagcuaaaucucaaucccaaaaugcagcucuuggagugcaacuauauugugcaaguaagauuuuuuuuuguacauuuacuacuucgauuuugauuuuuuuuucacucaguugcaguuuacagccaucugaaauagaaaguucagacaguccauaaaaaucauuugaugauguggcuguaaaagcucugauaauuuugauuucuauuaaagaucuucuuaaugaucuuacuguuuucucuauuauuuucacuucccagagggauguugucagaggaaggggaaugaacuaucuuucccauugucagguuuagugaccugucccauaaaguguguauaauaaugacagucaauaaaauauaguaauuaauuaaauuuuaaaauaaauaaaaaauaacacauacaccuacacacacacacacacacacacacacacacacacacacacaccccugcacuccagcuggggcgacagagugagacccugucucaaaauaaauaaauaaguaaauaaaaauaaauaaaguugguagcuucgugggaaagaacagaaaggggccuguugcaaucaagaaaacuugggaggcaauuuuggcuuuggaaauuuagcauauaacagguaaggaaaaucuuuaaauaaaaauuaucugacaaguaguuguagcauuguuuuuucccuuucuuccuuccuuuccucuuucuuucccuuuuucuuuucuuuucuuucuuucuuucuuucuuucuuucuuuuucuuucuuucuuucuuucuuucuuucucuuucuccuuccuuccuuccuccuucucucuuucuuucuuucucuuucuccuuccuuccuuccuccuucucucuuucuuucuuucucucucucuuucuuucucucuuucuuucuuucucucucgcucucucuuucuccccucccuccccuucccuucccuucccuucccuccccuucccuccccuccccuccccuccccuccccuccccuccccuucccuucccuucccucccucucucucucuucuuuucuuuuccuuucuuuucuuuccuuuucuuucuuuucuuucaacaaggucuugccuguugcccaggcuggaguguaguggugcaaucaaucauaacucacugcaaccuugaaguccugggcucgagcuguccuccugccuuagccuuugaaguuguuggggcuacaggcacacaccaccaugcccagcuaauuuuuagauuuuuuauagagacagggucucuguauguugcccaggcuggucuaggcuccuggacucaagcaguccuccugccucagccuccuaaagugcuaggauugcaggcaugagccaccaugcccagccagcauucuuuauuuccuacucgguuuuccuuauuagucuuugaguuaaaacagaauuaaucauagaucuucaagggcucuccuaauucugaucuauaggugaucucuccuuacacauucuagagcuucaauucucaguuaagagagucagucauuuguggguagguuagaaacaauauauaaggccgaaaucagugaauuauuuaguaauuacuuuaaaauggaucauagaagacaauauuuuauuuugaaguaauuuuguuuugaaagaccgaggauguccuacuguacuugucuuucugaugcuauagggcauuggcacacuuuuucuuaaagggccagguaguauuaauaaauauuuuaggcuuugcacaacucucugucucaaccacucagcuuugcuguuguagcacaaaagcagcuagagacaaugcauaggugaaugagugugacuguguguguguuccaguaaaacuuuauuuaccaaacagguggccagccucuagggccacaguuugcuaaguccugcaaaauuuuacaaagaaauagaaucuuugaucuggaaaauuuagauaacuuaacuuuagaaccaguagcuaccuuagcugcuuacaucgagucuaggccuuuugcuuucccaguaggaaauugagacucagagaggucagugggaugagcugaggguugaaaccacaggagcagauuuucaguucagcauccuuucugcuagaccaugcugccugucuaaaacaggauagccuuucuucuacgugcuguuggcuguaggacggugaucaagcaauagcuugagauauaucuauuuuucuucucucuuccuuccuccuuuuaauuuuacuauuauuuacaauuuuuuauuuucaaaauuuuaauuuaaaaauuuauuuuauuugaaacauuuucagucucucaaucuucuggaaggguuaauucccuccaaagaagaaggcgguguuuccugugucgaacaucuucauaaauuauuuguguuuggccuaauguggaguuuaggagcccuucuggaauuagaaagcagagaaaagcuugaagccuucuuacggcagcaugaaagcaaguuggacuuaccagaaauaccuaaaggcucaaaucaaaccauguaugaguuuuauguuacugauuaugguaagcccacugaacuauaccuuaaaugaaaugacuuuuuucaaaugagaaaauauaagcuuucauaaacucuucuaugagagaauauuaaaacaauuaugaaaacauaauuguuaauaccauuuugaaaagagcauguauuugaaagagaguggaauuuugcauaugaauugugcccgaaacugauauugagacucuugacuucuccuuuuggagugggcucaguaaaaucuggcauaaauaaguuaguaauaccuuguacaacaucuacuuucuaaugcuggaauaggaaagguagcagcguggagaacacagauucuucaugaugcaaagcaugcuaauacacauaacggaucagccccacaauuccccuguugggaaugccagaaugaguagagaaugaacguagcagauuccucaagguccagcgcugucaccuuagccccccagccuuccauguauggccgggcccagcucacugcuccuuaaaagaaaugccuuugaacuuggugcuuucauccagagcccaggcccugauucuucaaaguuccaaagaggaaaaauaugcuuccuaaaaacucuaauuaccucugguucuuccuaaaaacucaaaaacagcaauagucuuuuguuuguuuguuuuaaugaauaaacugaaggacaacuggagcaggagaguagacagcaauagccaaauuuugaaagcaagaaagcaguaagguaagcggcagucgauuuagcacacuggcagugggaagagcugagaaguaauugagaagcgcacgucacaggacauucaaagggcucaggaaguggaaacuggggcaaaaguugagcuaaaaaccacagggcugguuauaagucuguuugagaaaaagaccuccugggccgcuuuccaaagcccugcugccagacaaucggccuuccccacacuggcaagacuaaagaguuacuguuugaaucguguaaaauagaggguuuccuagacuuggggacaccaggcacauuuaagagugggagaaucauaccaaaacuggggauuaaguggaaauuuguguuugaaagggacugagauaaauaaauuuuuucagugggccaucuuuaaccagaaaggccaauaauuguauuacauguguuagaugcugcuaaagguuugagauggcaaaagggcacucuaacucaaaaugcaaacuaacaaaggaaucuuuaaaucuagauaugcacucccuuagaauccagagccaagcuccuccacagcgcugcuuucugagcagccggaguucuaugauguuuaaagguucagauugccucccucugagugccuuguccuuauucagaggccgggccccaaguuacucagagagugaaauucaucagcagcaauuuuccaaccauggcagagccuugguuaggggauugagauggcaucuaauaaggaagccaauaaaauaauuaccuuccucugugccaucaaaaauauguauugccacauuucuuaaagagcaguccagugauguuugugacauuuucuuccaaguagcuaggacugguucuguaaguuuagacaaugauguuuucuuauuuuuaauggagauguuaacaaaagguugacaacaaucuagacucauauuccuucuucaaggugguccugaaguggucuguugacuaaaauauugagggguugcaggcauucagucuugccauccuaaguaacuacuuuugacgaaauuuauuugcccgagccuuuguggccacgaaaugaacuaagauauuaugcacuuagugguuauuuagggcccuaacauguccacucagcugacuucuagccagcccuuucuuaacucauucuucauccauccuuuuaauuuuuuuauggacauuaacaucuuuggagaagacuucauucauagauuuaaaaugaaguaaggagacuuaugcuuccagcgaagauggaguaauggggacuggguuuaaccucuuauauuaaaaauauagaaaacuggacaaaauguguaagacgguuuuuuuucagagauuggacaauaggcacuacuggacugaaaucaccgagggaagugaaacaaggugauugcauuaguuuauugcauggaugcaguuucuagaagcagcucagggaggggaagaucaaauagaauuggcugucucaccaaaugagaaggcagagguugauuugggagaggccaagguggcuggaauuugcagggcagagcaccagagaggagaaaucugcacaaggaggaagugucagagaacaacagaaacagaaagacaaauccacaguuauacuaaaggugucaauauuuugaauaauugauagaacaaauagacaaaauuaguaaauauauggaagacuuuaacaacacuaucaauacccugaauucaaaauuauagaaugcuucagcccaaaacagcagaauauacauuuuuuuccagugcacggaaaacacuuaccaagauauucugggucauauaacaauucucgauagggagacuuuacagcacuuuaugucuuuacuagaaaagaagaaaggucucaaaacaaugauuucaacuucuuccuuaauaaguuaggaaaagaaaagcaaauuaaacccaaaguaagcagaagaaagaaccaugaucaaagcagaaaucaaugaaacaaaaaauagaacagcaacagaaaaaaaucaaugaaacaaaaagauggaucugaaaagaucaauaaaaagaauaaaucucuuauuagagacaucagaacaaaagagaagacauacauuaccauagucaaggaugaaagagagaacaucacuacaguccucacaaacauuagaaacaugacgugaguauauuagaaacaacuuugcaagaacacauuugacaaugaagaugaaauggacaaauuucuugaaagauauaaacuaccagccaucaucaagaagaacuagauauugcacagcaugcugaauauaguuaauaacuguguuguacauuucaaaauugcuaagagaguaaauuucaaauauuuucaacacaaaaaaaugauaagcauuugaggugauagauauguuaauucgcuuguaauaauuccacaugauacguuaauucgcuuguaauaauuccauauuguauccauaaaccauaacauuuuguuccccauaaauauauacaauuguaaauugucaauuuacaauaaaauuuaaaaagaagaaauagauauccuaaauagcccuauaucuacuaaagaaauugaauuuguaguuaaaaaccuucccacaaagaaaaacaccaggccaagaugauuuuauuggugaauucgacuaaauauuuaaggaagaaauaauaccaacuguacacaaacucuuccaaaagauauaaaauguacaauaggaagaaacacuucccagcccauuucauaaggacaguguuaugcucaugccaaaaccagagaaagacauuccaagaaaaaaacaaaaacaaaaaaaacuauagaccaauauuccucaggaacauugacgaaaauuucuuaauaaaauuauaacaaauccaauaguauacaaaaguccaacuguggcuuuuauucuagaaauggaagaucaacauucaaaaacugaucaauauaaucugccauauaagacuaaaaacuaagcaagccauaaacagucaucuaaaugaaugaagaaaagcauuuggcaaaauuugacacucuuuugugaugaaauaggaacuuuaucaucugacaacaucuacaaaauaccuacagcuaacguuauacggaaugguaaacaacuaaauacuuccuucccaauaucaagaacacaacaaggacgucuuucucaccucuauucaauuucauuucuauucaacauuguacuagagguucuagccagugcaguggggggcaaaucaaaugucuauagauuagaaaagaacaaguaaaauucucuuuauuugcagaugacaugaccaucuguggaaucuucaaaaaguuauuagaacuacuaaaggauuuuagcaaggucacaggacaaaagggccauacauuugauaaguuauauuucuauaugcucacaacaaacaguugaaaauugaauuuuaagaauaccaguuaaaauagaacgcaaggcugggugcaggggcucacaccuucacaccuguaaucccagcccuuugggaggccgaguggggcagcucaccugaggucaggaguucaagaccagccuggccaacauggugaaaccccguaucuacuaaaaaaaaacaaaaaaauuagccagguguugugguauaugcccguaagcacagcuacucaggaggcugaggcaugagaauagcuugaaucugggaggcggagguugcagugagcugagauugugccacugcacuccggccugggagacagagugagacucugucuuaaaaacacacaaacaaaaauagaauccaaaaaaagaauacuuaggaauaaauuuaauaaaauacguguaagaucuguauacuaaaacuguaaaacugcgcugagagaagcuauagaaggcccaaauaaggggacagaucuuauuuaaacauuauuuaaagauuauuuugcuauuugaaauagcaaaaucuagccagugcgauggggggaaaaaucucuuuugcuguuuaaaagucacuauuaagaaaaugaaaaacccagccacagacuguaaagaacuauuugaaacauauauaucugauaaaaaaaauuuauccagaauauguaaagaacuccuauaauccaauaacuaucaauaggcaaccaaucuaaauuuuaaaauggggaggaaauuucaguugauacuuugcuaaauaagauaagugaaaggugaaaaaagcaugugaaagauauuuaacaucauuggucgucagggaaaugcaaauuaaaacuccaauggggucugggugcaguggcucaugccuguaaucccaacacuuugggaggccaaggcgaguagaucacuugaagucagcacuucgagaccagccuggccaacauggugaaaccccgucucuacuaaaaauacaaaaaucagcugugcgugguggcgggugccuguaaucccagcuacucaggaggcugaggcaggaaaauugcuugaacccggagauggaggcugcagugagcugagaucgcaccacuacacuccagucugggccacagaggcagaccuugcuucaaaaaaaacaaaaacaaaaccccgcacaauggauaucaucacauagccacuggaaugucuacaguuaaaaagguuaauaaugccaaauauuggugccguaauagagcaccuagagcccucauaugcuacagaauggcacagccacuuuggaaaauaguuuggcaguguuuuagaaguuaaacauacucauuuuugcuuacuuucucaagaaaacaugaaauugggguuauuacuccaaugaugaguauuuguucaucauuguuucaccaauaucaauguaugcuuucuuuccaugcauucuguguacacaguaacuuuuggguauaauucugaaucauuguauaaucuuuuugaagacauuuaaaauagaggcuaaacguaucaaugaaaguaauucaauuugaauggcaaugauaggaauaacgccaauacaaguuugccuagcaacagcaaugguacaguaccacagguuguaaggaacauccagagaugcuaaaauguaaauaaauuuuugaaaucaauguuuuuuuuuuuuuuuuuugagacggaguuucgcucuuuguugcccacgcuggagugcaauggcgcgaucuuggcucaccacaaccuccgccucccggguucaagugauucuccugccucagccucccgaguagcugggauuacaggcaugcaccaccaggccuggcuaauuuuguauuuuuaguagagacaggguuucuccacguuggucaggcuggucgcgaacuuccaaccucagcugauccacccaccucagccucccaaagugcuggguuuacagacgucagccacugugcccggacuugaaaucaauuucuuauggcaaauacucuauaucuaguaaacgguugacucuuuuuuuggucuuuuccgucuuuucaguugauguggcuuuucugcuaggcauccauuacauuacugguuuuaccaccggcugauuuuaauuccauuucaggcaagguuucuccagaugggugaguuagcaauuuaaaagccaauuuacaaaaaauaacagaugcuggagagguuguggagaaaaggaaaugcuucuacacugcuagugggaauguaaauuagugcagccauuacggaaagcaguuuggugauuucucaaagaacuuaaacuuagaccuaccaucugacccaccaaucucauuauuggguauuauacucaaaggaacguauaucauucuaccauaaagacacaugcaugcauauguucauugcagcacuauucacaauagcaaagacauggaaucaacuuacaugcccaucaguguuagacuggauaaagaaaauuugguacacauauaccauggaauacuaugcagccauaaaaaauaugagauuauguccuuugaagaaacauggauggagcuggaagccauuauccuaagcagacuaacucaggaauagaaaaucaaauacugcguauuuucaauuauaagugggagcuaaauauugaguacacagggaugcaaagaaaggaacaacagacacuggggccuacuugaggguugggggugggagaagggugaggaucaaaacacuacuuauuggguacuaugcuuaucaccuggugaugaaauaaucuguacgacaaaccccuguauaucuaacagaccugcacauguaucccugaaccugaaaguuuuuuuaaaagcugacuuuauaaaaaaaggcaaaacaaauuaucaaaugcuguagacauaagauaagcagauauauuaacauguuuuaggaaaacauuuugaauguuuauacgauucuauugauuguuuauugcacuuaacauuuuuguauuaugagauaacuuucacagaauaugguucuauuaagaugaaauuuuacuuauuauauaggugauugggagcacuggaauaagaaacuucagccuuauuauuauccaacugacaguauuccggaauauucaucaauuuugguuccaaauguugacaauauuagaacaaauuuuuugauagacaccauugcaaaacaacauaaaguaaguuuaauagauaguuccuuaaaugaucacaaaccauccauggccacgggaauaugcacccauauuuucuuccagcacuuuuauaguacacauuuuacauuuaaaucuguaauacaacugggacuuauuuugaugguagaugcaauucuaaaaaguuauuaaaaauuaguuguauuaauuuauagaagacuagcccauagaaucauaagauauuugaaacuaaauaaguuguaacacauuucaacacuauuauccuaugauugcaggcuguuuugcucacaggagagcagggaacugcaaaaacugucaugguuaaggccuauuugaaaaaauaugauccugaaguacagcuauccaaaagucuaaacuuuucaucugccacagaaccaaugauguuucaggugaaauccaucauuugcuguaauauuauaaacauaauacauuuuaaauuagugguuacaauaaaauguguacgcauauaaaaugugaaaauauuauauauucaaaagaaaucaugcugcacuuggcauucagcuguuuagcuuuccuaaggcuaagguugaaggcaaauccaaauagcauacuuugaccuaauauugagacugcagcugaacuuuggagcauaucuacuguaauguaaaugaaggauaaaacuccaaugccuuauuuuuaaaaauuuaacaacauauauuuuaauaauuauauguauacuuauuaaaugcguaaguaaauuauauucuacucugacaagaaugcucauuauuuuuagaaguauggauuaaaaucuaaugcauaagacaaaacguuuccuucucucuagagaacaauugaaagcuacguggauaagcgaauuggaagcacauaugggccaccaggagggagaaaaaugacuguauuuauugaugauauuaauaugccugugauuaaugaguggggagaucagguauggcugaaauaucucauauagaugauccugaauuuguauuuuuauguauauauauuauauauauguaaauguuaauaacuuuguuaaaaacuuuauguuuuuaagucuacugccaauccucagucuuuuucugacuucucuguuauagcugaguuucuccuuucuuaaaucccuauguguuuuuuuguuuuuguuuuuuuauuaaacuuuaaguuuuaggguacaugugcacaacaugcagguuuguuacauauguauacaugugccauguuggugugcugcacccauuaacucgucauuuaacauuuugagacggagucuugcucucucacccaagcucgagugcaguggcaugaucucagcucacugcaagcuccaccucccgggcucaagcaauucucccuuccucagccaccugaguagcugggauaacaugugcccgccaccacgccuggcuaauuuuuguauuuuuaguagagacacgguuucaccauguuggccaggcuggucuugaacuccugaccucagaugauccgcccaccucggccucccaaagugcugggauuacaggcaugagccaucacaccugucuccuacgugguuuucuacagcaaaugccuccucucucuuuggcuacuugacuucaguguccuuucuuagcuccucucuucugccuuucugcaggguuacauccuugcucuaaccucuuauugugcauaauuucugaggaguacgugauguucaaaaaaacaaaaacaaaaaaugaaaaaccaaacaacuauuuauuuauuuauuuaacugugccacacaccgugguucuaguuguggucaucuauccacccaggucauuccccauuagaagacuucaccgguguugccagaaguccgcaugcuccuggugggauccccaacacuuuccucccaccgaccuacacugcuucauugacaccaucuacuuuggcucuaccaggacaagucccauuuugcucuuuaucccuauucgccucagacaccacuagaagcucaguacucauccuguggcgaaaaaccaaacaguucuguauggccugcgucugcuccaaggcagauagaccucagcaguuccuggaaggagaggagggugaaggcauguuuagaucagguucaugcuuaucuuccauaagcugaagcgcuccugaauuccgaacucacguauccaacuagggaugucugguuggaucgcaaacuuaacaccuccaacaccugcuccuccaacagucuucucucucucagcaaauagcaccuccacagucacucugucagaaaaucaaguuggcucuaucuucacacuguaucugaaauuugaccacuacucaucaccuccacugcuaccaccuggcgccacccaccaccagcucucuucuugaucauuacaaaugccuccucacugccuccugucucccuuacccuucucagcuuguucucacaucaucaacaaaugaaaacaagaguuagaucacgacacacucuucuggucaacauccuccaaagagacuuguagaauauaaauaccaaaauccuuaccaugauccaagacucuacacauuuugaccgccucucccucuucccgugacucuuugcuuccaccacauuuacugaucuuuguauacgcuggauaugguguucacucaguaccucugcauuugcaguuuccucugccuagagugcucuuccccuagguaucgaacuggcuuacuuucucaccuucuucaggucuuggcuuauauaucaugucaggugaagccuccccugcucuccuugagucacacccuugagccccuccuauauucuacaaaagucuuagaguauaccauuuuauuuacauaucaacaugcaucuguacaucuugucucucaccacuagaaugugugcuucaugaggacagaaaauuuugucuaugcuacaagagaggcuggcacacaguagucauucaugaaauguugguuaauugaaagacgguuauauuugaggugcuugugugauaugcacuaagagaugcucaauagagacuugaauauacagguguagagcuuagaagagaauuugaagcuagaguuauagauaugagauucuuuagaauauaggguugagauagcauuuccuggaacaaugagaagaggaaagagcccaggauggaacccuggagaacaguuacaugugagggaugaguggacaaugaguggcuuaggaagugaucccagagcccugagauggaccuggaaaaaaaacaagccucugaaaccaagagagguaacauuuccaaggagggggguuggcaguguuggaggaugcagagaagauaagaugagaacauaaaaccaacaaccaaaacaguuaguaauauaauauugaaaacucaggacagaaaccauccuacauucugaucuaaagguuuuuaaguguugaauauugaguaugaaagaugucuacaguaaaacuuguuguaacuuggaguauuaauguaauuuaaccaaauaucuuauaacucacauaucuaaauuuauuuggaaauuaguuugaucaauguggugaaaggcaccuuggacuuggaccaugcauguguuaugaucuagaguucaugggugacaucauuuaagucaaauuaccuugaaggugaucaucgacauucacaaacacuucauugauaagaguuuaauguuuucuucuaaucucauuuguacuauuuuauugaaguuauggaggaauaugauagugauauguuacaaaaauauugcugugugaaauuucagauaacuaaugagauugugcgacagaugauggaaauggaaggaauguacagcuuggacaagccuggagacuucacuacuauuguugaugugcagcucauagcagcaaugauccacccuggagguggucgaaaugauauuccacaacguuuaaaaagacaauuuacuguguuuaauuguacauugccuucaaaugcuucaauagacaaaauuuuugguaugaauauucuuagcguuuauuuuauugcauuacauaauggacauaaaccacacaaaauuucauuuaagagacaaaaaggcucugucuaaagugggguuagguaugugaaauggagagcuaaacacuaggaaagagggacuaaauacuaaggugaccuaugcuuauagccuauucucagacucagagauauuuaaaaauaggcuuguugaaaguuaacauuagacguaaaggaaccuugguguuuugguuuucaggacaugguuaaucagagaaauuugggccaauaaaugauagcacaaagaucacagauuaacgauauauuauacaaagucaaauguagcacuucaauauguuaaugaaaaugagauucuugacaucaaauguaacaucgaaucacauaaauuaugccaucaaaacuuauguguaggucagcccaugccuauaaucuuagcacuuuggaagaccaaggugagagaauugcuggaggccaggagaucaagagcagccugggcucauagagagaccccauuucuacaaaaaauuuaaaacauuagcugggcaugguggcacacgucuguaguccuagcugcguggaaggcugaggccagaggauugcuugagccuaggaggucaaggcugcagugagcuaugaucacauugcugcauucgagccuggguaacagaguaagaaccugucuaaaaaaccaaaaaacaaacccccaauccaccccaaaaccucuuacauacacgagaaacagacccuugcauauaagaacauuaauuauuugauauagcaaguacuguagucagaagggaaagggcagacuuuuuuuuuuuuuuuuuuuugagauggagugucacucuugucacccaggcuggagugcaguggcgcgaucucagcucacugcaaccgcugacuccuggguucaagcgauucuccugccucagccucccaauuagcugggauuacaggcgccugccaccacacccggcuaauuuuuuuguauuuuuaguagagacgggguuucaccacauugacaggguuggucucgaacuccugaccucaggugaucugccugccucgggcucccaaagugcugggauuacaggcaugagccaccgugcccauccgggaaagggcagacuuuuaauaaguaguucugggauacuuaguaauucuuauaggaaaauaauuaaauuuggacagcuaccucaugccaaugacaugaucaacuacagaugagauaaggaccuaaauauggaaggcaaggcuguaaaacauuuggaagaaaauguagagaaauaguugagugaccucugaguaggaaaggauuucauaaaugagacucagaaagcacaaaaauaaagaaaaaaaauaccaauuugacuagauugaaauguaaaauuucucuucauuaaaaaauaacauuaagagagugaaaagccucaaaguggaagaaaaaauuuuaacacauauaauaacaacaaaaaugucauauucugaauauuuagagaaauccuauaaaucagucagucaagaaaaggaaacaaccugauauaaaaaugggcaaacaacuaaggcacuuuaaaaagaggaagcuaaauagccaauaaacaaaguaaagaugguaaacaucaucaguauucuggaaaauacaaaugagaaacaccaagcgauaccauuucauacccacuagauuugcaaaaauaaaaaauucugacaaaaaucaagcauuagugagaaugugaagcaacugagacucucauugccugcuggccguagugucaguugcuacaaacccuuuggauaacaauuuugcaucccugcugguaaaguagggcgugugcccaucccuagcaguaccacuucuagguuuaugccaaauugucauuuuuuuccuuuaugguuuggguuuucugagucucaagaaguccuuuucuauccggacaucauacaaguauucuuuuauguuuucuuccagacauuguauaguuuugccuuccauaucuggggccucaauccaucuguaguugauuuugcacaugcaugccagcagacuuauacaaaaaugcucauagugcagcguacacaauggcaaaaacgugaaauaauccagauauuuaucacuaguaaaacuggauaaauacauccugucacaggcacacaguggccugcugugcagcagugaaaaugaaugaauauagcuacaugcuuucaccauggaugaagcccagaaauacaaugcugaauugaaagaagcaaaucacaggaaaaauauaauuccauuaaacugaauuucaaaaauuuuuuuuuuuuaccaguucagaaguucaaaaaccuaaguggugaagcuauaaagaaaagcaaguuacugauuauauuaaagagagguggcgaccucuggagaagggaggaauugugaacaaggaugaacguacaagggcuucuaaugugcugggcaagguuguaguuuucaaucugguggucuguacaugagcguuuguuauuuguuaagcuauuugacauacucuucaguaugacugacacauuuaaacaaauacggaaaacaaaccaaccagaaacugagccucagagaagugagauaacugcccaaucaaggccuuuuagcuagugcuuggcagauggguguugcuaaucccuaucucaugcuucuuauaacaugguugucccacaggaagguggaaaucuagaauauaggauuucaggaagcaaacggacuuuacaggcacuuagcacaaccaaccaugauuuggaggaaaauuucauguuuccccagggcaauucuucaauuagugugaacaaacuccaguuucuuuagucuccacucuucaucaaccuguucugcaucucugagcagauauucauauuccucugagaauaccaugcucagaacugaacacacucugcaguguguagucucacuggagugaagcagaguaaaucuuucuucggucuaaaucaaagacauucugagacuuugagaacagucucuaaaccuacaccccagucuuucugagagucauaaugauggucagaccaucacuuugcuggguguucccuaggaauguugcaugucuagcccaggccagaguggugacugacuguaggcuggaaaaagugguccugauuccaguucugccaauaccaguccaugugaccuugaacaaucggcuucaccugucugggccuggucuccuucucuguaagaugagggaguacucucuaagcucacauaugcuucagggugaaugcugauguacagacucuagggccagguugcuuggguucacaucucagauuugucugcaugcaagcuguguaacuuugagcaaguuacuaagcucauguuaaaaugggacuaguaauaauaauaccuaccuuguauuuuuuucuuguagggugcugggugggggauuaaaugagucaauacauauaaaacacuuaucacugcguacuaagcuuggcuggauccacuacugacucccagucuuagcugaucccuugagagaaauucugaacaacacccagcuuagucagccuuguaaugauuuguuuacugggauaaacauauacuuggaaaucuuuugguaagcuuauaccuucaaucuugcuuaucuuucaggaauuauuggauguggauacuuugauccuuguagaaguuucaagccucaaauaugugagaugauugugaauuuagucucaguggguagagugcuguggcaauggacuaagguacagaaugguuugucaauaauuuuuaaaaaggcaacuauuauucagcccuagaucacaccucguggcucauuaaguuaucauaauaucauauauagugguguuuuuuggaaaagacaaauuacgugcucaaauagauuuacaacaccuuuuccuuccagggagcaaaugaucugacuaaaugaugcuuuccguauguaugagauguuacuguaaaccagacaugacauccaagacaaaguagaauuuugcugaaaugagaacacugcauuuccacuuguuacucugauuuguaaaucuuuauuuguauuaucugucuccuucuaccaaacuaugucagacacucagaugcuuauugacugacuuaauacauggauuuccagauauucucagccaacuaggacuugaagucuaacuuguguauuucucugagcaggagcgugaguuaguaaauggauggaaauguucuuaacaaaaauuggcuagauuugcauacacaagucaguguccuaaguaaagcucagcaaaccugcagcuguccccagaugacuuagggcaguacucaugaaaaggcaauuaaguguagguaugagauaaaaaugagguugauauauuugacaaaaagccaugaaggagauaaggauuaguugucguaauucacuacacauccauuaggccaauuauacacaugugggcacgcacuugucuccugggaaaccugagugugccagccuuucagauuccuggguagacugggggauuucuagauacacaauuauuggaagaggaauuuggggguuucuuaugagaugcucuuccauguggccaccuucagugaugaguguggggcccuguuccuugccaacacagggccuuugcacaugccauugcaccucuuuuaaagaaacucagaaaugaguugcaaggacugagcgucugagauaguuuuccgugguaagauacaugugguuuccaauaggauuauugcucaauuuacugugcuuauauacauaguucucugaaaagcuuugcccuugcagcugucuuccaucaguuucuuuugguauuuggauguuuccuggcuccauuuccucagugucuuuucuuuaccucuuuaauccauucugcacaagcuuucauucccacuguucaugucaaggccaccaaagaccuugaucuugccacaucucaagguuaauuuuccucucccucuuacuugacuuuuuagcagcauuugaccuaaaugauccuuuagcagcauuugaccuaaaugaucccucuaaauauuuucuucacuuggcuucagaggguccccauagucuugauuuucuuccuagugcacuggcuaccucauuaaagucccccuucuucuuucccuccucuaaacacugaaaugcaccuggucucgaugccaggcccucuucucuaucuacauucuuucccuagguggccucaucaagcuucaaggcucuaaacaucaucccugugcugaugacuucaaaauggauaucuccaucccaggccucucuaccuggcuccaggccgauugcuaacuacuuaauagacaucaguguuugaugucugauacucaucucaaaguuaccauguccaaacagaacuccuaaaugucuuuaaauacaauccucucucagacuucugcaucuuaguagcagcaccaguuauccugcuucuuagguuaaaauuacugggcaccauccuugauuuaugucuuccucauggccuacaucgaguccaucagugaaucucagugaccuccccuucaaaaucuaccccaaagcugaaccuuccucaccauccccccgugaccacccugauaagugguccgaucaccuguccccuggaccaugcaguaacuuccuaaccaaucuccuugcuuucuucuugcucucuuggagucuguucuuuucacaguccuagaugauauuuuuuaaaaaguaaagcagaaaucuuuacuccuucuuaaaaccaccaguagacucccaguuccacuuacaaugucagcagacuccgcuuacuucccuugccugccaccaaccugcuccagccgauggcccugcucaccauuccuugaguaccccagguuuauugcguugcugggccaccauacguuggcucauucucaucacucuuaccuucagagcgacuguuccaaucauccucuaaagugacugcacuugucccuauccuagucauuaucugucuccuggcccugguuuuuuuuaaaccauggcuucuaucauuauuugcauauuuacauauauauuuguucccuguucauucucaggcucuccccacuggaauaaaagcccgcuugauggcagcagaguuagcuguccucuguuuaccacugugucuucuuaagaaccaaggaggugcucagucauugaaaaaugaaugaaucuuccuccucugcccaccucuacauaagcagccuucuuuguaucuuuucuucaaaucucccaucuucacaaagcacucuuuugauccauucaugccuugucuaucagcccaccuuuguauuacuuuauauagcuuuaaggcagaagcaguucagaaaagaaagaaggugaugaaaaguagagggaaauauuagaagagaaggaaagaagcagguuaacaaauaaugagaagaagaaggaaagaaaggaauuuuuuuuuacagaauucucuuuaaugacugccucaguuaccaauggcugccgucauggcuggaguguuauacuauaaaaaaagcaauauucacauaaccuuaccgcuuugaguauuuuuacauacuuguaauauaacuauauguuuuacauuuuaguggguaggaugaacauuuuaguuugcaauggaacugagcaaagagggaaguugauaggugauugauaaaauacacuucuuuuauuuucaucuccccaugcuacuugcuguuuuaaauagcacugugaauuagccuguaaaaauuacaaacucaauaggguaauuuuucaguauagaaagggcuuaauuuaugaacagaugcuaaagaaagcaucugcuuugcugaaauaggcguaugggguguuuguaucaccagaauuaucauuauuuucacuuucaaaaaugaugcuaaugauaucaauuaugaucuuuauacaugaccaucaaugcuuuccauaucuagaguaccucgagguuaucucuuaacggguaucucucuggguaagaaugugguauuguuacagcuuugccuuuuuauauccuagaaguugguagaaauaguaaauuagcauauaauacagucuuugugcucaaacagaaaaaacaucuauuacuauacguauagcugcaugucagacuugccuguccacuuauuauggauauacagauacaugaaagacuguugacugaguuuggauccacacaguaaaauccagguuaugauaugcagauauauuuauggaaauccuaacacauuaaggacccuaaucaaagcaauuuauagaagauagccauuauuaacuuuaaaggugaacauucguuguucuuaccugcaugacaaccaacucacguucaguuuuuguuaugacauauuuccacauauacuaccaauaauuagggaugauuauucccacaguucauauaguccuuaagaauucaggggaggugacuuguucaaagccaacugaugguaguagaacaagguguuggaaucugcauccagugccuuggucuugaauccauccuauccaagagauuauggucuuuuaaauccuaaguugguuuauuuaugauuuuuuucuguccguguugucacaaaaugugaacuuaaucuugauuuauuuacucagcagauuuuaucuaaaauaggauuugugagacaguuguaaaaguaauucuacuuuuaguuguaucugaaaacuaacugagaguauuacauuuuuucaucucuaggugaagaugcugccaacuccuucuaaauuucauuacaucuucaaucuucgagaucuuuccagaauuuggcaaggaauguugaccauaaaagcugaggagugcgcuucaaucccuacucuccugucccuuuucaaacacgagugcagcagaguaauugcagacaggugcguguugcggcacuagaguuuaaauguaugaccugagaaguuuauacuacuugguuaauuuuuuuuauuuuuauuuuugagauggaguuuugcucuuguugcccaggcuggagugcaauggugcgaucucagcugaccacaaccucugccucccggguucaagugauucuccaacuucagccucccccguagcugggaucacaggcaugcaccaccauggccggcuauuuuguuguuguuguuguauuuuuaguagagaugggguuucuccauguugaucaggcuggucuugaacuccugaccucaggagauccuccugucucagucucccaaagugcugggauuacaggcaugagccacccugcccagccgguuacuucuugcauuaccuacuaggauaaguagaguaaggagcauugucaucauuugcuguggggcuugugaagcauugauggcaucucucaccugcccacugucuuaaaaaaaugcucugccgauuuauuccaguaugacuucaacaauacaucuuuauaaaucaccagaucaucagaggugauaacauucggaggcacauuuucauuguauauauuuucuacaaauuuugugagcucuuuguagguuuucuguggggaaaucugguuucaucccuuuaaaguuaaacaaucccauuaaaguuaaauucagucaucuuuuggagccuccauucccucaucuauaaaucauagaugauaaugccaguuucacaaaguuguaaagugucuaccaugucucacacaagggugauacuugucaaauguuacuccccuuuguccucucuucccucuguuauauugucaaucugaaaagguccuuuguguacugaauccaccaacccagaaagaggacgcucguccacuaccgaccaucacuucugcucuccuaucgcaaguuuuagggaccuuugaucucaccuaagugauucaucuguguuuucuauaaguagugcuguuaauguuauaacuuucuuggaugggguuaugcccuucuuaucaaaaggcagaacauauuguuucccuguccugaauugagaagguccaggguggggcugagaagaggcgaagggacauguucaguuagaaaagaugcuuucauauuuaacauucuuacuacuacauuuuccuuucagauuuauaacuccugaagaugagcagugguuuaaugcacaucuuacucgugcaguugaagaaaauauuggcucugaugcagcgucguguauucuuccugaaccauacuuuguggauuuucuucgugagaugccagaaccaacuggugaugaaccugaagacucuguguuugaaguacccaaaauauaugaauugguauuuauuuucaucucuuaaaagagguuuucagauugcucaccugacuagaucuuucucucugcaccagaguccuaccauggaguugcuauaauuccagcacuuugggaggcugaggugggaggauugcuugagccugggaguuugagaccagccugagcaacauaaugagacccugucucuauaaaaaauaagaaaaauuagucgggugugguggcaugcugcuguacucccaauuacucagcagguggaggugggaggauuacuugagcccaggaguuugagacugcagugagcugugauugugucacugcacucuagccugggugacagaaugagacccugucucaaaaaaacaaacaaacaaacaaacaaacaaacaaaaaaacaaaaaagagagagagagaguucaguaagaugaccaagcauuauauaaaugugaaauaacuauccucuauaccuauaccaaggguuggcaaauuauaguuucugggccagauccagccagcccacugccuguuuuuauuagacuuacuagcuaagaaggauauuuauuuguuuauuuauuuauuuauuuugagauggagucucucucugucaccccaggcuggagcacaguggcacgaucucggcucacugcaaccuccgccucccaguucaagcaauucuccugccucagccucccgaguagcugggauuacaggugccccccaccaugccuggcuaauuuuuuguauuuuuaguagagacgagguuucaccguguugguccugugauuacaggugcucgcuaccaugccuggcuaauuuuuuguauuuuuaguagagaugagguuuuaucauguuggucaggcugguuuugaacuucugaccucaagugauccacccaucucggccucccaaauucuggagugacaggcgugagccaccaugcccggcugauuuuucauuuuuaaauaguuaccaaaaaauaaaaauaagcaaaagaauaauauugugugacauguaaaaauaauauagaauucaaauuucauuguucauaaauaagguuuuauugaaacacccauugguuuaaauauuggccauagcugcuuuugcacuacaauggcaggggugaguagagacugaaugggccuuaaagccugaaauauuuacuaucuugcccuuuacagaaaaaauuuaccaacacuugccaacaaucacaagacagaaaauauaacauaaaaguauuucauuuaacagcaacaacaauauuaacauguaggaauuaacaugauaaaacuuuacuuaaacagcaacaugucauucuuucuaaauuaauauauagguuuaaugaaauuugaaacaagauuucaaagggacuuuuaaaaacaggguuauauaacaaaguaauucuaaaguuauauagagccgggcgaggugguuuaugccuguaauacccgcgacuugggggaguugagguaggaggagccauagagccaaggaagucgaggcugcagugagcuaugauuggaccacugcacuccaguccgggugacagaguaccuugacucuaaaaaauaaaaauaaaaauaaaguguaugcagaucaaagaauuagauggggaggaacaauuugcaaaacaaagaaaguggguguggauuuauuucagaacaacaaagacuuguggauuuaacuccauaaauaauguaaaaccuuuuuauauuuuugaaagcugcaaacaauauuaaaaaguaaguaaaaaccaagaaaaauauuuccuauauuaauguguuaauuacuauggauaggaguugguagggaaaggucagaaaugauuuugcacuagaaaccaacuaauacaguuaaguuucaggccuuagaaaauggaaauaacuaaaaguagacuaauacgugagaaaccucuggaaauccauaacguuuaaaaaaagauauguauauuuuaaaauuacuuuugagugucuuuacaauugcuacuuuaauacauacuuggaucuuaaauauuauuuuuuuaucuuucucuccacccauagaugccauccuuugacuuucuggcugaaaaacuccaguuuuaccagagacaguucaaugaaaucauuagaggaacaucucuugaucugguguuuuuuaaagaugcaaugacucaucuuauuaagguccuaacuauugccuauuuacugauauaaauagaugauuuaaaagcuucguauauuucauagauaaauuuuuugagagaauaacuauauacuaucagguaccguauagaagacuguacauagguugggucaauucacugucccagaaaauaaaggcuuaauaggaaacccuuuauuugaauccaucuacauggcagcaaaugucuuucaagggcaaauagaugguuuucuguucagagcuuuuggcacacugagucaacaagaaaguauggagaaccuuuagaaaguauggagaacccugugaaaaaauauacuucccucaaauuauauuuugauauuaugggaauucuguugcccauggaggaaaagauguugcuuuuaaaagugucaauguuaugauugacuuacaggugaugggacagggguaagguugauauauaggacuggugagagaauagaagccaguuagagguaacacgaaaaagggguguuuucacacuaaucuauucaacaaguaauuauugaccauucaccguggcuagaucuugagguucugagauccuauucugagugcaaagccauaagugauuaauauauuuuaaaauauacugauagaauuuacacauaccagggugucauuauugauccaccaucugcaaaacuuguauuuuuuuaaaaauuauuuuuaguggugauagugaauuuacugauccaucuagacuuucucccuaauuggugacaauaauauaaaagacagcuuuuuagcaaugucuucaauuggccugcaugagauuugacccacaauuugagucuuaucuucacugaggaaaucaaccauagaaaagcaacacaacaugaaaggcugucucuccaaguuggcuucuagaaacauccuccuaccccacuguaaauagaauuaugguacuuaaaaaaauuuguuggcagagauaugauagaguuaguguucauuguugaguuaggugucuacaugauucagugugucaggcugaugaauaauaaaaaaacaauuguaaacauuucuuauaucuucugcagauugggaagagcagcuccacuauccauugggucuaaaaauaauaaaauucuacaugcgugcacacgcaugaacacacacacagaauaguuuuaaaauagaagggaguaaauccaguuuguucuguucuucaugauguaaacauagauggucaaggaaagauucgagcugaacaaaucaguauuaaacuuuaauuuuaaaaauucugucauagaccauuaacgaggaaaaagucuaauaucaucuagaaacauaugaucaaaacuugggcucauuuagugcaagaaaauguaaacauugcauucuuuuuucaaauaagcacguuuuaaaucucaaaacagauuucacgaauaauucgaacgucguguggaaaugcauugcugguggguguuggugguuccggaaaacaaagucuuucaagauuggccucuuuuauugcuggcuaucaaauauuccagauaacauuaaccagguaggaugaaauaaaacacaauauguuuuucuauaguuaauuucucuauaguuaaauguuuagaaaaaaaggaagcacaacaguuuccuguauuucuuuuuaagguaaacuuuaaguauuauauauauaaggauauuuacgcaagugucacaaaguaaauacaucuauguagccagucuacagaugaagaaauaaaacacuucuuguaucccagaagugccuccauguuacguugcagucauuacccucccaaggguaaccauauucaaaggguaagcccauugauuaguuuugcccaguuuugaauuuuguaucaauugaacuauacaggauuugcucuuugcauccuauuucuauuacugcauuguuugugagauucauccaugaugcuacauguagcaagaauuguucauucuuuuugcugcaugaucuucaacuuaaucagauacuaccacagucuauuuauccauuguacucuugauaaacauuugguuuggggcaaauagagcuacuguaaauauucuuguacaugucugaguacacaucuagaguuaaaauugcuggauguagguuaucuguauauuuagcuuuaguugaucugcuuaguaguuuuccaugugguuguaccaauuuacacuuccaccaacaugucaugagaguugcuccgcauccuugcucccacuuggcauugugugucuuuuucauuuuagcaaaucuuuuuuuuuuuuugaaauguagucuugcucugucgcccaggcuggagugcaauggcaugaucucugcucacugcaaacuccaccucccagguucaagcgauucucuugccucagcucacgaguagcugggaucacaggagugugccaccaugcccagccaauuuuuguauuuuuaguagagacgggguuucaccauguuggccaggcuucucuugaacuccugaccucaagugaucaacccgcgucggccucccaaaauuauaggcgugagccaccgcgccuggccgauuuuagcaauucuguguguggagugguagcucacuguguuucaguuugcguuucccagauggcuaaugauguugagcaccuuuuuaucucucauuggccauuuggauaggcucuuuugugaauuauaaaagcccuuucuccauuuuuuuuucaauuuguuugcgauucuuucuuauugauuguuaggaauucuauauguguuuuggauauaaaggguguauauugcaaauaccuuugcucaguuauugauuugccuuuucauucucuuagcggaucuuaauuuuaaugaaacauucauuuuuuucuauuuaguccuuuuuuguauuauauuuuaaaaucuuuguuuacccuaagggcacauagauauuuuccuaugauuuucuucacauuuacacauaaaauuuacuacuuucucauuuaguacuauaacugaccuagaauucauuuucuuauaaugucugacauaggaguugugauuauuauuuucaauauugauauccaguugauccagcuccauuuauuaaaaaagucaucuuuucccugccacaucacagugccauuuuuugucuuaagucaucugaucauauaugugacuauauagucuccuccacugguuuccuuaucuaucuuuguaucauuaccuacuauauuaauugcuguagcuucuuuaguauauauauuuaaauuuaacauauguauauuugguagugucagaucucuaacuuuguuguucuucaaaacgucuuguccauuuggccuuuuauuuccguauaaaauuuagaucacuuugccaauuuauaaacaaacacacaaaucauucugcugccaaacaaaagaaaaauaaaaauugaacaaaauacaauuuauagaaguauuuuaaaaacauaaaauaucaaauaaguagguauuaauuuaauuuuacuucaaaaaauuaaauuaguugucagcauuuaaaaaucgggagguuucauguuuuagaaaagcguauuucugacuuuuugaaauaauuggaagaucuggcaaccuagggccuacacucccagguggcagagcucaguagcagcugccuccuuggaugggacaugcaauccuccaauccacaggccccaacagcacugcuucacucacuggcauuaucugucugauuccuguaggcaucuaaauuugggauccugagauaggugguguugcacugauuguaguuaggaaugacggaggcuuaaauuaaggcaaauuuauucacuauauuuucuuaauuucuguauucuugauacccuggcaucugagacucugcugacuggggagagacugacccuucuagguuagccaauucuuagagauucaaacagcuccuccaggagaguaccuuucauaugcaaaccaaccaauccagaguccuuacucccaaccaccaccucuaucuggugggugugugguggcaucucaugguggauuagaauauuccucugcccuaaucaccccagggccacauaccagucaacaagggaccacuccuaugccccagaggcugcugaaauuauucaaacuagcaaauccuaauucugcuuaccugccuugccuuucucauggaaaccacaauaaagacucuugcccguguuuucccaucacuccuuuugccuccugauugacucugguguuuccccaugucacccuaccuagcaugucaagcccccuucuguuucuggggauccuugaguauaaacaucuugcuucaugacagucguuccugugucauugugucuuaccacacuugauuacaacaaauucuggauacauuuuauaacagcagaugaagugggaauagagaggaagacucagcagggacaguuuaaaguaugcaggauugauaggacuuaguaacugacccaauauucaggaagaggaggaaagaacaggaaggcuaggaugacacucuaauuucucuagugguacaguugugugccccauaaggacauuuuggucaacaacagacaacauauaugaugguggucacaugagauuauaauggagcugcccuauacacgaguagcauuuuaaaaaucuuuuauacuguauuuuuacuguaccuuuucuaugguuagguagauacacaaauauggaccauugcauuagaauugccuaugguauucauucagugcaguaacauguuguucagguuuguagcuuaggagcaauaggccauuccauauagccuagguauguguaggcauacucuacgcuguucuguauuagucaguuuuugcauugcuaugaauaccugaggcuguguaauuuauuuaaaaacagguuuguuuuggcucaagguucugcaggcuguacaggaagugugaugcuggcaccugcuucuggugagggucucaggaagcuuucaaucauggcaggaggcaaaggggcagcagguggucauauugugagagcuggagugagagagugagggugcaggucccagacuccuuuaaacaaccagaucuuauaugaacucagaguuagaacucacucauuaccaaggggauagugcuaagccauucaugagggaucugccuccaugacccagacaccucccaccaagccccgccuccaacauuggugguuacauuucaacacgagauuuggaggggacaaacauccaaacuauauuaugcucccacaguuacaauguuuucuuuuucuuucuuucuuccuuuuuuuuuuuuuuuuuugagaaggagucucacucugucacacaggcuggagugcaguggugcaaucucugcucacugcaaccuccaccucccggguucaagcaguuaucugccucagccucccgaguagcugggauuacaggcgagcaccaccacgccuggcucauuuuuguauuuuuaguagaggcaggguuucaccaugcuggccaggcuggucuugaacuccugaccuugugauccaccugccucagccucccaaagugcugggauuacaagcaugagccaccgcgcccagccacagugacaauauuuucuaaggaugcauuuaucaaaauguaaccccauuguuaagcaaugcaugacuguacuuaccacacugcauuaaaaaaaagugcuuguucacauacauuucuaucuccuucacuaagcuguaagcucccugagaaugggccacuguaaucuuugucuuuuuuacuuuuauuauuaaaugcuuacuuuuaaccaauucuguaaaaggauguguugaauaaauaaaaaaaugaccagcuuugaaggguaaagugagaauuuaguucaguacauuugagucugaggugucugcagaacacaguguccauagauaauaagacucauggauguggaguucaggagagggguucugguucuggagauagcaauauagaagucucaguagagaggaaccuuuuguggucauggggaguacgaauagggugcgucauggaaagaaaagauggcuguggaaagaauucuggggucucccaacauagagaaagggggcuugcgauggagagugagaagaagaggcaagacagagaggaggaaauccagagugguuuccagaaacuaagcagguagauaauuaaucugaaaaugcuggccgggcgcccuggcucacgccuguaaucccagcacuuugggaggccgaggugggcggaucaccugaggugaggaguucgagacuggcuggccaacauggugaaaccccaucuguacuaaaaauacaaaaaaauuagcugggcauagugacaggcgccuguaaucccagcuacucaagaggcugaggcaggagaaucgcuuguacccugaugguggagguugcagugagccgagaucaugccauugcacuccagccugggcaagaagagugaaacuccgucucaaaaaaaaaaaaaaaaaaaagaaagaaucugaaaauguuaagacaugaaaaguggcaacugauaugcaugacgacacuuucagugaaguggaugggugcacaagccacauugcauuaggaagagaagaagcacagagaauacuuuuggaaaacuugaaagaaagaaacaagagaggucaggaucuggacaagggguguguugugacugucucuauguauugcaaaagcaauacaucacagucagucuaauucuuuaaaaaaucagccaaauugaccucuuuggcugauuaguucagagacuggccagucagugagaggauuacucugacagcaucaggccacuagaucuuucugguuccagggcucauagucuuucugugagaccccauggccuacugcccauuacuugcauuguaacaccuccuuccagugaggauuaccuuuuaguccuugucauuagcuuacccaugaggauuuacauacaacauuucagauaaugucugcuuuauuuuuacacaucucaucaccucugguagcacauacauuuaaccggaaacagagugaaccaaaaaacaaagaccaagaucuuuucauuccauaauuuguagccaucuaacauuucuauuauuuauaccuuauugcacaaugcaucuuuuucuguggguuuucuuuguaucuagccacuuaaugagcugugcaaauugccacuauauacaauuuaugacuaauuuuauucauaacguauuuugaauuuuucaccaaaucaaacucauccaaauuucagaugaguuuuagauauuauauauauauuuacucggacaaaaucuguugcugaggacugucagauugcagggacuaaaaguucauuucucuauucccacuuaugcuuuguggaucacuuuugguaaguucccuguuucucaguucucagcuuaaacgaaauauuuguuuugaaugguaacauaucacucuuuagcucuaaucucuguguuuucuagcaggcaccauuacuuaguaucuauuggagcagguacagauuaugcucuaauaaucacaggcuauuauuauguuuugggauaaauuaugacuaugguuuuuuuuguuguuguuguuuguuuguuuauuuguuuuaagaaggagucucacucugucgcccaggcuggagugcaguggcaugaucucggcucacugcaaccucugccucccggguucaagcgauucuccugccucagccucccaaguagcugggauuauaggcacacaccacacacuuggcuuuuuuuuuuguauuuuuuuaguagagaugggguuucaccauguuggucaggauggucucgaucuccugaccucgugauccacccgccuuggccucccaaagugcugggauuacaggugugagccaccgcgcccagccgacuauauauuuuuuaaucuaaaacuuucuaucauuuuucuucuuaggucuuacaaugugacuaaucuaacagaugauuuaaaagcuuuguacaaaguugcuggugcugauggaaaaggcaucacuuucaucuuuacugacagugaaauaaaagaugaggcauuucuagaauaccuuaacaacuugcuaucuucaggggagguaagucucaaaaguagagaaaaagcccauauuguaaaaauauaaauuauauuggaauagaaaaagcagcaaccuuucaaaaaugaggcuauuuaguacauuuuuuauuuuagacaugguuaauguacgagauuuagcagauuuucugaaguuccugugaaaugaaugcugcccaucuccagaugcuuuguuuaauuuugaacaugguuccuuacuugucucuucagucuucacuuuggucuuauaauuuauuuuaggagaagcaaaguaucuguccaucuaucugcauacuagugaggaguauagaaugguugaaagaguucuguuaguuguaaauggaugucuguacugccacuucugaaaccgcuuguaucagcacuuccgugagcacucacaucuuuaguacuucaucagaaagacucaccagacucagcauauacaggucgagcuucucaaauccaaaacucuggaauccaaaaugcuccaaaaucugaaacuuuuugagcacggacaugaugcucaaaggacaugcucauuauuggagcauuuuagauuucagauuuuuugauuugggggugcucaaccaguaagugaaaugcaaacauuccaaaaucugaaaaaaaucugaaaucugaaacauuguggucccaagcauuuugaauaagggauguucaacuuauaguuauacucauggcugagauuuauuguggcaacacaguaaggauacagagccagaucaguagagaaaaagacucaucuuguggagucaucgauguuccaggaacauggaauugauguuccagcuuccuaugcuuuugccaaggggccaugcagaacguccucuccauccaguaugaagggcaguaacauaugcacuguuuccauucagggaagcccacuugagauucagaguccagugguuuuuuuuuagguuuggucacuuccugccuagcuacaacuaccaaaguuccagauuccuagaaggaaagcagauagauguuugccauguaucacaagguuuguguaaacagucuaguuggcacugcaaaacaaccuuaucaauuacuaauggaggagacauuccaaaagccaaguucccugauaacagacaagggucagcucugcaagcauacccuuuucaagauuaggccugcuguguuaacucuucccuacaccaugguauacagaugcuuaauggugcaaaaauuaguuaaguauuuuggagccagaguugauuagacugacucugagucaaaguacagagggcaccccuggacauuuuaaagagaugauugaguggugguggagauagcuuuuuggugauagcuauuggagcacaggagaacacaauuaguucuugauugagcugcucaauaaaaaguugcagucuugaucaucucuggcaaaucagggauuugacuguggagaugcugaaagaaaauaugaaacaagaugacaugcaaauuaaaaaagggacuggacuuuggcagugaauugacuguggagaacucuuaaaacacagaacacuuccuuguccauuccuuaaagaucuccaacuuguuugcacgagaugagauggaugaaaucacccaaggucugauuucagugaugaagagggagcuaccucgccauccuccuaccuuugauaauuuguaugaauacuucauuucaagaucaaggaagaacuuacauguuguucucugcuuuucuccaguaaguuuuuauuuuuauuuauaucuacguagaaagaguuccuuauuuaaaggugcuuaguuugccuucucugauuagaaaaugaucuuagaaauuaauauuuuuacauugaauuaaaauuaacacuuuuguaccacacaaucuccauugaccaaauucucauuuccaguguaauuuaaaauauucauauuauuaaaaaauacugcauaaccugcaauuuucauuaauuaccuagagacauggguuguuugaauuguaagggacuuggugauguaaccucguccagcuccaccucccauguagacauauuagcuuuacuauaaugucucugauguagguuugaaaaucucuaucucauugugcuucccaauauaguagccauuaggcauauauggcuacuuaaguuuugauuaauuagccucauuucuacuuacuauuugguuuauuuuugguacagggucuugcucuguugccuaggcugaagugcaguggcaugaucauggcucacugcagcaucaaccucccaggcucaagccauccucucaccuuagacucccaaguagcugagacuacaagcaugugccaccaugcccaguuaauuuuuguauuuuuuguagagacaagguuuugccauguuguccaggcuggucuggaacuccugaacucaagcgauucaccugccugggccucgcaaagugcugggauuacaggcaugagcuaccgugccuggcuuagcuccauuccuggugcuuaguagucauguguggcuaauagcuaccacacuggaaagcauauauauaaagcauuuuuauuaucacuuaaaguucuauugacagcucugcucuagggagucucacuaauuuauaaggcagccugcuucauucuuggauagucuaauugccaaaaagcucuuauuuauaaucaauagaauuuugucucuguacuuuucugauucuaacucugcccuauacaaggaacucaaucccucuuccguguaaaguuuuucagauauuuggagaagguuuuugcaaggcugucuaaguugauuccuuuuuagaccaaacaacuguuccugcagcuguucucacuugucccaguguccaggccuuuugcuguccuggcccucucucuaaaagaguacuaguuuaucaguuuccucuuaaaagaaaguuccuagaauugaacgcaauaauguagauguagucccaggacagggaagaguguggaguauauuuccucccuucaucacaacauuaaauuuauauaugacugcagcccaagaagauucauuuucaaaucugugaugucacacucuugggucagauugcguaaaucucucucuggcugacuuauaaccccucuguguuucuaauguuuguugacuuugcuaucaauagguuggugagaaguuccgugcccguucuuugaaauuuccuggcuugauaucagguugcacuauggacugguucagccgcuggccaagggaggcucugauugcuguggccuccuacuuccuuucagacuauaauauugucugcucuagugaaauuaaaagacaaguuguagaaacaaugggccuguuucaugacaugguuucagagagcugugaaaguuauuuccaaagguaagugauauuacauaagcaccaucgcuauggaaccacagcauguauucccaagaggaaugcauuguaacauccagcagaagacucuuucuauucauugagcacgagcuguauuuuuagaucuuucuugcuuugauuuucuagugacuauguaugaagagauggcaaguaaacaagauuuaaaaacgaacuaguguccacacuuaaauaccuuuuuauccuccaagccucagaguaacagaugcuuaaugaauuacuuuauuucaucugcuuaauuuuguuuugaaaaugacuuaacuaauucaucaccaacuguuuaaaauuaguuucuuauucaaauguauuauuuauuuugauuaaaguacacugcuucuaauguuucuuuauugccuuauguuaaaggaguauuuagaauuuguauuugcauuacuuagucuuaccaauguuucuaugccagacaacuaugaaacaaaauaucaauugacuaugggaaaaccacucacuaaaagcagcaauggcauguucauuaugugaaagcuggugucaaccaugcaaaaacacagcuuuuuuccccaaagcaugacagucacuguguaagauugacaaaugggccaacguggauccccagaaaagcuaugccuguuuuucugcauagagaguuugcguaacacuuucauugauuuucagugagguuccuacuucacaaaaguuuauuuauuccauaccuuuuccuuuacuuaaaaccauucccagaccacccuuuuagauaagaucucccaaauucucuuggugaaucaguguauacuaauucuuacuguuaagaagauuuucuuucuauuugaacgccugcuaaugucauccauggagauaaauuuuuaccuuugugcagcuacaaaaaucuguuucuuuacuuugaaaauuuggguauauuuuucaaaauuuuuuauauguucuuagguuguugaaguuuauucugaauguaauauuuuuacaacacuuuaaugauagucacauauaugcccaagaucuuaaaaaaaacucaaaagcauuaaaaaucuucaaaacuacaaaaguuuaaauuaauauaaaagguuaaauaauuuuauaguacgugaagaacucuuuuuucacuugagcuucuucuguauaaaauuaugccuuuuguaauaaagccacaauaaaguggacauuugaaucgagugugguugccuugauuucaaggccaauccagugaacuugggagacauugguuuuugcuucuguaaacccacccagcugguauccagcagugaagagguuguaacaaauaucacuugaaugaaaauggaucacagcacaaauucauuucaaccacuuaucccuaauauuuguccagaaccuuaaaguuuugcacuguugacaccagcuuucacauagauucauauaugcgauuuuauuugaucuucacaaaauucugggagggguagagcagauauucuuuucucuauuuuccagaugaggaaacagaguuggaguuaagggugaagucaaagaccccucaggguugaaacaucagacagauuuaguccuuuuuccaccucaccucugagaaaccuugcucaaguccugucuuccugcuagugaaucacucuacaugaucacacugauuucaccuugggaaaggugucguuuuaugggaguacgcacaaugauugaaaugguccuuuuaauguucugcuuucagauaccgccgaagagcacaugugacucccaaaucuuaccucucauuuauaaaugguuauaaaaacauuuaugcugaaaaggugaaguucauuaaugaacaggcugaacguaugaauauugguaagaggaauggaauggaaugggauggaauagaaauaggguuuauuugauagggaucucaauauuuuguuugguggacauuuugucugaaaaugaaauacucacuuuguuaguaguagauaauuuuaaaggauggccuugaggguauuuugaccugucgagaaacucugaacagaagaaaaucuaaacagaaguggccuauuuucucugcagaaccauuucuccuggcucuuucaacucuggguccccugugcugagucacugagccauugcuggcagauggggacaagccagcuuuugggaauggacaacaauuucaguuuuugguuucauuuugauuugccuugauuuguauaaacuuugccauguuaauuuucccuacauuucuaauaaagaaaaaggcaaaauagaagcaaaaacaaauaaaaacaaaaagagauuguguaccuaagcaagaguuuuccaagugucugcuauauguaguauaacuagcaaaaguaaacauuggaagagauuauauguccagaaagcauguggcccaaacaaucuaaaacaccuuaguucuuauuuuucaaguucuaaauaaaacuugaggggcugaguaugguggcugaugccuguaauuccacacuuugagaggccaacgcaagcggaucacuugagcccaggaguucaagagcagccugggcaacauggugaaacccugucucuacaaaaauauaaaaauuagucaggcauugugguggugcaugccuguagaccaagcuacuugggaggcugaggugggaggaucacuugagcccuggaggucaaggcugcagugaacugagauugcaccacuacacuccagccuaggugacagagugggacccugucucaagaaaaaaucaaaacaaaaaccacuuggucacauagcauaacagcgccaaggucugugaagucauaguuaugagagaagacugugaaagaaggcuucuucugcgguuuucucaugauucagcuucuugcagcuuuccuauaugaugcuuuagaucaguagugugcugaagccaacucauaguggcuuuugagaacacaauguuaaauuuuuaggaauuuugugaucuccuuguuaaacagaacuuuuauuaaaaauuaacucauguauacuuacaauuaaacaaauuggauuuaaaauaaaggcaauaaaugcucaaacucaucccuucuuaguuuuacucuuuuuuuuuuucuuuuucuuugagacagaguuuugcucuguugcccagguuggagugcaauggcgugaucucuguucacugcaaccucugccucccagguucaaggaauucuccugccucagccucccaaguaacugggauuacaggcaugcgccaccaugcccagcuuguuuuguauuuuuaguagagacaggguuuugccauguuggccaggcugguuucgaacugaccucaggugauccacccgccuuggccucccaaaguucugggauuacaggggugagccaccguacccggccuacucuauuuucuuauaucaauguucuugagguuauuuacuucugucuguaugguaggaauauuacauaacagugugguacugagaaucuuuugguagccugaaaucagccauggugggaguguuuacacuacagaaauuggacaauauacagaugagggcuuccccuuuucccagugacccagauuuaaauauuuaccaacaucccacuaccuagaacccguuggaaugugagcaauucaguuaaccaguucuuuuucucuacggugcuaaaaguugcaaaguccauuacauaaguuuucacaguuauuuucauuuuuauaacaaagagaaccacaaaaauguuaauauauuuucuauuucauuugccaccucagcugcaauaugauucaaaggcaaaaaaugauagcuacaaacuguuuacaaagccacagagagcauaaauuugucaaauaaguuucuuggccaaacuaaucuuauucaauaggacauugugacuuucccuuaaauguagcuacgugauauucuucggucagagcuauuuucuuugccuuccuguugaaacucagaaauauggucaauauuguugcuuuuaagacauguauauuuuuaaagcuuuugucuacaauuuuguguuuguuauauuacauguacagugccuaauaaauaguaaacauugaauaaauauuugaugaaggcauauaccuguacucaguaaagguauauauguguguauuuguaaaggucuugauaaacuaauggaggcaagugaaucuguugcuaaacucucucaggaucuugcagucaaggagaaggaguuggcaguggcuuccauaaaagcagacgaagugaguuugcauuuauuuuaucacugaugaggaauauuuuuccauauuaaaaugcauuguuuuaaaaugguacuaaagaacaagcaggguauaaacccauggacaauuccugauaagauaguguucacaaagaccauuagacauuuuuguuuaacuuauaccagcguauaccugaacuauuaauuuugcuacuuggccuaagacuauuauuucuucucucacucugucugucucucuuguucuuuuucaucuguuuaugaaauuucugcuugacuaugaguuauauuuggucuucuguuuaaggucccuguauguuccagguuucugggauggcccaaaucgaggaagaguugguagaguuuuuuuuuuuaaaagaaagaaagaggaaaaauccauacuccucucaaggagauagguauauaugugugcugcuuuuucucuuuuuuuuuuuuuuuuuuuuuuuuuugagacagagucuugcucuguugcccaggcuggagugcaguggcgugaucucggcucacugcaaccuccaccuccuggguucaagcgauucuccugccuaauuuuuguauuuuuaguagagacgggguuucaccauguuggccaggauggucucaaucucuugacuuugugauccgccugccucggccucccaaagugcugggauuacaggcaugagccauggugcccggccuaugugcugcuuuuuuaucuauuauacagccuucuagucucagacuuucagcuuccagucaccaagagucaguuaagaauagauacuucagucuugauccuuagccaguugcugaaaugagugaacuaacauaggggaggcacuuaagcauaguccuggcauauaugguaagcacucaauaaacauuagcuucuuuuauuguuauuauacaaggcuuaaaaugguuuuuugcccuuauucuaugauacuuacuugaauuguuuuaauuuucuagaaauuuguagagugaaaauacuauuucuucugaaagcuuuaaauauuuauuuauauauauauucuaagccuaagaaaagcuuagaaaauggaagacugcgaggaacugcucaaaggaauuuacuuuaauauaccuuaaaauauagacaacuuaggaaauaaguuuguucuuauucguguuuuauauuauguugaauaaauauuugcucacuauucagaucuauaaauuuugcuugaaagguuucuauuggcuuucauguguuuccucaacuuaacagguauuagcagaagucacaguaagcgcucaggcuucagccaaaauuaaaaaugaaguacaggagguaaaggacaaagcccaaaaaauuguggaugaaauugauagugaaaaagugaaagcugaaagcaagcuugaggcagcuaaaccugcacuggaagaagcagaagcagcccugaaugugagcagugcauuguuaccccuuccaacacaaguccuagaaggcuucauguuucauuacaugaaauuaacucaucagaaaacugaauugaauucuuaaugugauugauaaucucugagucuggaaacaaaugugucaauuaauucaguuuucuaaguucuaauuuuuuuaaagucuuccccucuuauauuauuuucaucccacaaauuggucuuccaugagaacugagaaauaaugcuagugguuaguggccuaaacugugagaaauucagauuacgcagagagccugcucaguuucuccagcaucccuuccagauuaugucaugcucccuuuuaaaaucuuccugugguucccacugcucuuaggauaaaguccugagcuagacauccacagcugugaggcaaaaggggcacagcuuuggaggcaggcagaccugcauucaaccucuauauauaauacacacacacacacacauacacacacacacacauacauacacauauaugugcauguauauauauguggauauauacacacauauauacacacguguauauacuuacacacugcuaauacacacacauauaaguauguauguacauauagaugaucuggaguaaauuugcuuaacuuucuuggguuucuauggggauuauaauuucucauugauccuuaaagaaucaaugugagcauuaaaauuaauuaauacaaaaugcuaggcacauagaaagcacucaauaaauauuagugcuucuguuccugcugaugaccuggcuccugucugucucuucaacuuuaucucuugucauuuugucccuacacacaaugcgauccagucauacagaaaaauguauaggauucuggaagaauggucaggaucuguuaccuuuaaacgugccuccaccucugcugggaaugcuuuuccuaacuuucauugccuaauuagagucauucuuuaaaucugggcccagaccucacuccucccaggaaguuuucaguucuucuucgaggccuuccuuuguuuuccuaucacucacaugcuucugucauggcagaaauccuuauguaggguaauuguauuugcuuugccauuuucagagguuaugaggacaagacuauuuugguuugcuuuguuuuauaugggagaaugccugcaauuguuaaaugaaugaauaaaucuaugauaaucauuuaauaaaauuuucacaaugaccaggacacauucugcacccccacuuccuuuaugggucuuacuguaacguacaaaaggaagagaucaccgaaccgaaggagucuuagaacauguuauugaucauauggucucccaguccuugccuugauggucaggcaaugucuuaauccaaacccagccaauggauagaaauuuucaaaaauguuuuuaugagccauauauuacaguaauuuucuugucuccuucuaauuccucucccugccauagacagggaagcccucacaaugaaggcuaaaggugagguuucugauauucagggcuuuguauccucucuuaauauccacaccuaauauagacccugugcuuugaagaugcaaguuaucuaaauguuacauaucagugggacuuauuaacagaggucuaugauggcaaugccuguuagugauauuuuaaaccaauucguugggagcaacagggaaaagaagaauacauacaaauaaacacaaauaccaaaauaacaaugaaagagccacuaagcaaaaaucuuggaaauggagagaaaauauguuuuaaaguuuucuaucuuaauuauugaaaaguauuagauuuccauauaacuauuaauaccacucaacaaacaaaauauugauccuuaaucccaaauauagacuaucaagccaaaugauauugccacagucaggaaacuugcaaaaccaccacaucuuauuaugagaaucauggacuguguucuguuacuauuucaaaagaaaauugacccuguuacuauggauccagaaaaaucuugcuguaagccaucauggggagagucauuaaagguaaguaaaaucuaucauugucaauccuaugagcugcaucaggcguccucagcccaggacacucaauauagaccagacaaacuggcagacaauaauugaucauugcguauugaaaaguuuaucuuaaacuccaucaccuaaaauguaaagagggauagauuuuaaagccaaauaccuucuuuuuaugacaucuguccagaaccgguggcuaguauuggcacagccuuggugucaacccagcccaguuuucaaaaaggggcuugugugguugguggcauucagaugcacuuaccagaaagaaaacuuacauagcuuuucuucuuuacucuuuccacauggaauccagaagacaauuugugauuuacagauuuagguuggcuacugccaauagucucaauuuguguauuuagagcaaaucaucuauuacuucuuugagaaaauucaauuuagaaguacauauuaacucaggaagaaaguauuuucuuccagaacuuacagguuauaauacuauuuuucaguugaugagugcaacaggauuccuguggagccuucagcaguucccuaaggacacuauaaaugaagagacuguugaguuacuacagccauauuuuaauauggaugauuauacuuuugaaagugccaaaaaagucugugggaauguggcuggucuccugucuuggacacuugcuauggcaauauuuuauggcaucaauagagaaguguugccucugaagguaaaaguuuccuuccuucucccaguaaaucaauauuucauaaaaucagucaucaguauuacugcuauuaaaagacaaugcguaguuuagaccaauaaagguagaugucccuguuaccaaauuugucuuuuuucucuauguccucucaaaguuucuccuucuuuuuauaucuguuacauguuucuugacaaugcaggcaagugacugaaaccaacauguuaacuuacacaggaaaugaauuucuugggaauaauaaucaagcugucauaagaagaaaaacuugccauuucuuugaaguuuggagauuagguuuggagguugaauuugauuacuguauuucaaacaaaacuuauaaaauuagguuugacaccuagaaagguuuuaaauuucaaagacagaaggagaaccuuaaaugcaaucuaagaagcaaucagacaaaaccuaaaagguuguuuacaaaagacaaaucaagauguugcagauuucccacaacccuaaauacuagaagauaaugaaaaaacauaugcagaguuuugaggaggaaaaugcugggguccaagcacuccauaauggccaaagcuggucuucauggaugagggaacagaaugagauucuuaggagggcaaggauucaugaaauguaucacucagauacacacugccuccagggccccaucccaaucucccaccccaacaaagcuaaaaguauuauaagugguugcucuguggaauggauaaugaggagucggugggcaggggguuacuguuuuucauaagccuuagagaaguggcugccuccuuuaaaaccugugcaugaggaacuuugagaaaaauagaaagucaauuuaaaauaaaaaguuuuaacaaagagaaaugauaggaaaaauacaaaaaacacaccccaacaaaaagauacuaagggagaaaucuuacaauaaauguagaauucaagaaaaaaaagaaaacacacacacacaucagaaaagaacuauucuuuguugauaaaaauuaugauccauagugaagacaauuaaaauaauguguuaugcaauaaauaaaauagcauaaaauuguauaaaccaaauccauuaguauuuucaguggaaauuaacaaacauaauacuguaauuugagauugugauacaugcuaugaaauuaacaaaaauaauauuguaauuugagauuguggcuaccccugguaggcauagggccagcuucuugggugugcacacagggccuuguguuaaugcucugcuguugcccucuucagauucuuaauauuuuuuuuuaacaaggggccccacauuuuucauuuugcacugggcccuguaaauuagagaggcagucccgaguaggcauaaauuaguaauuauauagaaauuuuacaugauacuauuuuucagguugaauaacuacauugaacuuucuucaguauaaacaaagaacaugaaauuauuucuagaguacaagaaacauuuauaagaauuaauuauauucaaugguaaaagaggaccuugauuaaauucccgaaagcaaaaaauccuggggucucauucucugaguauaagcaauaauacuggaaacuuuacauuaaaaugaacucagucauuccuaauuaggaaaugaugaaaauaagcgaguuaccaaagcuucugugauauggccaaaaugguacauucuuagcccuuacauacaucaaagaaacuaaacauuccacugaagaguuaaaguauauacucacucauaagcauacauacacaugaaauuuaaggaaaucggaauagagccaauaaaaauaacauuaaaaauuagagaaaagcagcagaauuaaugagcaaaucuaagaaccuaugcuuugcaaaaacaaaacuguaagaaauauuccuggaaaaucuaaucaagaagaaaaugaaaacaaaugaaaauagaaagauaaauccucauaauucuagaugugaagauuuaaauaauuauaaaguaauuguuuuuuaagagacaggguuucauucuggcccccaggcuggagugcaguggugcaaucauagcuuacugcagccuugaauuccugggcuuaagcaguucuccuaccucagccucccaaacugcucccaggauuauaggugugagccacugugccaggcugcaaauauuaccuaguuauauguuaauauauuagaaaaucuaaaugaaauaaaaguuuuaugggaaaaggagcuaaauucaaauaaacauugagaaugaaaauaagaaagggaucaaagaacuucuaccccagaaggcuuugggccuagauuauuuuacugauuauuuuaaauuuacaggaagcagaucauuaccacauuguaggacuuagaaaaauaugaaaaacuacuguuacaguaauuucacuugcagaaucuuugaaauuggauuguuaccaaaguaacaauccuaaauguguacauauccaauaguauuuaucacaacauuauuuguaauaacuaaaaauggguggguggacaaauguauaugaguaggaaaaagguuaauuaugauacauccaacacguagaauaucaugcagucacauaacuaacguucaugauggacuugggaccuucauaaaaugaaaugaaaugaaaaaaaaucaaaaugccaauuaccuacuuccuaacacaauacucacagguuaugucugagaaauuucgggguaacuuuuguccuccuuucuauacauugcugcauuuuccauguuuucuuauugaacauuaauaauuaaaaaaauuuuuuugagacagggucucacucugucgcccaggcuggaguacaguguugcgaucacagcucacugcagccucgaccuccggggcccaagugauccuccugcuucagccuccagaguagcuuggacuacaggugcaugccaccauaccuagcuaauuuuucuauuuuucuguagaaacaagaucucacuauuuugcccaggcuggucuugaacugggcucaagugauccucagccucucaaaguucugggauuacaggcaugagccaccacaccuggccaguaauuaaaaauuuaaaaguaaugaaauacccuccaagacgcuuugcuuucccagcugaagacacggaaacagaugugcucgaaagucccgucuagugcagaaauuaugugauuuguguuaucuaccaguuacaaucaugacuguuucaugcagcuaauacacuaaccacgucuucuucuuuucaggccaaccuggccaagcaggaaggccgguuagcaguugcuaaugcugaguuagggaaggcacaagcccugcuggaugagaagcaagcugagcuggauaaaguacaggcaaaauuugaugcagcaaugaaugagaaaauggugagauuaaacauaaaaaauccccaaaaugguguacugaaacuuuacacaagagcaugcuauauuuggaaaucaggcaaaugguugugaugaaaaaauauuggccagcaugccuaucugcuuuggaucuuuggugcucaaaauuauuuuuuguguuuucacugaucaaacuuuaccgucacugauuugaggguuagaaaacuggguuugagaugcagcucagacacuuguuaauugugugguuuggggcuuucacgcgcguccaugugaagagaccaccaaacaggcuuugugugagcaacaaggcuguuuauuucaccugggugcaggcgagcugaguccgaaaagagucagcgaagggagacagggguggggccguuuuauaggauuuagguagguaaaggaaaauuacagucaaagggaguuguucucuggcgggcaggggugggggucacaaggugcucagugggggagcuuuugagcuaggaugagccaggaaaaggaauuucacaagguaaugucaucaguuaaggcaggaacaggccauuuucacuucuuuugugguggaaugucaucaguuaaggcaggaaccggccaucuggauguguacaugcaggucacaggggauaugauggcuuagcuuuggcucagagaccugacaggggcaaucuaccuagcucuguuuguaaaauggggauccuaauauaaccucuugggauagguuguaagcagugguggucugguaaauguuaacaaucuagugugcaguguggggagaggaaaguccggauuuguaauauuugcugauuucugugguguaaauacucccaucacuggcaauuuuaaacuccaauguaacgucacugagcacagauuugggaaaaggugcauggcaguaccccaucgcauacuauuuccaccauccagauacaacggucuuaaccucaaaaccauagauaauauuaacauuuaaauaauuaggaaguaagcuuuuguuauuuauuacuuuugcuuuuaauauaauuuuuuaauuguaagcuuacauaguuuaauuuuuaauaaaggcuguguuuagcaccagcucacaaauacucuaaaaauuuaacaauuggcucuuaagaguugauacaagccggcugcuacaugcuauuguugucugggauuuuuccaggagaaaauacuuuguaaaugacaaagaacucgggauuauuacugcauccaagacaucaaaauggcaaaucuuauugauuugauucuguuuugaaaauauucaauagaaauacuauuguaauuugucugauuaaaagauaaauuaugugauuuggauucugucuuacaaaauugcuuuccuugaaauuuuauaagguaaaaucacuauauuaugaaugaucaaaauuuaauaugugaaguuucaaugcacacuguauuuuuagguuauauuauuuugcaaaguaagaaauucccccauguauuuuuaugugugaauauaauggauguuuguguuaagcacuuagaaaaguuuuuugagacauucucccauuauggcugcaggauuugcuuaaugacgcugauacgugccggaaaaagaugcaggccgccuccacucucaucgaugggcugaguggagaaaaaauccgguggacccagcaaaguaaagaauucaaagcucagauuaauaggugggaaucugggucuucuucauaaucacucuuucuuugugacauuagagaacauaaaguccauuuccauguguucaucucugaaucccaucaucuaugacagugcuugcaacuuaaaucaugcacucucaggugaaauacuauagagggugaagaagauuuugugaaauauuuuacaucucagcugugguucagcacuguggguuuucaguaugagagugcuuuugauauuguuuggauuugccagagccgucuccacuccaguucucuaugcuucaccucaaugauuuugaaaguguggaucaaugguuuguuguggaucaaugguuuguuguaaaugcaaggcugucuucugcuggugucuguugguguccuuagaaaacuuaaaagagaggggaaugagagaggagcaagaaaauggcaaaaaaauaaaaauaaaaauaaaaaaauaaaaaaauaaaaagggaggggaaagaaaaaaugguuuaacacaagacugaaaucugaauaagagcaagggacaggaugggggaagauacuuuccucacaguaucaaggcucacgaccuguaggcuucaggaggaagccuucuuucuugcuuccugaccaccccacauguggccacuccuacccacuuuuggguuuggggcuccacuuugcacggucuuuuuccaugccuggcuaccaagcauuaagcaggggcaaagaaggauuucacccaguaacagagcaaaacugugaccucucaaacaacuuaaugucaggugacucacuuuggggagggggcuguguguuuucuucacagacuuguaggugauauucugcugugcacgggauuccuuuccuaccuugguccuuucaaucagauauuuaggaacuauuugcuuaaagaucaaugggaaauggaguugagagcacggaaaauuccuuucacagaaaaccugaaucuuauuucaauguugguggauccuccaacuguaaguuuuacuuucccaauguuauuugaauuucagucucauuuuauuucuuacuuacugagaaacccggcugggugugguggcucacaucuguaaucccagcacuuugggaggcugaggagggcagaucaugaggucaggaguucaagaccagccuaaccaacauggugaaauccccaucucuacuaaaaauacaaaaguuagccgggcaugauggugcaugccuguaauccuagcuacucaggaggcugaggcaggagaaucgcuucaaccagggaggcaaugguuccgagaucacgccacuccacuccagacugggcaacaagagagaaacuccaucccccccccaaaaaaaagaaacccagguucauugaauuuuuucuuuaacugggaagauuguuuugaaagugcuuaagaguuuuuuuaaaaauaauuuucuuuaugguauaaauguuucuuugcguuuuaaguaaucuugcuuccaaauuaagaccaauugcauugcuaugaacugaaagaucauuugagagauaucagcuugcuaauacugggcccuucuuauaacucuucauuauuuacaccacuccugugaagucauacucucuuucaaacauuuuaggcaaauguaggcaugaucugugcugguauuaaccuuauuuucauuauuugcuaucuuuuuuagugucuaaaaacguaacagaauagcauguucuggugacccuaaguaauagcaaguccuuucauacuaaccuuccuugcugggaauucgaugccacugucaauuuccgguauaucuugcagagcuucuguuguaauaaaugcuuuccaggcaauuuguauucaugaguugcuuuucugguuugcaaaucugcucuccaguugcuguuuccuuaggggaugccaagcuauuaauuucauauuaucuguauuuaaaaguuaaaaacuaaucuuuuccaauucgaacauuguugaauucacccuuacagggaauagauuaugucuuggagaugcacugggcacuggugaagcaaagugggccagaauauucuuuauuaauuauggccuuuggggguccugggauaauuuaacaaagguggaggcugguuggcucauuggaucucugauuauuuuauuuuauuuuauuuuauuuuauuuuauuuuauuuuauuuuauuuuauuuuauuuuuuuuagagacaaagucuugcucuguagcccagacggaagugcagugcugugaucauggcucacagcagccucaaauuccugggcucaagugacccucccagacucccaaaaugcugggauuauaggcaugaaccacugcgccuggcccggugauuuuauugaucacauggugggaggcuggcaauccccucuaaauuuggagaaggaaauauucacaaaagugucauugaugagcuccggccaauauaauaacucaucuaauuuaucuccagcuaugcaaucacccauacaccaugugggcagaaccaaagggccggaaggggaagcuaucaggggcuaauugccugggacuuaccuuguucucugacauuucauuauauucacuaucuccauuaaccccaaaucagguuuaauaugcaaucaacuugcuaugauuccccuaaguaugaaaauacaaugcaaaaggauaaaccuugucuuggguaauuaaagaagggauucauuagauaauaaauuuguuuuuuuuuaaugugaauguuauuugguucacauuuacaaguuugcuuuuuuucgaaguacaaguugcauagucucaaaggaaaauaauguccacauuuuaaauuauuuuacuuuacaguacuuuuaauuacuaaugagggcauuccuguucuccuuugaauggugauauccauuuccuguuguucagauuggugagugggggcuacagggauuaccaggagaugaucucucaauucagaauggcauuauugugacaaaggccaccagauacccacuccucauagacccacaaacucaaggcaaaacuuggauuaaaucaaaggaaaaagaaaaugauuuacagguauguagcauuuggugcaggggaaaguaaucuugaaaucaugaaacucuuucaaaauuuugauugaaucugcagucauaaaguugucaucuccaugacaaauguuugcuaauucacacucuugaguuuuguaacagcaauuuggggcaacagcucugauucuuuucucucuuuuguacucucuuuggauccucccucccccucucuuuguacauuucccugacuccauugcuuuugcuaaugucgaauguggcuuuuguuccgggccuuggguuugggccuauaggaaaguggcaaauagaacauugugaucccucaguucaagaccauucaugccaaccuugcucaggcucuugguacuacguagcuuacugaguccagcuuuggugcuugcaucuaauaagguguuaauuuuaaggugagaguagacaagggcaggauuccaacauuccugacucccuuagggauucuguuacuauugauauuuuaauucaacuaccaaugugggauauucaguguuuccuagacacuguucccagugcucuaaacccccguccccauguuuuugcuuauacuguuucuacuaaccaaaaugucuuucucuaccuccacuuauauccuagauaaaaaucucagauauucuucaaaguccacauccaccacuaccuccaucaagacuuuucuguguccccagcucaauauaaccuguccugaauccucacaaugucuuguuugcacucauguuguggacuuagaaucugacuuaaauuauuguucuuugcacauuuaucuuuuauuucuauuguaccaugaacuccuuuuuggccaaguuuuauucaucuuuacauguucugcacugcucuuuuugaguaggaauucugauauuuauugaauuuaagugaauuaaucaaagugugucaucauuauagaaaaaaagaaccaggaaaauaauguggucaucuugaugaauaugaaaagaagcacuugguaaaauucaaugcucauucaugaucaaauuuccagcaaacugggagagaucuuccuuaauuagauaguuucuuuuuacaaaaagccauaacaaacauccuauuuaguggugaaauguugaaagauuuccuccugagaucagugcuucucauccaaguggauauagcccagugcugggaagcacaccuaaauaccccaccucaucaauacuccagaacacgauacaucagucuauguuuacuaagaaaacccagggaaauccuagaauggaccaggcaauguaaauagaagagaagaguuaaaagaaauaguguccauuuccacgaagcuucuuaggagccacauuuucaggggugcacaaaugugguauaccagaacacuucuguucuuaguuucugcagccaggucaacuauaacuugucccuggccccauuccccuuggcuccccuggcuuucaaucucccugcucaucuuauucuuggaaccuugccuggacauccuuagcucaaugcaugcuccuguaucacuuggacaugaaugcugcuauuuuuucugaucuuagcuuuaucucuccauuucuggauuaaauuuacugauagucuucacugaaguccuuucugaugcaacccagucccaggaaccuucuuguggaaggaauagaaauaugcccgaaacucuuccuuauuuuaaaaaccauccacugcugggauggaaauagacugaauuguauucuccuuacucagacaacauuauuuucuuauguggauaagcacauguacaaacacaugcaaaugaaaaacaaagcauaguuuuuaugcccagggcuguggucaaccuuggcagcuuugccaaggcuaccuucaaugccaucuccaggaccuacagcucugacuuguggaaagaggauguauuuaccaagucucccuaucaggaauucacuggucaccuuguaaagacccaauaccagucuuugcgcaggugaaccaggcucuggggguggcuaccaaauaguguuucacaagaaaaauccagugaaauaaaccugaaauugggauuccaaaauacuauuucaaguuucuaaaagacauugaagaugacugaagauaauuaucuccuuacuugggaaagauaucacaaaaauagaauuuaccccuugagaaauaaagcaagauauaagcaaauuuagucuuacuggugcuuuucuucaccuuguuuauuaaguucauuaaaguucuuuguuuagauucuuuuuccuuauuaacuuacaggaaggucuuuacagcacauuauuuguauaaagaaagcuauucauccagggaaacaacuuccuucaugugcagaauuuuuuuuuaguuauuuccuuuuuaaucaaaacaggacaaaaguaggcugauuuaauuguuauauuucauaucuucuuuuuaucauaguaauugagagauacauauuuaauuccauucuccuaaucgccuguugucccaguggauucuuccuugcaucuuauggucugcacccacaauagccuaaggcauuaguugaauucagaagauaggauacaaaaaguugagaaaugagccuuugggaaucuucacaguuaggcagggggagggauccuaggugaaguaaggguucaaauccaauuggcucaugcagagaugaaccacuacagugugucuauuuuaacuaauaacaaacgcauuaaucuaaacacgaagacccaaccaggaauucagaauugcaguuuuaaaaaaauguaagcauauauaaagugaaugucuagucuuuuagguugacuuuacggaaaguguuaaauucuucccagugccaauaggagacagaauacauggauagacccucagugcgacucaauauaucauuucugacauucuuauguuuacuuuuuaucacuuacucaucuuguagggguccugagaaaauaaaugaauauccagauaugcaaguugcuuugcuuucucugagcgauuauagcuauguaaguuugaaaggauuaauccuugacuauucucuuccaucugucaggagcagaacucugacauugcaucugagcaaugccccuuaacccuccucuuuugaucauagagaccccauuacacaucuagaccccauucaacaaaaucaugacucaccaaguuuuagaaauuaauuuuuguauguuacuuuaauuuuuuuaaguaagucuucuucuauugcccuuaaaauucuugauuaccuguccaacaaaucucucgguuucccuuagcaaugggcacauucuuuguaacacagauagaccaaugaguucuuucuguuuaggugacaucucugaaccauaaauauuuucgcacacacuuggaggacagccuuuccuugggccgaccccuucucauugaggacauucaugaagagcuggauccagccuuggauaauguauuagaaaagaauuuuauuaaaucuggcaccacuuucaaggugagcuuuguaaaaaaaaaaaaaaagaaagaaagaaagaaaagaaaaagaaaaaaagaaaaaaauuaagaaagagaaagaaagaaaagaacaauggugacaucuacuuaucuuauugagcauagcagcaaaugcaauuuccuuuaggcaguaguauuugguacgucggaaauaaacuauuuccagacugauacuucaguguuuccuuuuauuuuuuauagcguauaaaaguuucugaggugggggcaauauuuugauaagaguagucguuuagcuaaaacuaaguaacauuaaggaaacacauugucuggucuuaauauguuagugcaacacacaguauauauauguuuaagcaacucuagauauugguuuugcaagccuuauauauauacauuuuuacaaaauaacccggauuucuucccuggagaaaaugacauuuuaauaaagucauugauuugguaaagucauugauuuaauaaagucauuuuaauaaacacauugauuuggucauuuaucucuuuauuuucagucuaaacucauugacuuuguuggaagcuauggaauauuguucucaauuguuggugaugaauuauuuucaauuuguauaaguguuucauguuuaauuugugucauucucuaccuuuaggcuucuuaaguuuuauaacagcauuucugauuggguguuuauuacuuuggacaacuuaauuucaugaguaucagugaauaaguaaaaaugaauauuuucucauuaaauaaagacagauuuauucagaaaaauuuucuucauaaugugaaaaucuuuuauaugccgcauuuuaaaaaauucauucagcaaagguuuauggagcauccaauauauacuuaagccuuuaugaguuuauagggagaaaaauaaauaaaacgcaguuaguguucugaagguuagcaucauucuauaagauuagaggguagaauuucucuuuuucauaaaaagaagcuaagaacaaaauuuuggugacuggcuuggauauuauggacucauccacaauuuugaacugcauuuaaaaagguuuaauccacagguaaagaucguauauauuuaaacuguacaaugugaugauuugguauacauauacguuguauaaugauuaccacaaucaaauuaauuaacacauccaucaccacacaugcuguaccuuagauaccugaaacuuguucaucuuaucacugaaaguuuguacccuuugaccaacaucuccccauuucucccauccccuaucuugcuggcaaccacuguucuauucucugcuucuaugaguuugacuuuuuuagauuucacaugugagaucauacaguguuuaucugugucuggcuuaucuuauaugacauauuuaauaugccaaaggagguuauagaaucucuauucccgaaggucuuuuaaaagauccuagauuuuuaucugcaaugugaaggcauaaugccuuagaaugugaugguggccuuagugauguuuucggucacgggcagaauuaagauuaaccagagauuuaagucauuuaaaaauucuaugauugccaccugauuuuuagauagcaaaaaccaauuguuuuuucaacaugcugcaaauaguaguguugaagauaaauguuaccuuuuugaaaaaaguuggcguuuuuccuuugaaaauuacauuaacuuuuucuguugucaaauaugcuucagauauaccuaugaaauucaaaaaacaaaauuuccuauaaacacaucaaauuuccacaguaggaaacaauuuucuuaacuggagaaaaaauagcggcuccuguacuacaaacaauugaugggagugauaaguacuugcuaaaauguuaaagucaaaucuuagauaugucuaaguuuuccuuuauucaccguuuguuuuggauaacuuuuucauuugauuugcuugguaucauugcuaaaaacaucaccaggcaggacuacaauucuaaauuauucuaaauugaauaggcuuuauuauuuaagaucagugauuaaaauuuuguaacuuuccuucccaauuuauugaagcgucacagcacugacagguaaauucuuuucuaaauugaacccaaguuccuuucccugcccuuuaagcuguuuuuaauuuuauaugugaauuuauguaggugaaagucggugauaaggaaugugauaucauggauacauuuaaacuuuacauuacuacgaaguuaccaaauccugccuuuaccccagagauuaaugcuaaaacgucagucauugauuucacuguuacaaugaaaggacuugagaaucaguuacuaaggagagucauucuaacagagaaacagguaaucucucucucaagguaaagaauuucugcuuauaauacaugcuuaaaauguauugagaaauugcuaaguaugugaaaaagaaaaaaaaauuuaaaaaccauauuuauccuuguuaacauaaguauuucuuuugcagccuuaauuccugucaagaaaucauguaacucaucuucucauccagccugaaacacacacacacacacacacacacacacacacacccgucucuuucuacuucugucuuuaaacuucuagguguacugacucucuuauguauaguccuugucuuggggacaccugaaaacaucaauaaaacaaugauugagagaaaaagaaauuccucugaauggcucuucuuuccacuguaguaguuucaacuacuacaguccaauaaucuaaugauauagggagccauaccuuuauuuuuaauuaaauuuuccugcacuaaagcagggaaauuaugucuaacugaggguucuaauaaaacaaagaacaacuuaggacuggaagauuuuaagagacugauacaagauuaaacuaauuuuuaaguugaagcucagaaaacauuguuuuaugcauaaaauauaauugcauaaaauauuuuauguaucugcauuauaaaguacauuugcauaaaauaugauaaaguaauuaauuuuagaauuaaagauucaagacaaaggcaagguuagaaauaauaagagcagcaaggcaugaaguggaugggugagaaaaagaaugacaagggaggaaaacagacagaggagggaaaagaggagaugugaauccagggucccaaacacaggagagacauccaagaagggagagggaaaugacacagacaccaaagaaguagacucagugaaaggcaacauccuaccuggcucauagacaguuaccacaggcacaggcccuugaaagguggcuggucugguggagugaaaagggcacagucucagcuuugacucucuuaguuguuugaucuugguuuccaacaaaccuggggcuuaugcaguccaggaagggaucccguuccucuuccacagccaggcggagauggcccuggcccggcaauucacuguuuccaucgccucucaggaucacaugcuguuaacuguugacaguuagucccuuguggucuaauuggugcuguggguuuauuuugagaugauuccucgcuggucuagaucccccaugcaggcugcacuaaccuccagaagucaagcaacuccacugucuaaagguccccagggcuccccacacccacucuucuuauucccuagcuuccucuucaagagaugugcuaagaugcucauagcaaccuugcuggagaaaaaaaugcacauuuaauaugcaggaggguauucuaaacauuauauuuaacccuccuaacaauccuacuauuauacccauauuuuuacagaugagcaaauggagaccaaagaaaauaagggucucggucuguaacagcacauggacuuugcagccugccaagccuccuagauaagguuuacagguccugcuaugaaguuuagcaagaguccacugugcuaugauaucuguuuuuccauauccagaaaaggaagcuaauaugauuucauuuuguccauguauuccuauacugccacccaggggugaccauuuuaaugaaaaugacuaacugguuauuucccugcaaauacagcaaugcucuuuaucgccccaucaacuccugccacccuguaaguacaauggcaauaacacuagucuuggaguuggaggacaaggguauuaggcuguuuuaacacacagcuaguuacuggcagagaccggccuaauacccuuguuauucagaguucauauuucuggguccuuggcuuuuccaaauguaaaauaaagaaauuggacuaaauucagcacauuucaguuugacaaauauuuauuggguugaguuucuucuuuacaaagccacaagauaaguacugucaauaauacaaaaaugaauaggaaagcuuauguaucuguuuucuagaugcauaaaccguaguuggagggaaauaaucuacugauagauugugauacaaacuauauuagaggccaggcgugguggcucaccccuguauuccuagcacuuuggaagguugaggcagguggauuaccugaggucaagaguuugagaccagccuggccaacacggugaaaccccgucucuacuaaaaauacaaaaauuagccaggcgugguggugcacgccuguagucccagcuacucgggagucugaggcaggagaauugcuugaaccugggcggcagagguugcagugagccgagaucacaccacuguauccuagccugggugucagagggagacuccaucucaaaaaaacaaaacaaaacaaaacaaaaaacacgcacagaaaaaaaucacaaaaaaacaaaaaacaaaacaaacuacauuagauguacagaugaaggcugugccauggcuuuugauugacugguucaggaagacuuuuugaaaaugaugaaauuucugaagcaauuuucccagaaaccuucccaaauaaguuuuaaaacaccuucuuuuaacguaauucuaagugcagcaugugauucuguauaaaaucagaagaaaaauguuguaaggaauauuauugagauuauugagauuucaauguagacucuguguuuagugagaguaucagugauacugacacaucaguaucaguguuaaauuuccugaauuugaauauugggcuacacuuauguaaaagaaugaccugguucuucagagauuugcuaaaguguuuagggguaaaaggacaugacauccacgagugauucagcaguaauaauaaugauaacaacaauaacaauaaugacaacauuauguauucuauagagauauagugauaaagcaaaaugugauuuggugaaucuaagugaaggcuauaugaaaguuccuuguauuaggcuugcaacuuuuugaaugcuugaaauuuuuucaaaauauaauuuuaaaaauauaucauuuuauguaagaagaaaaaaacuccuguaaacauucaaguuugcccucuguagaaggagauacaaauaaaauggaaaauggguuuguauuggcaaucggcugugccaaaccagguaccuggugcucccauaggaaccaggccaagagcucacauuuaaucuggguagccccuugguuucuugguauuauugccuuuuuguuucuacuuguucugacugcaaauaaagauagcauuucuuacagaagcagugugggaacagggccaagagaaugggacaugcuauuuauaaacuuaaagcuggcaagagagcuugggguaauugggcaaaauuauuuagcagaauugucuggugccugccaguauaagugcuguggaaccuuaaugacaguaggcauaauuuuaaaaaaauuuccacagaaacaaaaauauggauagauagauuuggcuaaugauaguaauuucuucugccauucaaaagguacuuugcuuuaaacuuuuaaaauuguuaauaaacacuagugaguuggguuuacuguaauaacugguaauuauaguuccaauguuauuuuuuguuuuuuaaugacaggaguuagaggcugagaggguuaaacuuuuggaggauguuacuuuuaauaagcggaagaugaaagaacuugaagauaaccuccucuauaaauuaagugcuacaaaagguauuguguuauuaagaaguaaugaaauaacggauucugaauaaggauuucauuuacacucuuuucaaugcccucaugacuauagauguuaggaaauacucauguuaucaaugcaaaaacaagcaaggcaauuuccaucuagacauuaaagagggacggcagagaaucugauuuuugaauuagcaaauagagacugagcaucugagaauaacacaauuuucuugauauaauugcuuucuccugagaaaaauuagggcuccugauagagcuagauaacucauuauagguuaauuugcuugccccaaagaaacuaaugugcucaaucuauuuuuuuuuuuuuuuugagacagagucuugcucugucucccaagccagacgugguggcucaugcuucuaaucccagcacuuugggagaccaaggcggguggaucaccugaggucaggaguuugagaacagccuggccaacauggugaaacucaaucuauuuuuuuucaaauugacucuuucauuuggcauugaaaugcaguuauugcaacggguuaugacacauguaauccaugucagaagagcuuggguaccaaaggcccagcuuacccucuacuuggcuugaccucccacuuuagaugggaaagacagguucuccucugggcagccaaaucaucaugccacaccucaauuugaggauguacucucucugcaauauauaaaaagaaaauuuuauccaaagaaaauaaaaucaacaaacauauuguucuguagcagacaaaucacagaaaccugaauucuacuaccuuauuagaagugaaugaauacuucacaacugcaccuuaaucccgggauguuauuuaaacaagucugaccuuccagaaguacuguaccuuuauggugagcuuagugaaaaguccuuuuaucugccuacucgcacugcucccgcuagugaaguugucuguuucuugguccagugacuccucccagccauuugggauaccccugggcauuaaaaauauagcaagcagagcugagggcugcuccccuagucuagccaagagugugcuggaucaagaccucucuccuugagguuaaucccaauuuggacuuccacaguagacagcauacccguuggaguaacacagcccuuccugcagcacuugucugccaucccgaacucuaggguaggccagagugcugcuguucgcagauaugggaacuguucgcagauauggggacuguuagcucaguacauccaaggugucuuuccuuagauuuuaauuaaaaaccaaauucauugucauaaacaugcacuauuuccauuaaaaacaauaauaaaaaaaaaggaugaguucauguccuuugcagggacauggaugaaacuggaaaccaucauucucagcaaaguaauaucagaauagaaaaccaaacaccgcauguucucacucauaagugggaguugaacaauaagaacacauggacacagggaggggaacaucacacacuggggccugucgguggguaggggucuggggggagggauagcguuaggagaaauaccuaauguaaaugacaaguugaugggugcagcaaacaaacauggcccauguauaccuauguaacaaaccugcacguucugcauguguaccccagaacuuaaaguauaauaaaaaaaaaaauaaugaaaggcaaaacuaaaaauaaaauucaaguuucucuuccuggugagacauuuucacuauacccaauuugcucuuguuagagacagagggauuagaguuuucuauagcaacgacuguucuacuaaagcagugugaggaguguaccauucaacuaucagcaugacagucagcccaugugugaaguguucagguuagcuacacccugagacaagcagcguggacaagcugugacacuuugaggagagccaccaagaugacagugggugugaagccuaucacauggggaacagcaaagagcacuggagacaugaucauugucuugagacaugugaagacccaaucaaaugggucuuuugcuuuuugcagauguuuaggcagagcaggggauagucugucagcaggaauguucagaaggcuucagguauugggugguaguuggacuagaagcuuuuuggugucuuaagauucuacuguaccaguagucuuccugacuuuggagacaucaaguugaaagcuaacagcguuuuuuuuuuuucagaagagauguaucuugcuuugcaaguuucccgucuuguguacuacgguuuuccuguuuugaauuucaggcucauugguagaugacgaaucucucauugguguacuucgaacuaccaagcagacagcagcugagguaagugaaaaguugcauguggcugcagaaacugagaucaagaucaacgcggcucaggaggaguuccggcccgcagccacccgcggaagcauccucuacuuccucaucacagagaugagcauggucaacaucauguaucagacgucauuggcccaguucuugaaguuauuugaccaguccauggccaggugaguccucacuaccuucauccaaaaguggugacuuaaaaguuugcuuguauuucuacucuuuuagaaauugcuuuuucacuauucacaauagcaaagacauggaaucaaccuaaaugcccaucaacaguagaguggauaaagaaaaggugguacauauacaacggggaauacuaugcagccauaaaaaagaaugaacucauguccuuugcagaaacauggaugaagcuggaggccauuauccuuagcaaacuaacacaggaacggaaaaccaaauaccgcauagucucauuuauaaguaggaacuaaaugaugauaccacauggacacauagaggagaacaacagacacugugaccugucagagaguggagggugggaggagggagaggaucaagaaaaauaacuaauggguacuaggcuuaauaccugggugaugaauuaaucugugcaacaaaccaccaugacauagguuuaccgacguacaaaccuucauguguaccccugaacuugaaaguuuuuuaaaaaaagaaauugcccuuugcuucuuugauucuuaaaauguguuucagaucugaaaagucaccacuaccucaaaagagaauuacaaauauuaucgaguaccugacauaugaaguuuuuacauacucugucagaggccuauacgaaaaccacaaauuccuguuuguacuccucaugaccuuaaagauugaccuucagagagggacaguuaagcacagagaguuucaagcucucauuaaagguaaagugugugggauacagaugugguguguggaggauguugcuuuugauaugcucuuugauauaccauaaacccauuucugugauacaguagggaaaugauguucuaacgaaaguuuaauuaaguuuuauuuuuaauaccuuuuuucuguuuuucauucguuuugcccuaguuacuuaagauucaggccugugccaacucaccugaauauugguauuauuguaguuauugauauaacuacauucaguuuauucacugcugcccaugccaggaaaagugauacuggugauggcuuucuuuagcaggacagccauucccucagcaagggaguauaaugauuuuucagacugcaagaaaaggcucacuuauguuucauauuugaaguuaauccuauucauugcauaucuccauguuaaagguauaauuaaggagacaaaagaauggaauuuucauuucaguuuaguuacacgaguauuuacugagcacauguuauguaaacccaccacgcuagcuuuggggauguaagaauaaaccagauauugcuugaaaagaaauaauaaccucagaauggggauaaagauaauuuaaaaauaacuccaaaguaaggcagaaucaccuaagugcuauaagagagcuaagaaacaaguguugagucuaaaaggagggaaagauuacaugugguuggugaaaucaaaaaguuucuuagaaaauauaccuuuguggguuaagccaugaauuggggaacuauuugguacguggcaaaauguuucaaucuuuuucuuguguuuuuggcucuuuauguaugauuuaaccaauuauuuucuggcuccccacaccccauaaagaaaguggcauuugagguggacccugaagagguagaaaugaggaaaacauuccaugcugaaauggaacagcaugagaaagggaacgaguggagaacaucuaaguuguaagaaucagucugguuuuguugaaaugaaagguggauauggaggcauacugagaaauagagcuggacauguaaacuggugacauacuguggagagccuggguuccuguaggaaggauuuucuugaucugggaagaaacagggaguuguguaagguggugacgugauugaucauuauggucauuuagggaggugaacuuggcacacguguaaggaucaaagaaaagagguucaagggagucucuuucaaucuucccaacugcaggaauacauuccuaaccuagcguaaaggcaaugggaauauacagggagauaaggguguagagauuaaggaaguaaaauggcaaaaccgaugcauacaagagccaagagagcaugcagaaaugagucuaugauuucuggccuaugcagagauuucuggucuggugguuggaagaggaguugguuugaggaggguuggagugggggauugcuggaugugauuuuaggaccuguuuagucagaaucagaauaggccagguuuugcugccauaaaaacaaucucaaaauuucagugacuuaacacaaccaagguguacuucucauucauguuaccucuccaacgugcuguuauagucacucagaaauccacauugcuuccauaacuacuauggcagaggggcaaggauguggcagacugugcacuggcucuuaaaaguuaccccacaagugacacaugucacuuacgcuccuauuuccuuagccaaagccagacacacagccacaucucacuucaaaaagagcagggaaaugcaguuccccguguguuugaaaggcggggaaacaguuugugaccagcucuuaugacuacagacgugaaauuugagcuauccagaaaacaauuagaaaagauaaccuaggccgggcgcgguggcuaaugccuguaaucccagcacuuugggaggcugaggcaggcggaucacaaggucaggagaucgagaccauccuggucaccgguuuaggugaaacccugucucuacuaaaaauacaaaaauuagcugggcgugguggcacgugucuguagucccagcuacucgggaagcugaagcaggagaaucacuugaaccagggagucggagguugcagugagcagagaucaugccacugcacuccagccuggugacagagugagacucugucucagaaaaaaaaaaaaggaaucuagacaguccaagagaagagucaggcaguuacaaagaugggguacagaaauaacagccaaagccaugggaaugaaagcuaaucuagggaaaaaauguggaguauuucuaacccacaaggugauaggaccugcuauacuuuuguccucugcagccuauuuauaauaaacgggcagucaccgauaacuucuuacucuuucucuacuucauuuaauuccuuccucagauucagguuagauuaccacuguggaaacuucgcaaacuauuuugcaucaucucugaaaucucuucuuugugccuuuuucaugaacacagguuuuauuucugguaguuccaaggaaguugaaauguaucaugugguucauauuuuuuucacaggucuaaugcacuuauggaaguugguuuuuuaaggcaguguggugugguacaaugaacacuaucuaggguggggaggaggcacugcagagagugucaagauguaugagguuuuggucuuggggaugcuuaaguaaaguaagugaauuuacccaaucuggaaaccuauuuuaccucauuucaaaaaucuuuaagcccucacuuggacuugggcugcagcccugguauuguaugaugcugagcagggggguagggggcauugaagcgugcugaaauccaggcagcaguggcagcaaaaugacccccacaaucuggggaagccucauaucuaugcaccauggucugaauguuuguguccccucaaacuucaucuguugaaaucuuaccccacccccuccaaggugaugguauuagcaugugaggccuuuggaaggugauuaggucaugaggguagagcucucgugaaugggguuagugccuuuaugaaagaggccugagggagcucacucccccucccaccaugucaggacaccaugaaaggagccaucuaugcaccaggaaaugggcccucaccagacguugaauucaucagggucuugaucuuggacuccccagccuccagagcugugagaaauaaaaauuucuguuguuucuaagccacccagcguaugguauuuggugauaguggcugaauggacaaagauaccgugcaauacgaguggaggagaaguauacuuuugaaucuuuccuuacuggugagcuggcuuugcuuccucaaugccaucugcuaauaugaccccugagaaggaggcacauaugacauagaaaggaagaagugggaaaccuggugccuggguccacaguggauggugggaaggaaaaaggaggucagagguagaaagaggaggucaggugcaaagauccucaucucuuccuugccuccugagggagcugagaaggggagagugccggagaaacucccagauaggagaugccccugcauucugcccagugucacacccaccauggaagcaggggaauggcuggaugggugagccugagguuuggcuggcacacagcagagacuagaggucaaaccaaaaagcugucaagaaagagaacuuuguaccugcagacaaaggaccaaugccaggagcuggggcaguggauugcaguccagggccccaacagauagcauuugucguagcucauaggauacaguacagggaccuagccugcaccugaggugugggaagccuggagggcagccugcauaccugaggcaugcucgauacuaagacauagucccaccccgucucaccucucccaccuaccaaccaggcagaccagagcuacuaccugaaagagacuggguuauuugaaagaggguggguaaaccagaggagacugagaaacacggcaacacaguggggagggaauucaucagggaggauuagauuuguuacagaaaaauaaagaaggcugaacacauggguuguggugugagcacauuugugaccccauuucaugaaauuggagucagggagaacuauacuguauagggccaggagagucagugagaggaguuuggauuuaauuuaguuggcaauagggagccaucgaauguuuuaugagcagggauguggcaugaacagaacagugcuuuaagaagauuaauuugggauuuuaugauagguugauugacagcaguacaauuggcuuagcaauaaaggaguuuuucuuuuuaaacaaaacauaacauuuguuuuaguuuugaacuggcuuacauuuugacugaauuaucuuuaaaagaugguaugacuuuguuuuuaauguuucuuuacaaaguuaacaaauaugauccuuagaucacagauacuuuuaaaaaaucauuuugaacucaauacuuaagggggagaguggaagaguuauuuauccuagcagaaauguuugauuucccaagagugacagguuuuuuuuguuuguuucaauuacuacuugcuuucugcaauauuugcaaggugccuuugacuuucuucuucaaccaaaaaugucagaacacuuugaaaaaugaaauggauaccaggcgcaauccugcauuauagagcaauggacuuaucuuucuucccugucugguuauuuuagaaagauauuaucuuucuuuugucauagacucuguacaaaaagacaccuuagggggucuuuucuugccuuccaaacuggacugaaccugggccuuccaagcggggaaagaaaaagagagagagaaagaaugucagaacaagagcuaaugauuacauagcucuuauuauuauucuauacuguucuagguacauuaauguauuuaaccuucacagcagccaaucugguagauucuaucagacauccacuuggcagaugaggaaacugagagggauucauguuuuuuuguucaaguuuaugcagcuaacaagcggcagagccaggauauuuugggggaauaggaagggcugucauuguucuggguuaguuuaggaaacacaaagguagcuuagauuucuucuccuggugucucuaaagcucaggauuacaugaaaacauuucuuuggaaacaaccaagaagaaaaggggugaguuugucucugugccaggccugcagguggcucucucuaguggcugcuucucgcaccagugacuccuacauuagcaauacuguugcuccagugagaccugcucugucuccagguugcagaggggccgacaguaagaagaagguuuacacauuguucuaaagguguuguugcacucagagccacagauucccaaguccccuguggugaagcaaauggguuuacaugaaaaaaguacuuucguucauacagcuacucaggacgaugcuagauggggagagcaaagaccuguaguucccccaagccccuuuuugguccaugaguugauuugugaacuggaaggaaugaugaguucuuaaggaagaugauaagauuuaaaaguuaaagaaucacugcuuugcaugcaucugaauuaaacaacaguggagcuggaauuauuaugauacauuacuaaagacaugcaauagaggaauuuuuaaauuguaaauaucaucauguauuucauuggaaaaugcuggguaugcccauuuggccugagauaugcuucagaauaugaucaaugcuguaacucauucuccacuggacucaagcucuguaaaagcaagggccugguuggguuuucugugcuauaucccccagugucuggaacaugucaaacaccuggagggcgcucaauaaauauuuguucaaucaaugaauggauaaaugauuuaaauauuacucauccacuaaaaaacccauagaucuauuauaucauuuccuccuucacuuccuucuuuauucccccccucuuuuuaucccuggccuauguuucucccacccuccuuccuuaacccuaaccccaaccuuaacccuaacccuaacccuaacccuaacccuaacccuaaccuuaaccccaacccuaacccauccaugucuuuaucuaucuguuugaccugguaacaaguaguuuuuaauggcaagcuucuggaggaguaaugacuaagaagugauauuuaaaauccacacauggaaagaucaacauauucauugauaucaaaauuauaaguuuuagguuguuaaaaaauaaaaagcaaacaaauauaaucacuugagaaaaauucuuugcagggaaaaaugacagaguuguuauuuauaccuuauaagaugguauaaaucaguaaauaaaacacuaagacuugaaggaaauguaccaaaaaacccucacauuuucuguaauauuauuauuuuccaauuuuccuauauuuucaguaauguggcuauuuugcuuuuauuauuugaaaaguacauuucuagaagugaaguacaggcuuacccaauucacccugucugacgcucuuccccagggggagcagcucuggaccugaaagccuguccucccaaacccuaucgcuggauccuugacaugacuuggcugaaucuuguggagcugaguaaacuuccacaauuugcagaaauuaugaaccagguaauacaauaaagggcugguugaaagugcagaucugcaaacccaaacauaccugggccgcuuaaacuggggcuuccuggcagcaauuccuucacccaaaaaagucaacccaauaguuuggauuugaggcucuguggcugucugggagagaucuuggacagauggaccucaggguuaaccucuucauaguugcaggcaacuauguuuuccuccuguguggugggcaugggucauuuuuguaugccuguuagaguugcugcuggaaucagaaccaguagauggacccuuuuauuguagacgacucaugcuuuuacacuuuaacuucugccuaugauuaagugauuuguacagauuugaaugugagucaaauuaagagguugaggucccucuaaaaaauuaauuauuuuaguggugaaauauaauggugaaaauggagaaauagguaccgauuugcuuguuguuuuuuucuuauuugaaaauguacauugauuacuguggauuaauuguugagucaauuguuacuggaaaacaaucaugagacucagaauaaagauagcuguuucuuacuggguucuguuggcugcaacugccugucacuaauggagccugcaguuucccagugucagaugccaauaaucaucucuuuucuauggcugcuagugacugacagauggggccauagguagacugcagguugucagagccucaugcuguaaucaccaauccccugcccaacauacuguguuagcugccucuguuuguuuaguggcauuucugaaacauuguguagacucuaccuauucagccugguugggucugagucaauuggauaaacucucuggguuccaucuguggauagacagugagcuuuguuuuguaguacaaccacagaugaguccuccaagcccaaacaaaugcuuggaaaaagaaagugaucuugggcugggcccgaugguucacgccuguaaucccagcacuuuaggaggcugagccagguggaucacgaggucaggaguuugagaccagccugaccaacauagugaaaccccgacucuacuaaaaauacaaaauauuagcugggugugguggcgggugccuguaaucccagcuacucgggaggcugaggcaggagaaucgcuuaaaacugggaagcggggguugcagugagccgaaauugcaccguugcacuccagccugggugacagugugagacucugucuugggggaaaaaaaaagaaaagaaagugaucucggucugaucagagauuggguaagggagauagucaagaaccacuggaaaaaucacuugaagcccacgcccucuaaugaugguuuauauugauacaaggauauuuauuauuguuugccucugccaacuagguuuuaacuacucaugagguagaauauaguagcuauuacugcuuacuaugggauagguacuuugcaacaauaacccugccacagaagggcagaguuauugacccuaauuuauagaugagauaacagagauucaaagaguuaguuaaguacuugcccaagagcccauugccaauaaguggcaaagcucaugcucuucccaugccaucaugaguuauuucucucccacuccucuuacaccaccgauugggccagaaguggggugaggggcaguucucaggaagguugcaaaaguucagcggagaccugcagucagguggccaucagucuggccugccugugggaaggaagggaggaagcagaagaucaaucucccagcugaguggaugucaggaacugaaauauaauagagcagcugcccugaccuuggcaucccaggccaagggucaggaaaaggaaugagaaauggagauggacauccagaggcuggaagucaucuuaucaccuaucauggcugcagcucacuuugaagcucuacuguggucaagucaaaauuagcagguggaaagucaguaggugaagaauagucauccgcuuucuuccugugccucagcugcagauguggaggaggccugugggggacacugugggcaggggcaagguagggcucgcaacacccaggcccuggcaugcaggcaucuucuuugagggcagccaaccagagagagcugcugcaaucuucaggagauagauggcaguugugaaacauuucagaaauccucuucuuuuuuuuuuuucuugagauggagucucacucuguugcccaggcuggagugcaauggcgcaaucucagcucacugcaaccuccagcuccuggguugaaacaauucuucugucucagucuccugaguagcuaggauuacagauacacgcugccacgcccagcuaauuuuuuguauuuuaguagggacggaguuccaccguguugcccaagcuggucgcgaacuccugagcucaggcacucugcccgccucugccucccaaagugcugggauuacaggcaugagccaccaugccaggccagaaauccccuucaucuuuuagugccccagggacaaagugggagcaacugaguugcagaauaacuguucuguuauuaauuuauacucuaucuguauccuguaugaugaauuguucacaccacagauaugagacuuuggacaguuauuuaaccucucuaugccucaauaaaaaguaggggucauagaggaaaaaguguaauccucaggucuggcauagggcaucugcuaugugagccuuugcuauuugcuauuacugcuuacuguggcuuuuuuauuuuaauuuuaauuuuuuuauuuuuuuguuuuugagggggaguuucgcucuuguugcccagagcuggagugcaauggcacaaucuuggcucacagcaacaucugccuccucgguucaagugauucuccugccucagccucccgaguagcugggauuacaggcaugugccaccacgcccggcuaauuuuuuuauuuuuaguagagacaggguuucuccauguuggucaggcuggucucgaacucccgaccucaggugaucugcccgccucggccucccaaagugcuuacaggcaugagccacuguguacuguggcuuuuuuaaaagcacacuuacaaacaccgucuaaauaacccagccugauuguugcugaagagcagggauaggcucaauaaucuauaguuuucguacuuagucuugauggaacuugggcgucagugagcaccuuuuaaugccucugaaaaccugaaguccuuuucaugcuucugaacaauauuuaagaccagcuguuggagagacuccuuucguuauuaggcuuuaggucucaaggugggggaucacuaggaaaauaaaaguuuugauuuugucaucuaucauuauuuuuaaguagagaucaacauuuagagguuggguuaucagaauggucugucagugguucucaacugaggguaaucuacccacccccaggggcauuuggcugugucuggagacauuuuugauuguuaggacccggguggagggugcuacuggcaucuaguggauagggacgcugcuaaacauccuacaaugcccaggacagcaccccccacaaaaaaaauucagauccaaaugacaguaauaccaagcuugagaaaccuugauuuguguuucuucuggcccaaucauuuggugcaguugacacacgauccuaauuguagcgaauaauguagaaaaauaauggaagaacuggaagggaauaguaauauccaaguuauucaagucauugauccugaagaaagguuuaaacugugcuguuaugcuugaaaaauuaucugccuguaaagaaugacccucucaggugauucagaauccuuuguaauauauuccacuuacauauaguucuguggcuugcuaauuggcuugcuucuuuuagauaucucguaaugagaagggguggaaaagcugguuugauaaagaugcuccagaggaggaaauuaucccugauggauauaaugauucacuagauaccugccauaaacuuuuacuuaucaggugagaacaggcauuaucagaccuagaagcaucacucauaauauugcuaaauuacagauuuuaucucagugaguuuacuucacuauaucacugucauugaaaguaacggcaaaaaccgcaauuacuuuugugccaaccuaauauuauaagaaauguauguacuuccaaauuaugguuuuggauagcaguucuucaguuccuugacaagcaaaauaaaauggugauggugacagggaaugauguauuuugacaacguauuaaugauagugcuuuuagcaaaaagcgugaaaaauaugcuuuuaauauucacuuuguucaugauuuaccauugaguguaaaucaguuauuguugaauuuauuucuuuaaaaaaacagaccucacaaaguuacaagacaauuagcuuauaagcuaaaguuaaauugcauucgagaaaaaaacccaauaauauugcacugaauuugaaauauauaaaugcuacuuuuggcuauaaaauggaaacaaaaguuugaaauugauguuaaagaagaaaaucgcccucucuuuucacuguuuacauuuucucaguauccaguaacucagagaccuuccacauugaaaaaaaucagugugugugucugcguguguguguguguguguguguguguguguguuuguaugguggauggguaaggcagaggaguaaagcaggggagaugagacccccacaugaaaaaugagagguagaguuauuuugaagcaauuuuuucuuuucuaauguuauacaccuaaguuuccacuucuuagaaaaagcuguuucuuagauauugucaaccuucaagagugaccagaacaacgcuaauguugaccucauaguccgcagaguaugaaaaggcuuuuuuuuuuuuuugagacagagucucacucugucacccaggcuggagugcaguggcaugaucuuggcucacuguaagcuccgccucccggguucacuccagucuccugccucagccuccugaguagcugggacuacaggcgccugccaccacgcccggcuaauuuuuuguauuuuuaguagagaugggguuucacuguguuagucaggauggucucgaucuccuaaccucgugaucugccagccuuggccuuccaaagugcugggauuacaagcaugagccaccgugccuggccagggcuacuuaguuuuauuggaacaaaugugucuuauuuuuuaauccgucacuuaaaaauuagaucuaugucaaauagugcaaucuaguagcaccaaaaaaaaaaaagucuguggggcuugucugugcuuuaccauaucaauauuaaaugacacuuauccaaugugucuguguguguagaacuugcuauggugugcacuacacaaaugguaugccacaaaugcuugcugacccacuuacuuugggcaucuuuggcauauugguuccuccucugaaaaggcuguggagcuucagaguguguggcaggucagccccuaccauguguuggagcugguagaggacacuguguuguuaugggcucugcccuacuucuugccaaugccuggcugguaccaaaaccacacgauuaaguuugugcucaucugugauaggaaaccuugccauuccucuuacuuagauguggaaaaguaggaauuaacuuguugcccuuuugcuaauuaaauguauguuuuuacuuacucagauaggauaaaaauugaacacguuuaguuuauuucgccuaacuuguauucauuuuuaggucuuggugcccagaccguacuguuuuucaagcaagaaaguauauugcagauucuuuggaggagaaguacacagaaccaguuaucuuaaaucuggagaaaacuugggaagaaagugauacccggacaccucugauaugcuuccuguccaugggaucugaccccaccaaucaaauugaugcauuggccaagaaacugaaacuggguaagacuagcaaucuacaaaauguagcaacacuuccauauuuuuuugccccaaauuuugccuuucguaauuuuauaacugauucuuagaaauagauguaaaacugaauucgaaaaauauuaaacuuauuccucuuucauccuuucauaccuccuaaagugaggguaugauauagguaucuuuguuuagagaagaacaugcucaucuagcauauaguguuuuuuuuuugauugguuguguuuuaaguucuaaggagauagcuguauugcauggauagcugacuaacaagaaugaacacacaauagccaaaguuuauguuauugccaugucuauauaaaauuacagcaaaguuuauuuugucacaaauuaaaaaacuauaaccauuauuguaaugcauaguaguuagggauuaauuauuucauugcuuucacuuaauaaccauucaguacaggcagugugcuagaucuggggagcacagagaugaauacaacacagcugggaaagacagacacguaaacauguaauugaaggcaaugugacaacugcaguaaauguuucauagaaguggcugaucacaggauucagagcuacucggauugccugggguauaggggaaaacaucacauugaugauauuugaguaggaaauuaaaaaauagauaaaauuuaccaggugggguggugggagauagaaaguuacuccagggagaggagaugggaaagaaguuauaaacacagaaguguuuauaagugugacugagucaguaggauuaaaggacagggaugcagagcacaucuugacaggacugagccauccuguaagaaggacuuucuugacaggacugagccauccuguaagaaggacuguuuaucccuugcuucauucauacucugaaaaucggaaugcuguugacauuggcauuugcaaucuucuagggucagguaucuguaacuauaccuuguaggguuaauccaaucaugucuuuugaguauuacagugauugauuaugaaucacuaaaucuauccugugaaguaaaauuacauuaaauuuauuacauagucgacauaagcaugauauaaaaucaauucagucauguccacguacuagccacaugucccucugcauaaaaccaagcuacgguagcaugguccauguucauguucucuuuucucaucuugacuucacucuauuuguugucaccacacuguucuauauucucaguggaucaguguucaaauggccacggucuucugucugaacacugauaccaaugcaaagagcucccagguucuauuggcaacugcucaugguuaagucucauucgcuaucuucaaaguaggcaguuuugcucuaguauuuacugcagcacaccagccgucugaguuuaucucagagugaugccucucgaguagccuuauaguuugcaaaucucucucaaaucuguugcucuaugaguguuuauccagcugccucuaagccucacuucucucugcacacagguauauuuuuucucucuuaacacuuaccauucuucuccacauggcagaacauguggcuucuaguggcucaugggcuucacugcuuacgugcucagaauguucagcacccucagggaaacuccucuuauugucaugguuccaaguuccaauauccagggaaguaacucauugucuuugcuuuggucaugcacuccuuucugggccaaucaaugaacugucgcucuggagauagguuccuaguagaaaccuuauguacagagcuggaaugggggacauuucuuagaagauacaacgccuagaagaaggaguauucaacuagaguuaccauuucaaauguuguaauuugagaacauaauuaaaaaauucaaggucuccuuugggagaaauuauaacugacauuaaaugaaugcagaagggcagacuuguguuauauccuuuaguguuaucauacugcuuugcuuggcaauuuggugguuuccguuucuugguccuaccuuacuuuuuccaacaacaauccaggcuucuauugauuacuuuauuaggguacuggaacaacauagauuuggcuuuaacacugaaggaucaaaugaauuuuauaaacaauucuacugccaaaucauuugagcaguauuaggaagucucaggcugcuugcugcuuuggguugaaagucccaaagauagcuguuaaaauggaacuauuacacauaccgaacaacauguuaauguagucucagcuauuaauauuuuauuugaaaaucuggauaauaaauaaucauagaaugcuucaggugaaugugacuggaaaucuugaaauccaauuacuuuuuuuuuuuuuuuuaacaguugggggaaacuauggucuggagauaaggccccagaccuaguccguggcagaucugguucagaacuuaucucaggaaccccacuucagugaucucauuggucuuucuuuuucauuccuucucauuguuuucauugaaugaauuaaccagcuacccgaaaauaacauacggaugggacagaaucaauaaguuuuuguagaaaaagaggagaagggaaacuuugguuauagauauugucuuguacuggucaagaucuguagugagaaauuuggagcagauaaacucugcacagaguacuggguacaugggcaaaguggagaaagcagauggguuuagcacgagagccuuucuaggagccugacuacuggaggagggaggucucagaggaaggaugggcuuaaaaagaacaccuaaaaacaaacgaaagagaacaaauacauaaaaccccacaaccacacaaaaguaguagugggaaaacugauauaacaauauguacagaugaaacauuuuaacauuuuaaauaauaagagaauggcucauaauuauaguaauaaauuacaggccgggcgcgguggcucacgccuguaaucccagcacuuugggaggccgagacgggcggaucacgaggucaggagaucgagaccauccuggcuaacacggugaaaccccgucucuacuaaaaauacaaaaauuagccgggcaugguggcgcgcgccuguagucccagcuacacgggaggcugaggcaggagaauggcgugaacccgggaggcggagcuugcagugagucgagaucgcgccacugcacuccagccugggcgacagagcgaaacuccgucucaaaaaaaaaaaaaaaaaaaaaaaaaauaaauuacagcaucucauuaaaauuggcaaauuuauagaaacauaugaauuuagaaaauuuccucagaaaagguagaaaacccugaauaaaccaauaaucaaggggagaaaaaguagaaguuuuaaaauuauuacaucagcaaaggcucuaggcuuggauaauuuucugauaaguccuuuaaaacuuucaaggacucucauaugcuauauucuguuccaaaagauggaaaaagagaauacauuuuccuuuuucuuuugagacaggcucccacucugucacccaggcuggagugcaguggugcaaucauggcucacuaaagccuugaccucccaggcucaagugauccuccuaccucagccuuccaaguagcugggacuacaggcacacaccacuaauccuagccacauuuuguuuucuguuuuuuuguagagaugaggucucauuauguuucccaggcuggucuugaacuccugagcucaagugauccucccuccuuggccuccuaaaguguugggauuacaggcaugaaccacuucaucuggcccauuuuccucuuuauuugcauuauucugaaacaguaaaccgacccagauaguaacugcauaaaagaaagaaaacuggcugggcaugguggcucaugccuguaaucccagcacuuugggaggccgagguggguggaucaucugaggucaggaguuugaggucagccugaccaacauggcaaaaccccaugucuacuaaaaauacaaaaauuagcugggugugguggcgggcacuuguaaucccaguuacucgggaggcugagacaugagaauagcuugaaccugggagguggagguugcagugagccgagauugugccauugcacuccagccugggugacagagugagacuccaucucaaaaauaaauaaauaaauaaauguaaggaucuuaacuaaaucacaagcaagaugaauuuauagugaugucagcaagaugucucauaucccuccacauaucccucccucauaucccaccaccacaucaggaauucuguauccaucuacagacaaagucucucugcaggaaccucgggauauagguagaagguugugaaacccuauuaaaauccaagaccuaggaggguuguuuugagagcacaaacugacacccaaauggcagaucugccaauugugcuuccagguucaagccuagaaauggcccugcuccccaaggaguuuggcuauagcccuuuuuggccuugagccugcaacuaaaaccaacugccaaggguuguagguggaaucaggcacacuagugucucagugcagaggcucgucugccugccaacaucgaucuuggcagugaacuugaaaguugcccuguggcuugucuccaaccacccucagcugaggucccaacucagagcuaacugugcaagagcccagaaggaggcuugcucauaucuagcagacugggagucugagccuccaugaagggcucaucaaccucuguaccccagcagauaccaagggugcccacugucagcucuggucccuccugcugcagucagggaacuauccuaccugugcagggaucuacugggagauacaugcccuucugagccaaugagaugagcucuucagccaucauccuccagcagaucccaaaagggcccagucucagcuccaguuccuccugcuguagucaggaaacuaauuugugcagagaccugcugggagacacacucccaucugaaccaaugaggugggcuugccagcucugccccacgucaaguccugaagggcuccggucucagccuuggcuccuccugcugcauuuggaaacuaucccaucugugcagagacuugcuggaagacaaacccaucugggccacugggacaggcuucugggcuugugucccugaccaacugucucacacaguucaggcacauugucccuaaaaaacaaaacaaaacaaaacaacaacaacaaaaaacuuguuauaaauaucagauuuuuugguaagccucaugguaaccacaaagcaaaaaccuauauuagauacacuaaaacuaaaaaguaaggaaucaaaacauacuacuagagaaaaucacuuaaccccgaccaagggaagacugcaagagaggaagaauggaagaagaaaggaucuacaaaucaacuagaaaacaaguaacaaaauggcaguaguuaguccuuaccuaccaacaauuaccuugaauguaaauggauuaaaaucuacgauuaagagacacagaguggcuuaauggauuuuuuaaaaaagacccagcuauaugcugccuacaagagacucauuuuaccuggaaggauacacacagacugaaaaugaaggauggaaaagauauucuaugcaaaugggcaccauaaaaagaacaggaguaacuaugcuuauaucagauaaaauagacuauaaaccaaauacuguaaaagaaggccauuauacagugauuaaggguaaauacaacaagagugcaugugugcauacacacaaugcacccaacaucagagcaccuaaguguauaaagauauauaaaaauuaauauauauauuaauuauaauaaaagauauaauuaauaaaaauguaaauauuaauagaccuaaaaggauagacugcaauacaauaauaguagggggcuucaacaucccauuuucagcaauggacaaaucacccagauagaaaaucaauaaagaaacauuagaguuaaaccauacucuaaaucaaauggaccuaacagacauuuacagaacauuccauccaauaguuguaaaauauacauguuuuuaaacagcacauggaacauucuugaggauagaucauauaugaagccacaaaacaagucuuaacaaauuaaaaaaaacuggaaaccuaccaaguaucuuucuugaccacaauggaaugaaacuagaaaucaguaacaguaggaacuuuggaaacuguacaaauacaaggaaaguaaacaauauguuccugaauaaccaaugagucaaagaagaaauuuaaaaggagauuuaacaauuucuugaggcaagugaaaauggaaauacaacacaccauaaucuauggaauacaacaaaagcaccucuaagaaguuuagagcaauaaaugccuacaccaaaaaaaaaaaaaaaaaaaaacaagaucacaaauaaccuaauguugcaucucaaggaacuagaaagacaagaacaaauucaacucaaaauuugaaggaaagaaauaauaaagaucagaguagaaauaaauacaauaguguuuuguuuuguuuuuuuuuaugaagucuuguugucucccaggcuggaaugcaguggugagaucucggcucacugcaagcuccgccuccuggguucacgccauucuccugccucagccucccgaguagcugggacugcaggugccagccaccacgccugacuaauuuuuuuuuuguauuuuuaguagagacgggguuucaccauguuagccaggaugauauagaucuccugaccuugugauccacccaccucagccucccaaagugcugggauuacaggcgugagccaccgcgcccggccgauagaaauuuuuaaaaguacaaaugaucaacaaaaugaagugauauauuuuugaaaugauaaaaucaguacaccuuuggccagacuaagaaaaaaagagauaugacuggaaaaaaaaaaaaacagagaugaaaaaggagacaucauaacugauaacacagaaauacaaaagaucauuaaagauuguuaugaaaaauuacaugccaacaaauuggaaaacuuagaauaaauggauaaauuucuggacaaauauaaccuaccaagacugaauuaugaagaauuagaaaaccugaauagccaauaaugaguaaugagauugaaucagugauuaagucucccaucaaaaaaaaaaaaaaaaaaaaaaagcccaggaacugauggcuucauuauggaauucuaucaaacauuuaaggaagaaauaauaccuauucuucucaaauuauuccaaacaauugaaguggcuaggaauuuuuucagacucauucuaugagacuagcauuacucuaauaucaaaacacaaggacacaacaaagaaagaaaacuacauacaggcugauaucccugaugaacauagauguaaaauccucaacaaaauacuagcaaaccaaaucaaacagugcuccgaaagaucauucacauugauuaaauggaaugcagggauguuucaagguacauaaaucaguaagugugauauaugacaguaauagaaugaaggacaaaaaccauaugaucaucucaauagacacagagaaagaacuggauaagauucaacauuccuuugugauaaaaacccuaaacuaauuagguaugaaggaauguaccucaacacaauaaaggucauguaugacaaacccauagcuaacaucauacuaaacugggaaaaguugaaagcuuuuccucuaaaauuaggaacacaacaaugaugccuacuuucaccacuucuguucaacauaguacaggaaggucuagcuagagcaguuaggcaagagaaagaaauaaaaagcauccaaguuugaaaagaggaagucaaauugucccuauuuguagaugacauguauacagaaaacccuacagaugccaccaaagaauuguuaggacugaaaaacaaguucaguaaaguuguaggauacaaagucaaucuacacgaauuaggguuucuauaugccgacauugaacuaucugaaaaagaaauuuaaaaagcaaucccauuuaaaauagcuacaaaaaauaaaauaccuaggaguaaauuuaauuaaggaggugaaaaaucucuacaaugaaaauuauuaaacauugauggaagaaguugaaaaggacacagauaaauggaaagacaucuuguguuaaugacuugaaagaauuaauauuguuaaaauguccauagcuacccaaagcaaucugcagauucacaugcaaucuuuaucaaaauaccaaugucauuguuuauggauagaaaaaaauucuaaaauguauaugaaaccacacaaaaucccaaauagcuaaagcagucuugagcauuaaaaaaaaaaguuuaaggcaccaaacuaccugacuucaaaauguacuacaaagcaauaguaaccaaaacaggaugguaguggcauaaaaccagacacuaggccaauggagcagaauagagaaaccagagauaaacccaugcauuuacaaccaacuuaucuucaacaaaguugccuagaacauguaaugaggaaagaucaaucuuuucaauaaaugguguugggaaaacuggguaauuauaugcagaauaaugaaacuagacccuaucucucaccauacacaaaaaucaaaucaaaguggauuaaagacugaaauguaagaccugaaauugugaaacuacuaugagaaaacacugaaggaaaugcuccagaacauuagucugggcaaauauuuuuuuguguaagaccucaaaaacaggcaaccaaagcaaaaauagacaauugggauuaccucaagcuacaaagcuuuugcauggcaaaggaaacaaucaacauaguaaagacauaaccuacaggacaggagaaaauauuugcaaacuaugcaucugacaagguguuaauaugcagaauauauaaguaacacaaacaacucaauagcaaaaaaaaaaaaaauaauaaucugauuauuaaaguggacaagagauccaaacagacauuucucaaaauaagacauauaaauugcaaaaagauauaugaaaaaggcugaacauaauuggucaucagagaaauacaaaucaaaacuacaaugagauaucaucucaccccaauuuacaugccuuguaugaaaaaaaccaguaacacaugcuggcaaugauguggagaaagaagaaccuucauacaguauugguagaaauguaaauuaguacuuuggagaauaguaugcagguuccccaaaaaacuaaaaauagaacugcucuaugauucagcagugcugcuacuaaauacauauccaaaagaggugcaaucauuaagaaaacuuugaaaggauuuuuuucauuuuaaauauaaaauuuaaaaaaacgaagugaaaucaguauauuguagagguaucuaucuguacucccguguuuacugcagcacuauucauaaaagccaagauauagaaucacccuaaguacccaucaccaaaugaauggauuaaaacaugcgguacauauacacaauggaauacuauucagccauaaaaaaagaauggcauuaugucauuugugacaacauggaugaauacggugggcauuauccuaaaugaaauaagcuaggcauagaaugacaaauaccacaugaucucacucuugagaaucuaacaaauuugaucucuuagaauuagaguagaauaguggcuaccagaaacugagggaggguagaggggaggaagaaugauuucuaguguucuagugcacaguaaagugaauaguuaaccauaauuuauuuuuuaaaaaaauauauaguccaaaauaucuagaagagagaauauugaaugcucugaacacagggaaaugaaaauuauguugugacggauaucuaaauuaccugauuugaucauuacacaauguauacauguauugaaacaucacacuguacccauaaauauuuacaaucauuaugugucaaugaaaaacaaaauaugacuuugaaaaggaagaauucaauagaacaucaagaaauaacuugcaaauaauaacgugccuucaccaaguuggaacacaugggcaaauauaagaaagaugcaggauuaagaaaucucaucacaacaauaagagaaaaacuucuccuuaagcuaucauacuguuaucuugaugggugcuauaaaagccauuuuauaaaaauucaacacuuauauuugacuuuugaaaaguaggaacagaaggauauuuuauuuauaugauaaugauuaugaaccccaaacaucgugauacuuauuggcgaacaacuagagacauauccauuaaagucagauacagaugucugcuauugccacuguuauuuagcauuguguuguagaagauauggcuaauguauugaaagaaucauaaauaaaagauguaacuaccggaaaggagggacaaaaucaacauuauucuuagacaauauaauugucuaacaaaaaauacaaaugaaucaacggaaaaacuauuagacuuaauagucuaauaguucagugaggugacuguuuacaagauaaauauauaaaaaaugaugcuuucuuguaaaauaagauguaaaacuccucuucauuauagcaauaaaaauaaaacugagaaauaauuuuuaaaauacucauuuaaagaaaacuauaaaaccuucuuagagacauaaaaguaguuagaauaaauggagagguaagccacauucccaguauagagauucaauguuguaaagaugucaauauuuccuaaauuaaucuauaaauugaagccaagucuaauugaaacucaagcaucauuguuuuucuaguuggauaguagagggauauuagagcuucuagaauugcaaauggacaagaauagcuaagaaagcuugaaauggaaaaaaauaagaauaauggggaaccagcaccaccagauuuuuaaaacauuaucaaaugccaauaauuuuaucauuuacauuacaaacauugauaaauauggagcaaaaugaaagggccaaaauuagacucuuguauguacaauagcuuaauaugugauaagauuugcauuuccaaucaguggaggaaaaguggguuagacaguaaacaauguugagauagcagguuaacuuuaguaaacauaaaaguuuuaccucacauuaaacucuaaauguuaggucgauuaaggcauuaagugcuuuaaaauaaacuauaaaacaagaaaaagaauauauucaauuaguuauauauuguugaguggccaagauuuucuuaaucauaauaccugagucuaaaaccagagggacaagauagauaauaugacuggaagaauuuuaaaacaucuguauguuauaaaaaggaauaaaauaauggcauuugcagcaaccuggguggaauuggagaccauuauucuaagugaaguaaaucaggaauggaaaaccaaacauauguucucacucauaagugggaacuaagcuaugaggacacaaaggccuaagaaugauacaauggacuuuggggacuggggagaaaagguuugagggugugagggauaaaauacuacuuauuggguagaggguacacugcuugggugauggguacaccaaaaucucagaaaucaccacuaaaaaucuuauucaugcaaccaaacacaaccuguuccccccaaaaccuguugaaauaaaaaaaaucuguaugucaaaagcaccauaaauaaaauaaaagcacaaacaaagaaacaaggauagguguguaggcuggggacuauagcauuccacuucagugggagacacugggaguccuuuuucuuuuuuuuuuuuuuuuuuuuuuuuuuuguaaaggacauaucauauuuauucauacacaugcuggaauuauuggugcagacauuuaaauacauuuucuuugagaaaguccuuuuuuuuuuuuuuuuuuuuugauggaguuucccucuuguugcccaggcuggagugcaauggugcaaucucagcucacaacaaccucugccuccuggguucaagcaauucuccugccucagccucccaaguagcugggauuacaggcaugcaccaccacgcccagcuaauuuuuuuuauuuuuaguagagacgggguuucuccguguuggucaggcuggucuugaacuccugaacucaggugaucugcccgccuuggccugccacagugcugggauuacagucgugagccaccacagcuggccugggaaaguccauucuuuuuuuuuuuuuuuuuuuuuaaauuuauuuuuuuauugauaauucuuggguguuucucacagagggggauuuggcagggucaugggacaauaguggagggaaggucagcagauaaacaagugaacaaaggucucugguuuuccuaggcagaggacccugcggccuuccgcaguguuugugucccugauuacuugagauuagggauuggugaugacucuuaacgagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaggaauuuuucuuagugcagaacaaaaugaaaagucucccaugucuacuucuuucuacacagacacggcaaccauccgauuucucaaucuuuuccccaccuuucccgccuuucuauuccacaaagccgccauugucauccuggcccguucucaaugagcuguugggcacaccucccagacggggugguggccgggcagaggggcuccucacuucccaguaggggcggccgggcagaggcgccccucaccucccggacggggcggcuggccgggcaggggggcugaccccccccaccucccucccgggggggcugacccccccaccucccucccggacggggcggcuggccgggcagaggggcuccucacuucccaguaggggcggccgggcagaggcgccccucacugggaguccuuuuucauauguugugaauuuuaaaaaaauguuugaaugcuguauccaaacuauucuccauguaugaauuccuccuaagaacauauugagagacauacauccagauuuauauacaaggguguuuaaucuagugcuauuuauaauacugaaaaaucaaaaaugucuuaaauauauaaaaagguauugauugaaugaacaagaaugcauaugacaugauggaacaccgugcugccauuaaaaacuguuuucugauaauauuugaugacaguaaaauauucacaacauacuguugaaacguagagauauaaaauaauguauaguccgggcaugguggcucacaccuguaaucccagcacuuuaggaggcugaggcagaaggaucauuugaggucaggaguuugagaucagucuggccaaacauagcaaaacccugucucuauuaaaaauacaaaaaauuagucgggcgugguggcacaugccuguaauccuagcuacucaggaagcugaggcaugagaaucucuugaacccuggagguggagguugcagugagucgagauugugccacugcacuccagccugggcgacaaagcaagauucugucucaaaaaauaaaauaaaauaaaauaaaauaaaauaaaauaaaauaaaauaaaauaauguauaauacauauaugcauauauacauuuuaauauagauaggucuacaaacccuuggagucagauauguuucagaaaucagaauguucugguuuuuagaaggugauauuccauauauuauauaauacacugcagcuaagauauaaauauucaggaagauagggauaaauaaagacuauaaauagccucacaucuguuuaggucagcuuuugccuccaaaaugauuuacgauuuucagagcuuucugaauuuugaaaugaagguaagggauuguggauuaugcauauuaaaaggauuagaauaaagaucucuagggaggaauauuggugauuuuuauuuccuucuuuauaugcuccuguauuuuucaaaccuuuuaaugugaacauauauuauuuaauuagaaguaaauccaaaaaaauaagaaaaaguggaagagacacaagccuaauuuuggaaaggaauauaaaggcagucaaaauuuuacuaaagucuuucaaauacaaacaauuaaaacaaaaccuaaaccaccaaaguguaauuauacuguaucaccugcagcaacacuuccuccaauguuuccugcauacacgcuucucuugagagucccccuuaugauaucuuggcagucuuugccccccaccuguaaaaacucagccuaugcuguuucuugucucauuggccccuuuccuuccuugcgugggaauguuucucacuuuuucaaugccaaucaaucuuuuucuuccccaggccacucagaaaagauauaaaauauuuaucaccuuauauuaaaugaagaaagauuacaaauuaauaacaaccuuccacauuaagaaacuuagaaaagaagagcaaacuaaacucaaagcagucaaaagaaaggaaauaauaaauaugcgagcaaaaaaagccagauaauagaaaaacaacaaagaaucaagaagucaaagguaucuuuuuugaaagaucaauaaaacugacaaauauuuagcuaaacuaaccaagaauaaagaagagaaagugaagauuacuaaaaucagcaaugaaagaggggcguaacuacuuacccaaauuuaaaaacuccuaagggaauacugugaacaauuaugccaacaaauuagauaaccuagaugaaauggaaaaaauauuagaaauaacuauugaaacugacucaagaagauguagaaaaucugaauagagccauaagaaguauggagauuuauucauuaaucaaaaaauucacacaaaaggaaucuuagucccagauggcuucauuggugaauucuagcaaaauuuuaaagaauagcacuaguuuuucucagcuuuucuaaaaaauaaaagaggagggaacacuuuucaacccauucugagaccaguauuaccaugauaccaaaugcagacaaagacaucacacauagaaaaaacuacagaccauuaucccuuaggcacauagaaacaaaauucucaacaaaguauuaucaaaccaaaugcagcaccauauaaaaacauuauacacuaugaccaagugaauuaaucccaggaguaugagauugguuaaacauaugaauaucaaucaauguaauauaccauauuaauagaauaauagacaacaaccacaugaucaucucaacagaugcugucuuagucuguuugagcugcugcaacaaacuaccauagacuggguagcuuauaagcauagaaauuuauuucugauaguucuggaggcugagaguccaagaucaagaccuuggccgauucaguagcugauaaaggccgguuuccuauuucauagaugacuucucauugugucuucacaugguggaaggagggcaucuuuuauaaggucacuaaucccacucuuaauaccuugucacuuccuaguaccaucacuuugggguuuagguuucaacauaugaauuuuagggguacauaaacauuuaguccauugcagaugcagaaaagcauugaaaacauugauaaauauggacuagcaaacuaggaauaggaggaaauuuucucaaccugauaaaaggcaccuacaaaaaacucacgguuaaugucacacuuaaugguaaaagacugaaugccuucucccaaagaucaggagaaagacaaggaugucuacucuuacgacuuuuauucagcauuguauuggugguucuagauagggcaaucagaccaggcaaagaaaaaaaaaaaccaucuacauuggaaaggaagaaguaaaacugccucuaugauugugacaugaauuugugcauaaaaaauuauaaguuguuuaccaaaaaacaauuagagcuaauagaugaguucagcaagauuguaggauacaagaucaauauuuaaaagcuauuguauuucuaugcacuagcaagaacaauucaaaaaugaaaucauaaacacauuacaauuccuuuacaauauuauuaaaaauaaaauacuuaggaauaaauucaauaaaagaaguggaagauuuguacauugaaaacuaaaaaacaucauuaaaaaauuaaauaccuaaauaaauggaaagacauccaguguucauggaucaggagacuuugguaaaaugccaguacucaucuaauagaucaagagauuuaacucaaucccuauaaaaaucccaacagccuuuuuuaaaaauagaaauugacaagacgauccuaaaauuuguauggaaauucaugggacccaagauaacuaaaacaaucuugaaaagaaagaacaaagcuauaggacuuaugcuucccaaaaucaagacuuacuacaaagcuacaguaauuaaaacagugugauaugggcauaaagauauauaucauugcaaagaauauauaucucaaugcagaauugagaguccagaaauaaacccagcccucacauauuauggugaguugguucucaacaaggguucuaagaccaugcaauguuggaaaagacaaucuucuuaacaaauggugcuggaagaacugauaugcauuugcaaaggaaugaagugugguuuuuacaucacaacauacacaaaaauuaacucaaaaucaaucagagacuuaacuguaaacacuaaaaccauaacauacuuaguaaaaaaaauaagaguaaaucuuugaggccguggauuaggcaaugguuuucuagauaugaaaccaaaaacauaagcaauaaaaggaaauauugauaaauuggacuucaucaaaauguaaaacuuugugcuucagagggcaccaucagaggacaaccuauaaaauaggagaaaauauuugcaaaucauacaucuguuaagggucuaguauccagaauauauaaagaccucuuacaacucaacaauagucaaauuacccaauuuaaaaaugggcaaaggauuugaauggauauuucuacaaggaagauguacaaauggccaauaaacacaugaaaagauacucagcuuuguuaguuauuagggaaaugcaaauuaaaaucacaaugagauauuucuucauucccacuaagauagcuauaaucaaagacagggacaacagcaaguauugguaaggauguggaaaaauuagaacauucauacauugccaacggaaauguaaaauggugcagcugcuuuggaaaacagucuagcaguuucucagaaaguuaaagauaggguuaccacaugacucagcaaacuugccucuaaguauauacccccaaaaaacugaaaauauacauccacccaaaaacuuguaugugaaugcucauagcagcauuacucauacuagcuaaaaagugaaaacaacccaaaugucuggggcugaugaacagauaaagaaaugugguauauccaugcugugaacucuuagucagccauaaaaaggaaugaaguaauacaugcuacaauauggaugaaccuugaaagcaugcuaacugaaggaagacagacacaaaagaccauauauugcauaauuccauuuaaugaaaugucuggaauagagacaaaguagauuggugauugcuggggugggaagggggaaugggaagugacugcuaauggguaugggguuucuuuugggguugaugaaaauguucuggaauuagaugauuugauaguagugauaguuaugcaacucuaaaaacauauuuuaaaauauuaaaguauacacuuuauaaugaaguauauauuucauaauuuauauggaaauuauaccucaauuauaaagguucagaaauauauauuuauugagcaucuacugagugccaggcacuaucuaggugcuggguuggccaccaugucuaagucccuagcugauauucuagacuggggauaaaacagacaguuauugauaaacaagguaguacauaauauccuaagaagaaaaguauaaaauaugcuaagaagcaggggaagggacagagugaugggagaggugugccguuuuagauagaacaagguccgucaggaaagucuugcugacagggugagaaaaaccugagaugugaagggagugagucuggaacucugaaggagggaacaccaaugaggcuggggugggccuggggaggaggcuguuauggauggaggaaagugaauggauagggggguggugagauaagaaaaggugugugugggggggaguggggggugguguguggcagcaguagcagggacugauuguguagggccuuauagucuguaaauaagaacuuugguuuggauuuuggauuuugccuuggaugcaaugggaagccauuggaugguucugagcagaggaugaacauaaucugauuuagggcuugagagaccccucuggcugcuguaggaagaauagcuaguagaggacaaggguggaagugagguugucaccaguuaggaggccauuccaagaaucuaggcaagagguggcggucacuuacaccaggaaauaaaagcagaguugggaaauggccagauucuggauaugaagggaugccucuaaaucgccucuugacccaauaccuggaucaagcaacaacugucccagggccaccugaacgaaaacuagaccuuccuuguagaagguguguuucagaggaguuggaagaagacagagaggcuguggcucacacucauguguuaauacuuuuugagccuaucacuuucccucauugaucuauugaacauuuguguguucuuccgaaauaaguggggcucgauaucuauccacgauccagaggcuccucccauucaagucacgccucuccuuucuucugcuuuuauaggcugggugggauucuuuucaggugccagauuccccuuaggagcuggaaagauucaugugggcuuuggugggaaaauccaccuuugcuuguuaauacuuggcccauuucaauuccugauucuccaagcagugagugcucuuccauccuccuucaggcucucauugcaaagugucucccugugacccugagcccacgaauaaucccuaaucuugcacccugcagacccucucagaauaucuggccauuaaccacaggaugccauuuaaaugguguguccugacagugucucugguuucugacauacuucccuccccaccccaugaagucuccagcuucuuauagucucuaccagcaguuaccauaaacacacacugguucacaaugucuccauugauugcuuuuccuuguacagggauuaugccucuagaacucaagaaaauuuggguccacaagggcuugcuuaagaguuaauuuccaauugcaguugugcaaacaugauucucagacuucuucauuuuagcuaauucaugugggaggucacaagcaugguucucugccugggacaucugguccuaaaugguguauuaucucuggaauuaugacauuucucaucguggaguguuuucauguuuaguuccaagguggugauuuaaucugaggagcagcugagaacuaggucuuagacaguugccccugaauguacccgucacagggcugaacugucucaaauuucaucucagaaaaaugaucaaacauacaaagaaaaccaaaacaagcagacagaaaacacugugagccugauaucuaaaaggaauaaacagaaaauuaaaucuuuacagaagcgucugcuaaaacgccgaaaaggauucuaaccaaaacuuacagcaaaacuaaaaaauccuuuuucccuacaaauaccugugauagcauuguaguugccucucccaccauugaucuuguuccucauugucuccaaagaaucucaaacucucuaaaagcccaccauacgugccuuuuucucucccuuccugacccccaacccacgcuuuuccggguggugccuccaggucucugcuccaugcauuucucugauccacacaaccaaaggccaggccuguuugaacagcaaagauuuuuuuuuuuuuuuagaaacaauagaaggaggcuauaaucauucagaaauuaauuuuucauucuaauccugcuguaagaguuguguuucaucauagugaacuuucuccuauguuacagaauguagaacuaucucaauggggcaaggacaagaaguacaugcucgaaagcugauucagaugucaaugcagcagguaugugacaagagacugcuccugcugcaacauuauugcuagaaaccccacaaucauggauguuaccacauucuucucgugaugcucaauccugguuuuuccauuuuuguuuaucauuaccugugaauuuuaaaccucagucuaguuuccuccugauauucgcauggaaagcuuauuccauuuucuauaguauaugcuccauuuuaccuucaccaauuuuuuguucguuuuaugauuugggagacacaccuucugauuucuaagaaugcaucucuagcagucuuggaauuucaugaucaauaugaauagguaguacuuaaggagugacagauugagacaguuaaauuuccauuuucaguuaaaggcagacuuucauuuuucauuaacggaucauuucaggcaaagaaggaauauuuaaggaugcuauguuuaaauacugauaaugguuuucacuaauaauugcaagcugaauggaguguugagagagauuucccaucacaccuaauaaauacacaggacauuaauuuucuagaaaugcucuguagauagccauuucagcuguaauaagaaauuauaccauuuauaaaaauaaaauaagauauugguuuauuuuuaagcuuuugaucucagaaugucuguacaaacuuuggugcagcuuuucccugggaauuaaugacuagagaggguuaaugggcuaaaacucuguugggucaucaacuuuuccagcuagucauuaauucucaaaugcccuaagccucaaucuuuaucacuuaauuaaauucaauaauuuauuuaauuuauacauguauaucucaaagcaauuauacauaauuauuuuuacucggaucaaauguuucacucuauugagugauuugacaguuuaacuuugggccuuaaauaauuucuuuaguuucugugggugcaaaacuuuaauuuaaauacgguguucauguuaacugucuuuggaauacuagccuuuauaacuuccauggucuguuugucaaagugggguaaguauugauuauauggcauaaucagaaaagaaaaccagacaugagcaggugcagccauguugccgccuugagggacaccauguuuagcauaaagcuggcauuguggaacacagaguggggaaccagaaaguaaguggguccaugaugacacaaacuaauccugaaugcuguuuuccucugaaaccccaguuguauagacggcacauccccuuuacuaguuaagccggugugaguuguauuuucgcuuacaguugagacaugguauauaugccuugccauauauuuaucaugcucacuauuuuguaguuuuauguaguucaagauagcugauuccuguauaaagguauuaaaaugucuaguaaagaaacuauguucucacagggcagugaugguuuugugacauauuguuuaagguaguuuguuuaaucaaguauuuauuuagaaagugcuuaauaaguuaugugguuucaggaaaguguggagagugaugauaaagaauaaagcuuagcauuaugguaguaaaugucaccaaacguauugucuccagcuuucaugagaucauguguaucuuucuuuguaacuaugaauaacugugaaccagucuucuggguuuugggggugagucaguucugauuuaccuuaggcaggacaacuuguuacugauuccaaaauacccguucccaccauuagauggugcacacacuguacuuacacaagucugccuucaaguuuuaauuucuguuccuuucugaaccagggguggcagaauacaaucauuuugaacccacuugauucuaaguaauuagcuuguaccaauuacuuguaccauagcaggagaaaugauuguauugacauauaauuuuuaaaaauguguucaaaacagaguauucacaugguuuuuaaaaaaagugcacauuuuguuuuauuaaaaucauagcaaaaagguuacaagaaauaaauaugaacuuauuuuuggauacagggugguuggguauuacuacaaaauugccaccuuggccuggaauucauggaagaauuacuagagacgcuaauuaccacugaagccagugaugauucuuuccgaguauggauaacuacggagccccaugaucgauuuccaauuacauugcuucagguuuguuacuaaacgucuuuucaucgagagucauaguaauaaagaugacaucauugacauuguugaaagaugggaacacaacagggcuuuuugguccuguagggucuggacugcaagaucuuauacuauaauacuauaaucaucaaaaucuugacaucaagguuagacuguaguaaauauuuccauagaagagcucuaagacuuaguacuaauuuauugaguuucagcucugaucaauguacuuaguuuauacaaugcugaacuuugcccccacuuuauguaccauaagcauauuguuuucugauauacagguugagcauccuaaaucugaaaaucgaaacccgaaaugcuccaaaaucugaaacauucucaaugccaauagaaugcucaaaggcaaugcucauauaacaauuuaaugcuaauauuccaaaaucugaaauucaaaacacuuccagucccaagcauuucagauaaaggauauucagccuaauauuguaauuucuauuuuauucuuuauaguaauuuauagaaacaaaagcacuguuuucuuuucaugacagaccucucucaaauucacuaaugagccaccccaagguguacgcgcagguuugaaaagaacauuugcuggaauuaaucaagaccuucuggacaucaguaauuuacccauguggaagccgaugcuuuacacaguagcauuuuuacacuccacugugcagguaacugcagaaagcaguuuucacauuuaggagauggccaguggugugcugaggccccauuggagaggcuuccaggagggugcuauccguugccgcucugucuccuuacucucuuuuccuucauagcacuuuccccaccugguauaguguauauuuguuuauguauuuugugugugcccccugccccaacccccaacccugacuauuggaauguaagauucuccagggugaagacugucuuuucguaacugcugacucuccuacugucacaacagcacgcaggggauugucagagcucaauaaauauuuguagaaugagcuaauggauuauaaagauaggagcuugguuuugaaagugccugugcuggccaagaauuuuaugugcaccaucuccuguaauacuaacaaccacauuucaagauaggauuaucaccaucccaaagauguuaaguacucuucaaaugugguugcuaggauuggcugaacuaggauuggcuggcucugauuuauguauuguuuugacucuauuuauuaccugauaguaaaagugguggugauguuggaggaggaggaggaacagcagcucccugucuuucucaagucauuugcuguuugcuuuuacagucuuaguacugacgcaguaauuuaauaauuuuaugauuaccaagcaacuugucuguuacgauuuuuuaaauuauuguuaguguuuuguucugcaucugaauuuuauauuuuguucuguaauucaaaagcuauacauuuucaaugcacuggauccauuccuugauuucacagagaauugaagagauuccuuuaagcccuaccuggaguucuuucuuuccugggguuggggugaaggacaaaauaaaucaguuggucuaucccaggagucaggcuuuuagcuguguacagugaugggcagaacuucacauuaccucucccugcccuguccaaagauggaggggaacuuaaugcucaucccagaaaauacuguguguauuuaccccuaauucauuaucccuaccacuuuacuagguuccuggcugcccaggagagggaugugguguuugucugccucccaacacugagaaaguuaaaaucagauuaaaugcuuugcuggugguuaucuuuacuaaguuccauuguggccuuuggauugucaauuacagcuuucaagucacagaagccuauuucauacauucuuaucugggaauuguucgcuuugcuagaccuuaucacauccuaauacaaauauugcuuuaacucugcuauuucauucccaauucacaaauaauauuuuaugauuguguucccaguagugaugauucaacucuuccacugugcuuaucauggagagcugguuggggguauuugccauaugguuaauguggcaaccuguguuuuuaguggccauuauccaagugcuaaagggaagaagagcaacaggaccaugguccagccauggggcuaaagugcccuugcacuuaacaccacauguguuuggguuaaaacggaggaaaaauauuuucacugcuagggcggugaaguuaccaguggaguguccaggaauaaaaggcugaauaucucuuaaaaucaaauaauagagggcuagaaauaacacuucacuaagagucaggaggccuggacuuucgugcuugcugugaaaucaguuagcugaaagcaguuaguugaucaaguuaugucucucucagggcuucuguuuccccaucugugcaguuagaggcagaaguaggugaucuuucaagguuuuuuucaauuucuaaaauuccaucgcccaauucugugacaauacagugaguguagguaauucuuuuucaucaauuucagaaguguuuacugugauauuuccaaaaucuccugggaauuuuagacauauguuucagaaauaucacagaaguguuugcugugauuuuguguaaauauuuuuuuuacuugguuaggauagggacagcuugauagaaaaauccaaaauucuucagagacuuguugucuugggccagaagcaucaacaucacuugggagcuuguuggaggugcaugucagaucucgccucagacucuccuaaaucagucugcauuguaccaagauaccuacaugauuuguaugcaccugaaugucugagacucaacugcuauaggaaggaauguuguggauuagauuguuugugacuuacguuucuuuucucucucuaguguugaguauaagagccaaacaucugauuuguuaauugauuaauugaguccuccaaauuaaaacagguauccguugcuuuaaacaaacauguuauauguacuuuuguucuugcagagacagacugaaaaaagaauuaggcacaggaucugaagcuccagagggguucaugcuggaguucaucccacauuacaaugcagaacccaggaguaaaauagccaacucccugccugcucuccaguaaaaaauguaaauucucccuuggaauccugguuuggguggcauuaugccaucagcuuaccccaguucauaggcaugauauguggauucuacuucaguugcagggaacaaaaugagcaccucuccuuuucugggagaaggggaaguaaauuuggcuggucaaggauaacuugggcagaagagugguggagggcgugguuugcuuuauucuugaggugggagcaggcuuucccaggaggagggugcccugggugcugccaugggaacaugcauagaugcacgaggcaacgccgcacuaagcucugcucccugccacuccccuucuccuccagcaacuuacuauccacacagagcaguagcagcuacccugagaggggaaguuacugcugaagcccccaccccugcugcaguccagugaugucucugcuuuugccaguggcccuucugccuuccuuaugggagccuuuuauucccaggacccuggugugugccugggcucgguuuggcugccacucccugagaauguuucagcauccucuugaagauuacuuaggagggaagcuucucucuggccucgguauucugucucugugcuuuccugggugguguagcauccaguguagcaucguucugggcuugagagcaagcccacauucacccuuugggauuuuaauuuuaagcacauuuuccuccaaagucuuagucuuuugaaacucaaucauuacauuuuuagccacuuccuaacaccuccugcagaagaucagaauaauguucuauggguuauuuuuuuccuauugauugucaaugugccacucuuugagguguguauuggaccgaguaaaugucuuaaguggucuucucagccaauuaucuacaauugucuucucagccaaugccugggccccagaacaggacacuuaagucaaaauccccaggaggccaaaaggaaggagcucagucuuuuuaaaaacuuccaagugauccugauauguggcaagaauugaaaauaauggccaaauggccacaacccuuaagggaagagucuugaaccacuuuuacauccauuucauagucuggaguuuuucuccccaucaccuugguuuguccacauugaacugcguauuucuuuaugacuuuucaaacagcuuauauauaacucugugaggugaggugcucuuuucuuuuucauuuuucuuuuuuagcuaaaguuauugauuaggaucucuaagggccuauaguggcaguugcaaacuuggaaauucuaucguggcccuuaaaaauuacuuagauaguaaauaaaaggggcccuaucaauagggcccagggaaucucacuauuaacaguucuucauucggaaaaguguuugcuuccccuacauuucguuuucuuucucaaguuugagccuugauaaacauuccuuucaaauuuaauagugcauauaaaguucuugcuuuggggagagaugguuauaaaauuccucauuuaaaugucuuugaaugauuaugguaauaugauacugguuuaucuuuuacacucugccccauaguguuucccagagguucuggcugcuucugucaacuauuuuuaccuaguaaaguuucccuuacauugucuaguguggcuuguauuuuucuuuguauauuagcuccaguuauuggaguuagacaguuaacuccaguugucugguuuugaagcugugaaaugauucugcagcucugugggaacugcugagguagaaccuaacguaaaauuggaaauggcucugacaucauuaaaaugauugaacaacuuuucaucaguguucuaaggaguuuuucaugauuccacauuuuccauauuucucuaguaguucagaguuuuguauauucugugaaaugaaaagaagaaacuguauuaaucaaauuaaguagggaguggacugguuuuccuaaaaucaucagucaccaucuuaaugauggacaguccucucccuucugucgaaugaaguuuuaacauucaaauuugucugcauuccaugucuugaagcacgugaccacugaguugcugcuacucaccagaacuagcccgcuacugcaguagaaccuucugucugcagccuuuuucuccacaagucacaggauuuguguuccuaguuuugcucauggccuuugccaagccuggaagucucuucucuccuccuuguaaagaccagcuucaguuuuauucuucccagaagccucugauugaacgucuccuucaggcuuaucauugugaaauuuugacaguuaauuauauucacuaucccauuauucuuuuucuugucuccaagucuuauuuuugcaacagauuaaaacuucuugaaaaugcauccuuuuugauauuuuuuauuguauugcauaggacucaucccaugguuucaaaaauguuaauuaaacugaagaaauucaauauuccaaauaaguccagcaaaaccccuugcuuugaucuuccaaaugaguucuuagguucuaguuguuugagucuauccugauaguauuccaagguaauuuaaaaaaauagcaagaagaugaaaugacuucauuugugaaagaaaaggcacccacuaagauuuugggcuuuuuuucccaagaugagcuaaucaguuuaugacuuuagugaaccaacuuaaaaaguaaaugcuuuagaugaaaauugguaguaagaaauauaaacaugaagcaaaucucagcauuagggcaauuuucaaaacucacauuuuaaagaacaacuaaauugcaguugcucagugcauauaaauaggaguguuuccauagagucaauuugagcagcuuuaguaauuggaguuauuuuucauuuggccacccaucuaauugaacauuaaaauuuaaaaauuaaaucaaacacauagguaaaacuaaugguauaaauucugauccucuuuuucaaaaaugggaaaacauucacauuucacuaauaagucauuagcauucuucucuucaaaguccucaagauggaagaaauuccaagaacuaaaacgguuagcuguaugaauuuucauguuaauaucccauaacccucuccacccacccuugcuccugguauaaucuggaagaggcucaccucaauguuucugaguccacuucagaaauuccaaacacugggugagccucagcauugaccucuuacagagaaaggguuccuuuugcccugguaauaaucgaccaguguuuauuaggcaaccaugauucuuucccccaaggugcaaaaggggagacaaaaauagaagacguguuuuucacugucaagacucaaaaucugguuacaggaccacauauaucaauaugaaacaucuuaaaaaacccacaaaacaaaaaccaaggcaacaugaaugcugggacuaggaagcaggaagcugucaagagaagcaauguuagggaccaaggcucccacccuugcaccuaggaccacacagucucuccucccuuccaggcuauggccucugcuccuccucaccucuucuaaguacaggguggaagaugguucuucacagcuccugaguuuacaaguuuucuuagucuaagccccagauaacaauuacaaacccuaaguccaaauuccugggagaaggggucuggucaguucuuuuuggguuggcugucuaccuuggaucaaauuagcuaagggauaggugugggugucacauagcgcaaaucucuaaugccugacaaccuuaacuaaagaaguuuaggucuagagguaacaguaguacuuuacguuuuuaagagcuacuccuauuauuauuauuauuauuguugcucuuagucugaucucccagggucagaacaucuagacccaaauuaaucuuaaugguuuacuaaauacuuuaaaagcauacccugaaacucaguaauucaaaccuuugaauuuucugaauuccuucucugacuuguucaugaacuugucccaacaaaaauuuauuuagauuuuuuuuuaaaugguggaauuauucaggaucggaaucauggaacagcugcagcaagaaggauuggaauggcuugugaaaacggcaguguguguguguguguguguguguguguguguguugaguuggggaaggcagaaaagaaaaagaaaaguuaguauauacuuagagguaaaagaguagaauuaaacauucccauagauguauagggauucuacucuccacaugaguccucaccuuaggcacuagaauuagggucuaggaacuaaucuaauaaaucccuggcccuuccuuagagacugauuauguguugcgauaggaaaagcugaugccauagaaacaucuggacucaucuauguggguuguuggaucaucaauucuuggagcuaucaggucuaauacuugccauaccuuuaaaaugcucucuggaauaucaaaacaauugaaucauuugcucugaguccaguuugauuauuuauuggugauuugacaauuguaaacaguuagccacuauugcacaggagucucuuaggcccucuuugauuaaguagagggaaacaaaugagggucaugugaaaguuucaagacagacacgucauguauacaacagaaauuuuuaguuuucaaaaucugaaauggcaagauugcaaagggaagccaucacagaaucuaagugcucuugagagagguuuagauaauccaacugaaaaaauucaaacccuugcauuugacauuucaaacuuucaagaguccauuguagaauaacaguucauucaacagguauuuguugagcaucuacugcauuuuuugaguugucaguggagaccuagacuuuuuuuaaaacccaagaacuccaacuuggcaaaucuuuggagauuucuuuauauaaaccccuuagcuauagagccaugaaguaauauuucuaauauggcuauaugccacauaacguuucagucaacauggauugcauauacgguggugguccuguaagaguauaauguauuuuuacuguaccuuuucuguguuuagaugugucuagauacacaaauaccuaccauuguguuacaguugccugcaguauucagucccguaacaugcugcacagguuuguagccugggagcaauagacuacaucauguagccuaggugcguauaggcuguaccaucuagguuuguguaagugcccucuaagauguuugcgugaggaaauugcuuaaugaugcauuucucagaagguaaccccaucauuaagcgacaugaauguauauccaaaauuguauauacuauucuuuuaaacuaaugucaauuuauuuugauaauauagccuuaauuuuacuguauuuugauagcaauaaaaauggaaucagguacaugcaauacuuacuuuucuuugguguuuuuaaggagcgacgaaaauuuggccccuuaggauggaauauucccuacgaauucaauucugcugacuuuucagccaguguucaguuuauucagaaucaccuugaugaaugcgauauuaagaaagugagugaaauuaugccuuuuuuccuguuuuuauugcucuucuuaaaucaggguucuacagucauuugaagucuaugauaaggugugaauuugcugagccccauggagcccccuuugaagggacuuguugcuguaaucaggcacuugcuggggcagccugucccugcccccaacacucacauaccucugaagcuaacuaacucaguguguugcaaaauaccgcagccuuccucauguuacacucagggaccacagugcacuucaagagaaggugugcuuuaggucaagcuucuccucacugguccuacuccugccuccucagaagugaagaugguaucugccugcccaugcgaaaguucuuucucaccuuaagucacuucuuaacugcucagcuuaugcauaugaauaacaauacuuucuaguaauggucauucaucaucauaugacacuuugcaguuuucaaaguucucaugugugcaggaucucacuuuuaucuucacaacccugugagaucaauaaaaaaggcauuauuauuuauuuauuuauuacccauuuuacugaugagguaacagacaggagagacuaagagacuuccucaaggucacagagcugagaacguaaaaucuguuguccuuucacacauauaaaggguuggaaauuuguuuuuucuauaaucuuuggcaaguuaaugagccuuaaagccuguuuccucaucuauaaaaugaacauuguuucugugaggaacgaaugaguuaguauuugugaaagcacaguacacaguaccuaauaagagcucauucaauaugacucucugcagucuggcccccucuucuuccacagaguagggcuucaagguaauuagagauucugaagcuuccguaauggggugguaagccaugaugaguguuuacucuaguaccaaaccgucauuuuuccuugaaaugacaaagggauaugaaauuaaaaguaaggcagucugaugaaaaguuauauucuauguguucauauucuguggucauuuaucauuuugguacauacaaauaauaguuaccuuaaaauaguugcuuugaaaggcaaccaagcugaaaaauaaaauuuuaaccaagaaaaaguaaacaaaaagcaaauauccuuauuucucguaacucaaauguaucaaggguuuaaagaaacugcuaaacugcaauauauugcuaguauaaaauugcuauagaaauuaauaaauauuuugauguaguuuuagcacauagaaugagaugcagaggauggcagaggauugcauugaggaaaaaucuuguggauaaauaauuuucuuguuguucucguaaugauuccagaaaauacauuacuaagaaagcguauuaaagcaaugauuacuugauuuuucuccuuuuuucacuaaacaccacuuuccuccucuguaacagcuuggcauuacuacaaugaguauuauagguaauuauauccccagagugaaaauuagucuuuuucccuauuuuaaauaauauacgugcaauauacuuaccaguguuuaguauuguagauuuuuucuuggugaacaaacuguagugguuccagccauguaauagugaaagaguuauuaauauaagacgaugaauaauuuuaaaugugagucuagugagugcuuccuuuuccagaccuuuccucuagggaaagacccgaaauguuuauaaugauguguuuggguugacaauuaauaauccuuuuuuacuuuuaauaaaggguguaucauggaauacgguucgguacaugaucggagaaguacaauauggaggcagagugacagaugacuuugacaaacgucuacuuaauugcuuugccagaguaagucaauuuagaaaaauaaaguuuggagacacauuucacuguauuuuccaauuuuuuuguuuguaauaggucugccaaacucaagcauacagcagagcugcugcaaagaauuagccaagaaacaaaugcaugugugcgcuuacacacacgcacacacaugcacacacacacacacacacacacacaacaaccagcaauugggccaggcaugguggcucacgccuguaaucccagcacuuugggagacugaggcgggcggaucacgaggucaggaguucuagaccagccuggccaauauggugaaaccccguaucuacuaaaaauacaaaaaguagccgggcgugguggugaguuccuguagucccagcuacuuaggaggcugaggcagaagaaucacuugaaccugggaggcggagguugcagugaaccgggaucgcaccacugcacuccagccuggugacagagugagacucugucucaaaaaaacaaaaacaaaaacaaaaaccaaccaacaaucuacuuguggugcagagcagagcaguggucaguucucauugcucuauaacuccuuucccauguagaugaaacugcuugugcccagggccucucccccacugccccuccuccaucuuccgcauuccugugcaccucacuugugaggaaaacacuggccaucauuucucugccucuuucucugagugaaagucuuauggugauuucaagccccaaaauaagugauugggggauuaaucauaauuugaguuuucucaucucuucuauuaggauagacaauuggaaauugaggaaguguucacuuuuucucugugccaaauaaaauccacauauaacaugcugauaaauauuuucuagagaaaauuguuuauuagcaauuguggcuuucacaucaaggaugaauguaauaaauaacaccuaccagacucaaacucuucuuaaaauguuuuacauuuuagggaaguaauauauaacaccuaagugagaaaaaaccagaugucuuuuaugguuauuaaauucuuuauauuggaaccuauaccgguaauucucuacuuaaaugauucuuuuuucuugacaaaauuaaagccucaacaacaaagcacaagcuuugggaguauuuugauaagcuggggguugacuagaaaacggauuuuuaaccuuuacuuguuuuagcaaguuuuucuugaagcuacauauggagaacugugaaaaauaauaaguguuggugagaaugugcggagggaggagcccugcugcugggaggucaaauggacacagaccuccuggaaagcaguccaguaauacuuacugaaauuagguaucucagguagacauaucucagaacauuucuagaaagaguccacaaauggacauguacaaaaauauucauggcaacauuguguguggagcugaaggcaagcaucauagaugguuuuccuggaagcagagguggagauuugcauucaagugccuccuccccagccuuccugcaagacaugaccuuggcugaagcagcugccuccugcuagggcaguuccuggggagggacaaugcugugaguccacaguagccaacacuccagacagcgguggggagugaguaccugcuccugaaagaggaucgaguggcacaucauagcauccacuacaaaaaccuaagacuccuaagagaauagauaagauguggugggugagcaccauggcauacuauugcucacccuuguggggugcaaccuguuagucauagucauaucaagugugugauacgacuaccuucugaaccagaauccugcuccugaguauaugucccagagaaauucucagaauguaccaaauagauuauucauagcauuguuggugguagugggaaguugaaggcaacuuaggaauccaucauggggaaauaguuaaguuaccuguuguagaggccuaugguggcauauaaugcagcacuuagaagcaaugaucuauacgacaucaugcauaggucuuacaaacaguguugagugcagagcuuuaaaaaaaaguaaagugagaucuauaaaggaauauaugcauaguucacaaggauaaauacauguucuaggacauauaucaaguacacuuaaauagaugcccucagagggaaaaggagacagugaauggauaucagggcagaauggggaaaaauuaaaauaaaaggggccuagauucauaaaaauaauaaacucgggagugugagaaacugaccucuguauuugagauucaaaggagaaaaaaaaagaugucuuaauaaguauacuuuguuagaauaauuguaaaaguaucuaaaauuggaguuuuagcagcagagacuaagaugugguuagcuucagaauauaauucaccaagaguaacagcagaaugcugaugggaucaagugcgugggugaaagaagaggggagucaaggucaucccuaguuuugacuuaagccacuggacacagaauggggcuauuuacagacaagaggaagggcugcagcagggaagaguuuuauuggcuggggcuggaaauuaagaguuugguuuugaucauauaacauuugagaugucuauuagacauccaaaucaaguugucucagacuguaacugccaugagggcagggacuuugucuuauuacaucagugccaaacucugagcaccagaaacagagcccaacacaucuaagugcucaguaaauauuuguugaauagaagaacgaaugcaugaaugcaggugaacaaggcaccuggauguacagauccggaggucaugguggagcucaggcauggagauaaggaucuggaauucuucagcauguagacaguggcaacggaaagcugcuguguugguccagagccuccagggagaugucugagccgggagcacacggagggggaggaagaagugucgcugucucagccugcuccaccuucaagagcucaagcagggggauuccccucucugaccccucuccugccuuucuuccucuucuacuucuucccuguacccugacauuuggcauuuugggccacagaggacuagugagcugacuucaacccucuccuagaaacccaagauucucuguccucugggccugggaugugcagacuuccugaucuaaaagcacaggguuccauauccaggccccaguucauuggcuguucccaaguaacagcagcucccuccucaccugaguuauuuuacucccuucuaucaucugauucugguuucucuggacuccauucucagcaauuagugccuuaagucaaaaguucaucuuacuauuuucccauucauuugccccugaguggcuucugugggcucauucccucccccucucucaggacuucccuaagaguggcacaaccuucaguggcuucaauucucugacuguuggccaccccacuuccuuauccuacugaaucuucucuuugcccuacauccucuccaaccuccugucuuguugcuuucccucauucauuucucugucuagcuuggaccuguuucagauggucaucaauaaccagaggugaguuugggucucuggcccuaagggcaugagcuuaccacaugaaccuggcagcagcaacccucuugagaaaggcugcacaaaagccucacagcccccacacccugccuucaccuguuugaucucauccucagccccaggcuugccuucugaccagccaccugccugcacuaccuccacuuuacccuaaccaugucauccagaguugcccaugggagaagcagcuccacuguaaacucacgccugcacauggcauccucugucccucugacuuucaaucucgggcuugucuuugaaccuuguuuucucuguucucagcaucuuacagagucucucugcuaaaagcgauugcagaacuguauuggauguucaugggguaugaccgcucacaaaguagcuccauguagauuucauauuucauauuuugacuuugcccccaaauagccuccaaauuuggugaaacucagcuauuuguauguguauaaagugcugggaaaauaguaagaaacuucauuuuggucuuauacauacaugucaucugacaacacagaauucagugugguuauuuguuaucugugugcugaggacccagggccuuugcccccuuagggugucuuccugcaauuuaagucauccacgucgugaaaaaucuaauauuucuaaguaaugaccaugcucauaacacuauucucuuuaauaacuuucaacuacucuccauuucuugaauuaaucaccaguccucacccugacaucaauagucauccaugauaugaccucaccucacuuuuccuguccuaucucuuaugacuacauuguguccacccuauauuccauuauucccuuaaccugcuucucauuuuugcaucaguucuauaacuuugcuuauguggccuccccauuccaaguucuccggucaaacuccucuccuucaaggcuuagcuccaaaaaucaccuccuugagaagaccucagcugacauccaccuggauguuuuuuguuccugcuuuaaaccucuuuaguacuuugcuuauuuuuauuuccuucugacucuugccuuagugcacuuuguauugugguuauuaaguaauuggcucaucccuccgcugggucacaagcuccuugaaagaaaggacugugugucucuuaucuuugcauucuguucugguucuaaacucagccugcucaugcauaggaguugaauaggauaaaacagagagaaucaguacacaggguauuucagagcaaucacuggaucuaaaaagagcuggaggaaggagauggagggaagguacuagagaacgugugaccaaccagaggaaggcaccgucccucuuuccugucaagugcuccgaguaauucagacgucgugccugcauuuccacucuuccugucuucccauuauuuccuuccccacugggaaaauugcugugagacguaagucauugccucaaaucuggcucauaggcauuuagcaucauuuuuuuuuccuuucugagaauaagucuauucacaccaacuauauauuuguucucucacuguuuuguuaaagauaauucauauggaauaagaaagggaugucuuaaggcaaacagcaaggcagcugaauacauuuacuucauguggacagggacauaauuagcaaaggaagcucuucaacucaaggugggaggggagaguuugcauggagcucuccuggccgugugcuggggcucauugcugugugagugaaacugcgcacaagcacauccuucugguaugagccccaugucggggagaaguggggugaugaaaaugcccagauauucucuugugugugggaguauggccucacagacuuugcaguauguuccuauuccuaaaauggaauugaggguugucaaaugacucaaucagagaaugggcauguagaguugcucucuuccuuacucuuggugaauaucuucuuugguguuaaauggaggccaggucaaauuguguucuggacucucucuuuucuccauauaugugguaauuauucuaucaguaguauuguuaaagcauucucaaaaucaauauuaaaaacucuguuaaaauggaaauaagguggccccucuccuuucuuguagcaguuuucauuuagaugcucaucaauuuuauuucuuuuguuuucucucacauacaggucugguucagugagaagauguuugaaccgucauucugcuuuuauacuggauauaaaauccccuuaugcaaaaccuuagaccaguauuuugaauacauccagucacugccaucccuagauaacccugaagucuuugggcuucacccuaaugcugauaucacguaagucccuggcauuuuuuaauuugaaggggucauuuguaacucagucuggcaaagauggugcauuucauuuucucuccuaaucucucuccuuucccccuuuuuuuauuuuacugugaaaaauagugucgcuuccugucucccaauuacaacuuugucauaucuuggccugcucuccucucacuaaauccugaugcuccaguguuuaugacaacguuaagcucuaauuuaugcauugauuauuucuucucugucaugucauaaaacgaguugguguuagugguagcagugcucuccgccggcagaagaguggucugccagcuccucaucucuuucuucaaaaauucauuaagaauauaaugcucauaaauagaaucuaaaaagccaggugagaacagaugggagggugaagaaucguauuucugccugguccucucuuucauggccccucucccucacuugcucaucugcauccuuuugucaugcacugccuguggugggugcagugcggugagcacuugaguacccgacacagaugcacagccccgggaggaaagaguggaggggcucagcuuugcgugaggucccugcuccacucaucaccuagagaagaaaugcuccccaguuccaagccccuuggcaugaggugucaccccuucucucuuuaggaucccuaccaaacccaagcaccugaacuggaauccuuuggaauggaccgcauguccucugcagcccccugaugaaaagucacaagguuuacauucaggaaaaugguuucaggaaguggaagaaaccaagacuccucuggcagauucuaaguugagaaugcccuaagaguggggcauuccucucuccuagucccuggccuacuguuguaauuuuaauaauucucuggguuuggacauggacauuucccuggccuugccagaugucccaggagucccaguuugcugccaauuuccuugucuucccgccucugaccacccuccuagcucccugcaugaggaugcacuuuuggccucuuuacacccaccuugauuccaccuucuucauauccucucaucucgcccaggcugcuuuucaucuucaaagaugcggacaugauugaaaauaccuacaaaugccaaugcuucauuccacccccaugauggaaccacgaagguucguuaguggcagcucuugcuguuaucuaaggaggcuuucauaaguuaucuggggaugggaaagaagugaagaaauaaaaaggauuccucagggauuggauugacaaucaacucuuaacguuuuaugaaagaggagcauaggaaaguaguuuugcuuuagcugagacuuuaaaaaugugagucagaccacaucaaccccugcucagaauccucccaagguucccgugacacucugagacaaggucaaagaccgacagugaccuacauacagaugaccuacaaagucaaauagugccacugcccucuaccuccccacccuggcucuuucaguccucucccaccuucgugcccacucagcuccuguuacucaggccagacagcuuccuguuacucagacaggccagacagcaccugccacaggauacuugcacucccuggaaccucccuccuccuagauaucacaguggcucacuuuuaccucuucuagucuuugcuuagauguagccuuuucaaugaugccuucccuggcugugcuauuuaaagauugcaacccacuccccaaacccugcccaagaccuuguccuccugaccugcucuucucuauaguuuguaucacccacugacauacucuacacuuuuuuuuuuuugccacggaauuucgcucuuguugcccaggcuggagugcaauggcacgaucuuggcucaccacaaucuccgccucucagguucaagcgauucuccugccucagccucccgaguagcugagauuacaggcaugcaccaccacgccuggcuaauuuuuguauuuuuuaguagagacaggguuucuccauauuggucaggcuggucucaaacucccuagccucaggugauccgcccaccucggccucccaaaguguugggauuacaggugugagccaccgcacccagccucauacuuuacacuuuaauuacugauuuguuauuguccaacaaccaccacuaaaccauaaguuccacuacaccugaaacuuuuguguguguuuucacugcugcaucccuugugcuauagcagugccuggggcucaggaaguauuuguugacugaucagugcugcuaaauucuucuagagugugaaggaugugaucaaugaggagauuccauagaaagaucccacaaguucacgugaguggacagagaaagaacugauaagucuuaaugcacuugcaaauuugugacugaaaauguucucauaugagggcucugaacuuuaauuccauccuugacaagagacuggggagucacgagagcugguuccuggauaauccacaggaucccaacaagaugaaaccauuucacccucacccagggugauggugcaccuaggccuuguucacugcaggcuguuucacucaccagcucucaagaaagaugaaacagggcuagaaaagguccagagaaguacaacgcaaauguaaaagcaauuggagacaaagacaaagacaaaccauuuuuuccuugacuuuuuauuuggaaugauuacaaacucucagaaaaguugcacauacaguaaacauucauacgcuccaucgagauccaacaauuguucauguuuugauccauuugcuuuuucuccuucuauauuuauaucucuguaugcuuauguaucuacagcuauaucuauguauaaucacauauauuucucuguguguguguuugugugcccucucaguggauagagcuaggaagcauguacuuuuaaaaacaucaugaguuaauacaaauaacuccaauuccaguuguauaccucaggguuguucuuugucuucccccauuccauauugauaucuccuuucucccaccguaaaaacucugguucccagcaacuucaauauguguauucauuuacuugcaauuacuaugccaauaccacuaccagcaacaaaccuauuaaguagaggucaagauuucuuugcaguucuuuuuguccuuaggauauauuccacuagguauaaagaguacuguguucaaaggucacuuggauuaaugauuuuuuuuucugugugguuaugcuaucaacugauauauaguuauguuuauuuguuucuguuuguauuacauuuaaggguuuuuuucccccacauaugcuauuguuuugaauauguaaaauaugaacaugguucaaaaguuacaacuuuaaguuguucuuagagaagucucagacccuuucaacccauuucccucuucuuuuauggguaaacaaacacaguuucugguuuaucuucucuguguuucuuuuugcauguacauacauauauacauauuguuauuacccuuucuuauacaaaguugccaaacuauaucuauuguguugugucuugcuuuuuucucuuaacaauguauccuguaaaucacuucauaucaggucauuauuaucuuccucauauuuuuuuuuacagcugcaugcugcuccauuguuuauauggaucauaguuguucaaccauuugccuauguaugggcauuuagguugcuuccaauauuuuccuaucucaaauaauucuuccauuaauaacuuuaugcuuguggacucucauauuauuagagauguauuuucaggguaaauuguuaugggugggauugcuagaucaagauuuagcgaauauugucaaauucccuuacauaggguuauacuguuuuguacuuuuacuugcagucugugagugcccauuuuuucagaaucucaucaacagagcgcuggugaggcauuugaaccuucaccaauaugacagugagaaauguuaucucagcauaguuuuaguucacuucucuuauuuugagugaaauugagaaaauuuucauauacuuaagggcuauuuauauauagucuguccauuccuuuccaauggaguuuuuauucuuuuuauuuaauuuuaggacuuauuuauauguuagggauaacaacccuuuguuugugauguggauugcaaauauuuuucucagcuuauuuagcguugcuugugauuuucccccauugaucagguagaaguguuauugucguuucguuuuauuuuuaugcagucaaauuuaugacuacauaaauucuguucuugcuguuguuacaucuggauuuuuaguaauaguaagaaagcuucuucccucaucaggguauaaaggaaucaucuacauuuuuuuuuuuuuuagugcuuguaugguuucacguuuuuacauuuaguucuuuuauccauuaggaauuuaccuauuagguauaaguauggaugaaauucuuuuucagaauagcaauccaguuauccuaucaccagugacuuuuuuuuucuuuuuuuuuuuuuuuugagccggagucaugcucuguugcccaggcuggagugcuguggcaugaucucggcucacugcaaccaccuccuggguucaagugauucuccugccucagccuccugaguagaugggauuacagguacaugccaccaugccuggcaaauuuuuguauuuuaguagggaagggguuucaccauguugaccaggcuggucuugagcucuugaccacacgugauccgccagccuuggccuccugcuuccuuuaacauagaauuuccuuccauagguacucggguccauuucugggcuuucuauucuguuuuccuuucuauuuuguagcagucuguuuuaaguuuagcuagucuccaguauguuuuauuaucugauaguuauagucuccccucauugcucuuuuuuuuuuuuucugagcuuguccuagcuauuguugcauguguguuucucuauuguugucagaaauugguguugaauuuuguugaauaccuuucaacauuuauggaaagaaucacaugauuuuccccuaaacaccuaaaaaguuagugaauuauauuaauggauuuccuaacucaaauuuucuacagauaaucugaaauuaauaccacuggguucggagguauuauucuccuaagguagugauauacucuauuaaugguucauuggggaauuuugcauugauauucauaaauaagaauggccuggaguuuuuuguggcaucuuuaucagguuuaauuacuaaucaauguuauauuugcuuuguaaaaauguggaaguuuuucuaagcucuggaacaauuuauguaguauuggaugcuuuaaaguuugguagaauucuccugugaaaccaucugggcucagugcuaguucuuugauaucuuucguauuucucugucaccacugcagucaauauuuugucaguuguguucuccuaggaaauuauuuguuucaucuagguuuucguauuuauuuucacaaagacaugcaaacuagucuuuaaucuggucuaauaagcuggacucaguacaaugugguaaagaaugaaaucacuucuuccuuacccuauacugaguccaacccauucaauaaaauuguuacagaaguguggacauaacacuagcucuguagaccuuggucugaaaucugaugacaacuugaagccacucucgugccucuccuaaaggaauguacuagccuucuuaauauaaucuaucgaggcagcucuguucaaccacuucacuaugguguugccaacacaucccagagaaaccacugagaaacagugguuauacuguuauauggugguuauacuuacuuaauacuaagaaggaacuuaguauugacacagaugaacacuucaccagagccagaggcuccucuucacaggguucuccugcuguccggcuuagcagguucucaguccucaguggcaaaaucacacugugacagaguaacaaaauuuguugcaaaaugcaaaaggcugcaaagcaugacuuuaauagcaucacccuucaguguaugguccagguagcagugugaucuaguaucucucaugcuuuaaagagccuucccuucccuucacaugccuauaaaucuauggccuauguucuacucacauuuuaaccucuuuuauagucauguccaccuucccuccugaguagagcucaucuaugccaauggccuuuaaaacaucaauaugccacauauauguugucuagaccuuuccucugugcuccacagucauuuauacaauuucuaugugacauucacuggcaugucuuucagacagcuugaccuuuaaaagccccaaacugaaucuccuccaucuacuucuccuccaucuaaauggcuuccuacagcaguuagaauaaaagacaagcucucugccaugugacaaggcucaucuagagcacccaugaugacuaaucgacaccucggguacccuguggguaaguccaggugugugaggaugcaggccuagaauagggaugaucaugggguggagugaagcugcaggacaggucucaaggggggacugauaggacuuagcgaaugcagagcaauggcugagaaccuucuucuguagcuguuaaucuguuucuugcugcaaacugguguguuagagaggacacggugagccuucuguguuuugucaagucucucuucacagcuuuguccagaagcccacaugguguugcuggcaugcaugcuguaggaugccguaagcgagcuucucccaaaauagugucaggaucuugcaaccuuucaccacacuagugaggucagguagaaggcccuggaccccugccuaaaaugggggaguauauccacuagagcaacuggcaggccuguaagaccuucguccuccucuguucucucuucauccuuaacuucccauauggucugccuuggggucucucucacccaccccugauccccuuuccccagcaugucuuagcccauuucugguuccugcucaggugguuggcucuguucugcagcucuguguuugguaauuuuuuuggucucugaguaccuagguuugauucuucuuuccucuggcucugaaauaucugguggauggaauccuggcaagugagcuugccuucuucaaggacuucucuacgccccuugcuguucccccaccggccaccaggaagcaguaagcaauaacagaugaagcaucccagcugaaacccaccucugguccucacccagcuccagcaagauguaacucuccaaguucugagugaaaugaaagaaggggucaaagaugcccugacauugcuugucugggagcugggguaguggaggaguugggaacaggaguauguuggaggagaaguuacagaguucuguugggggcauguugagcugggaaagaacaugggauauaaaugaauggggugagaaauauggacuggagcccaggugaaagauuugaaugcaugugugcagagauaacagcuucagccaugagagaagacucucuaagauaugcuggcuaagucugugugaauguccccagccagaggaaucauuaauuuaucugaccauccaugguguucaacagcauucuugcuucuuuuuguuuguuuguuguuuuuuguuuuguuuugagauagucuuacccuguugcccaagcuggagugcaguggugcgaucucagcucacugcaaccuccgccucccaggcucaagcgguucucaugucucagccucccgaauagcuggaacuacaggcaugugccaccaggcccggcuaauauuuguauuuuuaguagagacaggguuucaccauguuggccaggcuggucucgaacuccugaccucaagugauccacccaccuuggcuuuccaaaaugcugggauuauaggcaugagccacggugcccagccaucacuugaugauaggcuauaauugggccaugauggagaacucgaugcccccuguuuauuggaaucuucacucugaaguuagcauccauaaauuugagagaagagggagauuugggcagggcgaaucacaagucucucuccucaguccuugcauaagaaugcagaaucucugaaguggagggggaaaucaaggugaauaaaugcuuuaaaauaaguaaaaucucucucaagaguuuagauagcauagugauaagaaccaugaaaauacacaguuuauucacauuuuauuauguagauuuauaagguaccaaagacucugcaaauucaacucuuucaaugucaaaaaugguugcuuauuuucacucuuuuucucaucagugguuaugcauguuucuuuacuuucugaaauuuaucaaaugccuuauuacaaccuuuauauucauuucaaugcaauacaaauugaaauguauucccuugaguauuugaggacacuuuugagauuuagauuuuuugaaaaauuuaugcucauugauauuucaugugcaaagacguauguaaaucuagacugauuuggauauuauggugcacuaauaucucauuagguaguuguuuauuucauagacagcucuguuuuucaguuguuuugcauuucuauuauccaugacccugacuucccagaaccaccaagcuacaagggcaaucugagcuucuucccauauuuacucuaaagagaaauuuucuucaagaaauaacuuagaaccaacccucaaggaauauuauagcucuuguucuucaucucagagcauuuaugaggacuguucuccugaaagcccuugggcuuuuguggcauauagagagauuugcaauucucuguuauagcuagcuaacuaggcuucugccuuucauaucuuugcaaacauaaaaucacauuguggaaaaagaaaugugaguuguucagcccuggaauaccagggaaugacauucugugcauaguaaaauguguguuggggagagcuuggcuagcucuuauucacaguggaucagcuuuucaaggcuucuucccaacaucuauguuuugaggcccguguucagaucaucucauaaaaaauuaaaucacucaucaugaaagugauuuauuaggugggaucuagcagcagcagcaucuccaucagccucuccuuggagcaccagugaacuuggccagagucagcagagagcaaaauggucaucucugcaauggugugcacuguugggaccuagccccuggugcugagcacacuuccacggagggcucaagcugaaggugacugagagagcaccugagaauuuggauaugggggcuguuuuuuuuuuuuuguagcuagaacagguaggaaucaugaacucugcuuuucuuagcaugaauggaaauuuacugugguuuucuugucuuuaaucauuaaagaucugcauugauaaaauaauaagaagaauaguuuuacuucacucucaaauuauaucuuucugauucuccuguguuuugaggacuauuuauauauggcacaaaaggcauuugcaacccauuccugaauuuugaaguagggcaugaucacaguuuuuaaaagucauauaaaguauaagaaaaauacaaguaacucugagagggggaauccugugaaaauauccuaugaaaacaaaugaacuuaucaauugucaaagacucaagaagagauagauagaaagauagauauuucuaauaucuauagauguauuuauuauuauauuguauugucauauuauauaauagauauauaauaauuagaaaugaauguuccuaauucauuauuagaaaugaauacaaaaguuguaauaaggcauuuauacacacacacacacaaacacacacacacacauucauugaaaggugccaggaaauaaaaaaacaauaauaacaauauacuauguuuuuaccauaagaaggaauaaguaaauuuucauguccuuuaaauauugaagaauugcuguccuuuguauuugagguuuaauaaaaugcaagccaauuggccucaauucaacaaacaaacauuuguugagaacuuacugucuggcuaaccuggggauacaaagaugaguaagaugcaguccgugcucuuggagcgcaucaucuguuggggaagaugaugaauggcaaaugcugaugagguacaauaugguaaacucuaaaaucaggguauguauacauugcuaugauaacacagguggaggagcaaucaauuccaauuuagggaucaaagaaagcuagugagacaggcuccauuuaaguugugccuuaaagcagggguccacuaccccugggccacaagccaauaccaguccguggccuguuaaaacugggccacacagcaggaggugagcagcaggugagggagcacuaccgccugagcucugcuucccgucagaucaguggcggcauuagauucucauaggagcgagaacccuaccgugaacugcgcaugccagggaccuagguuacacacuccuuaugagaauuuaaugccugaugaucugucacugucuuccaucacccccagaugggaccgucuaguuucaggaaaacaagcucagggcucccacagauuuuacaugauggugaguuguauaauuacuucauuauauauuacaauguaauaauaguggaaauaaagugcccaauaaaaguaauguguuugaaucaucccgaaacuuuuccgccgccuccccuccagucuauggaaaaaugucuuccacaaaaccagucccuggugccaaaaagguugggaaccgcugucuuaaaggaugugcaggaguuucucagauuggagaugaggugggaaggaagugacugcaggacuggggucaaggacagaguacaaagaagaggaacauaaugagcgguaaggaccaagaacuuagacugggaugcacacaccaaggaacaauccaaggaagggaaugcaaacaugaauguguguggggaguucugggaaccagguccaguaugccuaaagcaugagggaggggggugcuuaaagagcggaguggccgaugcagaguguggcuuuugaagguuuugccaaaagaguuuggggcaauauuuuaaauuggaauacgguuauuuaaucauuuauuuaaaucuacuuaaccuacucuaccuucuacauggccauuucugcuugcaugaguugaugggaauuagcauuuugcauacagagauuuaagccuuuuccugccaucacauaauucaggcugaaguuggaaugaagauaaacaagcaugucaucauguacagaaugacaaguacaacaauaaaagcaagcacugagagcuaugcgcacacauagggagaaagucuagggaaggcugucuagaggugaagacaucuaagcugagcuuaauauuaauagcuaguuaggaaugagcuauaaucgaugaaaaaaugagggcagagcauuccaggcuguggagguaacuugggaacagucaaagaaauaugaggggagucauggaaugcuugaugagcuucagguaacucacagcacaggguagagugugggaagaagaaagaaggaagcaagagcagaagcuggagauagaaaaaggcuuagugaugaaaaagguuuguaugccaugugaaagacuucagauuuuauccugaagguuauggggagucuucgaauacauuuaauaaucacuuuucaaaugucaaaacuuaccuuggaacagugguuggaggcaggaggauguguuaggaggugauggcagugccgcacacagaggaugaucaggaaguuagggggcagaacugaaggcaguggggaugacggugggucacggggaggggaugcuggaaaugauuuggaacuagagcuuggaaacuaagaaggucuggggagccacagcaaggaggaagccaucucugaggguucucaguugggcaacugggcagacauugaugucacuaaaguagauggggcaaggagcaguccaggagagggauaagggagaacuaaaauaauaagguuuuggauuuguuugguacaggaaacaaagagcucuggggcuccagggaaauguggaugcacagaguucaugauaaagucagagguucaauguuacccaggcuuaccugguguuucguggcucucuguaagaugucagccauggugacaccccucugucuucccuaacauagcaguucauccacauauucuaucuguaguguaccuaaugcuagagagagcucauggaguaauaugaaucacauacaaauuuaaauuucugaaaauguauauaguaacauguggauccuugacuuuuguugacuucauuuuguugucucaucagcuauuuucauugaacuuucuucucagacuuauuuguauuuuucuuauacgguacuuuauaugacuuuuuaaaacugggguugugccauauuucaaaaugucggaaugggucucaaaugccuuuugugucauuuuacuagaauauuguguucucuguucauguauucaacugcaugcauguuucaacuuuuaagauaagugucuuuugggauauuccaaauccccaacaucugaauagagguugcucacagaaauaguaaaagaauuuuaaguuauaucuaaaauauacuauacagucaauuuuuguucauuaaaaaucagguuuuacuucauugauccuuacugggaaagucauguauuuaaagguaauaugaagcuaauauuccaacucuggauggaguuacaaacacuugcuagaucugauacuaggacccucguaucacuguaucugacugaaaguucuguaugugaagcaugacaccuuaugcauuuaucauggcaugacuuuuggaaaggaugcagauaguucggguaugcauguuuggguccagauguggcauucuagcugcuaaucaaauaaaaaugcugaagacagagcaucuccuccauucuucagcuuuauuccuaaaugaauccaaaggcugcuauauaggauuuccucuacuccccaccacacgcagcuuuuucauaagcaaagaagccugguuaacuuucccagcagccucuuaggauucugccaauucguguggcaaauuucacaaaaggcuguggaacugacaccagggaaggaggagagaaaaggaugcaauucucucuuuccauacacugcagagaaaaggcagaagggggcgcuuucugguggggcauaaagaguaaggguuuguaagaugcaucucagugaaccugaaauauuugucccugauuuaucucuguuaacuucuugacaacugugaugggcuuugccuuauggggauuuauuuuucucuguuuuucaaacugaaaaugauuuuuaauauucuuuauucuaaaaguccuacauucuuauugagaagcauaaacaauagagaaaaauaaacagcaaaaagaaacuaauaauuacauaaaaagcucaucauacaaaaauccuacugcaaaaauacccuucuaguuuuuuucugugucuauaagcacaauauuaacaacaaaauuagaucauaccauaacuggguuugaugccauguuauuuuauucuauaaucccccaaugacaccucgcaugaucaaugaauauacagcuacaucagcauuuuuauuggcuauauagauuuuuauaaagcuuuacuaggauuuauuauuacaaauacuguuauaaagucauauagauucaucuuuguacacuugucugauuauugcuucuaaaacagccuuauuaaacauugaauaaauacaaaagaauauauauacuguauauaaaauguaaaggacaaauauacaauguugcuuuuuuacgccacucuuucuauguuuugcuucuuuucuucuucuuccuuuuuggcuuuugcuaaauaagacuuuucccauuucauuuuuuuucucuucucuaguuuggaaauuauguacucuguuucuguucuuuuaccaguuacccuagaaauuuuaacgucaguucuuauuuuggucuaaaauuaauauauuuaugcuaggcauggugguguguaccuguagucccagcuccuugggaagcugaaguaggagaauugcuugagcccaagaguguuaaguccagccugggcaacagagcgagaaccugucucuuuaaaauaaauaaauaauaaauaaaaugaacauauuuacuuuccuuucucuuagauaacuuuagcuacagucacucuccuccugacauuucaguauuuuaauuuuaucuuuuauaaucccacaauuagacauacaaugauuguuuuauacuauaaugcuuauuuagacuuaccuaugcauuggcccauucuuuucuauacuucaaaccuuccaacagaauaaccucccuccuuucuaaaguauacuccaccaugagggggacauucuuuuauggaugauaaacucuucuauuuuuguaugaaaaugccuuauuuugccuuccuuuuuugaaaaacagcuuuuaugagauguaaucugcauaucuuaaauuaucucauuucaaguggacaauaaaugauuucuaguaaguuuaccacuacaauauaacguuauaagauuuccaucacucuaaaaagaaauguugggcccauuugugccaggcugucauccccagccucaggcaauugcuaaucuacuuucuguuucuguaaauuuaccuuuucuggacauuuugcauaagcagaauuauacauuaugugaucuuuuaugucuggauucuuucacuuaacauaauguuuuugaaguucauccauguuguagcguauauuaauacuuccuugguuuuuauugccaaauaguauuccagugccacauuuuguuuaugcauuuaccagcugaugaauaguugggcauguucuacuuuggggcuguuaagaacacugcuaugaacauucaugugcaagucuuuguguggacaugucuuuucauuucucuuguguagauaacuaggaauguuauguaguuauugggucauugggucauaaucuauucuuaacaucuuaagaaacugccaaacugcuuuccaaagugacugcaucaggccgggagcagcagcucaugccuguaaucccagcacuuugggaggccaaggugggugaauugccugagcucaggaguucaagaccagccuugccaaaauggugaaacccccucucuacuaaaguacaaaaaaauuagcugggugugguagugcacgccuauggucucugcuacucaggaggcugaggcacaagaauugcuugaacccaggagauggagguugcagcgagcaccacuguacuccagccugggcgacagaguaagacucugucucaaaaacaaaacaaaacaaaacaaagugacugcaccauuuuacaauccccucuagcaauuacgaagguucagguuucuccacauccuugccaauauuuguuauuaugugucuugugaucauaaccauucuuuguaaaugugaagugguaguauuacauugucguuuuaauuugcuuuuccuaauaaauaaugaaacugaacauauuuucaugugcuuauugacccaucuguauuucuucuuugaugaaacguuuauucaaauauuuuuucuugccuucauucuugaaagagaguuuuguuuggcacacaauuauagguauauaguuauuuuauccuagcaauuagaagacacuuuuccauuuucuucuggauuucauugcugcuguugaggaauugacugccaguguaauuguuauuucuuucuagauaaucugcucuuucucucuggcuccuuuuaagauguucauuuuguuuuugguuuucuacgguuuuacugugauguaucuacauguagaguccaagggcgggagggauuuggcuugccauuacuggcuuugcaaauauagaaagugggccacaagccaagaagugcagguggccucuaguagcugagaaggaccuucagcugacagccagcaagaaauuggguaccucaguccugcaaucucgaggaaguuaauucugccaacaacccaaauaagcaaggaaauggauccucuccuacauccuauggaaaggaacccagccuugcugauguguugauuuuagcccagugagaccugugucauauuuagcaccuacagaacuguaaaauaauaaauaugucuuguuuuaagcugcugacuuuguggcaauuuguuauagcagcaauaaauaguauagguuuuaaguuuuaguuauguuuuauuucuagaacuucuuuuuaacucuuuuucaaauaugcuauucauguuuauaguuuccucuuuaauacuuguauuuucagucuccuuuuaaaacucuucaauauugcaaauacaguauuuuguagugugcaucugaaaagucacuuaagaucuccacaggucugauucugauuucuguuguuucuacuggcucuuucucacaguuccuuguuuccuuacaacuuuuuaaacuuuugacuuugagcuuaugucuauuggaaauugacuguuggauuauuugagaccugagucaaagguauauuguuccaggaaagaguuguguuugcuuccaucaggugccaccuaggacuuccuaggaccaccuuaaaauaaauucuuggcuugagcuuuuccaaauugcacagguaauaugaguaaauguuaacuaauguuacaaacauggugaauucagaauuuucaggaaagauuuuucccccacuuagugcuaagcuagguagaacaaguuaccuaucaucuucuucugacagguggagguuacuuucuaguuuacccuuauacugagguuguagcuguguggggucccagauuuauguaggaauuuccuauuaugcuuuccaccucagguaugagggcuucucuccugucucauugcacuauccaaacagaaacucaaaaacaccaguuaguugaugcccccaggguaaaaucuggcuuuaucucucuggauuccagcauucacuuuauuuccagcauucauuuuauuugacccugaggauuuuuuauuguauugccaguucagugauguuuuuaaaaggauguuuuucauaucuucuccagaaguuuuaguuguuucagaagggugguucacaguaacauuugcaccauaccgucagaaauguaaaugucaaaugucucuuucuuuuuaaggauuaauucuuagguguagaauugcuauauuaaaagguaugcaaguauaauauuuagauguauauauuuccauauuacaauggcuuguuuucuguucaagaaaauaaaacagaaaaacaagccacuaaucucaagcauuugcugaaucccuuuuagauuugccucucacaucuacaaaaggaaauaugaaugugguuaacaucuggacaagagacaaaauuagcaaacaaaacaauaauccuccaaaauaaaauuaugugaaguguauagaugguaaauuaggaguucagaaaaggcugaaaaauuuaaaucugaccaugucacaccuggcuagggaaaucuucaguggcugcccauugccuuuagggugguguucagaauccuacaaguucccauauaacccugcauggucuggcuccugccucuucucuguccuugucgcuccuccuagcucacuagcuccaagcucacuggccuuaucuguguuccucaaaugcacugaaacccuuuucaccccaacccuuacuucuuaucugaauguccuuuucugccucccaccaccccaccccacugcguggcugaccuguucauccuucuggucucagcuuacaugugacuuuuuaacuuuuacuaaucuucuaguguaaauuaccucuggcacacaaacacauacacacacacaggcacauacagcgccccaccccccacccacccacacacacacacacauuucuacucaaauguccagguaacuggucaacccagcaucucagggacagagacuaaauucaugcaucucagagugucuggucgaccugaaagaaagcuagagagugggaaugagagaaucaaaccucucugaaagcauccuguucuuucccuccacagcacuuguuagaaugggauuaucuaauaucuaucuccuccacuagagaacagaacuauguccuauucccugccauauucuagaacuuagcucagugccugguacaugguaaaucuuuauugaauaaauggauuuaaagaugcauggcugcauuugaacagguggagccgaugggcgucaauagauuucccuggaaaucauaaaacuaguggaaaaaugagaaaaccaagcagaaaagacgaaaauauuuuaauagguuauaacucagugaggaaauaugaauguuccucuuugagccaacaagcuguccuauaaugauagacucuuaugaccagucuauagcaggggagagugaaaggaggugugcccgcuguucagcaugagguggucagguuagcuacaaccaagauggugaagaagcgauuuggauuuccaaggguguuuuugggucucuuuccuugaagauggagaguguuucauuucagugauguucuugauguccuauuaggaggcaguagaauggaucucuaguuucuuucauuccucuagguugaugguaguuaacuuuucuucuuuuuuuuuuuuuuguagcuugcuuugauuuaagugauucuaucaguucauuuuaacacuugacacuuaucucuuacauguuucccuguaacauucugaacagcucacucuuuuuacuagguaucagaguaacacugcuucugcuguucuugaaacaauuaccaacauucaacccaaagagaguggagguggugugggagagacccgggaggcuauuguuuauagauuaucugaagauaugcugaguaaacucccuccugauuacauuccucaugagguaagucuugcugguuucccacuggcauacagggcuauuuguauauuuaaacaguaaguuugauuaccuugaaaagcaagaaaucuaccuguuggugacuauguggcagauuaccugugugaaaaauuuugacuauauuacuaaacucugcaucucucauuguucacauaguucucucuucaaaacuuaaaaauaucagaagaaaacauuuuccaugaugcuuuucuguugcauucuuuuaaaaauuccuucacaaguuaauuccuccucaaucaaaguuuccacggugacccauuuauauaucaauuucuaugauaccuuaagcugugcuaaaaaaaaaaaaaacucaaaaaucuuuaaggccaaaaagcaaugguguuggucauuugguauucuauaagacguuccaaguguuuuaacuguagguagaugauccacccaucuauuccauugauuuuuaaucacuucugaaacucauugaauaggguagaacaauuaguggagauauuaugaauauaagcacccuguuaccaaucugaagucuucuaagaaccacacuuauucauugauuagaaugggguggcaugggacaguagcuguguuuuugagcacucauuacaagccagacacuguccgaagugcuucauacacauuaugacacucagugcucaggacagcaccagcagaaaucaagcuaaguggcagagcaagaauuugaauacaaagugaucugacucuagaaccugcagucuuaacuaguuuuagcaugcaaugagugucccaacaauaaaaaauguuuuauugccucuuaaaauaauuauuguuuccauuguguagauagguaccaagaccuuugguuaagauauugaaaucaauagcuucauguagagauaguuauaguaaggggagaaaauauuuuuaaauggauaaauauuguaaguauacacuuucaauaguuuuauuggugugaucuucaaaaaacaaggcagcauacuugccuucaaagauuuuuaauacuggcaugugaaagugagauaaaacuuacucuaaaagauuacaccacaggacugcuauugccaggggaaagguucaagaccuugugauaauucgagcuguccagucuuagcuggggccacuucaccaacaagaccuuuguucuggugauuauuccagcagaaacagcaucagggguguaacuaaauggauuccuauaugggaaagaguuuguacuaagagacaucuaaaacuugucccuguuccaagaucacuuacuuuuuagugucuuauuuuauagaagagaucuuucuugaacagguggcuguaaagugaauuuuguaaaucaaaauauaauuauaccauugaguucuguaguaaaaaugaagcuacauuauuguagagaauacuaccuggucccagaaacauaaugaaaaugcuauauaaggcuacagcaagucuuaaauuuuauuaauaaaaagacaauuuuaggcuggaacaauaauuauacucaaaaucaggacuagaauuacauuuucuaggguuuaagguuuuucuaagcaugucucuaucucaaguaaaguuucccuuuuaaaacccuaagcaggacaaggugauuuguuugaaacuguuaauauacuagagauaccugggcuauugauuugauacuguagucaauaccugagcuuuauuuuccacucaugggguugcaaaaguauuucuauaauuucccuuuuccuuaagagugaauuuccacucuugagauggauugauuuaaagggaauuauauauagauauaauuuauauauauauauauacacacacacgcacguguacgcacacacacacacacacacguauguauguauguauguauguauguauguauguauguauguauagcauauacauaugcuguucagccacuggagguugaaggacuugggauggagaugagaaugaggcacuggaggcugcaaaaauguaggcucuagaaccaagaauucugaagaguagcugaagguugcuacgucggacugcguuagggaccuccacuggcaugcuugacugauuuuaauauaguuugcuccacccgcauagguaguccuauucaggcugccuauuuuauaucugugcucaguguuauaucuccuucccuuuuugugcuuuccgucuuccucuuucacucacuagaaacaacccaauugcaguaaacagaggugucccuugcugaaaggaaacuucugcaccauacuagaggccuguccuauaaaaggaggagaaugguucagaugacucugaagcccacccaucucuaacauuccaggcuuuaugagggggcagugggcaucucuggcagagaauccugcaguuccuggccuccugugauccuuuggauugauaccucacuuugaguucucucccacuccaugugucccuuccuuguuccuuugauucuggcaucucuuugauuguggccagcagaaaguucaaaucccuuuaugaguuccugccaguauuuguagucaaucuuuuguugggcauaugucaccaaauugaaauguguauauugcauuggcuuguuuuccaauaauugucauauuuuauuguucccacaaccagaggcuuuuguauugaucucuucaaaauagucaauaagugauacaucaaaaggaacaaaugacagauauuuaacuggcugucccacaaaaucaaauauuuucauugauuggauuaggaaaggcucucuuuagcugucauagcuaaggcaacaaugaucuuuggaaacuauagcuaaucauauuuguugguaacugcucuguaaagauuuuugcuguauuaacuuucuaugacauuucuaauaacucugcaaacauaaugaagaaaaaaauuccacuguaccccuaugaagguuagauugcaaaaagaauaucuaacugacacccaguacuuaaucaugugaaaggagaaaaagguacaauuuuauuucagcucuuuaagguacauuuccaauuauuagcuaaguacaaucaguaagaaauaaaaaucauuuuaguugaacaguaguuuuggaaacgcaggaaauggaaaguuuaauggcaaguuugguucugcaagacauauuuuagaauucauuugggcugguagagauacaucuagaggaagaaaaagaauugagaaagaagagguuauuggaagagaaaugucagaugagaaaaucuccuuuauugcauuguuuacuuuguuuuaggugaaaucucguuugauaaagaugggccaucuuaauucaaugaacauauuucuuagacaagaaauugacagaaugcaaagagucauuucaauacuccgcaguagccugagugaucuaaaauuggccauugaaggaacaaucauuaugagugaggugagcuguuauuacaucaguaggcauuuccuucuuuguugauguuucuuauucauguguuuuaacuuuuucuucuccagaaucugagagaugcucuggacaacauguaugaugcucguauaccucagcucuggaaaagagugucuugggauucguccacacugggcuucugguucacugaacuuuuggaaagaaaugcucaguuuucuacguggauauuugaagggaggccuaauguguuuuggaugacugguuucuuuaauccccaagguaugugcucauaggagauuuggcaagcuuggaauuuguguauuguuggauaguagcaucgugugauaaauauauaccauauaaaacaauauggaggcguagcuugcugggugcugcacauagccauucaaaggcgaaagaacacaaauaauucuucuguauuuguuuuacaaauucaaucugaagcucuuccuaucaauucuuuacaaugugguagcaaaauccuuccuuuuucuuuucaccaacuucagcaaaccaucagucugggguuaggacacaugaaagaguaaaaagaaguuucucucuaacuuauaguuuuuaaauguuugugaaauaucaaaaaugaagcaccaaaagaugcaaaaauuguuuccaggguuuagaaaauuauauugguuucaaaaaugacugugacaaaaguauucagagaacuucaggggggucuucccccacucaguuuucuaguuuucuuuuucuuuuuuccugaaagagugcuuuauaauucugcuucauuuauuccuuccuucuagaaauguuuacugagaaaguuaauggcuugaugucauagaguuuguaagguucagaaacaugacacauuuugucuuacuaaaauauggauaguuuuacuucaaguaauucuuggugaaaaugaagaaauguugaauuccuuaugguucagcagcuuauggcuccauuuguaauaaaauuuuagaaacauucacacuuacagauuuaggaugaauuauuguuucuuguagcaauauaggugcaucucauaaaauaauguugaguaagggaaaccaaacagaaaacauuacaugcgguaugguuccauuuauacaaagaagaagaacaggcacaauggcucuauaguguucaaagucaggauaaugacuguagaaggagggcagugauuagaaaaaggcacaaagggccaggagcgauggcucacgcuuguaaucccagcacuuugggaggucaaggugggcaaguugcuugagcccaagaguuuaagaccaguggggcaacaugguaaaacccugucucuacaaaaaauauaaaaauuagcugggugugguggcaugugccuguagucccagcuacuugggaggcugaggugggaggaucaccugagccuggaagaucaagauugcagugagccauaauugcaccacugcacuucaaccuaggcaacagagugagacccuaucuaaaaaagagagagagagagagaaagagagagagagagagagaaggcacaagggacuucuggggcccaggaauguuucacuucuagaucuggauacugguuauguggcugaauucccuuggugaaaauuccuugauauugcuguauacugaugauuugugcaggguuuuuuuuguguaaagcauacuuugaucaauauuauacaugaaaaauauguauuuaauuguccuuuguauacauacauucauucacuguaugcauuuuccaauaccuuaaaaauguuuaaauuugaaacacuaaccauggugauuucuaugaacauaucaaauuauacauaguauuuuauaaaguccguagccuuuagaguuguaaagggcagcccccagauuucacuuaucuauuuuucucccagaauuuccauugaguuaggggaggaacauuuuuuauuaugggucucagauuuugugugucuacuuaugagucucuuuccuccguaugagccucaauuugaguaagucgucaccagguaauuucuggcuggggagcaugaaguaauagcauuuaacuuaauaaggauuguuugaccaccucccauuugccagccccucugcuagguacuuucaaugaagagagauuugagacuugguuccugcccuaaaggagccuauaaucugguugguaagacagacacaucagcaaccuuaauguaaugugauaagugccccacugugugagaacuaagugccaugguagcccagaggacagagagauuaauucugccaagagcuucacacaggaagcagugaguaggguuugcagaagcagggaugccaaaaaaagagcgggugcuuuccagguagaggccugagcaaaaacaagucuuguucaggggaacagggagaccaguguggccagggcucaggagcaaggcuggggguaguggggaaugaggcuggaguaugaaaaaucuuccggggccucagggguuggggcuguauaucagaagguaaucccaagagaaggcaagugagggacuggaauauggaggcccagugcaaugagacucuugccagguccaaggaagagggccugggaccuuaaccaggugccaaggagggaacagauuugauggagugauuaaaugggggucucugagagagcaaggagggacaauguaggcuggaggcaagguacaagacagggaacauugggagagggacagguagggcagagagacagggagcacuggagagguauguuggcagacuuggaguugggagaggcguaaggaccaaugauuuucaaaagugugagguuauugaauguaucuuugauauuuagaaaccaagggaguggaguugguucaucccuggcuuuccauagucacgaaugcacauaauuuuuuucagugauuuuuuucauucaaaauauaacuuuaaaaagcaaaguguuaauaugaacugaucuuuaauuguuaauauuuguuaagaaauguuacaaagccaaacaauacuuaaagaaauacaaauguagauucacaugauaugguuuggcucugcguccccacccaaaacucaucucaaauaguaaucccagugacuggaucauggaggugguuuuccccaugcugcuuucgugauagugagugaguucucacgagaucugaugguuuaauaaguguuuggcaguuccuccuucacucucucucuccugccuccauguaagacgugccugcuuccccuucugccaugauuguaaguuucuugaggcauccccagccaugcagaacugaguccauuuaaaccucauuccuucauaaauuacccaguuucggguaugucuuuauagcagugugaaaauggacuaauacaucacauuucaguuaaugccuuacuuuccuucauuuguuaauaauacuuaucuuuucccuuuucuucaguucugcuuucaaguuagacuuugauucuuucucucaggucucuccaugucuuggaaagcccuaacuuauucaaacauccuacccuuuacacacaagcacacacacacccuuauccaugacugcuuucuguuagucgcacagaagacuggaagucaacucuuccugcacacuaaucacuucucugcucucuuuucauucucuugacaugagggacaaauuacuuucuguuccaccucacuuggccaaaucuggcaaauaaagauuacagcuacuccauacauguucccagggagugugcaaacagauagaguccuuucccacuggaagccucgcuggacacuauuugacaucaacaguugaucucccaacaugaauguaucuccuggguuuuauguccucuaauucaguccucuucaaugaaguaauuucuuucuuugguucaaaacauuuaaguaaauggcuuuaaauaaaaaacccuacauaggcagggcgugguggcucacgcguguaaucccagcacuuugggaggccgaggcgggcggaucacgaggucaggagaucgagaccauccuggcuaacacggugaaaccccgucucuacuaaaaauacaaaaaauuagcugggcuugguggugggugccuguagucccagcuacucgggaggcugaggcaggagaauggcgugaaccuaggaggcggagcuugcagugggccgagaucgcgccacugcauuccagccugggcaacagagcgagacucugucucaaaaaaaaaaaaaaagaaaaaagcccuacauauuuaaguaaaacacagugcaguuuguauaaaggcuguaguuucaucacaaauauauaugcaguaaucaaaaucaccuggaccauaaggaagacuauagaacaccugcaaaggcuuuauucacgugugauugcuaauguuuauaauuguauaaugcaauguggcaucugaugcuguuuaguguguuucccucauugacccucuggugacugcuccacaggccuaagugacuuugagguccgugcuaccucaaggacaagugacaugccuugcuugccccuggucagcaccugagcuucugcuguuuguagcacugcuguuugccuuauggguggccugauauuuugucugucauauuugaagaggcugagucagccaccguggagcucaucuggcauuuucagcaccccucacaaucauuucuguagcaauugaugagcucaaccauguggcaauuagacuggaugauuaaaauagucaagcucucuauaucugugacccugugauaguuuuuucaaugugcagcuuuuuucuguguguggauuugucucccagcagauuacucaggccaggggaaccuuugugcuccacuggguuuucccagcaguuguuggugcacaucuucccacauuauuuaagauuguuuuucucgggugucgcaaaggauggcccuggucuguuuuucccgaaggugcgccuuuucagugcaucguguaacaugauuuagauucuggugcaugagcuugcaaguguguguacaugucugugcuguguguggggauguguuuaaacccaaagaauauagucguaaugagccugacuucaggccaggguauugacugccuuucagaacaucuuaauugauagccaugcuuugccauuugauguuagcuaugacucacaggggcugcuaaugaaauggaggcagaggcugaguguguuccccaggucucacaccucuauaguagauugaaccaugcagucccguuauuuuccgaacguuuagcucaaucuggagcuugaugccauuuagaugccaaauugugcccacuuuuuucuguuauuuuuuucucagugucuugacaagccaugccagucaguugugucagauaucagugacaacuucuuccguaaugcaaaucaagauuuuucaguuagaggcaauccugcuggaucaaagagauggaucauuuuuguucuguuaucuugcauucuguaaaaauaaucuacaacuuuuugccuguguguguguuuucagggaaacaucaucaacuagcuacaaucucugaaugcuugucuugaagaguuauaaaagucugccguuuguggaggugggaaagugugccaaggacuaauggaccuuuaagauuggaagggacuuggggauagcuucuaaucuaauagcaauucuaagcaugccccagugccacuguuugaugaaugagagcuacccuuaaacaucuugggaaaucuaggugaguggaccucaaguccuaaacuucaacgugagugauagcacuaaccugcccuguccccaaaucacagaacuauagaaaugccucugagugaauaacaacccauccuccuugacuuucugugugagcagcuuuuacgcacuggccuuagacacaaccacaucucuuguaauuccaguuucugcauguguuuaccuuccuuagcaaccaccuaguccuuuguaaucuggcugggcuccaucacugugcugaagcugcucucuccacggcccucauaucuaacgaccucccugaugacaucauugcccuugacuagagcuagaaugcugacuuugaaaacucucaugccuugguuuccauccaugccccuccucugaucucuuccuaccucagagcucacuuugugugcucuucucggcaacuucuguccuuggccucggcccccucguugaugaccucagccuaugaguggcucaucuaaugucccacuguagcaugcucauuccucacuuccaccugccaaguaggaauuucauccuccugcaaaggucaccagagccaugaucugcccaucuuccuccugagucaucugugccaggauucugcugaauaugcuugugcaccauccuccaggucaccuggacucuugugaaugggcuccucaugucaaacaguguggaagagggaaaccaggacagcauggugucauggaaggcaaggagaaggagaguaguaaguaaguaguggcaggugcuccaagagggcaaguaagaugggccaaaaauggccagauggauuuuucaacaagaagacuguuggcagaagucucaguggaauagguggggagguacaggagucugauuugggggugugugagugaaacgaggaaauggagacuaggugaguaugcauaacauggauaauucucucaagacauuuggcugggaagaggagaaucaaguuggaggaguagguauaagaauaaaaaguuuucuuucuuucucuuuuagugauaggagaggcuuaaaccuguucaaauacuggugggaaggagagagaaagauagaaaagggguugugggaggaaugaaggagggagagagagcucaacaaucccagggaggagguaaaagaggcaggaggagguggacacagcacucacagauggagaaaugugcuccaggcaggcggcaccucgcacacuguaacaagaguaauaaggaaggaaagggcauagaugcuuauggugauggagcauagguaggcuugcuggcaagaaguuaagggcauucccauuugaugcuuucuacucucugucugaagcaggaggugagguccucuugaaagcaagaagauguugguggagagauuuuuaaaagagugguggaaguuugagaaagagggcagaugagggggacagggaaggacugauaaguggccuugagaauucuguugaggcucuucauggugaacuguggugaugguggcugugugaugguuucuaguuucauucagcagccucguauagacgugagagaggggggcauuuggauucaucugggauugcgguuuugccaggcaagagaugaaaaggauggaucugaacuaaacagggaaguaaaugaagaaaagggauggaguugagaagaaggucauaaaaaaugaugaggccaaaggucugagaggucagaugcugaaugggguacuggagagacccagguguugucagagugcuuaaugggucgcagcagauggguauauggcaaggacaaugagaggagggacauguggccagaggcugugguugucaaugcagcagaaauucccuuaaaggguggaggaacagcugggaaggacaaggucuuuaggguugagccggggcaaccuggcggaagguggaaagaacauucugugaaaagguggaaaauaugagaguuugucaacagagggaacauuggaaagguuugcgagagaggggagaagugggagguugguuaaagggaaaggaagcauaaacuagcucaaggaaaagauaguucagggcagaaauuacauuuuuaaauggguuuagcugaucccagccuugcuaagacagguagucccaacucuccuguuuauaccgaaguuuuacuggagccaauuauguccuggauuagucauuucagagaaggugugugucucaaggggcccuggaaagagucagcuuguacuagugacagucuucuuaauauugugccuguacucuucccacuugucaaacuuguucuuaaaacaacugugcaucagugacugucaaugacuugucugcagagcuuuuuacggggcagugguucucacaccugccuccacaguaaaaucacccagggagcuuuuaacacauacuacugccuggggccccagaacaaguauaucagaaucucuagggaugagcccucuagaauccauacaaucaauuuucuuuucuuuucuuuuuuauuuuacuuuaaguuccgggauacaugugcagaacgugcagguuuguuacauaaguauacaugugucauggugguuugcugcaccuaucaucuagguuuuaagccccgcaugcaucagcuauuugucuuaaugcucuccuuccccuucccccaccaauaggccucaguguguguguucccuucccuguguccauguguucucauuguucaacucuuacuugugagugagaacacgcgguguuugguuuucuauuccuguguuaguuugccgaggaugauggcuuccagcuucauucaugucccugcaaaggacaugaucucauuccuuucuauggcugcaugguauuccaugguguauauguaccacauuuacuuuauccagucuaucauugauggacauuuggguugguuccaugucuuugcuauuauaaguagugcugcaauaaacauaugugugcaugugucuuuauagcagaaugauuuguauuuuuuuggguauauaccuaguaaugggauugcugggucaaaugguauuucugguucuagauccuugaggaauugccacacugucuuucacaauggcugcggagaaauaggaaugcugucacacuguugguggcaauaaauuuucugaaaagcuuccuuggucauucuaaugagugaagaaccuugaccuuggaccuuugcuacccaguaugugguccaccagccagcagcgucuguaucaccugggagcuugauugaaaugcagaauuucaggccccacucuugaucuaccuacugaaucagaacaugcacuuuuaguacaucccccuccucaggugauucccaugaacauuaaagucugagaaucccugccuuaaaacaaaucuggugccuggguuccaccuccagagauucugauuguauuuaucugagcugugacuugggaauugggaguuuuagaagauuccugggugucucuaauuuucagcaguuuaaugucccugccuuacagcaaagaaccggggaaggugcuuggugcauuuuuauucaacgggguugaccaacccuaucuuuguuuaaugauuucugaccuuugguuuaauuuaccaaugaacuacauuugcuucucauuugggggaaaaacugccugucuuaaacucguggcaggaacaucauuucuccucaucuucaaagaugcugcugggaagcuuaguaacugauuagacaggaaauacugcacagccuaaggccuauugcauaaggaccaguucauuuauuaaagaaaagaaaauguugcuuauuuuuaguguaaaucauuacaaaaugccaaccaacuccuuauaaauuugagaagagcaaucuuccugauuaguuauuucuuucaccuuuucuaagaccuuguaugaaaugauauuuaaagcacucuucagcuuucuuuaagccagcugauugcacaagucaaacaacagccgugaguguguugaacuguuggauuacuacuauuauaggaauggacacauaacaaguguuacuuuagaccugaguuuccaaaguauaauccuagcuuaaaagggaauuuuuuaaaagaaagaaaacaggaaacuguauuguauugggaggaggcuggaggggagaugaaaaaaaucauuuggauuuuguguguguggguaagugggggguagcugucuauaacuuucauuaaguguuuuuuuuucuucucuuuauaaaguaagcugcaggcuuuggguuggcaaaccccagggggaugcagaaaucugaggcugcuaccuuuuuaucugccuucacgguacuguccucuucccccagcuccucccugacccuauggaccaggccucagacuuuccagcuaacugcuuccugugagccacuacucugauaucagccuauaaccaaaggagcugggggguccaggcuuggugaccaacccuucucagcccacucaaucagggugcuucccaccugcaggcaggaggcaacacccugucugcuaccauccuccccuuccagagcccaccugccugcccagcccugcccugcccugcccagucgagccauaccuugcuuugucccaccugggggugcccugcucagggaugggcuggcagggcugcacucagcuucucugguaagcagagauucaagaaaccucuggggucuuguuuucuggucgugugaucccaggggugcacauguuccccuugggugucugaacagaagggccugggagggagggccacaccccugcagucuugcugugcugguguagugggcagcugccuacccccaucccacccugcacugugggcuccagaaucggcagauuaagcauuuuauaaauuguauuuuagauacauauuucaaacuugugaguuuuuuaaaaagaacaagcuugacaaguguuuuaagaagucauuaugcuuuauggguuugagggggaagaauuuuuuuuaaagcaucugauuuagaccacauguaacucagauguuuaaauaaucaaaucaccuguuuucaugugggugguuuacucucaugaagaauagaagguuacuauuguugaagauuuuccccaacuuuuuguuucucccuuuggaguuaaacauaugaacauaggaaucauuuuugcaccacugaugauugaaauuugguuuaggaauuauuaaaacuaaauugugccagccaggggugcaguggcucacgacuguaaucccagcacuuugggaggccgaggcaggcggaucacgaggucaggagaucgagaccauccuggcuaacacagugaaaccccgucucuacuaaaaaauacaaaaaauuagcugggcaugguggcaggugccuguagucccagcuacuugggaggcugaggcaggagaguggugugaacccgggagguggagcuugcagugagcggagaucacgccauugcacuccagccugggcgacagagcgagacaccgucuaaaaaacaaucaaaacaaaacaaacaaacaaaaaacuaaauugugccaaaacaaaaguacugcuuucaagcucuuauagagaaaaauauaucaauagucuuuaaaaauuauacaggcuucaaaaaaucagcuuuucauuccauuagacuugcuaucagucuacaagaaagauggccauucauuuuuuaaauucaauaaugaacaguucauuggauuugcuacccuuugagugcugcaaggaucaugcugucuuuaggaagcagagacaaaaugaucaagacuugaaaggacauguaucuucucuacguucucugaacaugggaauggcccauuaacguuuccuaucuccacucucagacugcaaauauauuuaacauuuuccuuucuuaauaguacaagguaauguaaguguguucuagaguucaccuccuggcauugcuaagcauuaggagacuuauggcugaagucagcugcccaacaucauucccauuagggagugccucuccccauuagggagaagauaagacaugaugucuccuuauuuucacuagaguuuuucagagcucugaugauggcuuaagucuuuguagcagaugugcuaaauaagcgagaauccagcucuauccuccucuggcaccuaugacauugucuuggucauugucuagccacaaggaaugaggucaaauuugcaguuuagcuggaacuuuaaauguuauaggaaaauuuaauuauucaacuuguacaaauggaugguuaagaccaggauucaugccuuguacauuaugaccuuguagauucauagaucaguaaugaaucuuaaaacaucauaaaauaggguugauuuaauuccaaguccacaaaacccuacuaggauauacagugucuaauacauggaugcacgcugaauguugaauggugaaaaugacauuuucauggagugccuuagaauggagaauuggguuuuauuauuuuugucauauauaccauugacuggaaaacacaccacauguuuuacugcuaaaguaugggagccuggauguuuaaaauggaaguugccuggcacaguggcucgcaucuguaaacccagcuacuccagaggcugaggugggaagaucacuugagcccaagaguuugagaccagccugaguaacauagcaagacccugucucuaaaauaauaaaaaaggaagucaacauacucacaugcugaucaaauccccugaagugacuccacacagagcacaggcauugaccagccauugcuaccaggcaaacuuccacuacauuuccugccuccuauacuuaacauuuuguaucauaaaaccagucucuccuacuaggcacucgguuucaugaaacuauagcuuuauaagaaucuucuauaaaaguccuucacucagcugcuuugguugauuggucaacucuucuuuuggguuaaugcaaaggcccuucuuuaccacaccuaauccuauuuuagugggcacuccgaguaaaugugucaagaugcaaauaaagccaaaccauuugaauuuuuauuuaaauuuucaguggcuucucuccauccacagacuuaaguccaaacucugaccuugaaaaaucacugcuguaucuucguucuacccuuaucugcugucacugacuccacacucucucagccauccaugugugugugugugcuguuccuuuaccuggaauugccccaucuggcaaacuccuauguagcucucaagagucaucuuccacuucaucuucucaauuacgcuuucccugaguugucuucccgaguaguuaacuuuguucacgccuuuuuucauaaugacaacguugugucaauguccagccucccccacacucccucuggacugagcuccuugaauguggggcccauggauggccucuucaucuuuguggucaucccacauagugcagggcuugguacaugguggccacuucagcaagguuugacagagcaaugaaagcaugaccauaugagugccucuccaagugucucauuuaauaauggggagaacuugacucaguaaagccaggcuaggaccuauucuuucuuuccaacuccaagggaucucgacucagugcuuauaauuaugccuugcaacucuccccucccccaacucccauucaaaccugauaaaauguucacuuuuguguuguuuugugcauacauugguaugugcugguuugguucucagagcucacuaaucuaggaguagcgggaacacacacauuauaaaauuuuacucauuggagagcuuuaugauuuuuaauauuuacauggaggccaaaauaaaauauguagaucauaaauauguuuucuuaagguuuugaaguccaguuugaaguuuaggauauuuuuuucuaacauugauuguuacucuccaagaaaggcuuaucuuauugaauugaaugcaugguuugcaaauauuaacuucaaagaaaagccacaguguacguaacugcauauugucuuaaaaucacuguauuaugcacauuaaaauauguagcuuuccuuuccagggugauugcuuuguuuggucaaauugaaagucagguuuucuauuuuggcauuaugccuuauuucccuagacuaaaugaaauuguuccauuauagcaaauagaagcuugauaaugguuugauucaaggcuaauuggaaugcuauucucagaauauuucaccauuccgaucuuauuccucaauauuauauuuucaaauagagacugugagcuagaauuggguuacaagccuuuaagacuugagcagcugaaaucucaggagaguuucaaaccaaggcccaguuugaaguauaaacaguacugcuuuccugcugucagcaggcgagaaagauuuagcucauugcagguccccacagaaacgaaacacugagacaaaugucuccccugggguuuggccucaacuccuuuugagauggauguguaguuuggagauugauaagcaaguaacacuuaacauugcuuccuucuuguuuuuaaagcagauugcaacaaggcuucaacaucucuucuuuuuuucuuuaaggcuuccucacagcaaugaggcaagaagugacccgugcccacaaaggcugggcacuggacacugugaccauccacaaugaaguucugagacagaccaaggaggagaucacgucacccccugggguaggcguugcugggcaauagcagggaccauucuggagccagagcugaaauuucaaguucugcuuaaaacugagcuaugagugccuugguuagguccauuugcuuugcagugaggguucccuccaucauagccagaagacaucagugccaaagccucccccaucugccagaguggaagauuaaugacaaggucuaaugagcucuuagaacuccguagacuacauuucuacaaaauuacaaguuacacuuguguuugcuaaaaaggcuuuuuggccaagugcgguggcucaugccuauaauccuagcacuuugggaggcugaggcaggaggauugcuugagcccaggaguucaagaccagccuaggcaacacugggagacccugucuccaccauaaacaaacaaacaaacaaacaaaaacuagccagucgugauggcacacaucuguagucccagcuauuugggaggaugaggugggaggauugcuugagccccggagguugaggcugcaauaagcagugaucacaccaccagacuccagccugggugacagagugagacccugucuuaauaaauaaauaaauaaauaaggcuuuucuacacaucuccagcuacugcugugggcuacucacagauucuacuguaggcagcagagcagugcugagggcagcagagaugaaggggacuagcagguuggagccaggggccaguuccagggguguccccuuugaguggaaaggaacauggcuggggggaagagcccccacuuccuggacacugaucugcucaaugaaugugggaaaauucuuuaacuuuuuugagucuucacaucuucaucugcaaaaugagcaugauaauucaaccuuauuaaaggaguuguggccaggcacgguggcucacgccuguaaucccagcacuuugggaggccaaggcgggaggaucacuugaggucaggagugugagaccagccuggccaauauggugaaacccgucucuacuaaaaauacaaaacuuagccuggggugguggcaggcuguaaugucccagcuacuugggaggcugaggugggaagauugcuugaauacaggaggcggagguugcggugaacugagaucccgccacugcacuccagccugggugacagagcgagacucugucucaaauaaauaaauaaauaaaauuuuaaaaaagguaguugugaagauuuaaaugugaucauuuagguguggugcuggaccccauguagacucucaguaaaucagucucccuuucccuuucucugauuuucauucccucauuugucaaguaagggggcuggaccagaugauuuccaaguucuagccaaguucccugccaccuuauaacgagggccacguuuccuucaguuuccaguauuaucuuccacauuccugucugaggccucaccagaagcaccuuaaccuccagguucccaccaacaaucucuuuuaggcaguuucaaaauuccuccagccucuccccauuaugcaauuccagaauaccuuccacaucuguaggcauuuguuaccacagcauccugcuuccuggaaucaaaaucuguguuccuuuccaaaggcugucauaacaaaguaucauuaccuuggguggcuaaaaacaacagagaucuauucucucauugcuuaggaggccagaagucaaaucaggguaggguugguuucuacuggaggccccaagggaaaaucuuguucuaagcuucucucuucgccucuggugguuacugacaaucuuuggcuuuccuucaucauuacaaucucugccuccauucucacauucaucuguauaaguauauauaucucuguguccucuccucuucuuauaaaguuaccagucacauuggauuuaggaccuaccuuaauucaguauguccuuaucuaaacaaugugugcaaagucccuauuuccaaauaauuacauucuaagguucuggguggacaugaaguuuugggugacacuauucuaucuaccacaccuucucacugacuuuuuaaaguucugaggcugaaagcacccuggagagggauacaauuuaccauaugauggcuuuuaaguggucccauuauucauguaguugauugucacccacugaguuaaugaugguaaccauauguccugauuuucugggacugcccaugguuuuacugucaaaucaugugccuccguuuuugguucaaaaaacacaguccucacacggugagcccccacagggggauuccagaaacacuuugcaaugaaucuuacugucuuucguucuaaucagcauuuacuucccugauccgauccucacuggagauggaaaaacggucaccauccucuacauuuaccuauuuggugagcuggcaugauuguuggagccuccccugugauucuccuucagccuuucuuuuuuuagugaauauacugccuacaggauccaguuuaaacucuucagcuuagcacccagauccuuccacagucaaccccugacuucuuuuacaaccaucgagcccucugauaaaggaaauacuggggcuuuuccggcucgcccugccuuucuuuguaguguuacuucugccugugaugccuacgcucucuccucugucuuuccaaacacagcccccugcugcaagcccaucaaggcccaucaaggccauccccucuacagaggcuccugagcacuccagccacagggaccuugccucagaauucaccgcccucacccccagaacaguucaccgggcaccaccaguaacaagugugugcugcuauucaauucuuaucuuuaaaaaauuuuucugcaccuaugcaucuuaucucccugauuuaaugaugaggaaccccaggguagggccuauuguaugagagagacacuggggaggguggccagaugcugcccuggccaugauuccccuggcucuaccaugccuggccucugggggcgcucugacucucccgcuagcugggccuggcuguggaaaccucacuucauccugugacugagaugaaguugagacacagguugguuggccgggggcaggcugagaucccaccugacagcagcucuagauccuguuccaugcucccaccuuccaccaacucaaaccagaccucucagagacuuucaccucccuauagaggugaucuggugcuaccggcuaagccuguugcucagggaggccaccccacacuuaaauaacuaauaacaaacacgaacaucucuacagcacucauagccucaacacaggcugcaggagaaaacugggcucaguauuucacgaaugcaauguacccgguggugcuuucucccuuugguaguguuuuaagacugguguguguuuuauuuccaaacugacagccuuuaugacuaauuuugcagcaccuaguuuaaaaaauaaauccuauuaccuuaugcuugacucuuccaggaagguguguauauuuaugggcucuacauggauggagcagccugggacagacggaaugggaagcucauggaauccacccccaagguacucuucacgcaguuacccgugcuccacaucuuugccauuaacuccacggcacccaaggaccccaagcuguauguguguccuauuuacaagaaacccaggcgaacugauuugaccuucaucacugugguauauuuacgaacaguguuguccccggaucacuggauccugagaggaguggcccuuuugugugacaucaaguaaguucauuuccaucugcucagggcaccagaacccacauagacagccugugcuauugagggacucagugaugugugugucuuuucuccccaguaauuccuuaauuacucuuucuacauuaaaaaguugauguucuaaaauugcuagugcguguguguuuuccucacauaucaauauucaaaaagauaacucuaaaugaauguuuuuuauucugggaaaucauauuucacuauaauuacuuuuuaaagauaaaacccuguuuggauguuagaacacuuuggaagcucugaauuuuaaaaauuugaaaguguugauaugugacauccuaaaaagagccuaguaguuguaaacuuuucccucaaguagguaccaauuucccuugaauaaaaucuagccaugucuaugucug

SEQ ID NO: 192683 - RNA, 23805 nt, Homo sapiens
gcgggaccggccgcgucuccauggcgacgcgggacgcggcgguggaggcgguugcuacccaccugcuagaggcgcugcggcugugauccaggcuggggcgagaccaugucggaccugggcucggaggaguuggaggaggagggagagaaugauauuggggugagagcuccuggugagaaagggcuucccagggugcgcagcggcgggggaaccucgagguuggguuuggagagugaggaggcgcagaaaccagaggucugagccacagcuccccaggauccccggcagggacgaaggccacgccagacacaccugcgugcguccuggaaguugauggugaaaagugaaacgcugugacgucugguuaccacaugccgccucguucuucccccacccccauccugccucccauuaaaggcaaagauuucccagcggaaggcuuuggaaguuuccuccucccuguguuaauucccaucgaggcaguuuucucggaugagcagaucaucccacgcugccauacugcccuugaauaagucauuucuguagcugagauuugcucccccggcauuuagaugcauggaggauaguugcuuccuggcagccuccaagaaaugcugaggaggcccugggcucaggagaggguuccugaagauauuaccuuauaggcguauccucacaugugcuuucuucaguccccaucugaacugacccaggucuuuggaguuauuuccugaguuaggcagcagagaggagaaagagggcacauccagccugugagcuggguucugugugggaauauuucuaucacccagagaguaguuccucccuacuccagagagugaccucuccauggcugacagauagggaaccucagccacuauggucugcaugcacaguacagaguugagguacuuucagaauuaacugaaaaaucuagcgacucugcaguggugcugucagugccugcccagaccuuuuugcuagcucugggcacucaucucccagcuuccgccugauuugcuacucaagcuaucaccucugugcgcuggaacuaccugcccaguauggagagccagaagugccugaaauucacauccggccagacagccaguagcuagugcaagaagcaggacaaagucugcagugcgauugaugcccccagagucccuguuggauuaggccaagucugggacuucaccugcaaaggcauccuuccuuagcugccugcccuuucaugucuacuucccugcccucuuuacuacuuucucccaggagagcacuuaaaaaaaucaggccaggcgcgguggcucacaccuguaaucccagcacuuugggaggccgaggugggcagauugccugagcucaggaguuugagaccagccugggcaacacggugaaacccugucucuacuaaaauacaaaaaauuagccgggcaugguggcgggcaccuguaaucccagcuacucgggaggcugaggcaggagaauggcuugaacccgggaggcagagguugcagugagccgagaucacgccacugcacuccagccugggcaacagagcgacucugucucaaaaaaaaaaaaaaaucacuuguucagggucuguuucuaggugaacccaaccugcaacacuugaccagcaagauuucuaguuugucuccucaaauggccccacugauuuguaacuuuuuagugccuauaauuuuuagguucagaucacauuuggggucauuuuaaaggauuucugucuuauucagccaccccagcggcucaguguuggguguauugggaagccucuuggauagaaggaggggacuuuuguacauuuugauguaaacuaacccugaaacaaaucugugaggucgcagauuuuuaccuuauauucuaggcaggaauuagugguccaaacagugcuagaaaagggcaagaauugcacagacguuuauuucugaaguccucaauguagugugucaguacuuguguuauaauaagucuauauacauccaauucaauuucuuaauuuuaauuuuuaauaaauuuuauuauguauauuuaagaaauacagugugauguuaugagauacccauguuaaaucauuacuggaugcuuucagcauuuuauuauuuacuauauucacucuauacccauguauuaggugcuaaggaacauuuauuuucugaaggauaggaaaauugcaagcuuugaucacauuuuuuauuuauuuacuuuuaagauagacacauaauugagcaggcaugguggcucauaccuguaauuccagcacuuugggaggccaaggaucgcuugaguccaggacuuugagaccagccagggcaauauagugagaccuugucucuacaaaaaaauuuugaaauuagcugggaaugguggcgcaugccuauagucucagcuacucaggagucugagguggaaggaucacuggagccugggaggcggagguugcagugagcugagauugugccacugcacucuagccuuggcaacagagugaggcccugucucaaaaacaaaaacaaaccacagauagauacauaauuauugcagcauugggucaugaguguucgaaccuuaagucucuugcuaggggucuuaaaaauaagauaaacuuaaucagcaagggagcccuguguacuccucagugcccuccaaccugucccuuccaucggaaauuccuugcagggcaaaggucucuucaggccacaccccgccccagggaucauuugagggaagaguugcuucucucugggcauuugccuuugaaauccuggauuacugaaggaagcaaacggggagguauuuguguggacuugaacuguucuacccgcauguacuauuucaagcauguuccuacuaagaacacagcuuagaguaucuagcauuuuucacaaauugguuaaccuugcuuacaggguaaaggauuaucacaaugaauugcaagcucuguguuggagggagggaacgaggcuuccgcccuggacaugugcugggguguggccuuggucuagugccucaucuagcccaggcguuguuaccuaccucaacuuuaaggugggaaaggugggacaauugaguauagugccggggguuuagcauagugggaugacucaaggguaugauauuuacaaaaugcuuagcaccugguuagcgcuuaaugaaugguagcuguaauugugucaauuuucauuacccaggaauaugaggggggucggaaugaggcaggcgaaaggcacggacgugggagggcacggcuacccaacggggacaccuacgaagggagcuacgaauucgguaaaagacauggccaggucagaaccguugacuugacuggaugguuuucucuauuuaauacucuguuagcaaaugcuacauucagcaaugauaugaaugauauaaucaauguguuucaggggaucuacaaauuuaaaaauggugcucgauauaucggagaauauguuagaaauaaaaagcacggucaaggcacuuuuauauauccagauggauccagauaugaagguaaaauguuaucacuaagcagauuuucguguuacagaaguuuuucuuucuuuaugacugaacuugucugugaauacugacauguaugagaaagcuuaaaguucuccaguuacucauucaacgaacacagaucguguuacuauauucacaguguugaugcagaaauaggaaagccuuguaauuaauuaacucacuaaugaaucuguagugggaaaucugucccuguggccagcauguccauguccugggagcagacaaaagggaggcuccugaguggacgcaggccucgcagcugguggacccacggcuucagcugcucugcggcauucaucuuccugaaccugucuuugcauuuuccauuucugaccaaccccgccaucugacggauguguuauuucuucagaucgaguguuuccuuacaucagggcuuccugucugggagucuuccugccuuguuaaacugacuuuuccuaccugugccauaaguccuuacaggccaauguuauguuugaggaggauucuuuuuccuuuauuuccaagaaccucccugccgccccuugugccguugucaccuggugugaccacauuagugauaucccaaaccugggcagggggaccggcagggagcguguugugagucuucagaaaguguauauaaaauucuguguucugggcuuuuuguuuuuucccuaggaagaaagaaauugucuaguuuucuucagauuuccaaaaagaucugugacccuaaccuuggacucuggugacaauaggugugagcuugcauaggugacuucacaucuccuugccucaguuucucaucuguagcaugaagauucaauggauaaacacagggagacaccugcaaccuugccugauccauagugagcacucaguaacuggggcuaggacugugauguaccacuugugacagcaucacuucuuagugaggaggacauauucuuacaaagugcgagcuauaguugcuugcuuugcuccuagauaaaauaagaaccaguaggugguucuuauuuuaauagaugucagugaugauucuguccaauucugagaccaagauggaggguuuuaauaccaucccuguuagauagaaauuguuuuguuuuguuucauaaaucccagaaggcuugcucuauaagaagcaccaucugcuuuuuaaaucaacuuuaaacaauuuaauuuggggcuuaauuuaauucuuuccaaauccuuaugcaccuaaucucauucuugucacuuuugauuuuaguguagauguugauacaauuugaacaacacacacacacacgaagauauuuaggauaagggauuuaaggaauuuugaauaugaagguuaaaaauggguaacuguuucucugacaccaaaugcauggauuuuccaugcuauguacuucuccagucuucugugaacaccaacugaguuuccaaugaugcaacuccauucugacaccacccagaguuagcacagaccccacagguuaagggcucaguuuccaagacugccccacuucagaugucaaccucaaguuguggauccggaggguacccacaguucuaccugacucggcuacaaauuggggguuccuacaacacccuacucagguuugauaaugugccauagcggcucauaggacucaggaaagcacuuuacucauguuuacuguaaaggauauuauaaagaauauggaugaacagccagauucagagguacagagggcaaggccuggaagguucccaagcacaggagcuucuguccuuguggagguggagugcaccacccuccuggcacaugauauguuuaucaccccagaagcucaacaaaucuugcucaagaguuuuuacagagcuuaaucucuggccccuuccuucuucuuuaccaaaaguugguggguggggcuggagguucuauccuucuuaucacuuggucuuucugguguucagucccaucuugaggccauccugggccucauuugcauaaguucagguguggucaaaagagucucauuuugaauaacaaaaacauuucuaucagucaggaaaugucaaggguuuuaggagcucugugcugggaaccaugaauaaagaccaauauuucuuauuaugccacacuaacauauaaagcucuucugguaacaguugggauuuuugauucuccagauggcuuuguaucuuaaagggugcaagauuuagccacuacccagagauuucuucucugacaaaagcuuaaauaagugucuuacuucaugaaggcagcaauggaaacugaggucagaaguuauaauauuaauuauaacauaguaagccaauacucuuccaaucacaaaaucucaguuaauguauggcugaguuauucauaacaguguaucuuggcuggcugccaucacaaugggccagaaugguuuugugcagggcaguguguucaacgucaggacccuguggcauaaaguccaguacccuaccugucucccagauggucacacaaguccaauuagggaguccaggagccagcagaggcuauagugcugcaggagaggaguggggagacgguccuggguggcgggugacuuggauacaggcaggaaggccgagguuuuuagggguagugggggaugagauggaggggagggugggugccagaugugggggaggccuagaccccauguacugaugcugaggguuggggguguagggccaacugaggacucugagguuaagggggagaaagagcaucccuauucccugcuggccuuguugccugucaaacagaacucaucaaaacaaagaaguuuaagaaugacauuguggagaaagaagaaugacaugauaacuugaaccuggguuuuuuggaagcccccgaauggcaggagcuggaaaaaaugagcacuugacuguugggaugcuuguggagaagagagcaugguguuagacagacuccaauuuucauuucagucuugcuacccaccagcugugggaccuuggggaaugcaugcagucucucugcuuuucagguucugcaucuguaaaaccauauuucagcgauuacacauaccaaaugcuguggcaagugcacggaacccugcccagggucugacaccgaguguuuccccauaagugugggcuccuucucuccuguguuuggcugacccagcaguuuagggagccaacuuggcaagaccaugggccagcauggcaaaccagugaccaaccagcauuugaggggggaggagcaucuuggagagcuucucauuuuaaauugucuucaaucccaagugccagacaaacugcucuacccaaggagcaccugcuccacaccagccaacugacccacaaccagccaaucaaacagccaaccaaucaaccaaccagccaacugacuagccaaccaagcaaccaaucaaccaaccaauuaaccaaccaacugucuaaccaaccaaccaauuagccaaccagccaaccaaccaaccaaccaaccaaccagccaaccagccaaccaaacagcuaaccaaucaacaaaccagucaacugacuagccaaccaaccaaacaaccaacgaaccagccaaccaaacagccaaccaaucaaccaaccagccaacugacuagccaaccacccagccaaccaguuaaccaaccaaccagccagccaaccaaccaaccaaccaaucgguuagccaacuaaccaaccagccaaccagccaaccaaccaaccaaccaguuaaccaacaaaucaaccaaccaaccaaccaaccaaccaacugggaguuacuccugagaagaaauauaguuggaaaaaaccucaguugacaaguucaagaaugaucagaaaguauaggauugggguagaaagacuuuaaaaaaaaaauuaagugcaaauuuaaagccacaauaauaaaguuuacaaaugucacucaccucaaaaaaggaaacuugacuuauagcuguuagagaugugccucagcaggugacuuuucucugaauuaccuucucuauuugugcagggucccugugguggcauuacaaaaugcugggccgagccucuuaacagguuuuuuaaguagauugggacuuuaaaaaauuuugcucaccguccucuuggugcaaaauuuagugucuuuugcaacuuaacuguucucuuuuauuuuugaaauuuuucugcaaaauauguaauauauuuuucucaccaugacacccuggagauccucugacauggccaagagaggagggauguaauaauuuugucaugaaguuuuguugggaagaaaccaaaugauguaccuguuucagcugaggucucuaugccccagggcugugcuggaacccccucauaguagcucacaaaaacccauucugugcaucucuucccagcuccauguguagcuugaaauuggccgcggugugaguauuuacaccacagaaccuggcaaauguuacaaauccaggcacaucacugccccuuaagacccagacaaaucccucuagguauuugcacauccucaugguuaauuuagguucagggaccugaaguauuuuuuacugaauuaucucaauuuggggaucuucaucucucuuguucacauuguuccugucacacaucacaucaugggaccuaguccucuuccuuaauuguuagcaguugccaccuucccucucuccaugaauuuuugguaagccugcucuuuucugaaugacuuacccacuuuuugaaauugugccaugcagcuuuucgugcugccuucccuguccucagcugcugcucaggugccaaccuuccauccucaggcuggugcucgcgcccuggggacaugcacuguccuuuguacagcucuucguucaucucacaaagugcccaggacauuguaggugcugaguaaauaaugggaugauugaggaaauaaauauguagaaguuccuucugcagauaaauuuugggguuauucacauaaacaaauauuacuugaauaauuagcauuuucuuagccuauuggguauucuuuaucuucauguggaaguggguccaguuuuuguguaagccagaagcuuauguaaguuuugagaaccucuuuaaaaaaaagaaaauauaaaguugguauaaaagugaauuuucauuugcaaugauaaaucaaaauaaguuaaaaauuuaaaaauaccacaaacaucacagaaucuaaguagccugaguuuuaaugucugacauacuucuagaauagcuuuucucuaccuuuguuagcuaauacucuuugaaugcuucuccauauggcaaccauuuuguaauguuuucuauagagagaauagaaauauaauuccuucuuuucucuuugaucaacaaauugaucaacauuugcuuuuuauuauucauagucucaaaacauaucauuuagcuuaaugacuugguguaauaugcacguuuuuaagagcagucaccuuugggagaccucuauuaaguuucuuuccuaagugagcuguaagauuugaggacguuuugaguuuucuagugcagggauucauacugugguugacaaaaguaguuugcaguuguccacaucauggagugguauuaugaauuuuaugauauccuugccaauuucaguacugccuaccaagccuauaaggacuuagcagaagccguauggaggugaggaggugagggaagaguucaaacagaggcauggcaccagcggauggagcuggugugcagcugggguuagaguggcauguuggagucagaugauugggugggagauagacugaaaugcugccagguggcugaggauagauggucaagcccuggaguuguugcuggaucucuaaacauuugcaagguaaaugaagugugguguuaggaucacuggcaaugggucagacaaccuugguuugucucccuccucguugcaucuucguggugccucugacuaaccugugaaaugugcuugucaguacaugcagguggcuguggcccacauccauacaccucacucuguaccccgugaacuccugacucagcccucucuuagcccacuguccaccguggcucagcaccuaugccaucuggcacaaaaggaagggguggagggaugucagaguggaaacagauagcagccuuggucggugcuguuaaaaaucucucuucugcaggauuuccugagcagaaggggccugugugugcaugggcuucauuugcuucacaacacaucugccuuugccaugguuaacaauuugaagacaugguacagggcaucgaucccuucuucucaccugggcuugccuuuguguuguuccuuucaggagagugggcaaaugaccugcggcacggccauggcguauacuacuacaucaauaaugacaccuacacuggagagugguuugcucaucaaagguucgguuucuaucuugggucuuaacgggauuugcuuauguaaugagaacaugaugucugcagauuguuuacacuuacugaggaacagaaucauaacaaaagcccaguuaccaacucugccaggcagguccaaucuuucuauggcuuugaggcaaggaugccuuucugugcaaguguagacucaaguaucugacaucugcaccucaguuggggcagagcacgugagucuuucacccaagagucccagggaguggagggcacagaagagccacugggggaccugagccacagcucccacuagcucugccucuucccuggggaaagcagcugacacacaggaggcuugccucuguccagcuggccuguccucugugccucuggcaauguccugugcuuggggcacacugagcaaggggcaccuucugacuggacacagauauagaagcuacaucgcuugugagccugcaacagccugggccucccucaaugucaaugucuguguuuuaaaccugggagauuuuucacugugcuggaacgaaauaccauguuccccuugucuuaaccaggcaugggcaaggcaccuauuuauacgcggagacgggcaguaaguauguuggcaccugggugaacggacagcaggagggcacggccgagcucauucaccugaaccacagguaccagggcaaguucuugaacaaaaauguaaguccaugggaagugacauuugccaaugaaguacaaaauaacccccucuggcagccugugcaaaugugugaccagagaauaccaaaaacucagagaaaacugaguccggccuauucaaauguggagaacaggacagcugugccauucucugagccucugguacccacagagcacagaauugggggaagggagggauuggcccguuucucuggaucucaguacaaauucccacugucuuucagcggggaccuguugcauuguuauauaacacgagagggcaucugaaccucuuguguguauuccuucucauggguaaaucagauaccaaauaucuauuuccugcaauugagcauagagguguuuggguuuuguuucccuggaaggggaggugcgacaucccuggggaggaagacccccagcucccuccucaugcuacaggccagccugcgugcuccuaguuguggugggaauuaaggcugccaagggccuggcccugcgucuggaggcuugccagcuucuagcacccauggugggccguuucuguuuggaagacucggugguuccucuugcccuuauuguacagagaaaccuugaauaauucagaagcuaauacucaggccaucgugguagcuuugaucagggguugagcagaaacuuucccugaagagagaauuugcggagcaaauugaugguguuagaaguugacagagggaauguuuagcugauacaacgaagucucuucagacucucuuagaacccaguuuucauuuacguauaauucaugcccuaaccacagauuuuacuuuuaguuuucaucaaaacagcacauuccccucaaacccauacauuguuuauauaauucccagcaaacuuucugugggucuuuuuggaggagaugggaaggugguugcagaggaagagaauuugaugaaaaugaaucuggaagaaucaaucagcuuguccagccuaaaccagucugaaaaaucgggguaaaaauggaggcuuuguuuugcuaguuaguaaaaaacuuuaaauuauacaaauaauacacaaguacauuccaauuguaaagcauuuaaacacuaggauccugccccaccacccugggcccaauccuuccacacuauuucugugugucauguaagcacauucuaauacagucaucugacacagaauuauuguuuggggguuuuaauuacauaauuaggaucauacugugucaggauacaaaaauauacauaaagauacauauuugucauuuugcacauuugggacuauuguguagguuagauaauggaauugugaaaccuuugaggauuggcauuuagaaucacaaucgguagugcccauuuuccuaaaaaguggugucaguuuauacucuugccaauagaauaugagucuguuuaucauauauucucaucgauguuggauauucucagucuuuaauguuguuuuuguucuuuuccaaucuuauggguaaaaaaugucaucucauuguuuuaauguguacuucccugauuacuagugaggucaaacaucuugucacauguuuauugcugguuuguguuucuuccucagaaaauucccuguacauguccuuguggacaaguuaucaauaccacaaaacuucaauaauuaaaacagugugauaccaggauacacacacacacacacaccaaugaagcaaauuaggaaguccagagacaguucccaguauauaaaauaauuucacacacaauaagcgugucaaauuaacaaagggaugaugggaggagucaagacauagugcuaggaacacuugacaauuauuugggaggaaaauaauaguuuugccuucacacagaugaagauacuuucuagaagaaguaaagauuuaaauguacccuaggaaauauagaaaaaaaauguagaugaauauuaaccuugaaaugaggaaagagaacuuucuaaacagaaauagaaaggaaaaaccaauagguuuagcuuuauaaaaauaacuucuuauagauuagaaaaugcuguaaagaaaaucuaagagaugacuguuaaauggggagagaauauuugcaacauuuaauauauaaaguguuuuaucaaucaaugugauuuaaauggcuaaaaaucuugaaaaaaaugcaggcuuacuaacaacugaaaugaagugaauuaaaauugugagacccuguuguuuuauauaaaaaaacauguaaaaauagaccauuuuuacacuccuaaaaucaagaguuugaggaucugggacucuuaagugcaguuaugggaaugaaacgauuagagccucaucuaaucaaagcacauguaugcuuuuguccagaaauucugagaauuuaaggaugguaucaaaagcguacauaaaguuuuaacucagaguacguuugcuggagcguucuuuguaaaaaaaaaaaaaaaaucaguaucccaaauaccaacaauaguaacugaguaaaauagguugcaauccauagaugaaauaaaguaccagguggcaacuguuauuaggaaagaauauuuguaaauacgggaaguaguucaugccauauuucucaguaaaaauagaguaugaguuaguauguauaauuaugaucagauuuuuauuuaaccauguauacuagaagcaaaguuacaaagaaugcaucaaaauauuaguaguaguuccaucgguagcuaguuugccuauggauacugauucacugagguuuucugaaaaugaauacaucacuuuuauaaaaaaguaaaaugugguuaaaguuuccaaaaguaaacaaaacagggcauauaaguuccaaucccaucagccacgaauucacaaaagcauuccuuaauccauguuacacuuuacccaauuuggugauuugagguggguauugugguggugacauuuguauuuuguauuuucugcuggguguugacacuuaagaaugguuucucuuugcucguagccuguuggcccuggaaaguauguauuugauguugggugugaacaacauggugaauaucguuuaacagauaugguaaguugcggagcauguaggguuuuguuacauuaacagggaaguagcugcucaaaaauauugauccugcaagguuggaggugauucgccuaaaaguuaugccaacucuuaggcacuuucacauuuucauuuuccuuaucugcauguguuaguacagaacuaaauugccagaagcaaacaauaucauuucccauuuauugcagaacucuagacuuuguugauagauaccguuuuuguugauagaaacuaauccuggcagggcacaauggcucacgccuguaaucccagcacuuugggaggccgaagcgguggauugcuuuaggucaggaguuugagaccagacuggccaacgugaugaaucccugucuccgcuaaaaauacaaaaauuagcugggcaugguggcgcaugccuguaaucccagcuacucaggaggcugaggcaggagaaucgcuuaaaccugggcggcggaguuugcagugagccaagaucacgccacugcacuccagccugggcgacagagugagacucugucucaaaaacaaacaaacaaacaaccaauaaauaaaaaacuaauccugagugggaggguucuagacaguguuagguccugcaagugaaaacugaaucuguaacugguguugccacaguuuguccagugacuguuagcuuguccguugugcagcaugcuccucugaacgugccguugguaagucuuucucuuguuuuuuccuuuccaauaucuaacauuaauauuaacacuacauugacauucccugguuaauaguaaagcuagucagcuaauauugccguuauaaggcaucgagaugcguauguguguugaggugggaauauauguguuccuauuccucucauuauuaaugucugaucaaucccucuagauaauuagcaauucagcaacauuuccugacccugguacugguuuugauccuuuugacuuauuuguuuagaugaggucauucucacuguaagaaguuuugaguuuuaaggaggaguguggaaucacgcuuuuguuuguuuuuuggucucugaaguuguugagguguccccuccuagugaguuaagaauauauuaucguacacaaacucucccaugucugcauacuuucuuucugaagaaagccggggaacggcuuguuugggucuaccaucacaucaaugcccuuucaaccuggguuaguccuuuuugugcugcuauaaaggaauuccugaagcuggguagauuauaaagaagagagguuuauuugguucacaguucugcaggcuguacaagaagcauggcacccgcaacugccuggccucuggugaggucucaggaagcuuccacucaugauggaaggugaaggggagcugguaccauagcucaaaagaggaggaaaagaggggaggaggugccagguauauauauauauauuuuuaacaaccaguucuugugugaacuaauagagcaagaacucacucaucaccacagggaaggcaccaaaccauucaugagggaucugcccccgugacccaaacaccucccaccaggccccaccuccaaccccgggggucacauuucaacaugcgauuugaaggggacaaacacccaaacuaugucacaaccugagccaagucaccucguuuuguuuuuuuguugcugugucccucgucaagcccuuggcaucacccagaggcccugcuuuaaaccgacuccucgucaccuugggcucaggugugaggcuguggaaagcuauccuuggucacaggagguagaagccacacuguggggagcuuggaaggcugcgggagauccugugcaugagggccugucccgcaccugcucugugccgcccacugcugucucuaccuaaugcuccauccuuucaccccaagggcccuggccuugaauccuaagucuaaacucaucacuaauuuuucaauucaaugcucuucaaugcucuccagacagguuuuuuuuuuuuuuuuuuuuuuuuuugagauggaguuucgcucuuguugcccaggcuggagugcaauggcgugaucucggcucaacgcaaacuccaccucccggguucaagcgauucuccugucucagccucccgaguagcugggauuacaggcaugugccaccacgcccagcuaauuuuguauuuuuaguagagacgggguuucuccauauuggucaggcuggucucaaacuuucgaccucagaugauccacugccucagccucccaaaguggugggacuauaggcguaagccacugcgcccagcccuccagacaguuuuuuaacuuuucucauuuuucuuccuagaguuuguuagauucuaaaaccaaagggagucuuugaaucuuuaucccuuaaccucccaugaucaagugacuguccgugcuccguugcugcuucccaaguggccacagucuggacauccccggggcucucggcccugaccucagccacccucuuuuccugauucccgcuccugugauauucuacuuucugcacaucacucuggccaugguuauuuaguuuccccaaacagcccaugguugcucaugguccaccuucuuggcugaccagaauccuguguggccucacagugaucugucuuccuugccucuucuccugcuuugcuccagcuaaaaggaaccacuggcuaggggcaggucccuagaaaaccagaaaaugaaauggccaaaaugcuugauuuuguugcuaaguaagaggcccuaccuccucugagcacgaauucuucauggaccgcagggugcucuagucuggguggaaggcagcuuccuguaagucaccugcaucuaacaaaacguagaggaauuugacauacuguccucccccgagguuccacuucauuuauguguguguguguguguguguguguguguguguguaaccuccuacacacauagucagaagccuaagaaagacagucggcuuuaggauuugauugugacagggagguauuuaguauuuugcugggauuuccaugggguuggacaccucucaucuguucccugaaggaaccuauugguuaaauugauaucuugucagcacugguaauaacuguuuaggguuacuggugauugagcaaguuuuuacauuuguguagugauaaaaauaaagcccaucuuauuaagugcuuugcagcuuuagacucuacuggaaaaaguuccuagaagucaguauuucaggaugaugagaagaagguagaaggagcaucaguaacaucuaagagagaauuacugauauaagccccaaguccuguugcuguuuaggaaaaaccacccaugaaauaaugcagcaacaaccugagggcuuuguggaaggccucccacugugcuguggggauggauuaggauggugguggaacagaagggccuccguguucucucucccuaguaaggggaauguaucccuucuagaguagggcuugccaagcugcagcccacggcucacucccuguuucuuuuuaaauuaugguuuuauauguacguuuauagaguuugaaauuugccauuuuaaagcaugcuuucaguggcauucaguacguucaguguugugcagcugugagaaugaugcauuucuggagcuuguccguuaucccagacagaaacucuguaccuauuaagcaacaacuccccauucgaccucccccagccccugauagcuuuuaaucuacuuucuuucucuaugaauuugccuauucuagaugucgcauauagaugaauucauucuguauuuguccuuuugugucuggcuucuuucauuuagcacgacguuuucaagguucuugcuuauccauuugucuguugauggacaauugaguugcuuccacauuuuagcuauuaugaauaaugcugcagugaacauuggugugcaagcaucuggucgaaucucuguuuucaguuccuuugguuauauaccgaggaguggaauugcugggucauauggugaugcuguuucgcuuuuugaagaacugucaaauguuuucuacaguagcugcagcauuuuacguucccaccagcaaugugaaaggguuccaccucuugguuuuauacauaaaguggcgugcaguucccaaacuagugcugucagcuucaccugggaaucuguuaggaaugcagcuuauuggacgcuaucccagaccugccgaaucugaaacucuggggguggggcuagcaaucugucuuuuaaugcuuucugggugauucugaucuaagucaaguuugaggacccuguccugcagcauuggugucacccuucauggguggccauauucaaacacucugagaccaaaauagagaguaauugauuucccagugacucaguggaagaggcaggugucugccccucucugucaucgguauuaucaccuauguggcagcgaaguguuccauagucauagugcugaugcucagaucuuuggaauuuugugauagucacaaaacugagaaguaggcaaauaugcuuggcaaaauuggcacauguuggcugcucaccauugucggaauuguacauuuuuuauuacaaaguguuccauguucagacuugaugaacucucauucugcuuuccuugaauuuuauuuuuccccauaauccuugacacuugagcuuuugcguuuaugcaaauccauaucauauggacaucuuaggaacuucuuaggccuaagccuaaaacaaauggcuguuucuuuuauuauuuauauaaagaauaauauaaauaauuauguuucuacuaagcucaauagacauauaauuauauaauacacgauuuuuuauauuagaguugcaaaauguggccgaacaauugaaaagaccacuuacuccuggucacucaguucuggccacuuaguccuggccaugucuuagcuauugcaggcgacugcgacaugcucaucugaaagccuuuuguggcacccauuauaaagcucgcuggcccagcauugcucuggagacuuuauuccucacccuggcucuuucaagauccauucucaacccugagauuauaccauggauagucagcaacuggucugauuccugagugacguccuaaaaaggcugaaacacaagccaaaaccugucuuucaaaacuuguccuuccucccucacuuuuaauauuccagaccaagaugacacaaauguugguaaauguacauuuuugcacuuaaaauaggaaagaggagaagaggaagaggaggaagaauuaguaacuguuguuccaaaauggaaagcuacccaaaucacugaauuggcccuguggacaccaacucuccccaaaaagccgaccucuacggauggaccuggccaagacgcuccaggagcugagaguguggggcacccccgggcugugggguggagggggcagaggguguggggcacccccgggcugugggacagaggguguggggcauccccgggcugugggguggaggggucagaggguguggggcauccccgggcugugggguggagggggcagaggguguggggcauccccgggcuguggaguggagggggcagaggguguggggcauccccgggcugugggguggagggggcagaggguguggggcacccccgggcugugggacagaggguguggggcaucccccgggcugugggacagaggguguggggcauccccaggcugugggauggagggugugggcgccuuugggcugugggaguuguggacauccuguuuucaggccaggugugguuggacucucugaaaaucagaugcugggucaguugagugugcgggauguuauuagggagagccuuugggauuggaggacacucccggagagcggaggggagaggaaagaaacagaguugauuggacagaggcggagguguggccuccacaaccuugcuucauuccauggggagcacuguggcgucucggggacccuuauccccucaccuaggucagugagugaaugugggugugaccccgggcuggcacugacagcagcugaggggacagcccuucccugaagaaggguccguguggcaccuccauguccaacccaguggucuuucuggaaguccuuaaugugcuggggaaaguugaagguggcuaccccgggugagaucccuuccauggcaagcggaggaaagccaacuccgauuggccuccgugaaagaauacucaugcugcuaagaauuucuuggcucaugugacugggaagcuccgggacagcccccagaauggccgggcagccucugcccucugucccagcucuccucucugcuggcuccccuggcuggcacucucaggaaccccaggggacuucucuuucucaagagucucaucaacacccucaggaaugaaaguuaucagacuaccugcucccauccccaagccacugacuacaguggggacugggcugcuccccuggccaggccuaggcugggcuggguggauguugagauggggaacaugaggugcugccagugggagggggagggugggggcacggcagcccaggggacagcugcccugcacaggucugcaggcuccauuuuucccaggaacucaggcuucugacuuguguuuuaucucaggugcaggagaacccggggaggaggcccaggcucugcuggagggcuucgagggugagauggacaugaggccuggagaugaagaugcagacguccuccgggaagagagccgggaguaugaccaggaggaguuccgcuaugacauggaugagggugaggucccugcgcagggaaguggggcgagggcccgcacuuaggggccacgaacagugggauuccccuucccuucaccaaggccugccuucagcugggccccagggacucgaggaaggcuuagggggcccccugugagcgcucacuggagccaucucagaacguugcucccuggcaggcccuccugcaagccuggcugcagugggagaggccugggugugcagcggugcccaugcgcguugucacaggaggaccgaccccaggcuggagagcccugucagacaugcagagccuggcuuucuucuguugcaugauuuuuuuuuuuuuuuugagauggagucuugcuaugucacccaggcuggaguacaguggugcgaucuuggcucacugcaaccuccaccucacugguucaagcaauuccccugccucagcaucccaaguagcugggauuacaggugcaugccaccaugcccggcuaauuuuuuuguauuuuuaguagagguggguuucaccguguuggacagacuggucucaaacuccugaccucacacaggaggcccgccucggccucccaaagugcugggauuugcaugauuuuuagcagggcugacuaacaggaguaugguuucagacuaguggugucgggaacuagcucuuuuucaauggguuuggauguaagauuaaucuagaaacuucugccucugccagcucauagggcagggauuugaccucaguucugacugacugaagccucaggcuccuggaaucuuuaaaaaucuuuccccaagugcuugugggcacuugcagaaagucuggagagaggacucgcuucccuuaacgcacuuuucacaucugacugaaagagggugucgugcuugugagggaaagggccaucugggaacagccugggcacggcggccucaggcacggggucugcagucccauuccacuuaguuugucucuguuguaaauuaagaauauacuucccauuccuuugaaaauaauaccugaaauaaugaaaucacauaaagcaguuuucucuuagaugcuugaagcacacauagacuuucgugaucgguaauuccccugagcgcuggcauagacuuucgugaucgguaauuccccugagcgcuguagcaaugcacccagugacgcagugcugaggugggacguggggucagguggaaaccuggcuuuacaagugagcaucgucucugcuucucugacuugcacagggaggguggauagagugagcccugguagguagggaguccacaggauucuguuaggacugaguggcuagaguaugcacaguguuacagcagcaucuagcugugcccacagaugucaguccuuagucacuguggagcacagcuggagggggagacacuggguuugauaggcagugugggagugaggggcugggcucucgcccucuagcaccuaaugggaagcuggaauaaaggaaucagugaguucccugcagugacagggacguguuaccauguacccaggagaggugaugacucaccuggggcaggaccaggaaacuccggguuagcugggagggagguggcaaggaaugggugaaaccaggaaggaaauuccaggcagagagcagagucugacagcagaagaguguggggguggggagguggccccuuucccuuggaaccagauggccuuugaacuugauccugagcccaguaggcgggaccucugggagcuguggggauugccuguaucaggcuugcucucugagcuucucuggggcaaugaggaugggugcccuggagccaggcaaggcaggaggccccagaaacuuggugggggagauaacggaggggauggagcaggaggaauccugaaaaccggacugggagagauggggccgaguggacgaugcccaguaccagcgggcgucugagacuguggguucaugcaccagccuuggacagagggaacacccccuuaacucagugguuuuggggcuccaggggacauuuggcaaugucuggagacuugggaggcuggugagggaggugcugcuggcaucuuccuggguggaggccggggacggugcugaauacccugcagggcacagaacagcccccagcaaagggucacccaggccacagugucaggagggcccuaagugaaaagggaguaauacaaaauaggcuuagucggcagaacauuuaucaaaauaaugcaaguucagcauguauucaucaugaaucccacauuacauuggagauuuacccugcuaauuucuucuuuaauauacccaacagugaaaguuauagaguuuaauuaauaauaaaaaauagcucuaccuuucacaaaacauuuaaauauagcgucuuauaagaauguggcaaauuucugcuuuuuuuuuuuuuuuuuuuaagauggaaucuugcucuguugcucaggcugaagugcaauggcgugaccucggcucacugaaaccucugccacgggguucaagcgauucucuugccucagccucccaaguaacuggguugacaggcauguaccaccaugcccagcuaauuuuuguauuuuuaguugagacgggguuucaccauguuggccgggcuggucucgaacuccugaccucaagugauccgccugccuuggccucccaaagugcugggauuacaggcaugagccacugcgcccggccugcuuuucuuuuaaauuaauagccaagcaauuacauguuuuagccacaaagcuggcuguuuuggacaggugugcaggcauaagagaauuacugauguuacauggauagucuugucuuagcauuuacuuugaguacguauuuugcuuauuuuaugucggguaccaaaagaaaaaacuguugaagugcauaugagauaaaauuuaacauucaauuuuugacugaugaaugcuuaauaguuacaauaauuuuuuucggcaaaagaucuguuagugaauaaaggcuuuaaaaauagaacaaaguaaauaugagauauacucauguuucucuuuucuuuucaggaaacauuaauucugaagaagaagaaacuagacagucagaccuccaggacuaagaugaagugagccgagaggagaucguaucauaagaaugcuucugucguuagccgggugcagugcuguguguaucuaguuccagcuacuugagaggcugaggcaggaggauugcuugaguccagaaaguggcaguugcagugaguggagaucgcgccacugcucuccagccuggguggcagagcgagacccugucucaaaaaauaaacaaaaacaaaaugcuucugucaguuaacaaucuuuauuagaggguuuuuagucuuucuuucucagcuguauguuaaguugauugacaaaugcaaauaaacgucuuuauuauccuuucuuucugaa

SEQ ID NO: 192684 - RNA, 121757 nt, Homo sapiens
ucccgcggcggcuggcgucgggaaaguacaguaaaaaguccgagugcagccgccgggcgcaggaugggauccggcuccuccagcuaccggcccaaggccaucuaccuggacaucgauggacgcauucagaagguagccccucccccacccagacacccccuccuccccccgggugacagcgccggggccgggcgcggcggggcgggacuguccgugcgucugccgguccaggcugcggccuccgugcgcuccgccagcucuggucgggggcggggguccccacgcgccggcuccccggggaaaggggcgacucgcccugggggguggggggugggggggcgggcuaguguuuccguuucacaggcagagcuuuucuuuuugaaaaucugauuaggcugaguuuuuacauucaagggcuggcacaugaagccuuuaauuuccgguggaucggcccgccgggcagccccggggucgugguccgcggagggggcgagcagccgccgcuuccugucgcgcgggggcaggugcggggggcgccggcggggacacugcucccccgcaggugaguagcuccgacugcagagggggacucgggccgcugcaccuccggggccccgcggagagccuggggggcagcggguccggcucuccccugcugugcggagauaggaagucccucgaauguccagcguuccuagcggacuugaguuacacgggagagggguucagaauagacccccuuuguucguggcccccucugacgggcagggagggacaaugagcgcgccggcuuggaaggggcucucaugagcucccccuaaaguccccagggaaaagccauugugaggaaaucccucaaaccucagcugggcguuucaggaagcccuugcagcugcuucucaccuuucugcccacggaguacuccacugaaggaggccagggagagaugccccagccaggcacagagcaggugccggccaggcuugagucuuuccuguucccagaggugcauuuggccaguuuaaucaguagauuuaagccaacaagccucccucacccugugcccggcuugauccccgugaaauggaaaguacagcccucucccaccguagcccgcuuugagagacucagauaaccgggaggaggaagcaucuucaaggacagguggucacccccuuauuuaaucagugcugggcagcugggcagcugggcagcggcagacgcacaacuagacccaggucccugacuccaggacuaggcgucugcaauugcaugggacuguaacagccuccuuucuccccaaaggaaggaguggcccucccuugaauaugucacugcaccagcaugcacacucacacacacacacacaugcuccaaugcucacacauccacucacaaacacacacacgcacacacgugcauacacacacgugcacaugagcacacagacaugcacaccacauaggcacaugcacacacacuuuuucugcccgauagaugagaauguaucaaagaccugccuuuaaaagcaaaagucuuuuuaaagugaguugucaccagaucaacaguagcagguccguccuaagaacuuccuaaagaugucccgggagcagcucucuuggaagcaggugaaaaguggaggagagcuucaggaggggugggaggaggacgcugggcauggcaggccaggcuguuauugugggcaggguagcuuuucacaguggacacgcugagguuggggugaucuccagaaaagcagccugcaggugggcccuggggaagacauggcauguggcaccuuugcgggggagaggcggauugacugccagcucuaccacuuccuguaccacgagcaagccccugggcuccccaagcuggcauccccguccauaaagaagggauaauaaaaucugcuuuauagacuggaaugagaagggaaugagugaauguaaacacugccuggaacacugcagaacacgaugagcauuauucuucccucaguuccuuccauaaacguccuuuuguggugcaaacagggaggcgccagacgggucuccaacccccaccccgccccccaucuccacgaggucuguugcuugcuccugagcugcccccgcccucugccccuugcugugaaccccguuggaagcuccuagcuggacugugaguccugguugaagcugaaucguuugcccaagccaugugccgggcaaagcaugauaacuucucgcucaccucccaggcugcacacccagcagugcugucacggauggguugcaccgggcucagcugagagcacuuucagugccgcugccaucagccgccauuccuucucuuaaaguaccaggcacuggguaaauccuggaauuuccagcgugaaucugucucccugccauccgccccaucuccucuccaucaaaggucauggaaacaaacccauguugcuuccuaggagggagcccugggggucacugggugcaggagauaagggauguguugcuuuccgucacuguguucgucggcaccaccuggccaugaguccuggcgaugggcacacccgccccuucguuaucucugcucuuugucccucugguuaccugaccccuggccaucucaguuucccccugagaccgcagagacggggaggaaggagggaacauuagaaacuggggguucugccgaguucugugcuccggcaaagcuccagguugacaaucugaaguugucugagggaggccccgggcagcaagugccggugucuccuggcuuggccuuaccugugcagguaacccugcagacaugcccagugauucagaggagccgcugcagccacuuggcgccaggccaaugcuuuauuuauaugaagaaaacuccagacacgcacaggugucacaucaccagagugacacagugggagucagcaacaggaauuugggggauugucuucccuccucaggagcuuuuccuucagagguugugcagaggaagcugggcgugugaagugagucggagguugccuccugagcccuacacgaaggcaggacucugugcccuggaguccaacugaggcuccguuuucagugcuccccucucaucucgagaaccuugggucaguuacuucacucugugccccugugcugcugugcuaauaauuaaaugggauaaggcagauugccuggucaaugagcccgccguguuuauugagcaucuacuaugugcugagugcugggguccaugggaagcugagugcuggcggaaugggaaggcaacuacaaaugauaaacagcagcagacguugcaggcugggugggccagccccguguggggccugaugaacagguuuuuuucccugacgaucggcuuugcaggcuuugugggcuuuguggggaaggagcccuuugugcagaacugguagccaugaggauggccuggugagaagcugcugaagggcuggggacagccuccacccagccagcagcaucugcaccggccuguucccgucaucuguuccuuggcuugccagggugcacagaucaggacuuggcacuuccccagcaccaggugaagcccuccugucacccccaaccccgugucuagacccucaggugggcuguuaaagaaggggagagguggaagccagguccccaaaccuagggugcugagguccuugcuucagagagacuguguccucuaggagcugaagcgcuucgucuuuccccagaggauucguuuuuuccuuuccucagcugccccuacccuggggggcccuggcugcagcaccugcuccuuucucuugccuauggagaaaggguuugcucagcugagcugcccauggagugacagggacgacgcacucagcacuggggagcuggagggggucccaccugguggcacauccaggcuuggguuugccaaucuuccgaaucggggaagagagaggccuuugggaccccugggccaggcugugggcucggguguggugaggagccacaucugggcaagacugaaugcuccggggccucuguggugccacugcccugaccuggcggcccccucgggacacucgcacugugcgcggccucccuggcgccucugggcugugguguucuggucuuggccuugcucugcagcuggaacccaggucugaacacaucgguggccgcuugaguuugcggggcuguuucuacuguaaaccagagcagugaaugcgcacagcccaaagggaggagccgcgcuagaaaguguucaagcguccgcagaagucggcucccaguucuuaauaguuugccacccaccguggcuacgccacaccuacgcuugccuccacccgaccuaugccugcccccuucacaugcgggagcccagggcuccgugcccugggcagcugguggggucugcccaggccuucucgugaugcuuccacccagccugguccuggcacccaaggccaaccucugcgggccccagagcugugccuuuuuggcucagguccuccccgcagugcuuggaguccaggccucugcacccugcugggguggucugugguccuggcccaagggaaugucgcucccugcugccugguucuacugaucuguccuguucaggccccucugccuucauuucuugcuuuggcacaagcaugagcugcuguuucccccagcuccucaggggagaggagugcacugccccaaccuugucuggugugguuagcaugguggggccuuaagcccuacccggcuccugcgugccuuuccccucuccugcccacgacauggucaaaugcaaaccuccuuucauuuuagaaggcaugggcugcucagcccacacgcgcagugcccuuuccuguggcugcaggcaucucugcucaauugugcagggcugcgucccccggccacacugacuccucuccagguuucucggcuccagcaccacugucugcgcccuccuucccagguggacggcggcucuccucgccauccucuccacuuccagccuaucaucugucugccuguuacauguuuguaacuuuugaccuuuaaauugguauaaaaaugguacuguaaguucacugaaccaagaaaaucugcugaaggaagggggucagucacacccuuuugggguuuccaguguaugaauggaggggguggcggugguggagggacagggagcaaugagaguugccagccuuauugcuguccugaccccuggcuggggacgacuccccugucuccaccugaauugaagcugggcugugaaaaguaguaagaacccucgguuuuugguuccuuuuucaaccagcaaucagccaugaagugccugaccacuugagagcuacagcaggugcugucucggagagggcacaggaaacugggcccuucccaauuuuagcccaagggugccgaaaagucagggagcugcuggccuccacacuccuucccauuggugugguccgaauuccccuuuagccagacauuuccaauguccagaggcccaggaggggacagcuggaagccagaagcccaccugacgccaucaggaauuuccaugaaugaccuggaaaccucucagacuaaaccaaugccgcccaaucugggaauccaggagggcuggucccauagagugguggggacauggugcugagacggacagccucgccucauccgccuuucccacuugccagccgggaggccugggcaaaaucacuuucuccccagggaaguggaggcucacugugcaguccacgcggagcaauggggugaaguuuccagagcagggcagggcauguggggaggcucaggaaugccacccuugcccucaggccugggcacagcauagcccccaugacgcuucucucauccuggacccaucagcccggaagacucuggaagcagcaguggcagcaccuuccugucacuugucuugucacuccccgaguccacugugagcuagaaccacaggcucccaugaagaaggagccagaaccacaggccccaugagcccaggucccacagcccgcaccuucgucuuccagccagccucuccggagcucaguguggguggaggggcugucuggccucagaaaugggcaaaagacagcucucguugucagcgagguaaaucuagcgcagaggaagggcacacuguccccgucagacgccucagaugaacugacaugcaaaugagagaugaaacggggacgagccgggcagcugaucucagugcagcaacugggacaccucggggcauaagccgggcagggaggcggcaggaacugggccccagggggccaagacuuccugagaggcugggcccgguagcccaguccugggcuugcuucccaggggguggugggcaacccugaacccucucucacccaaucaccugcuccccugggugcaggugacccagcaagccgcacuccugggaaauuucagaagguuuugggcaagaagggcccagagagcccccagagaccagacggcacagcccgauagcugggccugccccagacaaagcgugucugcacuccuuggcuuucuccccagacaaacccacccugagcucaggaucccuccagcuuccaggagcaggugcggggccugcagggacggcucgcagagaaggcaguuugcgagucagugccuggcuuguggagguugagaccaaggccaguugggugcuugcauuuccagggguccaaauauuuuugagaagaaaauguucuaagaaagugcacagggugguggaugaaagaccacgcucuggguaccguguacaccgcucgggugacagugcaccagaaucucagaaaucaccacuaaagaacuuacccauguaaccaaacaccaccccuuccccaaacacuauuggaauuaaaaaaaaaaaaaaagauuaaaaugguuaaaaauagaaagugcacaagcaaggguccaucugcaggaguuggaggagcgcaugccuguauuccuggcacugcgggcacagucaugccaugggcaccagggacgcccagugcacucagccacccagggguggcucccaacauuuucaagcucaaaaagaaauauuuucacuugagggugcaacuuauuugucuugaacccaucccugacugccugucuccccccucacccugaccacaucuccccaaaucccgaagcuggucacgcaacgggagcauuggcccugaacagaaacccgcaguaccccugaaaacucggucuagaaacaacuaaaagaagaaccacagcauuuuauuccguuugcuuuagauucucugccaauuuuuuuuuuuuuuugagauggagucucgcucugucgcccaggcuagagugcaguggcgugaucucggcucacugcaaccuccgccucccagguucaaggaauucuccugccucagccuccggaguagcugggacuacaggcgccugccaccaggcccggcuaauuuuuuauuuuuaguagagacgggguuucagcaccuugaccaggcuggucucgaacuccugaccaugugauccgcccgccucagccucccaaagugcugggauuauaggcgugagccaccacgcccagccuuuuuuuuuuuuuuaauuuuaaauugugguaaaauauaugaacaauaaacccucccuccccaucccccucccccagccccugacccccacuguacauuccgcuuucuaucuccaugaaacugcugagugcggggaccucacagaaguggaaucacacaggaucgcccugcugugccuggccuccuucacucggaucaugcccucaggugcauccauguuguagcacguguccgaauuuccugccuuuuuaaggccgagcgguauuccauugugugcguggaccacauuuuguguuuccauucaaaacggaugaaucgaugaaacugccugauauuuuuaaagccucagucauuuucauucuuaguucuucaguuugcaaagggccggccuguugugauggguuuauuguugcaucuucugaaaaacuuugugaguucccgaaggccucuccacgucuugagucauggcugugcugcuuugcgaagcugugugcaugucugugguguagccuguguacagccugugaugcgucgcagcggaaggguagggggcugcccagggaagacagaugcgccagguuccgcuccacggagcucagcuaccagcccugguggagagcgcagauggggccgauuugucauuugucugcgcuugagcccagcagcuguguggccucccuggggcaagucauucacccucucugugccucagugucucugugaaguggggggaaguuuuuggaagauuaagugggcuaauacgcgucaaaugcuagaacacacuggcacuugguaaaugcuauauaaguguuaucauuuuuguuuguuuauuauuuauuuauccaugucauggauuuaaggcagucuaaucucagugccugguggagacccgggcgccacccccccagguugucaaguggucccugugccucccacuaucguccccagcacggugccguguccgggcgugcgugaagggccagcucaccucacagcucugcuucccagguuagcucccauccacccucccccuaccuguuuccucaccgaaggaaggggcagaaagaugcccuccaugccccuuccgacuguugcagagggauggaggacuaugguacauacacacauauacacgcacacacccaccacacacacacaccaugcacaugcacaucacacacacgcacacaccaugcacacacaccacacacguacacaccaugcacaucacacacaagcacaccacacacaccaagcacacgcacaucauacacaugcacacacaccacacacaccacacaccacacacacgcacaucccacaccaugcacacacacaccacgcacacgcacugcacacacaugcacacaccaugcacacgcacaucacacacuuguacacaccaggcacaucacacacaagaacgcacaccacacacaaggacacacaccacacacacacaccaagcacacacacaccacacacacgcacacacacgcacacacccaccacacaccacacacaugcacaucacacacguacacaccacacacagcacacacaaaaacacaccacacacaccaugcacaugcacaucacacacaugcacaccacgcacacgcacaucacaugcacacgccacgcgccucacacacaagaacacacaccacacacacgcacaccacacacacgcacauaucacacacaugcacaucacauacaugcacacaccacacuuacacacaugcacaucacacacaagaaugcacaccacauacacgcacaucacacacaugcacacaccacacaugcacaucacacaccugcauauacaucacacacacaucacacacauccacaugcaccacacccaccacacacaugcacgcaccuaccacacaugcauaucacacacaugcacacacaccacacacaagcacaucacaaacaccacacaggcacaucacacacauacauacacaccgcgcacacaucacacacaugcacacacaccacacacgcacaguaugaagaugacagagaagucagcagagccccuggggguuucaggaguugaguggggacgaggcagguggccacacagcucggagggagggcagaaggcacccgucuucgcagagucacaguggggcuugccuccuauacgugccggaagggugaagccccuuaucucauugcccgaugugaugagguuugaagugguugagcuuggaggguaugggcugagcccacagcagacaggccuggcagugccccccgucuucccacccugcggucaugcagcccgacucuugggggcggggugccaccgugaugugccgucacuugcagcaguauguccucaugccaggcugagaccagcacugugugaccagccugccccaugucccucagcgcugugucacacuccacacugaggccccacugaagcaugccaggccccauccuauuucuuccagguagucgucugcccagcaccuccccucccaggccuugcccuaaagcccaggccucucagcauccaggacucuggaaucucccagguguugauggcugaggucaucagcuggaugccaggacacccaggaugcuccagguccuugcuggggucuggaguuugugauucagccucagucccuguggugaguccaccauguguccucagacaauggaucagagagcccccagaggacggcccggggccgagucggguccagaugccaaaggggcuucucgaggcaucuccagcucccaccugccccucggagugccaggcuuggcuucuggaagagaaagcuggggguuuagugacuccagccaacugcugugagcccaaggcaucaaacuaaaaauagcgaggccaagagggagucuuuguguucggcucagugggcaauggugccucaccucgcagcaugacacagggcugaugacacggggcacguuggucacaaagugccagucucagccuggcacagggacgugccaccugcaggugaugacacaucacaguggcagccgcuccugauggugcugcugcauugaguaggagcccagauccagggagacaguugcagcagaugaggcaggaggccagcgagggguucuaccugcuuuccgggcuggccucugcauggacacaaagcagaaagggcauaaaggugacccuggccaccaaagcagaccuggagcaaacuggaccagcgcaaggccccggugccagcacucagagacauuucuuuucuggcaggaaauuugugcuucauuuucuaaugaaauuccaaggcaaucaaaaggcaaggaaagaggagggaaaggaagggagggagggaggggguuccauucccauccgaauggaagcccccaaggcuucuguagcuccccccaucaccaacuucacucaccacucuuaucugaugccuccuauuuggguacacacggccgggucggccuugcgagagacucaguuuccucucgacuuccgcccgccugcacugucaccacguccugccauugaccucuguucauccacucauggucacugcugugaguugaauugugucucccaaaaaaguggauuucugugcuaaccugugaaugucccguuaguuggaaauaggguauuugcagacauaaucacaucaagaugaggucauacugcauugggaugggccucaagcccauaugcccgccauccuucuaaggagagggaaaggcagacacacauuuguccauggaaaugagaacggaagacguagagacagaaucaggccauguaaagacagacucagagaccagagugaugcauguacaagccaggcucugcgggcagccccuagaagcuggaagaggcaagccuccucccuggaguccugggaaggagccagccccgcccaugccucgagcucaggcuucaggccuccggagccaagagagauaaaccucugugguuucaugucacccaguuuguggucuuuguuauagcagccccaggacacucaggggguugccuuguccacccccauccuggcccucugagggacugguuggcucuuagaagaccguucaaccugcccucugguccuccucccccacccagagaccccuggcuacacccugcccaagggagcucaccaaagcccacagggucccugugaucuugucaccugggcucccacaggccagcaguguuggaaccuggacaucuggcuccagccuugguggccacccccgaccuugcucugcuccuacagcucccggccuucccugcccuggccggcccuugcugaauguccccgcuccuaggaagccggaugugucgcgugcaggugccucucugcacuguaauaacuccucaccaggcacccuuggagcccaggaucaagucacucaccuuccaacccugccccugcccagagacuggcacgagaaccaguaacaguuguugaauaaugaacaauggaugcaugcagcucacccgugagagggcguugcucggcugggccagggaugaagcuucucccgcguggcuccaccgucuaucccucaagcuccugaugcuccccugggcaccucugcgccaugaggccccguugaagucaguuggggaggcaguguggaccgugagaagggaguccuaagcacaggaaacgcugccuuccuggggcccuaaagaacaggcucaccuuccccaagggccuucaggcccugacaucuaaaaagauguucuuuaucaaaggggaaagcagcccuggggugggggcguggccaccagugcagugggcguggccacaaccgagagggcguggucauucgugcagugggcguggucaucaagaaagggcguggcugcagccggaagggcguggcuaucagcuccagaaggcccuucuugcuguccuuggacuuggguucuccuugucgacgaggaucucagcuggagcugccaggggcagggcuggcaccaaagcacuucugaagucuccccgccucccaagugugaggcuguggggaaggagggagggcagcuggcuuguuucuggaugagcccaucugacucagcagcugggacccagcaggagcgcagagcagguccugaaggugccgaggccccacccgcagcuccgucucagcuuugugagggcugcacucccccgugugcauccggcgucacaaaggaccacaggcccggcggccuccacagcagacaccaaggcccucgcggucugaaggccgaauucccaggucaggcugcagcagggcugguuccugaggccucuccugggcuggcaccuccuccccguguccaugcagggccgagccucugcaugucuguguccucggcgccucguuuuacaaggacaucucauuuuaaaggcccggucuccaaauaaggucauaucgugaagugcuggggucagaacuacagcaugaauuuugacgggacacaguucaguccauagcacccgcuuugggaagugggaaugaccucucccuuccccaucuucuggccuuuguaacccuaaugugggaaagcaggagggauccagaacgacauugggucaccaaagagagcaucgcagcccaaaagguugaaaggcggcaccaaggucccgcgccuggugaccgccgacucgcccucccgggcuccaggcuguccccacucccccccgccccaaccccagcauguugaggcgccuggucccaacugcccauucacucccuguacacagacugcuucuuuguccuccagccaggggugaagggccaugcuggcgaaacagcaaacaaccccaacaugcuuugcagccuggccaaccacaugaccaguuugaggagguuggcuggagaucacaaugaggaaguuggaugaggggguccaacuucuagcagcccauaagccuauccauucagacaccaaauccauggaaaacagagagacaauauacugauuuucaaaagggagacauaccccagcaaguacagaccagggaacagggugcugacguggccacaguucuuaaacuacucgacuucauggauggggcacaguuuuuuuuaaaggaggauuuagaauucuauuuggcagguggcaugaaaaagaguuuugaauagaaacacaccccucccucccaguugccugcccaguauguuuguuuuguucucuugaaacaaaggaagagaguggugaggagggagggaagaugaaccaggaagaaugaaagcacuuggccugcuucucagauggucuuggacugucuccgcucacaggaguugcagguuuuuggguuuuaugcaaguucggaucacaacaggccucuugcaagaaccaggcauuaccuuuauuccaaaagccuugcugggccuucuugaaaggacuggcagccaccacuucccuagaaacccguggcaaguucccuccucccgacccccugcuguuugguccaggacccccugcaguccugacugggacccacuuggcccuucucaagggacccagcacaggacguguguuucugcuuugaugaaccgcccuuuccccccugcaguucuaguggaaucuccccucccuuaucccauucccacuuggaaaugaugaugauggaaugggcgaugccggcuuaccaagacauccaagcucucugggucgaaguuggagagaggggugcacaaaaaggauuccacuccugucugccuuccccugccuccccgcuggggugucccuuucccaugguuuccucuaaaucuuuucacccauguccagccacaccauucucacauacugccuugaaacugggcucgaaggggcugcgugcugagagaagguccucucccccagugauccuccagaggggcugccgccugggucccccgagcaccuccuaccccacccuccccauuccugccauccccaggguccagggagcccagauuccagggaaggguugcauuagcucccacucggaguccugaugcagcagagacagacagaggcccugggagaagugagcaugaauuauuaagacaagacaagggugaggccccagagaggggguggcggaagggucauguucaugcagcgagaguugcuucgagcuugaaccgcguauccaggagucaagcagauugcaacuggcgagaggccuucagaaaugccccgugagaguccugugugcagagcuccaucucagcacacuuccuguucuuuugguucgucgauuuuugcauuuucaguccccugugauccauuauuuauaacaguggagauuggccucagacacuagcagugaggaaaacaaaagcgaagcuacgcagaaaaaugacaagagugaugagcacagcagucaugacaaaugagcccugugcggaggcccgggauccgcgcagaugccggcgcgggggaaaugggcccugaaaucccaccgucaggccaggcagcucugagcgugaccuggagggcuguucagacggucuggguagccguguccugcgcaugaacauccuccgucgggagaggaauuccccacggauuaucagagcugcucccuccaccccccgccacgucccacgcgggccacaucaacucccucugcagccucuggccagcggcugagcccuccgugucuccccucguuaaugccuccuucaccauccccuccugaaguuucccccauugcauacacgcgcugaggcccacccgguaucaaggacucccauugcuugcgaaaaagauuccaccccucuuagaacagagaccagggccgcuguagcaaauggccauaaaugccacagcuuaaaacaacagaaacggauuaucucgcagcucuggaggauggaguccaaaaucugaaucgcugggcugaaauccaggugugggcagggccgcgcucccucuagaggcucccccggagauucccuuccuugccucuuccagcugcugguggcugccagcaguuugggaauugcggccgcaucacaccaccuuucuguuuguuguugacauccccgccuccccugccugcggggucuuagaugucucucuccuucccacugaguuucacuccacauuugaauuggauuaacucaugccauguuaggcaaacgugccccucaaauccuuccacuuaacagacauuuauugaagguuccugugugcggggcccaagagaagggacauuaaauuaggagaugaaccuugggaggccauggcaugcuucggagccucggcgucaaaaugacaacccacaccccacuuggcgguucaucuggggcccuggaaucagcagacugaggcuggaacccagcaauggcacaugcuggcuguauguucucgggccucaguuucaacaucagugacauggggauagaaucugcccagcggaguuaagucaccgcaucccggagagccgagugucucauagaggcuccugguguggucuccaugcugcugcucagcacggaaugaagagguucaggaacuugcccacagccacggauaaugagggacagagcuggaauugagcccgggaaccugcacacacagcccagugugaccgugccuucuagagagaggccagcccuggcaccaggugggcaugccagcaucaccuucaaggugugcuuuaaggauccaagauaaugugggugcuucaacagaugcauggcaauaaaaggaaagcaccauguuucaccuucacacacacacacuuacacauucacacacucacauacuuacacacauucucauacacucacacauaugcuuacacacauucacaggcucacacaugcuuacacacacauucacacgcacacacauucacacgcacacauacacuuacacacauucacacacauacacuuacauucacacacauacacuuacauucacacucauacacauacauacauucacacacauauucacacauucacacauacacauucacacacauacacuuagacaccacacucacauucacacacauucacauacauuuacacacacauccacacacacauucacacacauucacauuuacauucacaaacauucacacauacauucacacgcacuuacagucacacauacacuuauacacagucacacagacuugcacauagacuuacacacauacacuuacacacgcacucacaccuucacacacacaggcaaucacacauucacacucacguacacuuacccacacauucacacauacacacaccacauacacgcauacacuuacacaugcacucacacacuaucacauucacacacacauacacuuacaaacuaucauucacacacauacacacauacacaugcauucacacacaugcucacacacucacacauacacuuacacucacagucacauacacccacauucacacacauacacucacauucacacgcacauacacucugacacacauauacauacauucacucacacauacauucacacacacacggaugcauuaguuuucaagucaggauccuagcacagcccacacccugcauuugcuuggugucuccugaggucucuaguuauacuucccaucccuuuucuugccauguauuuccugaacacauguuaucuuugauccuuaaaccaugacuuagagauacagauguaugacaagcugagagaugaugugagacuguuguuaauuuuuucuccauguacuaauuacauugugguuaucuuaaccacaaaggaagcguucuacuccagagaaccgcguggaaacagugcagauggacuagcacgauaccugagaggagcuuuaggauaacuccggugcuggggagguuggggcccaguucaagcaggaggggaggcguggggacagguguugaagcugugggugugcagcggaggcuucaugacgcuuuccuccugcucuuguguacgucugagcauuuccauaacagggaaguguuuuguuuuguuuuuuaaauaacauuuuaaaugccucuggcacaugggaauccaugguaauuucugucguuguuguauauucuuuuucaaaugcaaggaccugaaaaauaucuccuaaacuggaaaaggaaaugaggcugaauacagauuuuauuuuagcaaauagagaagcagugauugucuggcgguuaacuguaauccauucugagugugacuuuacuguuaaguauucuaaaaacaagagaccaaacaaaaugaacaauauguccaaauguguauauauauaauuuguaacuagagguaaauugcagaugaauugcagauguacacagacagauggauggacagaugauugauauagauugauugacagaugauucauagauaacuugcaauguuucuucagugaacgcauauuuauuucuuggguaauaagaaaaaacaauagaauguggaauuuggggcuuggccucuuuuagcucauuuaaaaaaauauuaaacacuuggaauuaucgagcgcugaaaaaggcaauagaaaauucaccuuuuaacucccucaaagauagaaaugugugaaucugcuaguggguugcguuuggcugguccugcaggcugauuuggucuguucucucucccagagagauccccaagcccggcugagaugugccuguuugucuugagggcagacaaagccuagcaaaaucuuauggaagcugauauaaaagcuuaauagcuuauaaaagcucuaaaaaugauucacagucuaggauagagaaaauaaaaggaauuugaauugguuuauuuuccuuuagaggagccuaaaucaauauuuauucugaguaugcaaucagaaauaucaguaauuugagaacaaggcaaacagagcugcacaucccguuauggccacgagcccaccucgccuucguucagaccacagcugaaggucugacuuaggugcagcacgcaccccuggagcugagggccuggagcagggccaggccgggcucuucucucucuugucuguccucgucugugggggaaugaagaugacacagcacucaggagguccuuuucaggacccagagucacugggcuuuuagggcguuuggcucugguucuagcccgaguguggucucaguccccauuggugguugugguuguggcaugggcaucauuagucacacaacauaaaaccacagaacgcagaauuugcucacccugguucacacaggagcaagcuugggcaccagcacccccugaacgcaugccaaagggcagguccagcucagugcugggguguggaggaacccaccuggggccugccugcaaagacagaugcccugccguguuuagaaaaagagaaaacuggccuaaaccacagugaggucaaauggaucauuuaacccgucgaguuugguuucuuguucauccgacgcgguugaucuuauuaacgcauauguguuuguguugauguggccuccagcuucugucgcacuguggacacaguuggauguggcugcuaaucaaugcggggcuccguaggucagugagagcaaucagagccugcugugcgguggcauccccgaguuaagacaggcuuuugucccauacucuauugaaacacccagaaaugcugacauguugaaguuaaggccaugugccuuggugcuacuugcuugcgaaacagccuuugaaggaaaaaggaggaggaggauccaugaguuucaaggguccccuccuguaaucacggcugccacucaacggaguaaguaauguguagcgggcccucuaucugcaugacgaauccuccuaacauuccugugggcgagguaggauuugucucgcuuugcagccgaagaaucagagccucagaaaaguuaagaaaucuucccugggucaagcugguaggaggagggacuggaacugaacucacaucuccaccuccucucuuccuacuccucugccuuucuugcaccuagagcaguguacaacaucaacaacugaccagggcgauccuagagguaagagacagccgaauggcacggacccagccaagcccaggccugcccagguggaacagagccagcuaggagcauucgguagcagaggucaguccgcugauugacuguucucacuuccaggcccacagccuccuccacccugauggucuaugagucuagugcggcccuuugcacaauuuuagcaacugaacccuuuuccucacagaauugugauaccguccuaacauaugaagcauauauaaacaguugggcaaaucauaauaguuuccauuauuucauaaauuugcauuuguggcaccaaggagagaauuaaugggaacaagaggguucuugugugaguuccgcauuuggauuuggggguucgagguggcagcuauaggcucacauuagugucugcaucacuuugcuucaguuugucacgguggccccccaaauccagaaccgcccuccucgcugugugaggaggguccugccugcaccgcuuugcagacaugggccagccuggaugccugggcgacgcugcccugcgacucgcuggccugcaggacaucugcaaaacauucaggucucacggcaguggccaugaacggccucacagacacugaguggaccugaccccaaagagaaugcgucguccuugaacgugucgauauuuagguuauuacacaaugaguguguugcuuugcaauuagugucugaaagaguuagagcagauguacauauagaaacgaagaaacgaaaucugaauccaugcugacagauucccccuccccaaaccuugcucaagguaacacaggcgaccaggagcaagucccggccggcccccugcuagcguggucugaguggcccaagcaggaccccugcccaggcucacuggacucuccuggagcccccagacacgacacccuuccucaucacugaaaauccacuuccacaguguaggagaugcauggaucugagggccaguaggaagugcuggagcuuuaggcuuuagacauucuuuuuuuuuuuuuuuuugagacagggucuccauuuguggcccaggcugggguacaguggcgugagaaauucuuuaacacucugccgaguccuggcccuuggggagugaggccuggcuaugaggcuucuugucagaacuccgugugacucucaggauggaagaacagggugggggcugcuccuccccucccucccuccagccccuggccuuuguaaaacggcuccgccuacgcgccuguagccagugcagaaccagggaggccucuccccuucccuucccaggaggggccccgccuuguccuccaugccggauucuguucguccucccccagguccucucugcugccucccacugccccauuuccuccaggaaccuuccucucuccuaccaccagccucucuccuacccccagacacacacucuuuacaugccgauuucuguccucugguuaacuggcguuuaauuuucucagcugcuuggcuuaaugccaaagaguguucuuccaaauaaaaaugguaaagaccuuuuuucucccaugagaauuuuauguaaacgcagugcagcaugcucguaggcugguucuguuaucaauuucuaagcucagcuuccagagcuagagaacuuuuuuauugguuauaaaaacccuacauauucagugcagaaauucugaaaaaugcagaacaguaucagggagaaaauaacucaucccccacuacccagagaaaaccgcuguuaacaccgaagugccacaguugcuggcguucucacacaggugugcguuuaggaguguguaagugcguguaagugugugucuggcuuucuuucacauaauuuuguguccugaucauuuucacucagcauuacaucagcagcgguuuccaauauagcauuaaauugucuucaaaaacaugauuuuaaugccucuauaaaguuccaucauggaggcucacuaaaauguaaucacuucauuguuuaugagauacucagcuuaauuccauuucucugcagugaauaauccagaggaacacgcucagugugcaucuuugcuugcagcagggcagcgcagggcauugguugggguauaaauccgggggugcaguggagauuagauuagaucguccguggaaagcaccagaauggugccuggcacuuaauaaaugcucuuauuaguauguuuaucuucauuaugucccuaagagccauuccuggaaaugagacugugagucaaagggcacaaauaccgccaaccugcuuuccgacagcgcuguguggauacacgggcccgaacggcgccagccucacugccucugcguuagugccgccacuucaucucagauacucuccugaagauaagaggagagucccaugcagccauaagaaagacaacggagagaucuguguacccuccacccagucuccccuacugggacugucgugcaaaauuauggcccagucuuacaaccaggguauugacagcgagacaagcccccaucugauccagauucuccaguuguacuugcugaugucguuuagauauuuguccccgccaaaucucauguugaauugguauccucaguguuggaguggggccuggugggaggugacuggaucgugggguggguuucucacaaaugguuuagugccauccccuuggugcuauccuugagauagugaauucuugcaagaucugguuguuuaugugugaagguagaaggcaucuccucucucucccucacgggugugcacgccucccuucaucaugugauaugccugcuccuguuucaccuuccauccugagugaaagcucccugaggccuccccagaagcccagugaugucggugccaugcuuauacagccugcagaacugugagccaauuagaaauuggcuuuauaaaugacccagucucagauauuucuuuauagcaaugcaagaacagccucaugcacuuguacucacuugagcaugugcacuuacuucugcacgauguucuugccuguguagacucuuacauccacaaccacagucacagucuagaacauuccaucgccgcaaggcugccucuuauaaccaaccacauccccuaccugcacccauuuccaacaccccaugccuaacucgauuuccagcaccccguccuggugaacaugaaucuguucucuaucucuucaauuccgucauuucaagaauauuauauaaaugggauuacacaguauguaaccucuugagacuggcuuuuuccaacuggcaucauucccuugagauccauccaagugguugugugcaccuuuuccuugcugagccguguuccauguugugggccgaccccaguuuagcacucgcccauuggaggguuggagggcauccgacucaucucuaguguggggcagugcgucaccuucucacaauugucaacgggauugucacuaguauuugccuuccaugucuuggaggccaauguggcugcucuuagaaaucaguccuccuuauuuugguuggggagauuucugaugucaguuugacguuuauaauuaauaagcaucaucaucaaguuacaagaguaaauaaaaauaugaggcagggugaaauguaagaugcucgagaggcugagaucaguagcugugugaauacagcagggcgggcaccagcagugagcuccacggggcccagcguccggccucauuaaccagcugcccuuggggaggagcagagcccgcucuucccuccuggggaaggguagugugauggaaagacaggcugcccuucucuccugcaggagcucagcaucaugcuguguacaugccugggcucucuucuucagcccuagccacuuaaaaccacuuggagggaaagauuguagaauaauuauaaugaggaaaauuucgcuccagauucguuacuccaaguucagagaagcucuguaaaaauuguugcuaaggcaauugaauaaagaaugucagccgauguaagcgauaacagcaagacaaugaacauaauugcauguuuuacaacaaccaaccucaaagcaugacuucccugacauagauauguuuuuuaaugauuuugaaagguaacacagacauuuucagggauuuggagaggaaacuaaugccauccugguuuaccagcuuuauggggucaucucuccggugaaaaagacugcagccagccuugcagagagggcgcugucuuagggaggcaccuccaacuguccccgcgacccagccccuaagugcuucacaucaacacuguucuuuugugacggugcugcugucuuucauucgccagccugucaugcucaacucaaaccucaguugccauccaguuaucuuuuuuuuuuuucuugagauggagucuugcucuguugcccaggcuggaaugcaguggcacaaucuuggcucaccgcagucuccacaucccggguucaagugauucuccugccucggccuccugaggagcugggacuacaggcacaugcccccacgcccagcuaauuuuuguauuuuuaguagagaugggauuucgccacacuggccaggcugggcucaaacuccuaaccuugggugauccacccaccucagucucccaaagagcuaggaucacaggcgugagccacugagcccagccuaguuaucuuguuuguccaggaauuggagcauuucuagguagcaccacaaaugucugugcaagaaacccacaauuuccaguggucauuggcuuugugccaauccaaacuagagucugacaaacccagcaagaaauauucgcggcagcugcaaggaagcuccucaaauagaaauagaaaaaugaaccagggucugcucuucccuuccggguguggaaucaacggaagccgacucaacacagagcccugggggcgugagggguuuggcgggaucucugccggcugcagaucucugcucuguuauuaccagcccuucugcccagcuccuaauugcucugaagagggaauaauuuucucagcagccauugccagccacauuuggacugaauagaugcugaaauggcaaggguaaauggggcagagacagugaaaagccauuuucuaucuggagcccaaauaaaaucuuccucccacacuccugccuggcuccuccgcagccucaaugcccuucugagagcugccugccccaguaggaggccaggcugggaccaaggacacccaguucuggguaaccaucuucccauggcuccuuggacaaccaccuuaaagaagggaaaggcaagaagcagaaggaaagcagaggcuggacauuggaaucagccuuucuuuaaacuaaaaaaaaguuuucacauaugugaaugcgugugugaauuugaagucguauguggaaggggccauauauccgucaaugcaugcuccaaaaaucagaacugauggacggcaaacagcaucggaugugcagccagcauucuuccggcggccaccucccgggggaaauaggugcagcagacaggaccgucugugggacggggacaggcaagcaugacagcagguaccacagaucagggugcacagacagggcugggggaggcagcguggcacggcacccacuuccccucggcgugucugggcugaagcccaguggacucccgcugaucagaaggauccuccacuagaaggaucucacuggacgaguccccuccaaacuggaacaugcaggugccuugggcuucaugcugcaccuuucagauaaaaacacacaggugagcugggagagcuggagucccauggaccccagagauccaggucacgaggaggggaucgcgcugcaccaggacacauucaccaaggugagcccugguuccuccccacaggcugugggcaaggaagugucgaugccaggcuggcucaguagguggaagaaccuuccggaaugccugcccgcaggcugcugcuggcaucgagucuguguccuauuuuccauucacugcaugcauccuccaaguaugauuuccacucggaacccugagcugccucaucccucgcuccgucuccccucccucccgcccagcucacacugaaaucacgccucgcguucagcggcuggaguccugguggauugcugcuucggggcucucagaaaucccuuuacuugagucuugguuuuacaggaagaccaugaagcaccccccaggagcuggagcuccuccuucuggacccagugucucuucucagccucacgacgaggagaccugcucauggagcugcugcgccggccugagcucugaucccuccuccgacccagccucacccugcaagcagcaccauguggggcucagaauggggaucuuaagggacccuucccacaaccucccgauaagccuuuccacggagggcccaagcggagacaggagaacacuguauuugauaaaauagagucaaauccaggaaaaugccucuggacccggaaaggaaacgacucaccccccacccaugagagacccuucuguccugucccuuaacccagaggcccugggcauggguuucgcagcccccuggaggccagacccucaaacuccagccuuguuucuucuaagugugccagucaagaugcuucucacugcaagaaacagacucuuucucaagccaguucaagaagaucugcguugcugcagaggccgauggguguggggagcaggcucagugagagacugucguaaggaggcugagaggucuucagaaaaauccccaggaccuggggugccaggagccugggcgggccugggcucucgcagccugcagccccuccccucccucucacagccuccgcugcccccgggcucagggccccugccugugccuucuccugaggcuucuccuuuuuaccucucagggucccaguguggccagcccggcacuaaacccaugcgacccuggcucacugacagucgccaccagcuccacaucucucaguaaaaguucccccaaaagagugugauugggagcuagccagcggggcuuaaggcagcccccugcuccaguccccuuggccauggagacagggcaggguuagcaggaggcaaggcaugcgcaggacagcuggccggcagaggucccgugugcugucaugggugcaggguggacacugugacccugggucccccacuuggaaggggugaucuagagggacuuuugucagaaagacccccacccagccaaucugacugauggggccaucaccuugacaacaggcuugguggcaaagcaagaggguacaaccgaccagagccccggguccccugugcccuccugcacugccugacagggcugggccauggcccguaccaaccgugagcugagccaggaauccagucaaaccgugugccugagugacacguagcucucuuccuucucuggauucacugcugaucaaccccaacaagcagcaggacugucuugcugugaacccaccgcuugcggaccccuccccaggccuccauucccgccuuucugaaggucaaggcagcgcccuccccaagaaacggugggaacagaggagccagguguucguucuucccagcuccggaaacgcugcagauugcgcacucgaguuccugcugacauaacaguggcugccagacaaaauguggcgaaaaguuuuucuaggugccuuuguucacucagagacuuccuagagacuugugugaaaaucacaggauuugcaaccaguggggacguugagauucguggcaacugaaaugauacaaacuugaacuuugugucaaaccaguaguguuuuguguaauucuuuucaaaccugucauuucacuuacugcuucucacagccccaaggggcagguggaguugaugccaucaacccuauuuacagaaugguaaacugaggcucccacugguuaugcgcuugcccacaggguugaaagagaagccauggacaaaaggagucacugguuacccaaagggcuuccuguucucaaauccacugcuccuuccauuacguggugucuagaaggaggcucuuuuggauauagacauuaaauaaucugggagucaguguaugcugugaucaagcaugugcgguccgcagccgauggcccaggaugcaguccugauguacacuucuggcugggugcgugggagccacacacaucucugugugccuugguuuccguguguaaacaucuuagacuagugcuugccugugguuggcaccugguaagugucagccuucucuaauguaggcagcuugagggcucccagacagugauguucccgcugacauucccaggucucagcugauuaugaagaggcaucaauuuccagugggggagccgcccucugucucaucauuuguuucucucaucuugcuuuaauaucacagcacugccagucaaaccacacaaaaggguuugugaugaccugccgugcauucucguaagcuccagcccugacucgccugcaagccagaagccaacauaaaacuuucguuuuucccuuaaucuugcugccucugcaucucauuuucaaauuucauuuuaucaacuuuuuuugcacuauuuguuucuggauaaaggauuugcaaaauucuucagcauguggucaggaagcccuauggccuccugacgaggcagccuagggguccucccguggucugaagcugcagccgggcuggccucccacagucaggagcagcaucaggcugggugcuucugacaccagcgaagagcgcggcuguccaagcccccaucccuagggcucacgccucaugcccaaacucgcacccacuuuggcgccgcuggagacuaaugaacagcaaaagcugaagucaugacucucauccagaucuaaaaugaccgugugucaaacauuuuuacugaacugaugaaucgaaugggaacugguaagaagguacgaccaguucaaaagagaaauccaagaacccuaaauguauaaggagugaagcaauguugaaauggacuuacaaacggaugcagcuauauucuccaguggagacagccagugccaacuuuugugcuuauuccaaauuuccugacagccuccccaccuuuuuuccaacauaaucucaaagagagauuauucuggauggcagaauaaggcuggucccccuagguguggcauccuugcuugcauagagguggcaagagugccaccauaccaaacaggccuuuuucaguuuguuuugcuggaagaccucagaagauaucagaagcaaaagccucuguuguuugcuauccuaagguuaggaagccaagcauaaaaagcucuccuccagauuucaccggcaguacuuauaaauuugaugaaccccucucuucucaaggcccccacgauauuccaaaacccuggccugccagaguagagccuuuuuucccaucuuggaggcugugacccugagagccccuacccucccccaggggacuuugugggcauggacguugcacagucacccucggccccucaagagcggucacagcccagcaaaugagcgucguucucacgcacgucucucaggcuuaggcucgguugcauaaaccuuccccaauuuuauccuggcaaggaggaggacagauccuuccggaaccuuugcagauauugccaccaaaaguaaagccuucauaaaaguuugcauuuggggaggaaggagagcagauggugaaaaucagauaucacuuaagaauuacucauuucaguuuacaaaaaaucuaggucguuaaaggugacugauagcuuaagaagacagggaaagggcuucauaacagagccggaaaguccaacaguacaacgacacgcaugaugccaaaaaguaaagcguuccucacucauuccacucagugcuccguaacugauucuccacuggcuccugggcugcagccucaugaagccagcuguuccucaacugaaaagagcccuggaagcccugggcagcccacuggcagggucugaauaucaucugagcgaggccaucagaagcuguccccaggagucugugcuugggggucagucaucggaggugcuuacugcgguccuuuuccauggggcucgaagcuucugcauugaaucacgagcucuggccuccagccuggugcagaaccuuccagggggcauuggaguaaaagcuucuguagaugacagcuaccccuuuuuugguccauuuuauagcagaggaaauuuagguucaaagaaguugaguugagagucccaggaguaagaagcagucaaggauccccccaggccuccggggccgccugggcugccuggccucacgaccuggccccaugcuccugagauggagaagccccaggcccaugagccuguugcccuuggcaaagccacuucccuucugaguaaagucagacgagccugcccagucccaagagacugcgauuccguaaucgcccuccccucgccuuuugaggucuugcugguaggugcacccccuucaagccagcccaaggagccaugauuugagucggucuugccagaugugucuggagagaauuuaacuccaagaucaucccccgugcacucugaggggcugggacaggauguggugcccuuugugcccaggaggagaagcacccaguggggcgggguggggcgaggacuuuauaaaggcgucauuugcugcggccacccagguuggaacacagggaccacagggccccccgccuucugcaggaccaccccgcucaucugagggagacacuguagaaacacaucuuugagcaguggcuucuaauccaagaaacccaauagaagucaaacgcagauuccuagggcccaacccggacccacugcgugggaaucccucagccggggccagaagcacgcuuugaagacaccaaccuccucagcaagccucuugcaaaccacauccugcuucuccagaagcugcagauccagaauguucaaagaaagagcccuccuugccuuccucuucuuccaccccugcccucugcagacugggguucuguagacccccaaaguaaguccgccacaccggaaggaagugaguuacacaggggcccacaugggaaccgcuuuuuguccugucuuggugggaaaauggccacgaccccagcccaggcucugccacgccacaacuccacgggcauagccugggaggccgcagcgugaacugugacuagggcugaggauggugccaugguagaagugagggccuggcacccggccaagugcaggacuccucggcagugggguugggagaagcagccucugcaggcgaggccaggaaccaggacacaggaggagaagcacaucucagaggagggagcucugggaggagccagcagaguccugcaaaggaggaugugggggaaauggggugaggccaaagugggggcugcugaaggggcuacugcacccgugcgagcagggccaggaccaagcugcauaggcagccagggacacagccgaugccacagacgucaggaaccacgcaaugacacaggccaccuuugaccgaccguuaccccuggggcaaauaccaguggggauaacgggcaaggagaggugcuguuuacugucuuauuguugccaguucagcagcccacaggaaaugguguuagucacagaaaaaaaaaaucuguuuucuauauuucacuguuuccaaguaaagaaaaaagaaaacuaaucuuagcuuaaaaaaaaaaaaaauggugcgcugggcaccgaaaaauaaccaucuuccuaggccugcguuucccccacaccggggacuugugcuggaaagaaaagcugcguuggcagccaggagccggggaaacuguccagggaggcauccucugcgaugaaggcggggccucggcguggcccguuccgcgcucuguccagcccuggagaagccccacccucaccgagcucgaaauacccccucccugagagccgagacucauggccgggaccccuuggacagaagaugcggaugcuaacccggcgcuuccaccacagccccggcggcacuggggagcgagcgcggccaucccgcgcguaggugguguuucucugcaggcgccaguuucaccgcgggcgcccaggauccucaacgguucuguugugaugugauuccccucuucgacuucgucauucagccucagucccucaguccccaaauaccgaaaggcagucuuuuuuuuuuuuuuuugagacggaguuucacucuuguugcccaggcuggagugcaauggugcgaucucgguucacugcaaccuccgucucccuggcucaagcgauucucccggcucagccucccgaguagcugggauuacaggcaccugccaccacgcccggcuaauuuuuuguauuuuuaguagagacgggguuucaccauguuggccaggauggucuggaacuccugaucucaggugauccacccgccucugccucccaaagugcugggauuacaggcgugagccaccgcgcccggccuuuuuuucuuuuuucuuuugaaguuaaugaacuugaauuuuauuuuauuuacagaauagcccccaugagauacuugaagacccggugccaagcgacaguguugaccccagguggucaguccugccuggccccuuccgagggaugcgccuucaccauaaccaugucacggacaggcgugugggcaagggggcaucgcuguauuuuucacaacucuuuccacugaacacgacaaugacauuuuucaccacccguaugcaucaaccaaaugaaaagaugagccugugacauucccgugcguagaguuacagcuuuucuuuucaaaacgaaccuucaguuuggagccgaagcggaagcacguggcgucugacgucuccagggagacccgccgcccucgcugccgccucaccgcgcuucuguuuugcagguaaucuucagcaaguacugcaacuccagcgacaucauggaccuguucugcaucgccaccggccugccucggugagugcgcgcugcgggcucugcccggugacgccacgcggccuccucgccuuuucgggauggcugggaggggcgggaagaggcgcugaagggcccgaggcaccggccuucuacaaggggcucuucgaaaucaaucaaugcgcagaaucccgagggaggcucagccgcccuccgggccucucugccuccacaggugauggcuguguccacaaggaggaaaccgucgggcugaauuaaacagaaccgcccuccuaagaguguggguuuuucugccgggcguggugucucacaccuguaaucccaacacuuugagaggccgaggugggcagaucaccugaggucaggaguucgagaccagccuggccaacauggugaaaucuugucucuacuaaaaauacaaaaauuagccgggcgugguggcgagcaccugucaucccagcugcuugggaggcugaggcaggagaauggcuugaacccuggaggcagagguuguagugagcugagaucaugccauugcacuccagccugggcaacagagcgagacuccgccucaaaauaaauaaauaaauaaaaaagaguguggguuuuuuccucucacuucuucauucacuuuuggagaaagcggggugguuguguguguuugguccccagccccacaucaccccauaggugccuuuucuacccagggggcuugacccagaucaacacugggugaaaggcugacuucagaaauggguugaaaagaccagugaucugccuuaucgaguccucagagucccacaggaguuaauguccuaaaucaacaguguguucgagccagugaauuuucuaauuaucagcaaacuuuccaaauguaaagggugagcaggaguagcuuuggcucaaggauuaacuuuaaaguuaggacggagguggagaagggcaauugaaguuucucacagacaggugagaaaagggagaugaaaguacacgucugaaagugcagcaaauggcaguuuuagccgcaaaaauagcccauggucuggggcaucuuugggcaccauauaugaagcaaugugccaauaaauaaauauauauacacaguauuccguauagcagcccugggauuugaguaucaccucuauuucacagauuuuaacaauuuacaacugaagaucagagauuaacuuggucgagguaacacaucuugcaagaggccccaaaacaugugagguuggaggaagacucauccuaagcauuuaaaacuauuuuguaggagagacuugcgcaguucagacggacucccaaaggcacuggaagcggaaagacaaacuaugaguucgucaucugcugauauaaauguuaguuccuauuuuaccacaguuuuuuaaaaaaaaucucccaacucaauaaaguagacuugcuccaauucccauuuuaaaguauuucagcaucuacacgcacuuaggauuauacgcagcuguuuaauuucauuuacaaucggagucucaaugcccuggggacggccucccacccuucccaucccaccacaccuuggucaggcugguccugggacuguccugguugucucagggcucuggccccauguguacauucaaguguacaucccagagcacacuaugggcgaaaacacgggcuuggguguguuuuccaggaacacgaccaucucccugcugaccaccgacgacgccauggucuccaucgaccccaccaugcccgcgaauucagaacgguaagaggcuccggccgcgcuccucggggugugccuggcacuucucuccaugacaugggaggcuuucugugauuuuguaaaugugcuacugcagaaaggugugaauugacagcagagauggagagcgaggguaggagccagugugaaggaagcuugacucgucguguuccccugcagaggagcugggcacguuccaagauaacaauugcagccguggcucugcaccugcuucucaacgggaggaggcauuguacagaggggaaacugaggcccaggagggugagccaagagcugcagagccaggccccgggauccccacauuaaccccaggaaggaccucgggagauucccuacagagccccuggggacauuucguguuuacccacuuagggccggucucuguguucauaaagugaugccugugggagauucuaagcacagaagggccagggacaagggaggcccaggaagucaagaggagaggccggugaaagccuccgugaaugucugugaacuaggucaagccagcgguguauggcccaggaaggacgcggagcaggggcccucaggucagugaccugccccuguuccuggugaccuggggagaccccagcagccuccacugcucuuugugguugggcaaaguggaacuuagauuuccucaugaggcgagggagcaggugagcugggggcggggcgugcgaccucaggaccccucucuggcguccucuguuccucccagaguggggcucacugugccuccaagggacucaguagaugcgaugguacacuugucaaucuggucaucaggguguccugcccaacugacccauggccagcucugagcccacaggagaaagugcaugucaggcagacccuugugucagugaggucccagugggcguggccagcaccgucccccucagugaggccccccaguggacguggccagugcugccucccucagugaggucucaguggacauggccagagccgucccccucagugagcgcucaguagacauggccagugccguccucagcgagguccccguggguguggccagcgccaucccccucagcgagguccucguggguguggccagcaccaucccacucagcgaggucccaguggacauggccagcgccgccccccucagugaggcuucagugggcauggccagugccgucccccucagcgaggucccaguggacguguccagagcuguccuggucagccguccucccugucaccuugaggccucagccgagcuccucucaucuggcugugcccgucagucuccccuccugcccuagccaggaugcccgucuccugccccacacagucuggcucugacucuuggcuuccagacuccccggaaggugcagugcuaauuggcuccccagagacuccaguaagcaucuugucagccucagcaccagcuccagccuggggggucucgcucagaagcaaagucacugagugaccuguccuccugacacccacaagacuaaaaugaucucucagaggggaccucacagaaaccagcaccuuguccaugccagcuggguaucugagagaaacugcuuuguuuuccugaagucauuugaaacagcgugcagagacauuuaaacucggcgggaaauaggagaagcccaccuugacccuucuaauucucuggccccaggugccuuauuaacaagagacaguaucagacacaccagacaaaagcccuccugagcccaaagagcccaaaugucuggaagcucucugcugagaugccaaaaugcaugccuuucugauaaagagacagagacagaugagguaccaugauauggacauggcaguggacguggacaggggagcaguggagauggagaagauggagacacacgcaguugaggauacaggcgaagaagauggagacacacgcggaugaggauacaggcgaagaagauggagacacacgcggaugaggauacaggugaagaagauggagacacacgcggaugaggauacaggugaagaagguggagacagacgcggaugaggauacagauggagaagauggagguagacgcgggugaggauacagguggagaagauggagguagacgcgggugaggauacagguggagaagauggagguagacgcggaugaggauacagguggagaagauggagguagacgcggaugaggacacagguggagaagauggagguagacgcggaugaggauacagguggagaagaugggguuagacgcggaugaggacacagguggagaagaggaaguuagacgcggaugaggauauagauagaugcauaggguguggaucuaaccggguacaggugaugcggaaacggaucuagacagcgauguggaaauggaucuagacagcgauguggaugugaucuagauaauguggcucuggacguagaaagagcuucagaugcucuaucuaugaucguggguguggauauaggcauagacauggugaagaggagagaauagacucuccucucucaugacaaacugaucguggcugggggcggcacgugcugagauguggcuguauuugucccccaggcuggugccugcgccuccugcacccccgucuccuuugugccuucuuccauucccucugccacuguuagguccaggccucacugagcucugaccucccugccuccagccugccucucccacacggcugccagguucaaccugguaagacaccuucuucuccaugguggccucccaaucugggcccugccaacuuaugccucaccaacuucuccaacuuaccccuguacccacgcccgcaccaugcccagcccacaggauccugccuucccagcucugcagaaccagcuucugcuuauccgcuaggugccagcccagccaccugccuuaagcaccauccacagucacccagcccaucaccaucacuagcaaagucacccagacccaucaccaucaccauccagagucacccagcccuucacuaucaccauccaaagucaccagccccaucaccaucacuauccagagucaccagccccaucaccaucaccauucaaagucacccaccccgauaccaucaccauccaaagucacccagaccuaucaccaucaucauccagagucaccagccccuucaccaucaccauccaaagucaccagccccuuuaccaucaccauccagagucacccagucccaucgccaucaccauccagauucacccagacccaucaccaucuccaucuaaagucacccagacccaucaccaucacuauccaaagucacgcauccugucacuaucaccauccaaagucaccaagccccuucaccaucaccauccaaagucacccaguccuaucaccaucaccauccuaaguuaccagccuuucaccaucaccaucaaagucaccagccccaucaucgucaccauccuauccaaagucauccaguaccaccaccauccaaaaucacccagacacaucaccaucaccauccaaagccaccuagcccaucaccaucacuauccaaagucaucuagcaccaucaccauccaaagucacccagacacaucaccaucaccauccaaaguuaccagccccaucaccaucaucauccagagucacccagauccaucaccaucaccauccaaagucacucagcccaucaccaucacuauccaaagucaccagccucuucaccaucacuaucaccaggcccuucaccaucauccgaagucacccagacccaugaccaucaccauccaaagucuuccagacccaucaucaucaccauuugaggucacccagacccaucaccaucaccauccaaagucacccagcccaucaccaucacuauccaaagugaccagccccuuuaccaucacuauccaaagucacccagacccaucaccaucaccacccaaagucacccagccccuucaccaucuccauccaaagucacccaaccugucaccaucagcacaucacuggcuuccuccccucagugugcgccucagucugaagugaucucacuuacuuguuugagguucucacugcugcuggccccgcuggacggucuucucucauaggaaggaaauuucaccuugcucucugcuggauuuccagccccuaaacgaggcggggcaugcugggugcaggauggaaugaguuggggacggagugaaccaguccagcucgugcgugccucccccucugcacugcccagagcaguuuuuucuucuggggacgcagggcaacgucuggagacauuucuggaugucaccagggguaagggccugcuacuuguaucugauggguggagacccgggaugccaauggcauccuacagcgcacaggacaggcccacaacaaugacacacguggccggagacaucagcggugcugaggcggagcaccuggugucugaggucuccccugugcucugucgcuguccucucacccucccccaaucuuccaaccuaguaguucucagacaacugcgucagaauccgcagggggcuugguggagcacagagcuccccucagucucugguuugugacggaggugggccccgagaaucuuucugcagcagaaagccaggcuuucugcagguucccagugaggaggacgaggcuggcccgggacacgccacugaugcucuucugacccaggggcuuuucucucccgcuuccgucccucuucccucgccggcaggugacguuacuggccuuuucuuuuuuggcccugccucccccuuggcuucuccccucuuccucuccuccacucggugccuggugacaugcggccauccucagagaugugcuucggggcccgcacgccuugcuccucgcacucuuccugcaccggagccgcggugcgaggccucgggaaugcucaccguuucucucccgccccccggccgcaugcugcagccauucccucaccacauguccaggagggagccggcauccuuugcugacuuucuugcugugacuauggugcugcguggaaaaggggccgugggaaggcugggcagguggcugcucagagccccaccugacacggugacccacggggccuggaaauucacugccccgauuuccacacaggugccugagcuccugcagagaaugccugagagcgagacgcaugcccgucaauuugugcuuucaggcguccuaagcacacacgccugcucuuauuugaaccacucccuguaagcuaguuccacuaaagaguggcuuuccacccuggcugcagauugcaaccacccaggaaucuuuuuuuuuuuuuuuuugagacggagucuggcucugucgcccaggcuggagugcaguggcgcgaucucggcucacugcaagcucugccuuccggguucacgccauucuccugccucagccucccgaguagcugggacuacaggcgcccgccaccacgcccagcuaauuuuuuguguuuuuaguagagacgggauguuagccaggaugaucacgaucuccugaccucgugauccaccugccucggccccccagagugcugcgauuacaggcgugagccaccgcguccuacuuuuuuuuuuuuuuuuuuuuugagacagaguuucacucuuauugcccaggcugcagugcaauggugugaucucagcucacugcaaccucugccucccagguuccagggauucuccugccucagccucccaaguagcugggaucacaggcaugcacgaccacaccuggcuaauuuuguauuuuuaguaaagaugggguuucuccauguuggucaggcuggucucaaacuccugaccucaggugauccgcccaccucagccucccaaagugcugagauuacaggcgugagccaccaugcccagcccacccaggaaucuuuuaaaagguaccaguugaugcccagaccccucaauuaaguccagauuuuuaagagauuuuuuuuuuuuaaagcucugcaagugauuccagcacacagucuggggacuaaccgcugauauaaggucuggaaaaucuaagaaaccacucuaccccacccucuggugaccagaagcuuaugucuaccagacccagggccuucccuugcugaaacaugcuggguaaacucuuuguuucuuccuagcagacagcagcccucucccucuagcucagaagcuacgucagcaguugguugguugguugguugguggguugguuggguugugucucucuuuaacuuccuccacuucugaagucaccugcagugacuugguguggacuuggucaccucacuguccccccagccucaggcccaggaaccaugucuuuggaggaggcucuccugcuggcagcugguugcaucuggcaugcuuggauuccugcagguggcugguugcaccuagcuugcuuggauucuucccagauucacagccauagggugggcguuucaugaaaucuccaaauuccaagggcucuugacagaccaccuccauccugaucagaaggggugaugccgguugcacggucucuuagagcuuaaaacucuagcuucuucucugcuccucauuccaaacuaaacaaauuguugcauuggauuauucuuucaaaauacuccuugccuuaaugccauccuuuagauuuugguggcuggcuccuguuguggaccgcaucucacagguggacuuccugguuucugccuccuguuaccccucacaguuaucucucccuugaguccugcuaccuuccagaaaaauaggcuccaaacacacuuucaucccaucacucccagcauggaguucuccaguggccuguuggcuacaggacacucuccagccccccgcauugggaugucuggccccaauccaccauaauguacuugucuccaaucugcugagcugcaugaaugcccaccccagcccagcgggcacuccccuucugcaaaccuccaagcacauucccccucugcacacugccaaucuuccuguccccgccccaaauccaaaggccccuccuauggcuggggauccacuggcagcugccuaacccuuccuaugcuccuggacguuuggugcaaucuggagcacgcucaagccggcauuugaaauaaccuggaacacguuuacaucauggaaaauauggaaaauaggcugauuggcuuccacucccuuuuagagcuggcaagaaaaauaauugaugacuaaacaaccuaacgaccaacaaauauaaaaagucauagcccaaccaugaucaaauaaggcuccagcauuccuccuuggagggacucugagccaucuggugucauuuuccuuuccaauccgggaacauucuggagauccugacauccagcuaacaugggcguugcuuccugacaacccuaccccuuccauuccccagucacuacugcuucaagaugcaguggaaggagauaaaucagacaccucaguagcgugagugaaagugggguguguggugagacacauacagaggggagagggccagaggacggcgccgugcgacacacaccauugcuccuuuuguucccgguuucggccaaguugugccgcaggugacucuccaccggcugagcucugugcaugcagggccaguauucucggccauucuggcuuagagaaaagcuuucuauauuccagaauggcuccaggccuccuccuccuccuauuaaauguguuuuaaaagaggucuuagagcccaggcaguuagaucuuagaaaaagacaaauacaguagaagcuggaggcaagcuuauccuuuccaaagagggagugcuuccuguguuaauuuguuauugagcaugaugaagauucagcuccauugagacugagccaagaguugacucauucaugggagcaacauaacggguugugagaagccaaaggauuaagcaucugggagccaagacugaucuugaguggcccagaaaugcaacccaaggaucuugggcccaagggccaggaagguuucugcagccuccuggagcauucacagaggcucccuguccguccacuuuucccucuguugcugaugugauggcuccugcccucagcuuaccagacuccucggagaggcuggccucugaauugguugaaugggcuugaagggggcuggacuccauuuggguggaugagcaggcccagugccccuguaugaggggaaguugucuugguaagccuguuuuugugucagguccccaggacaccuuccucugagucucuugcgugggagaaguugcuggacacgccucucuggcucuguccccgccggcacugugugggauccaugcuguucucccuccagcccuugccccaccuccuggagcccuucucugcgccuggucacuacccgccccccaccuccagcauuaauuuucuagggacaaggggcaggggaaggaggagaagaaagaguccuugcugcuccucagagaagacacaggagaagaaagucggagaggaguggggagccaggguggcaaagccccuuccugcugcccacgcagguccuggcuuucucuccacccacugcaccauuuccagggcugcucucauggugggagccggagagacacugagaagaggaaggaaggaggauccaagaggagcccagcacacccggcuucucugcugcccacccuccacucuguccucccagcccaggcccuuccuaggcaacccuggcacggguccucacuggccacacugaggccaucagcaaagcaccuggccucuucacgccuugggcucugggucuguaaggcagugaggcugagguuccugggacagcugggcacuguggacuugcccagcugagcacaggcaucaggggcuagaggggcccuagucccgaugacgaccgagugcccucuccaccuggggagcuuggaggacuuugcucugcacuuagggccacgcuucaagcccagugccucuuaugaccaagucucuggggagaaaugagcccuccagugccaaaugacccaccacuaaaaggccuuuugaggcagggccucuccugagcccacgcaggcacguggugggagaugagagggugugggcucacuucuugacauucugugugagugaggucauucauagggugaggggagaaucaaggggacagagggcccucuaguccccagcacuugggcucagcuggcaaguccacagugcccggcucucccgagaaccucagccucaccgcccuacagacaaagggcccaaagugcagggaggucagugccacacagguuuuauuuuuucacauuauugguguuuaaaauuguaaagauuuuccacguuaccuguaaccaucaaaccacauguauugcccccaguuaaucaccaugaacagcuugguguguauaccccuccauauucacuguguuucuucuuccaggaaugagcucauucucuauacaucacuccguaacuuguuguuuuuaccuaguaaggagucaugggcgucccaccaggugaauacuugcauguuugucuucaucuucuuaacaacuaccugacacugcagugucucagucugucugaacuuaaacagcuagacauugaguucucagagucuggaggcugaaauccaagaugagggugugggcagguucuguuccuggggaggccucucuuccuggcuugcauacagcugccuucuggcugugcccucaugaggcagagcaagagacagcucuggugucuuuggcccuuguaaggacaccaaccccaucccaugggccccacccucaggaacuccuccaaacccaaucaccucccaaggcccuaccuccuaaucuuacccacuggggaugagggcuucauuauaugaauuuggggugggggugccucaacauucagaccccagcaccaugggaccacuaauguggcauccugccuguggagagaugcacagacugacccauccagacagcacaguggagcacgcucuuucaacccaccugcaccugaccacagugggcacucaggaagaaauggguagagcgagugaaugaaugaaugagcaagucaaagacaugaacacaugacaucugacugucucccugugugcuuguguuucauucugauacaucccucccuaaauucaucugcugagacaaaggauuuuaacugguguuucuacacugcuuuccccaagauguggcaacccacaccccaccagcaacaccugugaugucugccgcccuguguccuuguagcaccucucuuaccagguuuccaaauguugcuaaacugcugggucaaggaauagcaucugccugggguuagccucacuuguguggauuuuuucuuacuccucuuggccacugacugcuccuggucuaugccuguuccauuggcugcacuguccuucccugccucuuggccagaggcugucgugugucagcgacagaaacguuuuggcugucgucugcacagccaguauucucuccccaucacgcugggccucgugaugauggggggagggggguugacaucacagagaucccagugcauuuucgacuucaucacugucaccauccucucuuguucauuugggggauacagccgccaucagcucaacagagcaaaagagagggaggccaccugcauccgccaggugcugaaauggguccaggcagcugccagagucugacauuuccaacuugauacagcaccugugaucggcaguaguacccaugacaacauuuauuuaauugaccaaacacgaacauuauagaggaaggugaucauuuaaaugauauacuugaaauucaucugaguaaggaagcugagaacagucaaagaagcuaauuuaaaaaauaaaaauaaauaaaaagaaccaccuaauccgcugauuucuaaucaugccgagugcuuaucucuccugccaggcauacagcgagcgccuugcagagucucacagcggcacugucuucucuuuugcagcacuccguacaaagugagaccuguggccaucaagcaacucuccgguaaggcccugcugucguuuuuuaaacuaaaagaaggaaaaagaaaucuugagcuugccccugugauaaaauauauacuaguuaagcauuugaaucuaagcauuugaaauauauaugaguuaccuuugaagcauuuaacuauauguuaguuaagcauuugaaucugcauuugaagccgauacaacugcagaaucugaaaccuuguacuacuguaagggcucugccuuucuaaccccagggagaauagcaucugccugggguuagccucccuuguguggauuuuuucuuacuccuuuuggccacugccuguuccuggucuauggccguuccauuggcugcacugucugucccugccccucggccagaggccaucccaaggacuuugcaguugcagggcggcauccacucuggucuuccuggcccagcaccuguccuccccgcuccacugugaguugccaaggcaggcauuuguggccccugggaugccuuggggugccucauacaguuacuugggccgcuguguuacaauccuuuuucuuuuucuuuuuuuuuuuuuaaaaaaaaacggagucugguccugucacccagggcuggaaugcaguggcacgaucucggcucacugcaaccucugccucccaaguucaagugauucuccugccucacccucccagguagcugggauuacaggcgugcaccaccaagccuggguaauuuuuuuuguauuuuugguagagacgggauuuugccauguuagccaggcuggucucgaacuccugaccucaggugauccaccugucuuagccucccaaagugcuaggauuacaggcgugagccacagcacccagccuagaaugccuuuuccauuugauuuuuaucacuuuuauuuaugugugauuuauacaucauaaaaugccauuuaagugccuauuuugaugacuuuugaaaaauguguacacccuuguaaccaucaccaaaaucaagacauuugcaccaccuagaaaagcucucucuugcccccuccagugugucucaguccacaacggaccugcuuucugacaucauccaugagauuucuuuuugagaguuucauauauaagaaauuacaugguauauguacucuuuuugacucaacauaauguuuuugagauccauccaugugcuguguguagagacaguucaugcuuuguauugcuaagugguaucccaugguguagguuguaccacagggcgucuuccauucacuguggauggacauuuggguuguuaccagucugggggcuuuuaagaauaaggcugcugugagcauuaaaguacaaguauugguggaaacguauauuuuuauauauuucauuucacuuggcuaaauaccuaugauaccuauaaccuugccaacuuuuuuauacaguuaaacauauacuuaaccgucuucccuaagaguggauauaagagucuguagaguguuccccagucuggguuugucugacguuucucucacgaccagccugggugugguggguuuuggaaggaauacguggggcgcaugacagccagguaggaccacgagcuucuccacugcagaguuacuguugaucuccuucccugcucuucuuugaaagcaagucacgaaguccagcccacccaaacacaggagagaaaaaccgagguucguuuucucuacacagauauucauuucuccagcaccauuuguugaaaagaugaucuuuucucccacugaauuaccaugacaccuuuguggaaaaucgaugggccauguaugugugagucuuuuucuggacuccagauccugucgugugaauuuacaugucuuaaaacaacagcacaccaucuugacuaccguagauaaauaguaggucuugaaaucagguacucuaaguuaucucugguuucuuuuuucuuuuucaaaaauguuauugcuuuuauuuucaaauaaauuuuagaaucagucuaugaauugcuuccaaaaaaacagucugcuaggauuuugacugaaguugcauuaaauauacagaccaaugugggaagaauuaauaucuuaagaauguugagucuucugguucauaaauauggucuaucuccccauucauuuggguuuccuuuaauguuucucaauaauguguuaccauuguuaauaugaaguacuuaauaaauacugauaaauacaucacuauuucauguauuuaaugguacugcaaauggacuuuuuuuucauuucaauuuccgguaguuuuuaguuuauaggaauuggcuucuguaugggaccuugcuaaacucauuuauuaggucuaguaccuuuuugcagauuuccugugauucuauagaugauuuucuuauagugcuggucuucugacaacaaauuccuucugcuuuugucugaaaaagcuuuucuuugcuguuuugcuuuuuuuuuuuucaaagagagagagagauaaagucuuugucuguugcccaggcuggagugcagugaugcggucauagcucacgacagccuugaccuccuaggcugaagcaauccucccuccucagccucccaaguagcugggacuauaggcacacaccaccaugcccggcgaauuuuuuaaguuuuuauagggacaaggucuuacaguauugcccaggcuggucucaaacuccuaaacucaaguaauccucccucccugagauuacagacgugagccaccaugcccgacugacaguguuuuuauuucaucuucauuuugaaaggguauuuucuugccauagagaauuuuaguuucacaguuuuccagcacugugaauaugucuucucauuguguuuuagcuaguacagcuucuaaugagaagucugugaugucuuaucuuuguuccucugugugcaaugugucuuuuucccucuggcaacuuaagauguuuucuuuaucacugguuugcaggaauuugauuaugauggccuuggugugguuuucuuuugguuuaaccugcuugguguucauugaucuucuuggaacuuugggaucauauuuuucaugaaauuuggaauuuuuucugcucuccucugucucucuccuuuccccugggacccuaacuaccugaaugauagacagccugagagcguccccugacucacucacacuguuucuuucuuuccagaccuuuuuuucuguuugcuuuauuuuucuuagacuuuuccgugacgucuuccauugcacuggucuucccuccugcaguaucuagucugcuguuaaucucguucagugaaauuuucauuucagauauugcauucuucaucccuaggaauuauguuucccuccuuuuucguaucucccauuuuuacaucucccauuuaugccucauuauguuuauauuuccuguaaaugcuuauaccucauuauaauucuguuucaugccauugucugcugguuuccuccucucugccauauccgagucugucucuguugauugauuuaucuccuggguaugggucauauuuuucugauucucgugaaucuaguagaucuugauggaaugcugaucacaggaaugcacgcugguucaucaucugguuuuguuucucccaguuaagaguguugggcuuugccuuggcaagcaguuaaguuacuugcacaucaguuugaugccuuugagccccaccuuuaagcuuugugagaauggcucuagagggcccuuaccccagggauagcucaguccuacuaagacuugaucccuuuggggucucccccaaacuccuggcugaucaccaaauuccacucuggcuguuuagagugcaaauguuuggagaugagaaugaaagcgccagggccuugaaggucguugcaaggaugcuggcuuuuaugcugaguggcgugggcagcuauuagaaggcuuucaggagaggagugacaucaucacauuuguguuuuaaaucuugcucagggcgcugggucgagaucacgaaagggaaguggcagcaaagguggaggcagagaaauccaagaggaagcuauuuuuuugggaggaggcggaggccuaggccggggugggggccauggaggugaugaggagcgcagguuccagcagguucuaaaggaagagacaagcuuuuuccuaaguggaagcgggauauagagacccauccggggcuucuuugaccugagcacugagcgccacggcccagggaggggguugcugcgggugggcuuggucugcucaucagacaucaggugcaugaggagcaggcagagucagggcaggcggccucucggcugucggcucccaauggaugguguugaagucugggacuuggugaggccagcagggagugagugagcaccagcaggaggggccaggccugagccggacggagaccgaacccauccgugggagaaggacgcuggugacaggacaccaucgggagcagaggggaagccauaaagcccuggaggcaggaagaggcaaaggcuggccgggugugggugaggugcugcagggcucucgcaggccagcgaagacaggcgagauggcugugcucagaguuagaagagcaucgcugggagcagaggaaagagggauuucugugucaccuggggacccauccaggaccagugggagauggaguugggcucauugagggaaagaggugaauggaaggaaguuggaaccagcuguccuaaggccggagcugcuccucccuggaggacuccggcaaaggcugcuggccuugggcugugcgggcacccaguggcugagagaucguugcccucugcagcccuccugcaacuuggauccuaggagccacaaagaggcuugaaaaauaauccauccugagaaacacaaaggcucacauuaaacuucgcaucguaaaguuuugaguaaaagaacaauaaggggcauuucugcuaaaggugccaggaugagaaaaagcaggaaacagugcugcaccgccaggcucugcaccgucucuacagagggcugggguugguucaggagcauucggcccaggcugugaucucgagaagguggucagggcccaggcucccgccagcccucacggcagcacgaggcugguacgagacaggugcuucagguguuuguugagagcugcacacacuucugcugggcugggcaagacuucccucuucagagaggaugagcggccacacggaaggccaggcugggugucccuccgggccagccgaggagcgcugcgcuuauuccgcagugaggagucgcuggcuguccaggggagcugcauuuuccuagcagcgacaaccccucccacaucuccauagucacauccuggcugggcuaacaccaccuuuccccgccucugggugcguggggaccccgcucuccaaauaggccaguguuccaggcuuuucuuuaggagacaaagucggugucagguagaccccccccaccccaccaaacacacacacacacacacacacacacacacacacacagcuuuccugagaaauguguuuacagaacauuuuuuccauuugggguuuguccuuaggaauucuucacucucucuauggcaacaaccuucccucucccguccaucggccuugggucccagagccacugagccguggcccaaggucaggaguuagcucuagcgacgccgcccugaguucuggccuguaagcaaccccaggugcccuugugaaucaacagaccacauuuccaguggcagaaaaggaaaugggagcuguuucuagacuagcacaaggcucaggggguggggggugggggcagggugcagggaggccaacgccacacagccccacacccagccuuucccaaggcccuggguuccucacugauucucagcagguuucaguaaaugccucuaacgggcccgguggaacugugcaaugcagaaacaccccaggguuuugcuguuuugcuacuuaaauauucaggaaauaguaaagagaagaguauuaucaaaaacgugacuuuucauagaaaagggagaauaggccagcccuggccuggguccacaaccccagugugagcugcagagacuucucuggagcggugaacagcuccugccaggaaagagcauggcacagccucguucuccagcguagaguagaaggaauggccccguccacgcgaaggucuguguucaccaagcaucuucuguagaaaaaugcucucuucgccugaucaugggagggaaucaaauggauagagcauuuaucccuuuugugacuaaaauaaagguaauagcaacuacaaaaaccacgacacaggcuucucagcaucuuuuuauaacgauagugcugauuuuuuggaaaauccuugagccucaaucacuuuuauuugauguaagccgcucaaacucaaagaguguuguuuuccagauuauaaaacacagaucucagcugauggcgguugacgggugucccccgagugcccucggcugccaggagcuggcaggggagaugccugugaugaggauugggugcugugaucacagcacgcgggaaaaggacagggccucccucagcguggcagaucgcguggguccauggguccgugugaucucaugaccguaucaaggggauugugucuuuuugaccagagcguuagggaaagcgugcugcagucacacgccaggacggccccccacggcccaaguccuauaggagagccaggggccaucacgauuuucuuaggcacagcagcaguugaaccgugcugucacacuuaacccaagugaugacagccucuucaacuaggacagugcuguaggggucugguucugcuuguucucccccacauuccugccugcccuaggacccaggaccugucucuagucacacacacccuguucagccucugcaucuggcccccgcggagacccacaccacauucuacuccccuggccagagaccgagggugacucggaggcuuccaguucccagcagcuuuauuggcguugcuguuuccauagaaggacaauaaaagggggccauaaggaggcgcauccgcagagugcgugcuugagcuucugcaagccagaggaggccggcggccggcagggugggcaggcuggcuggcugugccccacaacaugcauguggagagguuuugggggcagccauggaaccccggagcugcccccacaugagaguucccccagguggugaccaaaugcauuuacaguccagccgcaguccagaugcagaugcgcuguaacuguagaacacacagcaaauucugaaggcuuaguaugaaaaagaauauaaaaaucucagucauuuuuauauugauuucauguuuccugguugagaugucauugauauaacauaaagcccaccauuuuaaaguguacaaccucagccaggcaugguggcucacgccuguaaucccagcacucugggaggcugaggcgggcagaucaccugaggucaggaguuugagaccagacuggccaacauggugaaacccugucucuacuaaaaauacaaaaauuagccgggugugguggugcacaucuguaauccuagcuacuuggaaggcugaggcaggagaaucgcuugaaccuggggguagagguugcagcaagccgagaucacaccacugcacucuagccugggugacacagugagacucuaucucaaaaaaaaaaaaauuguacaaccucagucuuuuuuagugucuucauuuuguugugcaaccaucaccacuauuuaauuccagaacauuuccaucaacccaaaaagaaucccuguaccugugagcaguccccccuccauccccuucaccccccagccccuggcaggcccuguucucuguccugugcauucugaccuuucacauaacagaauccguggccuuuccagccuggcuucuuccacuuugcacacgguguugcaggcuccccgcguuguggcauaugacagcucuuuguuccuuuauggcuggaugacguuccguugcguggcugcguccuguggcugcauuguguggcugugucacguggcuacgucacguuugguugauccguucaucagcugauggacauuugggcuguuuccacaaaggcucuugugaaugaugcugcugcaaacguuugugugcaaauuuuuguaugaaagauacauggugaaaugagguauuuugagguacauuggauuaaaugagauauuaaaaauuuuuuuaaagucuagccgucuugaaggggagggccugagagaagugcugaaaguucacagcagaggauaccggaugcugcgggugugccaggcuggccuguccaggaggucccugcagccugggugggaggucccuuacccacuaaugggugccuccuccaaccccugagucccccuaccugaggacuuccucuguguguggcauacgcggcugccccgaggucaguccuccccagugaaagggagcugaaggacaggugcccagcuucuuugcuccacagugggaccaaucucugacaucaucaaugcaguugcucaaagggagcucagagcgaggagucaccuguacaucaacucacccucugggagcucucuucccuuccaugccucaaucccccacucccucccagggcuuccugggcuggccuccaaaugcaccacuagcccccagcuccuugucuccggugggcuuuugaggauuuccaacuaagaaccuuagacuccaagacaggucaagcccccuggcauacucauuugucauuuggaugaaauagccuuaggagagcuacuuaaccccacugaacuuccauuucccugacaaaauaggaauucuaaugcauaccuugcaugguucuuggaggauaaaugaaguaauuuaugcaaaaugcugagcacagugccugccacuugguaagcgcccaguaaaugguuguuaucauugaaaaugacuuagggggcauuuuugaauggcuaaaguuaugucucucuggaauugcugaauuuuaauagaacaggaaugcuuccuaaggucuaaaacaaaaggcggaggacuggcugugucugcccuggaagccaaguuaaugcuggaugucugcgcauagacauguugcucaugagaaauaauaaugcuccuuaauaauauugucuauuucagugcaauuucagucuagaaggcuuuauaagcaaagccacagucauccuuacuugcauuuuuuugaaacaaaaagacugcaguguauaaaugaaaaauaaccauuucuggaaugguguguucagacggauuccccuuagaguagccuagccaacaaagacagcagcagcccuuagcgugccacugucagagauauugauggcaaacaguaauacggaagccugcggaauggaaguguccugacggcagauuugaguaaaauggagaugaugacagcugaacauugcugcacggaccucaagacugcaaacguuaggacugcccucccugcuccuaggcauuugugagaaccaggccaacccauacccacccacugcuguguccugccugacugcacugaaaugcacagauccugugggugcaguuugaugaguuuuguuuuguuuuuuguuguuuuuguuuuugaggaguuucgcucuuguugccgaggcuggagugcaguggcgcgaucucggcucacugcaacuucugccuccuggguucaagcaauuauccugccucagccucccguguagcugagauuacaggcgcaugccaccaugcccagcuaauuuuuuguauuuuuaguagagacaagguuucaccauguuggccaggcugaucucgaacuccugaccucaggugauccaccugccucagccucccaaagugcugggauuacaggcaugagccacugugcccagccacaguuugaugaguuuugauagaagugcauguguuagaucuuucaggaaucaccacccaaaccagaaauaccauuugacccagcaaugacguuuauauauauacccaaaggaauauaaaucauucuauuauaaagauauaucuacauguauguucauuguagcacuauucacaauagcaaagagauaguaucaauccaaaugcccaucaaugauagauuggauaaagaaaaugugguacauauacaccauggaauacuaugcagccauaaaaaggaacaagaucauguccuuugcagugacauagacagagcuggaagccauuauccucagcaaauuaaugcaggaacagaaaaccaaacaccacauguucucacuuauaagugggagcuggacaaugagaacacauggacacagggaggggaauaacacacacuggggccuguugggaggguugggggagggagagcaucaggauaaauagcuaaugcaugcugggcuuaauaccuaggugauggguugacaggugcagcaaaccaccaugacacacguuuaccuguguaacaucccugcauguccugcacauguaucccagaacuuaaaauuaaauuaaauuuuuuaaaagugcacgugcauguaaccgccaccacaaucaagacagaggacauuuccaucacccuagaaaaauguccccguacccccuucaaggcaguccucacuguggagugcucugccuauuuuugaguuucacggaguugaaaucauacagcacgagcucuuugugucuggacucuuucacucaacaucauuuuuguuuguuuguuugugugugugugcguuuguuuuuugagacagggucucacgccuguugcccaggcuggggugugaggcacaaucauggcucacugcagccucgaccuccugggcucaggugauccucccaccucagccuccgaguagagacauguugcccacgcuggugucgaacuccugggcuaaagcaauccgcaucaugauguuuguaagauccauucgugcaguuauuuccuuuugcacugcugagcacugcaugccucgcucauucauucuucuguggagggacauuugggucauuuccaguuuaggguucggcuacuagaauuauuguacaagucuuauugugggcauccuuguccaugaucuuggguccaccuaggaguuaaauggcuggcucauaugcuguguuuguuuaacuuaagacuuacuuguuaaguguaagaaacugccaagcugggccgggcacaguggcucacgccuguaaucccagcacuuugggaggccgaggcgggcggaucacuugaggucaggaguucgagaccagccuggccaacauggcaaaaccccaucucuacaaaaagugcaaaaaauuagcagggugugguggugugugccuguagucccagcuacucaggaggcugaggcaggagaaucucuugaaccugggaggaggagguugcagugagcagagguugcgccacugcacuccagucugggcgacagagcgagacuccaucucaaaaaaaaaaaaaaaagaaagaaaaaaagaaacugccaagcuguucuaccaagagguuguaccauuccacauucccaccagcagcaucugagugauccagcuguuccacaucccugcaacacuaagcauucucugcuuacauuuuagacauucgaguagguguaagagcaauccuaucuucuuauaguuuuaauuugcauuuccaaguaacuuaaugauguugaacauguugcuaugucuuauugacuauuugaaugucauauuuuguguagugucuguucaacaauacuuugcucaggccagguccgguggcucacgccuguaauccuagcucuuuggaaggccaagguggguggauuaccugcggucaagaguucgagaccagccugaccaacauggugaaaccuccucucuacuaaaaauacaaaaauuagcugggugugguggcaggugccuguaaucccagguacucgagaggcugaggcaggagaaucgcuugaacccaggagguggauguugcaguaagcugagaucgcgccuugcacuccagccugggugacagagcaaaagcugcaucucaaaaaaaauauguaaaaaggauuuugcucauuuuuuaagcuggcuuguauuauuuuugucacugguuuguaggaaacucuacauaagcuaggauauaauucauuugucagauauauguggcaaacauuuuucccaauuugugauuugccuuuuucguuuucuuaaugaggucauuugaugagcagagguuuuuaauuuggugaauuccauccaauguaacaaguuuuucuguuguggucaguacuucuugugucuucucuaauaaguuuuguuuuuuuuuuuuuuugagacaagguuucuuguugcccaggcuggggugcagcugugcgauaagcucacugcaaccuccgccucccggguucaagugauucuccugccucaggcucccgaguaacuaggauuacaggcguuugccaccacgccuggcuaauuuuuuuguauuuuuaguagagaugggguuucaccauguuggccaggcuggucuugaacuccugaccucaugauccacccaccucggccucccaaagugcugagccaccgcaccaggccccccaaauugcuaggauuacaggagugagccaccaugccuggcccuaauaauuuuuuuuaucccaaggucauggagauacauuuuagaagauuuagaguuauagcuguuauguuuuuucuuaauuuaaagaaaauuuuuaacaacccaaucuguugagauguuauguuuuaaucugucauucauuucaaguuaauguuguguguguugugaaguagagacugccauucauuuucuuccccacgcugacacccagcuguuacugcaccacuuguuaaaaagacuccuuuucccgcugaauccauggcuccuuuguugaaaguuaaugguaucucuguguuugggccucucgcugaacucuguucugcuucauugaucuauuugucuauccucacaccaacaccacacuggcuacguuacugugcccuggaaucagguacucuaaguucuccauguguucuuccucugcauuuguuuugacuguauagguucuuuucuuuucccuacaaauuuuaggaucaacuugucaauuucaaaaaaaaaagccaucuaugacuuugauuacuauuuuauuuacuauauaauuuggggaggguagugucuuaaccauacugagucuuccaacccaugaacaugauacaucccuccacuuauuuaggucucauuuaacuucucaaaagguuauggcuuucaagauaaagguccuucaugucuucgguuaacuuuacuccaaaguguuuucuguuuucugguuuuauugugaauaagauuucauuaauuuuccaauuguuugcugcuaguuuauaaaaauauaauagauuuuuggauguuggcguuggauccugugaauuugcuuaauucauugguuaguucuaguuguuguuuuauagguuccuauaauuguccacagagacaaucaugacaucuaagaauaaugacaguuuuaauuauugcauuccaauuuuuggcuuuuauuucuuuuacuugucuuguuguacuaguugaaacugcaauacaguuaaauaaaagugagagcagacguccucgccuuguucccaaucuuagaggagaugccuucggucucucaccauuacauacgauguuagccacagauuuuuuuguggaugccuuucauaagguuggaaguccccgucuaauguuaguuuucugagaguuuuuugucucauguucuuugacaaaauucuuuguuaacuuuuaucaaauguucucucuacagcuacugagguggguugaggagguguccucuuuuuccuuguuuucuaaugguuuugucccauaaagagguauuggauuuuguuccaguaccuuucugcaucuaugggaugagcauacauaugguuuuucugcuuuauucuauuaagauaaugaauaauacugauugauuuucaaauguuaaaaccacuuugcuuuccuaggguaaaugcacuuauauuuccaggaaauguuccuaggaaauuuccugggguaaacucacuuguauuuccaggaaauauuuccaggaaaauacuugggaauaaauguaacaaaguauauguaggcccucucccugguguguuugcuuuuuauguauugacuuguuuuuguuuuuguuuuuguuuugagacagugucgcucugucacccaggcuggagugcagugcugccaucucggcucacugcaaccuccgccuccaggcuucaagugauucuccugccucagccucccggguagcugggauuacaggugugcaccaccacaccagauaauuuuuguauuuuuaguagagacaggguuucaccauguuggucaggguggucucgaacuccugaccucaggugauccacccgccucagccucccaaagugcugggauuacaggcgugagccacagcaccuggccgcuuuucauguauugcuagauuugauuuccuaacaauucguuaagaauguggcugucuaugcuuaaaugggauauugauuuguaauuuuuuuucuugcagugucuuugucauguuuugauauuggcccuauaguggccucauaaaacacauugggaaguuuacuuucuucuguauuuucugaaagauuuuauguaauuuugguauuauuuuguccuaugucccuuuacacuuaauguauuuggguuuuuugugugugucuuuuuaauaguuaauaacaauguauuuuauucuugaaaaucacugagaguacauuuugcauucucaccacaaaaaaaaacuauguggcauaauguguauguuaauucacuugauuuagccauucuacaauguauauauuucaaaacaucaucuugaccaugggaaauguaucuaauuuuugucaauuuguuaaaacuuuuuuuuuaauuccaauuuuuuuuuuuuugagguggagucucgcuuuguugcccaggcuggagugcaugaccaugggaaauguaucuaauuuuugucaauuuguuaaaacuuuuuuuuucauuccaauuuuuuuuuuuuuuuuuuuugagauggagucucacuuugucgcccaggcuggagugcaguggugcaaucuuggcucacugcaagcuccaccucccggguucacgccauucuccugccucagccucccaaguagcugggacuacaggcgcccaccaccgugccuggcuaacguuuguauuuuuaguagagaugggguuucacugcauuagccaggauggucucgcucuccugaccucaugauccaccugccuugaccucccaaagugcugggauuacaggugugagccaccacgcccagccccaacuuuuauuuuacguacagaucuaaacguaucacaugcagguuuguuauguggugugucgcacccagauggugagcagagcccccaagucuuuguugauaugguugggguuagcucucccagucuuuguucauaugguugggguuggcucuaccagucuuuguucauaugguugggguuagcucuaccagucuuuauugauaugguugagguuagcucuaccagucuuugucgauaugguugggguuagcucuaccagucuuuguugauaugguugggguuagcucuaccagucuuuguugauaugguugggguuagcucuaccagucuuuguugauuagcucucccagucuuuguugauaugguugggguuagcucuaccagucuuuguucauaugguugggguuagcucuaccagucuuuguugauaugguugagguuagcucuaccagucuuuguugauaugguugggguuagcucucccagucuuuguugauaugguugggguuagcucuaccagucuuuguucauaugguugggguuagcucuaccagucuuuguugauaugguugagguuagcucuaccagucuuuguugauaugguugggguuagcucuaccugucuuuguucauaugguugggguuagcucuaccagccuuuguucauaugguugggguuagcucuaccacguugcuauuugcuguuucuugaucuuggguuuuguuuuucuguuccuccuuuucugccuucuccuguguuaauugaauaaauuuuuguuuuccauuuuauuccuucugcugacucuuuagcugucucuuuuugcauuauuuuuccucggcuguuguaaguguuacaauaugcaucuuuacuuuuuuuuuuuuuuuuuuuuacaauugauagacuuuguuuuuuagauucacggcaaaauugagugaaaaguguggagcucccacauguuccccccacacacagacauucagccucugccaccgucaacguccugcaucagauuguauauugguuacagccgggcgcacuggcucacgccuguaaucacagcacuuugagaggccaaggcaggcagaucacuggaggucaggaguucaagaccagacuggccaacauggugaaacccugucucuacuaaaaauauaaaaauuagccaggcgucauggcgcacaccuguaaugccaacuacuuggcaggggaaucgcuugaauccggaaggcggagguugcagugagcugagauugcaucacugcacuccagccugggcgacagagagagacucugucuccagacaaaagaaaaaaaaaagacuguacauugguuacaaucagugaaccaacauugacauauccuuaucagccaaagucuauauuccaccucagaauucacucucagggcuguacauucccuggguuuggacaaauauaugaugaccugugugucccaucccagucucagacagaaucgguucucucagggcuguacauucccuggguuuggacaaauauaugaugaccugugugucccaucccagucucagacagaaucgguucacugccuucaaaacccccugugcgccaccuauucaucccucccgccccaagccccagaucuuuuuacugucuccauaguuuggccuuuuccagaaugucacauaguuggagucauacagaauaaagccucuucagguuuucuuucacuuacuaauaugucuuuaagauucuuuuaugccuuuucccggcaucuuagcauugaagcauauuccauggucuguauguaucacaguuuauuugcccacucaccuauugaagagcaucuugguugcuuccagguuugggcaguuaugaauaaagcugccauaaauauuugugcacaaguuuuugugugcacauaagauuuuaacacauuuggauaaauaccaagaagcacaauugcuggaucuuuugguaacagcauguuuaguuuuguaagaagcugccaaacggucuuccaaagugacugggccauuuugcauucccagcagcaaugaacgagcauuccugccgcuccacauccuccccagcuuuuguguuucagugucuuggauuuucaccacucugauagguguauugcaguaucuucuucuuguuuuauuuugcaauucccuagugacauaucaugauaagcaucuucucauaugccugcuugccaucugcaugucuucuuugaggugucuguucauaucuuuuggccacuuuuaaucauccugaacuuuucacaaucuauuuagaauuaauacuguaccgccucacauaaaaaauaaggacacugcagcuauauaagucuacuuacuccccucucccaccaccuuugaguuauugugucauauguuuuauaucugcauacauuuuaagccccauaauacaauauuauaauuuccuuuuuuuuuuuuuuuuuuuuugagacggagucucacucucuugcccaggcuggagugcaguagugagaucucagcucacugcaaccuccaccuccuagguucaagcgauucuccugccucagccucccgaguagcugggauuacagaugugugccgccacgcccggcuaauuuuuuguauuuuuaguagagacgggguuucaucaucuuggucagacuggucucgaacuccugaccucaagugauccacccgccucagccucccaaagugcugggauuauaggcgugauuauaggccacugugccuggccuauaauuucuuauuuaaacagcuaguuguuuucugaagaaauuaugaaaauaaacuuccagauaguuuuuuaauaguugccuauauauuugccauuucugauguuuuuauuucuucucaacuuccaacuuauauuauaucccuucacucuaaagcauuucuuuuuucuuuuaauguuucuugcagugcauaucugcuaguaacuaauucucucagcuuuugcugauuggaacaugccuuuuuuuuuuuuuuuuuuuuuugaaaugaugucuugcucugucgcccagguuggaguguacaaucaguucacugcaaccuccgccuccuagguucaagcaauucuccugccucagccucccaaguaccugggauuacaggcgcccaccaccaugcccacccaggcacuccacccaggagguggagguugcagugaacugagaucucacuacugcacuccagccugggcaagagagugagacuccaucucaaaaaaaaaaaaauuuuuuuguauuuuuaguagagacgagguuucaccauguuggccagguuggucucgaacuccugaccucaggugauccacccaccucggccucccaaagugcugggauuacaggcgugaaccaccgugcccaggcaaggaacaugccuuuauuuugccuucauugugaaggaugaguuuucaugguguggaauucugcauucacaguuuguuuucuucaagaagcuuaaagauguugacucacuuucuuucuggccuccauuguuucugaugagaagucagcuuaauuugaucauuauuccucuguaugaagugugucuuucuucucuggcugcuuucuuugggguuuguuuguuuguuuguuuguuuuguuuuguuuuugagaugaaguuuuugcucuguugcccaggcuagagugcaguggugcgaucucggcucacugcaaccuccgccuccugauucuccugccucagccuccaaguagcugggauugcaggugcccgccaccacgcccaacuaauuuuuaguagagacaggauuucaccauguuggccaggcuggucucgaacucuugaccucaggugauccacccaccucgggcucccaaagugcuaggauuacaggcgugagccacugugcccaggccucuggcuguuuucaagcuguugauuucuuuccuuuaucuuuagguuucagcaguuggacuaugaugugcuucagucucauuuucuucuuauuuauccuucuucauguucauugagcuuccauggacuaugaauuuaccuuuucagcaaauuugcaaaauugucagccauuacguguuauaugugccauucuuucucacuaaugaccuguauguuagaaaguuugcuguugucuuucaagugacugcagcuuugcgguuuuuuauaaucuuuuuuuucuuugcccuucaaauuggguaauuucuguugaccuguccuugauuucccugacucuuccacugacuccagacuucuguaaguugauccaugaaguuuuuuuuuguuuaggauauuauauuuuaaaauucuaaaauuugcacuugacucuuguucauagauuugucucucgagacuccccucuguuuacgauuuacugacgccgcuuuuguuucgguguuugcacguaccugcaauugcugcauuaaagucucguuugcucauuuuggcaucugagccggcaagcguccagggugucugagggaugauuuucucuuggccaugggucacauuuuccuauuucuuugcaugucuauuuuuuauuguagacuaagauuaugaauaacaccuaggagagacauuggauuuuguuaucauccucugaagaguguuaauuuugcuccagcagucaguuccguuacucacugaucaucugaacuucgugcagccugguuuuaugcuuuguugggguagaucucuagacugacccuucugugguuuuaguaggaagccugagguauuuaucaagccucucuaacucgacuacauuuaaacuccaaacuuugucuccuccacagcaggagcugaaaccucugccacacuaggcccacaaacaugcgucauucagggauccaccaaggaacaggguaguuuauacagaauuugggucccacugccauggcuuccuccuuugggaacucuccuuuccauuuccauccucucugacaaccuaaaacugugucaucugacgcuucaaccuggaacuuucugcuuaaguuuuagccaucuacauuauaagggcacuuuauagcaagaaauagaauauuauuccauucuaggccaaguacaguggcucacaccugacaucucagcacuuugggaggccgagguggguggaucaacugaggucaggaguuugaaaccagccuggccaacauggugaaauccugucucuucuaaaaaaaauuuugaaaaaauuagccgggugugguggugcauaccuguaaucccagcuacucaggagcugaggcaggagaaucccuugaaccugggagccagagguugcagugagccgagauggcgccacugcccuccagccugggugacagagugagagucugucucaaaaaaaaaaaaaaaaaaaaaagaaauauuccuucguucuuuuauaggagcauaguacuucauuuuguagauguacuauuguguauccuacugauagauacuuguguugcuuccagucuuguuuuuacagcgaucagaugguucuucuuaauuucucuugcuacaaauguugcugcuguguacaaccuguuaaaguccacagauggaauaaaagcuuugguuugcaaaaaugacucaaucuuuacaaacauucugucauuuguaccauaaucaauuaguuuauuggaucaccgaauugccugacagaauccuuccuggaacuagucuauggggucauuuggcauagagucaaagccucagacacgaugagccagaguugauuuccuuuggcuucacauaauuaaacuuucccagaggauuaucagguuacagugacacacacacaggcugucagauaauggacaaagucccagcagcguguacaaccagcugguggcucccaaauucaaauucccccagcggcauccguucgguuauucguacccacacccucccuuagaaguuuaccccuccgccaggcgcagugacucacgccuguaaucccagcacuuugggaggccaaggcgggcggaucaccugagguugggaguucgagaccagccugaccaacauggagaaaccccgucucuacuaaaaauacaaaaauuagccgggcauggucacgcaugccuguaaucccagcuacucgggaggcugaggcaggagaaucgcuugaaccugggaggcggagguugcggugagccgagaucaugccauugcacuccagccugggcaacaagagcaaaacuccaucucaauaaauaaauaaauaaguucaccccacuacgggcaagaagccacacagaaagaaaaauaaaauagguaucucugggguuuucugaagggaaaguaagugcagcucugucccgucuuugcagcucuaaauaggaacaugguggaguagggcaggucgggcuugacgaugucaugacuuggccucucucagugucacgcagccccugcagguuauaaggaggauugagcuggccaggcacaguggcucauaccuguaaucccagcacuuugggaggccgaggugggcggaucaccugaggucgggaguucgagaccagccuggccaacguggagaaaccccaugucuacuaaaaauacaaaauuagcccggcgugguggugcaugucuguuaacccagcugcucgggaggcugaggcaggagaauugcuugaacccgggaggcggagguugcagugagcugagauuucgccauugcauuccagccuggguaacaagagcgaaacuccgucucaaaaaaaaaaagaaggauagagcuaacaugcaugaaccaccuagaacagcacccagagcauaguaacagcuccuugcagauguuacaguaccuugaucuauacaacaguaaagggaaaugcaugcuagcugccccagaugcugccagcuucacaggcauuuuucugccugcaaacuaauccuaaggaagagaggagggcagggggagaaauugcacccagucaaauguaaacgauacaaaaugugaaauuccccucucugaaaaugaaagggaaaaaacucgauucaaugccugccccugaggugaaccugaaaugacaaggcagacacucucuagaacuucacguuuggccaccagggucuucgguugauuuuccuuucuucgucauaucugaguggcugaaacgccagugaucugggauaguccuuuggcugcugauagacuuaugcaaucccuuggcaggcaggacaggccagaggaagggcuccugugccuuuaaggucacuguuaaucauguaacuuuauuguguuccugggcuauaaaggaaaugucguccuugaucugaaugucuguuuuaugauguccauaaacagugaauugccagugacuguacccugagugagaacauccucagccaguugaauaguucaagggcaguugcaggggucaggagagagcaaaagugggacagaagaugaguuugcuucccaggaagagagacagugccaccccaccccucgcugacagggaagccuuccagcccuuccuccaaagagccuuggcucucagggguuggagguuggacaagagcagaaauaaaggcacccugcucccaccccccacaaucuuccggacgucuagagugcuuaucucuuugggggcaaguaaugugaauuauuuucccuaaugcaaaaauaaaaaauaagagaccccuuuuacccuuuucugaaaggauagcagagguauuuuucuuuucuuuuuuuuuuuugagauggaaucuugcucugucaccaggcuggagugcaguggcacaaucucagcucacugcaaccuccgacucccugguucaagugauucuccugccucagccucccgaguagcugggauuacaggcacguaccaccaugcccagcuaauuuuuuuguauuuuuaguagagacggaguuucaccauguuggccaggauggucuugaacuucugaccucaugauccgcccaccucagccuccagaagugcugagauuacaggcgugagccaccaugcccguccagcagagguauuuuuucuaauacuugagaagugucugcuaaguauguauucaccggagggugcucagcaccucgcccuguugcucuggguugggacuaacaaggugaaacauggcucauugcaucauauuaauagcaugcaaaucuaagcccagugaugccgugcaauggcuacgaucaagggcaauagaauggaucgugcaugagcucccaggccacacacacacgcccuugugauguauuauucccucuacucuugcaggucggugcuugggaugcuagugcccaagcugauguuccuaggucaccucccucaaugcaugggucuaggggccagcauguucuauugcuagggccaugugugcauucguuugccuaggggagaaaaguacacauucccaucagcucaggugcguggaggacggaagaacugcuguugcugcuaguauucucuucagcacaagauaaaaaggagauaggcaaaucagcuggcuggccaaucaaauuaacuuauuguuacacuaauuuuuagaaucagaauuaugggucaggcugugcuagcaaucagugaaaucaaauuucaugucauucugcacuggguagacucaggauuugccugaaacaaguaaacaauuccuggaagaagugggcgaggcagaggcuugaacuauccacucagaccaaggaggagucaggcaauggcuucugggcaucguguggggugggggcagccccugcccuggacacccgugaacacggaggcagccgugugaacaccaugaggcaggguguccauccugccacccacacagcugcguccugcccaggaaugaggcuggcagcccauaggccccuccuuggucccucuagagguuugcuucauuccaguacccuugguucugucaagugggcagggccugggccccucugcugcaaacccauggcccaaagcggaccugauccggcagcaucuaaaaacaggacccggagaaucugcuggacuccaggauugcccuggaacaaaccuaaagucuccuaugacaugcaaacaauucugccagccccggccagcauucccugcaugugcuuaucaagugaggaggccagcaggacuuagcacccaggugagcacacuucauugaguccaggugugugcagaugagaagcagccaggaguugaggcugaagaggagccuaccuaaaccugucauuacaacugauugauccuugguguagucaaaucuucugccuuuaugaaagucaugguaucuagagguaaauccccaucagcuuggagcagcaccaugaaauccacucuagcaugcagacucgggggcacuuuuagauauucuauugguuguucuugggggacagcuuccuuuggagaacaugugaguugucugugaauaucagcuugcucucccuagguuuccaucacauggaucagcgagaguuaaugcugacucccccucccucgggggcuuauuugcaaucucccgauuugcucaaaaacuuccagguccagagggacccuaaagacccugucaugucccccugugaauuaccagcaucccaggccauugcuggguuuucuuaaaacuauuaagacacuaucaacgugaaaugacuugaauaggcuuuaauuuuuaaaauucauuauacguccugcagcauuuaggaaaaagagggaggugucacacauaauaucaaauuuggcugacacaaggugauuuugccacgaagguugggaaggaugaacauuugcaauugaaaacuguuuguugcccccagaauccagcgguuucaggcucucugaggauuccagaggugcuagaggggguaaggccacauucagguggugcaggugggauucaccccuucacagccuggagguggugcccggagcgcacccugucaccccaaggaugaugacaccccagggaaggugguggaagcaggaaggggaggucagaggaaaacuggggcccucagugggcauccgugaugcggaaacacuaauaaugccaacagcaauagcagaggcaggcagggcuuacguggccagggcugggcuggugcuguccugagcacuugacaugcaugaaaucacaguuguuuuaaguucugaacuccccugggaggaaacuguggccacagcaggaauuccaaugauucuagggucaggagaggaggcacccacuuccugaucagggcucuguuuguggaugcgugggugugguuggccuuugugcacacuggugguuuugcuucuuucccccagcaaaagaaugcagauuuugcauuaucuaaagaggcgguuccgugagcccacugugcugagucacauauauuccaucgguguaaguaccaccaccugggcagugccccuggaguguucucacugggagcgcagcuuugugucuguacccuuccugagaauagcugacaugcuggccuggguggcgcauuggccgagguguggcuaugacagaccaggauaccagcaucugccccagcacugaacugagcacaccacagaagguguggacagaguggcaugaaacaugacagcugcuugugcucgaaauuagauguagccacacaaauccugucgugcucaaaggguuccaucuccaaaguccaaaggaaaacucuuccuuaacuguuauuccauucugucuauacauuucuuauuuugaagcaaggauagguucacacgcugcuguaaugaugcaugcagagaaagcccacucauggcccgguuucucccaguggugacaucuugcaaaacucuagcacaaugucacagccuggcauugaccgugacacgguccagauccggaacauggcgucccccacaaggaucccaccugccgcucuuuaauagccacgcugcuucccuuccauuccccacuggaucccuguccccuggcaaccaagaggucucucucuuuuuuguuuuuguuuuuguuuuuuuuuugagacagaguuucgcucuuguugcccaggcuggagugcaauggcacaaucucggcucaccccacaaccuccgccuccaggguucaagcgauucuccugccucagucuccugaguaggugugauuacaggcaugcaccaucaugccuggcuaauuuuguauuuucaguacagacgggguuucuccauguuggucaggcuggucucgaacuccugaccucuggugauccacccaccucagccucccauagugcugggauuacaggcaugauccaccaugcccggccucuggucucuauuuguaugauguugucaauucuguaacguucuacacauguaaucaugcaguaggugacuuugggauuggcgccuuccacccagcacaacccccuggcauccauccggguugucgccuauauccgugguucauucccuucuuucugagucauacuccgcgguauggauggaccacgguugguucaaccauucucccuugaaaggcaucugcaucguuugcauuugggacuacuacaaauacauccgccaggaacauguggacaggccuuugugugaacaucaguucuccgcguacaucaucucucugcccuggugcuugcaucuuuaguugguuuuuucugucuuuugaagaaccuaccagacuguuuucagaaugacuguaccauuuuucauucccaccagccacgagugagugagccguguuuccacggggguuggcauuauuuuguaucccagccauuuugauaggugugcaguggugucucacugugguuguaacuggcauuuccuaauggccgaguggcucucagcaucucuucaugggcuucuuuccaucugugacuuucuccaguacccaucugcucaucucuugcccgcuuucaaguuggcugguuuuguuuucuaccauugaguuuugaccauucuuuauacaugcuaucugcaagucuuugucagauacgugucuugcaaauauuuucugccacaccguagcuugucuugucauccucuuaccaggaucuuucucugagcgaaaauuuucauuuugaugaaguccagucuauccauuuuucuuuuucugguuuguguuuuugcugucaagucuaagaacuccccaccuuaccgaagacccugaagauuucuccuaucuucucucuguguuuuauaguuucauguuuuacaucugugguccacuuugcauugauuuuuauauaaacugaauucuaggucaaggcucuuuuucuuguuggccugcggauaucuaauuuuuccaacacuacugaaacacuauuuccaacacuauuacugaaugccaccacgccuggccauauauauauauauauauauauauauauauauuuuuuuuuuuuuuuuuguagagauggagaucucucuuuguuccccggcuggucucaaacuccugggcucaagcaauccuccaaccucgaccucccaaagugcugggauuacaggcaugcgccacuguguguggcugguauuuuauuuauaauuucagugucuacauggucauugcuaagcuuucuuuucucuguugaauugcuuuuacaucugggucaaaaaucaguugggcguauuuguauggacauggucauaggcccucuguuucuuuccauugcucuaccugucugucuuucugccaguaccucacagucuugauuaccgaaauuaugucauaagucucaaaaauaagauaggcugauuccucucauuuugucuguuguuuuucaaaauuguuuuuauucuugugaauccuuucccuaucuaaauguuagaauaaucucuauuucuacaaaaaaaaaaaaaaaaaaaaaaagucuugcuaggcuuucaaugggaauuguguaaaacuuguuuaccuauguggggagaauuuacuauguugagucuuccaacccauuaacauggucagucuugccauuuguuuauaucuucuuugauuucuuucaugaauguuuuguaguuuucaacauacaacuucugcauauguuuugucaguuugacaccuaggggcauuuuugagugacuguaaaugguacugguguuuguuuguuuguuuuugagacagggucuuugucccugaggcuggagugcaguggcaugaucguggcucacuacagccucaaccucccaagcucaagcaauccucccaccucagccuccugaguagcuggaaccacaggcacaugccaccacgccuggcuauuuuuuuuuuuuuuuuuuuuuuuuguagagauggagaucucucuuuguuccccaggcuggucucaaacuccugggcucaagcaacccuccaaccucgaccucccaaagugcugggauuacaggcaugugccacuauguguggcugguauuuuauuuauaauuucagugucuacaugaucauugcuaguauauacaauuguaguaaauacaauugaauuuuguaugcuuuccacccugcaaacuugcuaaacucgcuucuuaguucuaggaggguuguguuuuuuuguuguuguuguuuguagauucauugggguuuucuauguagacaacaugucauuggcaaacaaggacaguuuucuuucuuccuuucuaaucuguuugccuuuuauuuccuucucuugccuauugcacuggcuaggacucccagcacuauguuaauuagcagcagugagagcagacagcuuugccuugugacagucuuagacaccaagcacugaguuuuucaccauuaaguacaguuggcucuucuguaucuguguguuccauauccauauauccaaccaaccgcugaucagaaauguuuuaaaaacaagaaaaacaauacaaauuaguaaacaguacaguauagcaacucuuuacauaacauuuacauuguauuagguauucuaaguaaucuagagaugauguagcguguacgggaggaugugcauagguuauaugcaaauacuauaccaucuuauauaaggaauuugagcauccuuggauuuuggcauccuuguggggaguccuggaaccaaucccucagagacaccaaggaacaacuguauaauauuggcuguaagguuaugguugaugcuuuuaaucaacuugaagaaguucuccuccauuccuaauuuuaugagaguuuucucaugaacauguguugaauuuugucagauguuuuuuaugaauuaguuaauaugaucauguaauuuuucuucuuuagccuguugauuggagacuacauugauugguucccaaauauugagccaaccuuauauccccagaauaaaccccacuaaaucuugauaugcaauuauuuuuaucuauuacugaauucuacuugcuauuucauuagugauuuuuguaucuauauucaugagggauguuggcauguaguuuucuuuuuguuguuuuuccuugucugcauuugguaucaggguaauaccaacuucauaaaaugaauggggcccaggugcaguggcucacaccuguaaucccagcacuuugggaggccaaggcaggcagaucacuugaggccaggaguucaagaccagccuggcuaacaugcuaaaaccccggcucuacuaaaaauacaaaaaauuagccuggcuuaguggcgggcaccuauaaucccagcuacucaggaggcugaggcagagaaucacuugagcccaggaggcggaggcugcagagagcugggaucauaccacugcacuccagcuugggggacagagugagacucagucucaaaaaaaaaaaaaaaaaagaaugguaguguucccuccucuucuguuuucuugaagauauuguuagaaucauguugacuuuuuaaacauuugguagaauucucuauaaauguuuagaaccaucuuggccuggacauuucguuuuggggaguuuuuaaauuacaaauugacuuuugcuauagguuguuuaaauuaccuguuugauauugaaugaguuguaguaccucaugcuucucuaggaguugguccauuuuauugaagaugucagaguuauguguguagaggcauuuguaguguucccguauuauccuuuugaugucugcagggucuguagugauguucccucuuucauuccugauauugacagucugugucuucccucuaauuguuucuuugucagucuugcuagaaguuugacaauuucuuauuuucaaauaccuagcucuguuuuguugauuuucugcauuguuuuucuguuuucuguuaccgggauuucuauuccccuaucuuugugauuucccuccuuccuuccuuugcuaucauuguggguuuacuuugcucuucuuuuccugggugcucauggugggaucuuggcuuauugaguugagauuuuuccucucuucaaaugaaagcccauagugcuauaaauuucccucucagcauugcuuuagucaugucccacagcuaaguuuuguguuguauuuucauuuuuauugaguucaaugucuuuuuaauuuucccuugagacuuccucuuugacccuuaaguuauuuagaaguguguuguuaaguuuccacguguuuggagauuugucugcuaucuuucuguuauugauuucuacuuugauccucguguggucagaggacaugcucuguauagccucaguuccuuuagauugggugagauuuccuguauagcccaggauauggucaaucuugguacaugcucuguaggugccugaaaugaacauagcacucugcugcuguugggugaaguggucuguaaauauucaucauuugauggacuucuaaauuuaucucaagacucugagaucauuuacucucaaagguuaugugauacgcuaccuuuuccagacaauuccuaagugaucuaaaccccugcugaguucaccaaguggccuguaaaacccuaugaugauucuuguugaugggagccaucuucccccacuaguaggugugggccuuucuuaaggugagggccuugagcucgcaccaguucaaccuauggcuguaugaaaauuuucuggcugacauuuuuacgcuuguaccuucaagaaauauaacaaaacaucauuuuucuucuucuuaucaagucauagaaugcuaaaggcagcgggaaucuagggugaucuggucuacccucucguuugacaggugaagcaaugagguguugcgaaguuaaacugauuaguuuuuuuuaauuuuuuaaaugaaauuaauauacguuaauuauagaaaaugcauaagaaaaaggggaaaugcauaagauagagggaagcaaacauuuuuaaauaaaauuuauauaaaacuuauaaccaaagaugacuacuauuuuuauuuuggaguauacucucccaauauguuuucaaaagcaggaucacucucuaugacugcuuuaaaaucuuuuuuuuguacuuuaacaacagacaugaacauuuuucaaaauauuauuucuaauagcaaaauaucauuccagauauaugucugaugauacaguuuucucaucauuuauuuaaugagucuccauugggugggcgugcagguugugacaguuuucucuguguuaaauaacacugugaugaauaucuuuuguguacaugcaugaugauuuccuagaaaugggacccugggucagugcuugugaacauuuuuagcuucugagccccauugccaaguuggauucuugaaauuuuuuguuuguuugggcagcuuugguuuuguuuuuuuguuuucuuuugagauggaguuucgcucuuguuccccaggcuggagugcaauggcacgaucucagcucaccgcaaccucugccucccagguucaagugauucuccugccucagccucccgaguaccugggauuacaggcaugcaccaccaugccuggcuaauuuuguauuuuuuaguagagacgggguuucuccauguuggucaggcuggucucgaacucccgaccucaggugaucugccugccucggccucccaaagugcugggauuacaggcgugagccacugcgcccagcgcagcuuugguuuuauuuguuuuguuuauaguggaggguuagacaugaaaucaacauagaagaugacguaaacuuaugacuaagccuggugugggcucucgguguucuggggcaugagcuagaggauggcuggagccagguagagaccgcucccuuccuuagaaugucaccuugcugacaaggacagcgcugugagcauccacaccuuccugugagguaucuggcauugagccuggucaggaaacaggaagacaagcagguuccauugagccugggaccuggaccuuguaaagccagccacccagcccaguuuuacaggccaggcaacaaagggagcaaccggcuggacccaggccugccucccccgugcagacccgccgugagaacaccguguucugaauugagacgugccuugcacucacuuugucccaguaauugcccccauaaaauagaccuggacacuaagaggaaacuucccauauuuggaaacccaguccugccugcuuuuuauagcuggugucgaggacaagagaaccacaagccguggccagucugcugagagaccacugagggacagacggguugugggccuggagcagccccggagggaaggagcauuugaaaguggacagguagagcccaggcccagagagccccagggcugcuaccaggaaggccagcgcaucccuccagguaacgggcagcuccucggccacagccuccaccccccaacacgugggauucgggcugcaauggccuacacaucuuuuccucuuguccguguuccaucugucuuucuucuuugguuuguagagagagaagaauuaauccagagcgugcuggcgcagguugcagagcaguucucaagguacagagucuucuaaacuuacaaccagccagagaugggcacaucuuucucuaagagcgagggcaggccccaggcucugaggcuggccuuggccggcaagcguggcugucucaccugccuggaggagcugcccgcacgguggaagccuucuguggcuucuguaacuaagccagcuuggauggggcccaggaaacgcucaccuuagaccaaagaccauguugagugggugcauuagaaugugagcucgugaggucgagaauguucuccaccggcucuucugggaugggagaacaagcuauaagaauuggcuccacuggaaaauaagcuuccucgcugagcuucuguguaguuaggagacuuccuuuucaucggagucaucccaacaauccugaccuggauaccguauuuuccauuucucaaacugacuucucuguggcgucuuacugcccagguuaauuaaaauagugaaaagcacagacgggugggauuuuuuaaaaaccuuugaauuggccgggugcgguggcucacgccuguaaucccagcacuuugggaggcggaggcgggcagaucaccugaggucgggaguucaagaccagccugaccaacauggagaaaccccgucucuacgaaaaauacaaaauuagccgggcgugguggcacaugccuguaaucccagcuacccgggaggcugaggcaggagaaucacuugaacccgggagguggagguugccgugagccgagaucacgccacugcacuccagccugggcaagagugacacucugucucaaaaaacaaaacaaaacaaaaaaaccuuugaauuguuuaacugacuggguuggagccuccagagagcacaacagguccuccgaaggugucugugcccaucaggggaaggugcggggacuggaccaucucaacugcaugagcagagagagggccauguguccaccccagagagcuuggguccacugcucaggcccgaagaaguaaauaugcccaaccagcccagaaaauacaccucaugauacuuuggugauucuuuccuccccaugggacaugaugauuucugaaaagcaaguccuagcauguuggcaccucagacccucaccagcccaccuagaggccuugcccaugcccacagcagggacucaguagguguuugcuuaaccgguuuuggcucugagaauuuuaagggucauauuuacucucucuuuucuuuuucauuccuagagcauucaaaaucaaugaacugaaagcugaaguugcaaaucacuuggcuguccuagagaaacgcguggaaugugagugacguuucuguuuccuuuuugcuucucuguccuuuaaccucuauucaaauuaaccacuuggaacggggaggaguucagugccgaagguaaauacaaauaaaugucuuuucuuugugaaauacuugaaaauuaccuuugauguuaacaaaggcuagcacagugacuaacuaagcauuuuauuucuauuuuaaaagaagcacagcucaugguauaaagcauucuuucagccccaaagaauaaaaaugaacacacgaagccuuccgcacuuagccccucugagaaccucugcugagugucuugucugugucuuuuuguguguaaaugaagacauucucugcacacugaucggcacccugugggucauaauuuuuuggaauaugucuacuaaguuguuaucucuugguuucugauacagucuggauguccccuccacaucucacguugaaaugucauucgcaauguuggagguggggcuggugggagguguuugggucaccaggcagaugccuccuaaauggcuuggugcucuccuugagauagugaguucucgcaagaucugguuguuuaaaagcacguggcaucucucuacccuccugcuucuccguugccuuccaccaugauuggaggcuucucgaggccuccccaagagccaagcagaugccggcaccaggcuuccuguaaagcccacagaacugggagccaaucaaaccucuuuugcuuauaaauugcccagccucagguaucucuuuauagcaacagaagaacagccuacuacagccuccaaucaccaccaaaggaaaagcagaaaaaggacuagggagccaaggagugucgauucaaguccugauucaaugaucacaaagcucaaauucugggaagaaaacagcuucaagucacccacccuuuuuguccucauccauaauaucaagaucaaugcuugaauuccauaggccucacaauucuguguuccacucacagcuugacaagugaacucuuugucaaugacaaggcaaagguuaaugauuaacaggcacuguauuuaccaacuuaggaacuaaauaaacagaauccagacaggauaccauuaagaguugcagcaucaccaaaaauaucuggcugauugacugaaugucgucgcuuuucuuuuucuuuuuuugagagacagagucuugcucuguuguccaggcuggagugcaauagcacaaucuuggcucaaugcaaccuucgccuccuggguucaagugauucuccugaaacaugauuuacauagucagauuuauacuuuucaaaguguguugacauuucuaaaaauguauguggucacuggaucuucaagacaguuucauuuuccccauugucaacgaggaagccacagagagguuagguaaccucaaguucacucagcaaauuagaaaaauaaauaaagcugggacuggcacccaggguccuggccgggcugcugucacggccugcuaccugcccuucuggaacgagucacuucccugcacaccuggcugaagaggaccaggcacuccaugaggauuccuugauaacgcagguuagaaagcuaaagcugcaagcaacagaaacugaucguggcugcuuucaacagaaaaggaguuuuucccuaaaggauuuugggaagcuuccccagauccccaggaaggcuugggaacagggcucagagguugugcagcagcaacaauuccccaaaucccgugcagagcugaugcugugcggaugccugugcugccgucucugagccccagaugcggcaccagcuccccuguacuccucacucuggaccuaggucccccggaggcuccacaaccacuuaugcagauaucaggcugcuucuccaugucacuggcuacagguucaaaaucuagacagagccaggccgcgcacccaaggucuagcugcaaggcaggccccacgaagggaggcugugaguauccugaagcugccucacaaagcaccacagacugggaggcuuaagcaucaaaaacugacucuuucacagcucugcaggccagaagucagaaaucaaggcaugagcaugacuggcuauuucuggaggcucugaggggcccugguuccaugccugucuccuagaaccuugugguucccagcaauccuuaccguuccugagcuuggaaggcuacauugcuauaaucucugccugugucuacacgugaugacauucucccaggaugucuccaugucaacagucucucucagcuaggucuuauaaagaugccucucuuugaauuuagggcccaaccuaaauccaggaugggcccaucuccagaucccuaauggauuauaucugccaaggaccuuuuucuacauaaggucccauucacaaguuccagggaguagguugugaacagaucuuucuggaggacacaauucaacccaccacagcgaguguuugcauuuccauauucugcacugggaggcuggcucagcucuccaccaagccccaugucgcagggaauucuccaaacuuggguagggguuugagccaaagcaugcaaaaaaggcuugcugcagaguccccaccccucuuuacggacacaaaaagccacgcagucacuacggggcgagugugcagaugcccgcgggcagcaggugccucccaccucuccuccucucuccagcaccuggguuuuuccucagccuuccccaucuccuacgccccaccuggaagccagugccagcuccccccaugcucuucccggaaagugcaaacaggcaaguugaagaggccaugucguaacucucaaaacucuuacagagaauuaugucgcccacaacaagaugaauaguaacccugugugucuuugaauaacugacccuggaaaauaaccaucaagccagaagaaaaguguuccuauuuuaccugcaaguggcaggugagucgaagaccacugaaggaaauggcccauaggaccuuccccccuagccuguucuggcugcggaauucuccaaaauuucucacuucucagagggaagcaucuucccauaaaacccucaguaaaugcacauagauggccuggaaaaggacaccgcucuugacccaccgagcucaggcucacugcacugaccaaaauuccuggcgcuucuauggguaaaaccgguugugacuaguuguacugauuucuagcaccagagaccuaggacugcagaaaugggauugagggagcucaccucucuaaggaguagagaaggaggaacagucuaggaguuguggaggguaagggaggggcuugggugaggucaggggggacucuccucaguccuccuggcugcccuccuccccuggcaugcaacucacacccccaccccaggaggcagccauguccagacaggcuguccuccuccugaacuccaccuggcuuugggcucauccuccccgggcacuucuggcugauggcuccccacucuccagcggaugugcuuuagcgggagguggccaggaugcugcaccugugcugagccccagagauucugaguuccagagacacuacaagggcagcagagccuuaacccaaagaugcaagagcccagacauuuuaggaagcuuggagggcagaaacggaaaguccuuuugaggagagggccugcagcugaaccucucacgcaggccacuggguaggugcgcgcccagcuucucagaaggucagucccaacccugcacggcugccagaagcuagccagauggggaaggcggccaggagccugguccgacaccccgaugcacagggccugggccagaggcagaugcucccaucuacauaugcacacacacauauaaacacaaacagagaaaggugcacaugcacucacauauacacaugugaaaucacacaggcaugucaggaugucacauauacaugcacacguguaagcacccaggcacgugcagauacauucauauauaugaucacauacccacacaugcgcacacacagcugcuucugcuauacaugagcugcugugagcuguuuuguuuugucuugucuuguuuuuguuguuguuugagacggaguuuugcucuuuggcccaggcuagagagaaguggcgugaucuuggcucacugcaaccucugccccccgaagacaggacacuucugucucagccucccaaguagcugggauuauagcugcccgccaccauguccggcuaauuuuuguauuuuuaguagagaugggguuccgccauguuggccaggcuggucucgaacuccugaccucaggugaucgacccgccucggccucccaaagugcugagauuacaggcgugagccauugugcccggccaagcuguuuucugccucuugaguuaaaggauucauccacuagaacuggccaccuuaaggccauauuauauugugguggacuugucuuaaauggaauuuccugcuucuucuuaaauguauaauuccucugaauugaauauaaauuucuucauuucuccucauugacuuucaaagcucuucuuccuuuugauauacaaaguuuagccuuguucgagagaucugggauuucccuuacguuacggauuauuuuguaaacagaacacccaggcuccuccccucauguccuggcuggaggugaaacauuaaaaagagauuuuaaagcagggcccuuuacucccuuccuuccugguuuguggccagggcacagggcagcucugcuccauccacccuuugucccugugcucugggcuuggaccaaaaccuaaacacagcgugggccguggcaggagcugaccggcuggggcaaaguuuaacacaggccauacaaacagcccagagccuggaugcuagaaccaagccuugcuuuucucugucacuccggaagugugcucuacgcgggcucuuuagugaggcuccuggaggaaguguugaaacacaacucuauucauacaugucuuuaaacagcuuucacuagcucuguagccaaaggacugggccugccagguucccggccucuugcuggagcacagugaggcuggggaaggagcacagcacagagccuccugagccucggcucagcucuccccgacccccagcucggcucuccccacccuccggcucggcucucucugacccccagcucagcucuuccccaccugccaggacgauuuccccaaagccagcgucugucagaaaaucacccuuaguuuuuccugcagguggccugugacuuguagaagcucacaaaaaucucuuucaaagcccuuuuuuguugcuguuuuguuuuguuuugagacagagucucacuuuaaugcaguggagugcaguggugugaucuuggcccacugcaaccuccaccucccggguucaagugauucucccgccucagcccccagaguagcuggaauuacaggcagccugugaccacgccuggcuaauuuuuguauuuuuaguggagacgggguuucauuauguuggcuggacaagcuggucucaaacuccugaccucaggugauccaccugccuuggccucccaaagugcugggauuauaggcaugagccacugcgcccggccuacaguccuuuuaagaggacagcccgggguuuccagauaauacuagccccacacacaggcauguccuaggguccacaccuggucagcgggaauaacaggcagccgugggcugggcucccagcccccuagcaggguccagugggccagggagccucugcuuugguuuguggugcguggucugugcccgccuguguucagcguuugaaggcagaggagcgggccaugaugggcagagccgacguccaggcuccacgguagggccguccugcugcugucugcagaccucucaggcuugaggccccccgccccacaggacuggcccgcuccucccucuggauugagguggagcagggcuggcagugggucgaagaggggagcuguggaaucuuccccaaagcagccggguguccuggaaaggccagggagugaggaggcaggacccccggggacacaggcacacacauccaccacaugcucaccucugccuccuccugcagaccuccccgccagccccgucauuucauggcaucuugcuuucucuucauugaggaaugcacuuuugcaauguuguuacucacuauccaucuacuuggccaacagccucuucauaaacuuaauugccacaaauucugcaucucugggaugcaaacuagugaagcugugcugugucacccaggaggcuuaauuuuaacaucaccucaauagguagccagggaagcggaucucgguggacucugcacugucaauacaaacgcuaugcacccaucaaaaaccaugagcuggcuuaaaacagagccuuguauggacaugggaaaaaaauuauagguuuguugcaaacucauuuagcagcaaaaaugugaucugaacugacaugaagcccuugguauuuauuuauccugcucaguaugauaaauagcauuuuccucgggggauaaaaagaaaaacgugagcugcgacagcagccacuaacauggggaagggccgugaccuccugaugagugaaaauagcaaguuagaaaacaacaaauuuuaucuuuuaaaauuaauaauagauauauagauacauagacacacacaggauggauagaagcuagauagauacauacauacauagauacauacauagauagauacuauauagauauguaaauagaaagauagguagaggcugggugcaguggcucaugccuaaagugguuccccagcacuuugggaggugaaggcaggaggauugcuuuagcccaggaguucaagaccauccugggcaacauggcaaaaccccaucucuacaaaaaauacaaaaauuagccagguguggcggugcaccccuuuagacccuguuauucaggaggcugaaguggcaggaucacuugaaccuaggagguaaagguugcagugagcugugauuguuccacugcacuccagccugggugacagggcaagccccugucucaaaaaaaaaaaaagaaaagaaaagaaagauagguagauacauagaauggguggauagagagauagaacggauagaaaaauaggauggauaaauagaacauagguagauacauaaauaugaugaaugcauagauggauggguggauggauggauggauggauggauggauggauggauggaugaauggauacauagaugaauggauggauagauaguauauaaauggauggauggauagauacacaguagguagguagguaguagauagauagauagauagauagauagauagauagauagauagauaaacaggauagauagauagauagauagauagauagauagauagauagauaaacaggaugaauauuuagaaggcugggagugggcagaaagccuggaaggacacacauuaauacaaauaauauuaacugaguuguuuucugggcccauaggauccuagacaaguuuuuaaauauuauucuuugaagugcuauuuccuacacuuccuacaaugauaauaggauauuuuauauucagaaaaaugacauuuaagacauagucaaugguccauggaccuuggacagagggcccagcugcccuguuugcagucuacaccgcaugcccaacccuuccccagaucuacucacuuucagaaugugcugccuuccacgugugaaccagacugagcuccuuucugccacugauguugaauuguccauuugcucacgucaguguccacguggcaaauccacagggcaugggugggauccugcagucuagacaaagccaaggagcaccgcuggaggccacguugggcuucccaauccacaugcaaacccaaaauguguucuuggguaccuuuucugagaagacagccuguggcaugcaucagcuuccuugaggggcccaugaugcuggagaaaacggagacccggcuccaaaggagaauguggacucuuagugguuggacaaagacgucccgaccucagaccucagguacccuguguuuccccagcggcagcucaucuggacucggccaucacgacagcgaccacacuggcuccagccacaugcacuuccggaccccauguccucuagcuguuggguagaagagggguggagaagguuucuguagcacagaaacacaucagcaggaccagauccaaauauugcacucuccagauucuucguccuucuggcagaaagaagcagugucccgggaacaugccccuacuugaccccugacccuggaaacgccucgaaacccacccgggaggcugauuccagcuagucugcccugggccacuguacugggagaguuucuuuccggagcugcaguacuuccuuuggggugggaaggaguuguuacaaacuagccaaaggcucugaguugcuugguuuuuccuuuagaaaacauuugcuuuuuauuuuuagcaguuauucagagccaaacuucaugaaaaggggaauagagugguaucgugggaguauccuuuugcauaaaaacuaaggugugauuacaaaguaacaaagcuaaucuuuuuuauuucaauugguuuaugaaccaacucuaauugaaaagccgugcaaagcugcuugcuucauggcagcuuuucugggguaaacgugcagucagccaaggguaaauaucuugaaguuuaacgcucgcucggaggcauaagcuccaguuuguuuuugguugaaaaauaguauccuaacuguugagguacaccuuugcagugggacucuguaacugcccaagggguucacccugccugcuaccuaaacagagcucauucaucaagacaggggaacugcaauggagaaagagccauucacccagugccggcugugcgggagaccagaguuuuauuauuccucaaaucagucuccccgagcauucggggcgcagaguuuuuaaggauaacuuaguggguggugggaagccagugagccaggaaugcugauugauuggucagggaggaaaucauagggaguugaagcugucugcuuuuuuuuuuuuuuuuuuuuuuuuuugagacagagucucacucugucccccaggccagaguacaguggcgugaucucggcucacugcaaccuccgccucccggguucaagcuauucuccugccucagccucccgaguagcugggacuacaggcacuggcacaccaugcccggcuaauuuuuguauuuuuaguagagacaggguuucacuauauuggccaggcuggucuugaacuccugaccucgugaucugcccaccucagccucccaaagugcugggauuacaggcgugagccacugugccuggcugcagcugucuucuugcacugagucaguuccugacuggggccagaagaccagacgagccaguuuaucuaucuggguggugccagcugauccaucaacugcagggucuccaaaauaucucaagcgcugaucuuaggagcaauuuagggagggucagaaucucguagucuccagcugcgugacucuuaaacuguaauuucuaauccuguggcuguuagucucguccccaggcaagaagcaggucugcuuugggaaagggcuguuacagucuuugucuaaacuauaaacuacaaaugaaguuucucccaaaguuaguucagccaaggaaugaacacagacagcuuggagguucgaagcaagauggagcccgcuaaguuagaucucuuucacugucucagucauaauuuggccaaggcaguuucaacuccaggaaugugaucaaguccaaguucugcugauccucaacuuugccuauuuauuucucuucuguuuuaagucaacacuuucuccuggugaaacugcucuggaaggacguuccaaugaaaagcuuuucccauaaugagaucguaauccuugcugaaaacgcuuugccguucacugcauuuuaaugcucuggcaccacaugugcccccuuuucuuuuugggauaaaagacgccuuugucccauguccucagcuggugcuuagggguauggagcaaaaagugggugccagaguugagauucagggaguggagaguggggaggagcuucugccuucugaaaacugcccggauggaugcgguagugcagcgguggccacggcacaugccugcgaggauagagucaguuguggcugagcuaagcgcggaagugcaggcaaaaccugaguaucggcagccagggcagguguggggaccucugcacugagguauauuccucccugggagccacagggagcccuuaguuaccagccuugagagauccuccacauucguccgugguaacccccuugcugucucucucucugucaccaguggaaggacuaaaagugguggagauugagaaaugcaagagugacauuaagaagaugagggaggagcuggcggccagaagcagcagguagggucugcgcuggggccacgggcggccgggccuggggagggcuccccguaccaguugggcuggggcugugggcuuuguuugccuaaaagaaaggcuggugcaguucgguacaguucaggcuugggagagugcagucuggaggcagccacccugcuugcgaccugcuugucaguggugugacuuucuucuaacaaaagagcacgcaugggccgggugugguggcucacgccuguaaucccagcacuuugggaggccgaggugggaggaucaccugaggacaggaguucaauaccggcuuggccaacauggugaaaccccgucucuacuaaaaauacaaacgguagccaggcaugguggcacaugccuguaaccccagcuacuugggaagcugaggcgggagaaucgcuugaacccaggagguggagguugcagugagccgagaucgcgccacugcacuccagccugggcucgacagagcaagacucugucucaagaaaaaaagagcacauauuggagauaggggcugggaagacgauuucacagaagaagaguccuccuccugcagauccaagccuuaggagcaauguguccagcuuggaauaaguugauauccacuuuuaaagacagaacaagaagaggaaaagcauuaggggaggagccuccuguugcccccagggacccgguuccuugugugauguucccacuggguugcauuccagcgagggcuucagcacuggggacacagaagucauucuccugggaacaggcauccuucacaggcgcuucggggggcccagugagcugugacucguggggaaaaugccccagucuccacgaugccaccuccaaagucaguuuuguguacagcaggacucuuuacuggagccagggucaggacacguguggaugaaccacgaccaaacuggggauggaaaugccgguaguagcaaagagacggcggugaugaugagcagagcgcaugcauugaggcacuuacugugugcgggcgcugugcuuagugaggggcacacaggaccugcucacaccuccgggcuuugccuccaugcccgcuggugccagcccagacaccacaggcauaugauguggcucaugguuccccagagugccacugcccggccucagugggauuuaauggggacuaauggacugagaaacagcccugugcaauugcacugaguugucucagagccaccuggcaugcugacgaucauucccugauuuugaaauugagggcaaucugcuuauugaggaagcguggcaagugaaagggucucagaggcagaaggugaagggaaagccgacgggccucaucugguccccucaaagccccgggggccuggccucggggugggcgcagggaggaaggccgagcggaaggaagcaggccuugucugagccacgugagagccuguccuacagggaccgugccacgugucugucccaugcacucaugggcucauuuggaguuagggaugucucagcccaauugacuuaggggaagucaggccauaguuuguggccauggaaaguugugagugaacaauccaucuucgucaucccugugcuggaggcucuuuaaaggacgggagacagagucucucauuugugagccaaggaagagcucccaaguugcacagggacggccacacagcuggggucccaaggcugggaccuggcaaggcugggacccggcuuggcagccucagacacacagcaccuucaccuguggcaccgcccuuggccgugggcucuacguggcuugguucagcccucuggcugucccuugcgccccaggugccauggcugcuuuggcaggagggugguguuccaggguggugcugccuggcaggguuccccucugcccagagccaggcggagauggguggccucaagcuggggcugcggguguagcagggccagccuuuccagccccaccagcagcacgaggggaagaggacaaaaacugaguucuagucuucagccugaaaccagacucccugaacagcggccucugggccccauauggguuggggaacuccaccgccccaaggggugugucuggagccaggccaugccucccgaagcugcccccagcuccucacccacaacugugugucccugagcacuuucuggagguguuuguaggaugcagccucuuaucccuuaaacgacugcauuuaccgcccaccuacagcagcaggagugaguggugagacagccuccggccucacaggucuugccucugccgugccugaugggcacccgcucuguagaaagcaaggcgagugcucggaucacacgccgcuccuggcgugguuucuggugugcacuaguccugcaggucagguugagguugcaggggggaagauuauuuuuaucgaaguuguagucauuuccuggggcugcguaacgaauucucauaaacugggcagcuuaaaacaauagaaauguauucccacauaguucuggaggccacaaguccaaaaucaaggugccagcaggcccugccaccucugaaggccccaggggagggaccuucccggucucucuuggccucugguggcugccggcggcauucucugccugcuucuucaccuggugcucccauccguucuguccaaauucccccuuuuuguaaggacacccauccuauuggaguaggggucacccuccuccaggaugacauccccuuaacuacaucugcaacagucauguccccaaaugaggucacccucagaggcagcaggguuaggacuucaacauacaacuuuuggggggagauguacuucagcccauaacacaccacgugggaggauaacaccgauuucagagcuugcagaggaagccgccaggaacuccagugagacaucagcccccaggugccugucaggcacgccgggcuguggggggcaccugggcccaucugaguaacggaggcgcauccgcacuucccccaggaguacauuuuuagaacccacagcgccauaaaccaaagacaaggagacuuccuggugccccgucagcuucuggaggcgacguucucggcugacagcucuggcagccuccccuguaggugagagacagguaaaugggacucuugcuuccaaaacggaacaggguaaaaauucucaagcguugucgacacauugagaaaaaacaaauccagccuccugggcucuggucucauccccagccgcgucaugugccccaggccggcguugccacacaugaaaccccuuccuguuuuucuauguagaaaggaacucagaauagagacacugagauauucguguugucccuuuugucuuugucaacagcagaguuacaucuuacucaugagagcccuguagcaauguggggacccugggaccagucucaguuaagcuggaacuuccccggaugacuggggagaggagcugcaaaaggcaggguggggguggggggccuucccgagauggcagcccagccagaggccagcguucuugccucugggaagagaauaaaggccccagacaggguggagcuagcucagccccgugccacacaaauggccagugugagccugaaauguggagcuacauucagcccacauagcacacccugguggggccucggagccagggguauggauccaccagaagcugccccuugggaacagcaguggcaucgggguccggcacacagcacccgggagcagguggccguccccugacacucacgggcuagguuucuccugcuuuucccucaaagaggacagagguccaacugccagcuuacauuuagggcaggggcaggggcaggucuaccccaggggccacggccacucuggcccccagcacugugccaggcagagagcagagcauggaauaugggguucacccagagcuggggagucugcaggagccugggguggcaacugagggcucagcguucaucccaaacaaauggccuugcccacuggccuaagccccagagaagggggauggggaccccaggaaaugaaagcaaagauaagcuccaaauaggaugaaaagaaagagcuccaugccagcugcucuguuugcugaagacgcugguucccguggcagcggagcgcagagagaggggcugccuggccaggcagggucagcgggccccagcagacccuccucugcucccagcucugguaucugcaaggaaacagcgggauucgaacagucaaacugucuugcucggugaagauuuccauaacccuccuggggaaugcaggagacuuacagagacagcacaugugcgaauguuuacacaaaacagguuaaaagcagcgaagaaaucaucaucaugccaucuauuuuuuuuaacuacgcagaaaacguucguuacuucucagaaauguguaaauggaauuucucguuuaauggaugacaauggaaaucauuugauuggugcauuuuguugguugguuuuguuaauacuuugcugaaucuguuagcguucccccuuacacaucaaacugugguagcaacucugauggguuuugcaagcaugaaacagagggaagggcuaccaaauggaucuccguggagcggugguuaucacggggaagagacggcagcaugccgagaaaauaacaccgaagccucuuuuuccagaaaggaaauagauugauuauucuaguuuugaaaauagcacaggcucauuggaaaaccuccaaacuacacugaugggagcugaagggugcacaccgaucaugacaacagccggcaauguccccccaguuuaaaccuggacacgaggccuucuagauguuuuucugugcauagauaccuuguuuugaaaaacaacuaaaacaugcguuguguagucuuuuuuuuuacuaguggcauugugagcaauaaauagauuaaauuuuaaccagcguacagcucauagauuuucccagaaggccacaaucaagcacucuuuuuaaaccuaccgaaugugcucuuucuuccucguagcguggcauuuuuuggcacuugcuuucaguacauacugugcauagcauucuuauuuucccuuuucaugucaaguuuccucacuuggcauaauauccgugaugauccuccuaauggcauaauaguccaucaugcggaggcacugugcugguuuaaaccgcuucccgucuugggacauucagguggcuucuagucgguuuuguguuuuuguuacagcagaucacaccacggugaauaucugugugcauagagcuguuuguuccuguuuaauucuuggcuuaagauaaauuccccaggauagauaugugggcuuaaaggauacgaauuucuauauggcucuuacugggcaguauuaacuugcucucccagaagaaggggcuuuauuuacaaaucgcaggagcuucugcugcauuuagcucccugagugcccccauagccuggugaaugucacacaagccaggcgugacccccacccaccaucguccaaguacacagggagccuguucacuuccaagcaaguucacacccauagggugugaacccagaucggcccagcccccuggugcacucugcugcaggggcccaagagcagccagaccuccuggggcagcugcuccucauucagccucuggggaccacccugaagccagcacacugcccaaccggaagguggcuuuccucugaaacaugccuggcucacuuugcccugcuccuaugugggauaccucgauaccaagugcuaaacaaaaacagagucagacagaaaacucaucugcuaacauuacauguaacagggaaaguuggaaacauucuaaaaguccaucacuggggacuggauugcuaacgugugcuauggccacacccuggagaaacuuggaaaaugaagcuaagcucuguggagcaacuugggaugaguucaugauauguuagaugacaaagcagguugcagcagacugacuuuggugcaauuccaucuuuguuuaaaaguacaaaggggcugggcgcaguggcucacgccuguaaucccaacacuuugggaggccaaggcagguggaucgcuugaagucaggaguucacgaccagccuggccaacauggugaaaccccgucucuacuaaaaguacaaaaauuagucagguguggcagcaugcaccuguaaucccagcuacucaggaggcugaagcacgagaauugcuuaaacccaggaggcagagguugcggugagcaaagauugcgccacugcacuccagccugggcaacagagugagacucugucucaaaaauaaauaaauaaauaaaaauuuuaaaaaguacaaaggggcggggugcagugacucacaccugucaucccaauacuuugggaggcugaggcagaaggaucguuugaaccuaggaguucaagaccagccuggguaacauagcaagacccuaucucuacaaaaaauaaaaauuaaaauauuguuaaaagguaaaagcggccacccauguguguccacacuucaaaacauucuggaaagauacaccaaacuauuagaagugauuuccagaguaugggauuuagggaaauaaauggguaaagugaggacuucgguuuucauauuuugguguuuuuuuuuuuacuuuacucuuguguuguuuagauuuuuuagaauguuuuucuuuugaaaacagcuucuaaaagagaagauagcccucaacaucugacuuuuuuuucuuuuuuuuuugagauggaguuucgcucuuguugcccagacuggccaggcuggcgugcaguggcacaaucucugcucacugcaaccuccgccuccuggguucaagcgauucuccugccuuagccucccgaguagcugggacuacaggcacacgccaccacgcccagcuaauuuuuguauuauuauuauuuuuuuaauagagaugagguuucaccauguuggccaggauggucucgaucuccugaccucaugaucaucccgccucgacuucccaaagugcugggauugcaggcaugagccaccacgcccagccccaacaucugacuuucuguguguuuuccaagagucuagugugaggucagaggucagacaggucaucagggauuuugcuucgagugaguugcugcugcccugacuccucucccacagcaaauaagaccacacggggcuuggggguuggguuugucgcuugcuuuugcugugcugagggcuucaccagacugaaacagcaggaccacagcucaucucugcuccuucucucuaggaccaacugccccuguaaguacaguuuuuuggauaaccacaagaaguugacuccucgacgcgauguucccacuuaccccaagguaagaugagauuccggcccagaagaagcugcagcuguguccccagccccacgcccagcccuguggcccugcggccagacccugcuguguguacguucacaucaaccgccccucccagcccugggccgcugacggugcggguuacuuuaaggcaaaguauuuuuucucuuugacauuuguuuagcaaaagugaucccagaccauaccuuccccugcaaggacauaacagcuccgugcugcugucugcccggccccgggagcugaccuggguagacaguuuuuacacucaaacguuacuggaaagaacuuuaacguuuaacugaauuuuuaaaaauccauuccauuggcccuugucucugagcaauucuuaguuguccuggcaaguuuugcucuuuugcacaaaaguguucuuaguucuaagagaagcugugacguuggugaaguagcaauggcauuuuugaaauaacgacaaaaggagggucucgaguugccggucacccgcucaacgccuucagcugggaagcaggcaaaaucccggcccaccugcuuuuuuuuuuuuuuuuuuugagacaguguuucacucuuguugcccaggcuggagugcaauggcacaaucuuggcucacugcaaccucugccuccuggguucaagcaauucuccuaccucagccucccaaguagggggcauuacaggugcccgucaccaugcccaguuaauuuuuuuguauuuuuuuaguagagacaggguuucaccauguuggccaggcuggucuugaacuugugaccucaggugauccgccugccucggccucccaaagugcugagccaccgcacccggcccggcccaccugauuuguaaugugcucucaugcuaagauucagggggcacagcuuccagagacagcagaggccugggcuaaacacaggugggcucugccacugccugcgguucaagugauggcagagccuuccacagccuccauguaggccacugguguccauuaguccgugauucuauccacgcaguuccaaacaauguccuggauauugucagguucuggguggauuugggggguuuuuguuuuuuucuuuugauacugagucucacucugucacccaggcuggagugcaauggcaugaucucagcucacugcaaccucugccucuuggguucaagugauucuccugccucagccugaguaggugggauuacaggcacccaccgccaugcccggcuaauuacuguauuuuuaguagagacgguguuucaccguguuggccagguuggucuugaacuccugaccucaggugauccacccaccucagcaucccaaagugcugggauuacaggcguaagccagcccagccucaucugagauuuuugaauggagacuagugccuuuuuccauuggaaaauaugccccgcgcuucucaggauccugucccagggagccgugaagcacagccuagauccaaaauaaaaggugucagcccuccagaucuguccccuuacaaaaaacagaaaaacaaauauccaguaagaccuaggagaagacagugugcaauaccaaagcaguguucuugucuucuguauagaaccacagccuucuguccuugugacagcuuaaccuaaagccugauguccucagaagcaacccaggggcaccggccccaucagcaggccugcucuucuagcucucggcagaaaccaggaauggguuccagacaggagcaucucagaauaacuucuuaggugguaucugaauuuaugccaagugaauuuuacccccacacuucacuuuauugcccuuuuuuuauuauuauuuuugagauggagucucacucugucgcccaggcuggugugcaguggcacgaucuuggcucacugcaaccucccccuccuggguucaagcaauucucccaccucaggcucccaaguagcugggauuacaggcaccugccaucaugccuggcuaauuuuuguauuuuuguagagucgggauuccaccauguuugccagguuggucuugaacuccugaccucaggugauccgcucgccucggcuucccaaagcacugggauuacaagcaugagccaccaugcccagcuauuguccauuuuaucaucgggcuuguugaggucuaauuuacaugcaguaaaguuauuuaggcuuggaguacagugaauuuugacaaacuuguuuaguccugugaccuccaccacaagcgagauauggaacauuucugucaccccaaacccuccccucugcucccucacccugccucuggcauccaccgaugggaucuccacccguagcauuggcccuuuccagaaguauguggccugugagucugacgcaggugccuuagaaagagaacgggagaagcugggugcgguggcucacaccuguaaucccaacacuuggggaggccaaggcggguggaucaccugaggucaggaguucgagaccagccuggccaacaucgugaacuccccaucucuacuaaaauuacaaaaauuagccaggcaugguggcgggcgccugcagucccagcuacucaggaggcugaggcacgagaaucacuugaacccaggaggcagagguugccgugagccaagaucgcaccacugcacuccagcgugggcaagagugagacucuaucucaaaaaaaaaaaaaaaaagaaagaaagaaaaagaaagagaacgggagaaagaggagaaauaucucagcaugcacaucacugucacaggcccacggcgccugguuaacacggaacuccuguccuuucuaguaccugcucucuccagagaccaucgaggcccugcggaagccgaccuuugacgucuggcuuugggagcccaaugagguaagugcggggcuugcaggcaccacgucccagggggaggcagcucaggaucuuggacgccagugggaccacccccaucgcucuuccuccuucuugcuuuuuccucuucuuuuuaaagacugaaaaaaaaaaacaaaacuuguuuugccagguuuuaguugaaacuaacuaacacuuuauagcagggcccaggagacuucacagcaaggggauucugugagugggggagacggcugucaggggcagggaggcuccacccagggcuccugauggcgcugggccccccgagccaucugcucauccugcagacccucaugcacgccgguggcagccccgugcugcagaacaccccugccaggagcaaaucucuccucaaggaaggggcugcggucagagugcucugcucugagagcagugucugcaaaggcaaggcacaggcaaccggcugccccagauaaguggacaugugggauuccgggaacugugucaccuucugcagcaaggcuugaggccaggaauuccacacuagccugagugauaugauuuggcuguguccccacccaaaucucacccugaauugucauaauccccacgugucaagggcagggccagguggagaucuugaaucaugggggcaguuuuccccauacuguucucgugauagugaguaagucucacgagaucugaugguuuuauaaaugggggauugucuuuugccugccgccauuuaagugacuuucuccuucucugccauucuccaugauugugaggccuccgcagccauguggaacugugagucccuuaagacucuuuuucuuuauaaguuacccagucucagguaugucuuuauuaacagugugagaacagacuaauaagcugggcaacauagcaagaccucgucgcuacaaaaaaaagguguuaaaauuccuauuugcugaaaaauacaagaauggggaauuuuuuguuucaucucauuggcuaauagacccccucuuuucacaccccaaaaaaugaaaaaguucccucauugcagaccucggccucagcuguuuucaacgcaccaaaaucuaaggacguuuuccugcuugucagcaacacagaaaaugcacaaggcuccucagcaagcucaccugugcucuuugacaagcucggccgcagcgaugucucugcaaagggcagaaagugggcucuugccucuuggcaccccugaggccaggcugcugacaccuggggcacugcccucuccuaagugaaccucuuuucaugugcauggucucccagcaggagaaaaacugcagcaccagccagaaaagcaaagcuccagccuccacuccccagcucaguucacccaagagcagcaggcggccagucccaggggcugcacugcugcaaaccugcucaaaaccuccagccgccacguggcaacuugcuccccagcucugagagugcaggaccggggcgcagagacgacagaagaggcuuuaaauaugcagaaugacugucuaggucaacgcacaaaaggaaagggccccaggugugggagaugcaaggggugagagggaaagcucagaagagacguguuggagcugcuggccugcagcagcucccagggucccugcacagcugcugagauugggcagagcaaguacacagcaaguagacaccgcagacaguuagagcacacugacuccugcucccagccugugggcaaccgccgcaccucagcaucauguagaaaaaucaccauccccaaagucauuuugaccucagccugcugggaggaagagccaagccaggggccacugauggcaaagcaccugcguggaaacuggcacucgcugucuuuucugccaccuucuaccagggaacccuuugagcacgggccacugugacuggggagguggggcuugccccacgaagcugggggaucugugucuccauaauagaaaggccaccucucuguccucugaucacagaguggauucacagcugcucucggggcuggcaggugggcaaggcagacagcucccggcagcuggacucagccucuggguggcaucucccacggcccguggcuccugcccagcagaucucaagggcacuccaggagaccgaugaggguuccagugcuuccaagaaguaucuagcugccugugugugagaaugcagagaugcccaagacaggagccuuggccucuggcagaucuagggaugccaggaauuuuggagugugaguggcaaagagggacaacuaaagggacacacaugaaaacagcccacucggccccacaaaacugcaucuggccacgcaugaggcaccuggcacucagagaacgucagggcgccuaaaagugaucaccucccucccuuccagcaggggcgcccccacuuuucuccgagugguuuggcccaguguccugcccaucacaaaccagacagaggacaugacuucaggcugcuguguccucccauguguuagggccuccgagggcccagggcuguggcccgugagcguggccugccucuauccuccgagggcccagggcuguggcccgugagcguggccugccucuauccuccgagggcccagggcuguggcccgugagcauggcccgccucuaucaagugcagagcuggaaggcugcaggagccucccccgucaucucaugagucccccacucacgaccaugcagcccacucagaccacgaccugccgccacaugcgggaacugcuggcucccucgugcccgcccggggcugaggacugcacgugcagccacagaugcauccggcccuccugccccacagccucuaugaaggccacauaaauggcaccaagugucucugucugccgaucagcauccccucuuggcuucacagcagacgcaucugccuuucaggacugccuugaacaacaucugggcuggucagguggagagcgaggaguuuccagguugcagccccuaugguccugagggcuggcguccaggaugguggggguccagcagcucugggcagcgaggccccuggcugggugauccagguggcagcugaccaguggccugggagccagcccuccuguccucacguggggccccaucuccaaaagccagugcagugcccugcacauuauccaaccuacaucuguacugucuccccaaggaaaacgagugugugguucacgugcuuuaaggacguuucccaggugacauuccaagcucccaucuguggccgcaagugggggaguuuccaguuuuccagauagauuuucugccaugccagagaacccuccgccuccuucagagccaucucaucaaugcagugaucgcaagcuucgauuuacaaaaacucgccucccuugcagcauuuccagguuucacacacagcguaacaaguaaaaauggauuuuugggcagcacgccuguccuaguuugcugaggcugccauaacaaaguaccagagacugggguggcgucagcagcaaaaguugauuccucaguucuggagcuggaaguccaggaucaaggugcugccagguucggcuucuccggaggccucggucccuggucugggaccuucuugcuggggccucggucccuggugugggaccuucuugcugggaccucggucccuggugugggaccuucuuccuggccagcaagauggccgccuucuugcuggguccucauguggccuguucucucggcacaugcaucccaggugcucuuccuccucuaaugaagacacuagucccaugggaccaaggccucacccugacuagauggaaacuucauuaccuccguaaaggccccgucuccaaauagccccacuggggucggggcuuuaccauguugaccuggggaagggggcaguucaguucguaacaugcccuuuugggaggagaaagucaggcaaugagcagacacaggcaggaagccacgccgggcuccagcagggauggcccagugcccuguacaggcagcaggcagcugggcuggaggugggcccuggguggaggacaccuaccaggugugucuaaacugccccuuuccuacacaucuuccuucgcacugggcucgccacccaagaccugcuuuuuccagaaagcaaagccuacuuuggucaaacucucauuuuuaaaaaucacuucaucuuuuccucccuaacuuaauuagcuccaaagcacugagcuguauugaaauagaucaccacaaugacaauccucuuugggacugaaaacaaaaucuauuucaacuugaacagggauauugauagaagacagggcuccaugaaaaaggguuaggaggagccgcuugcuggggcaggggccgcaucugggcacugcaguuaagauguuaaagugucuucggucccagggggccgcagaugaacacaguucagcguuucuggauguaaaucgucaaagcuccuucgauccccagccucgggcaaggaaagggccuuucucucugugaugccaccugugcucaggugugcacuggauggaacuguguccuagaccccucagcugugauauugauccgcugagauuguuuuucaucuguagaaaucaauaaauuccuuuuuggugcaguguuuugugaacgggugcacucucucacccggucgcuguccuaagaauucuccuugacuucggaacuggcccuccacgccccaggauccaccugccaggagacccccagugugcucucaaacccccacccaucugaguggccuggaaaggcuggucugaagaccucucuucccaugucugccgaccaggcuuugcucuccagggacuuucugggagggggagaacccaccuccugccaacggcccugcuggcacuccgaggacagcagagggaaggaagccaggggcuggggagccggccacacaacugcccagugccuauccuucuccugugcccacagaugcugagcugccuggagcacauguaccacgaccucgggcuggucagggacuucagcaucaacccugucacccucaggagguggcuggugagugccaaacccgccuucgguucuuccugggcacgugguuucauccaguuccacaggaauggagggaauggaucaccagggcaccuuccggauggcacugcgcucccugugagcagaggugacauuuccccgggaguucugugaggacacucagccugucucuguuccuccuuccaccaaaaccuucuuuacgcccgagcuacuccugcucugauaagcaaggaguagcuuaucagugagacucugccaucaucaagcaaagcagcauguccuaaagcagcggugugugggagcgugugugugugugugggagcgugugugugugugagagugaguauggggguguggaugugagugugugugagugugggguguggaugugagcaugggggugucugcauguguuugugaguggguguguggauguaaaugugugggagcgugugugugugugaguguggggugugggugugagcauggggguaucugaguuuacgggugggugugugugaauguguggugggaguguguggggugggaguaggaguguggaggugugucugugugugucaguguggaugugugcauguguauaucuggauguggggugugucugugugugggugugugugagggugugugugcauguguguaucuguggaugugaggugugugugcauguguguaucuggaugugggggugugugaggguggaugugugcauguguguguguggauguggggugugugaguguguggugugugagugggugugugcaugugggugucugccugugugaauauguuuggcagcagguuuuuuuaaugaaauauugcucagaaccaaauauuaaaagccuauuaaagguuucauggugacuggggacccagagcucccucuuggagucuccccuccccccauccccuaacuuuaugccccacuguggcuccucagacaccuccggggagaccccaguccuugacugcagggugaaaccccuggugggagcucuguccccacaccugccccgggugccgugguguggcccgcuggacguucucagggucccugugucaccucauugguaccugugguaaaccuggaacacuguugaccucugguugggaugaggguuuggcagagaauguucaaaccagcgcacagccuucuggguggcuuugggaggagaggugggcgggcccaggcacagggugacucggacccccugccucccgcaguucugcguccacgacaacuacagaaacaaccccuuccacaacuuccggcacugcuucugcguggcccagaugauguacagcauggucuggcucugcagucuccagguggguccugcccgcugcacacccagaccucuacucucgggggucagacggaggcccccuuccagggagcggcagccccaucccaccaagagagccacaggcgugggguccccagccgcuccgccccuccuagggacgcaccccugcccaccguugucagucaccccaugggcgaggcugcuccuaggauuacgagagcaggugaguccccgaccuggucacccccccaacccccacaggcaggccgauccucucccaccaugccaggagaugccagauggcugcaggggccuuugucccccgcuuaccacucacccaauuccacccccccucaccccaucccacccuccgagugaagagagcaaacaccuacgcccuguuuuccaauccaggagaaguucucacaaacggauauccugauccuaaugacagcggccaucugccacgaucuggaccaucccggcuacaacaacacguauguacaggauuuucucuuuuuuuccuuuuaaaaggcacccuggcuacuggagggaaccugucagcccaacccucagagcaguucccagauggagcugucaacgacggccucccagcccccaacucugccuccacugacacagcuccuggcuucuggacuuugcccagggccuugggucuccccggaguaggaacuuucaggauuaucaaaccccaggggcucuuucccacuccugugcgggccuggcuucaggcucaggugcacggcagaucccuggccccgccggcgccuucuccaccccaggcagggagcaacaccuguccgcaugcagggaugggggcuccacaccccccucucaggagcucgccucucccugggcaggcucccagcuggcuuccgcagggaaagcacaggcaggagccagaagagagcagaagagggggagaagagggacugcagagggacaggaggugggagugaggugucccucguggggccagggaucagaaggacagaccguugcuccacuccugccuccacaggcacagaguuccgccccauguggcggacaagguccaggccaugggcuugggucuguguccucaguggcgcagcagcucucucuguugaacuguguguuugugugaugucaucacaugccugagagcucugcugccaugugucagcgccuaguggguuccgagguguggcugucagcgcuccucccggggccaucaccaugcacacccaucuguuccccuuuugcucauuucacacucacaguggccggcacagcacaggucagcagaggccuugaccacagcaucccagugaaccucagccucguucugcccaccugccucuggcaccuggugacguuugauaauuucacaagaggccgugaugccucagggccugucccagggagcaugccgcuuccucagaggugucugucuggugggacugcaggagcauggggacgugcaguugcaggggcagcugagcggcaggagggaccuccuggccaggccagggcacaggcagcucccccagcccccacggcaccuucuccugacucuacuugcuccacuuacauggcuggguguugcucccccgugcagguaccuggugagggcgccugagucuccccucacucucuccuugccucccagguaccagaucaaugcccgcacagagcuggcgguccgcuacaaugacaucucaccgcuggagaaccaccacugcgccguggccuuccagauccucgccgagccugagugcaacaucuucuccaacaucccaccugauggguucaagcagauccgacagguguguggggugagggcccucccaccggagugggggcacauucagggacagagcagcccccacucuccauuggcuggaagcucccagaagcuccuggccacagcagugcccuggggacccaagggaaccccucccuccuuccucaccuccuccagggcccagaguggagccccaaaaagaggguacccucgccaugcgcacgugcaucccacugaccugcacuucccagccuguauuuaauucagccuucacuggcucccuuugagauaaauccuuugucccucuuccagcccaagaaacugaggcuuagcaaagguagggagccugcccaaggaggggacaggcccuggacagacacaucugcugcauccaacauaggagagcugcccccugccccauaaccccagcugcugucaccugccacccacagcccagucagcccccuuccuuuuauuuauuuuuuuuucuuuugagacagagucucgcucuguugcccaggcuggaguguaauggcaggaucucggcucacugcaaccuccaccuccuggguucaagcaauucuccugccucagccucccaaauagcugggauuacaggcaugcgccaccaagccggcuaauuuucgguauuuuuaauagagacgggguuucaucauguuggccaggcuggucuugaacuccagaccucaggugauccaccugccucgaccucccaaagugcugggauuacaggugugagccaccacgcccggccaccccuuccauuuuagauaagggggcuuuaugccucucagggcgugaugggaggagagugagaggauaucugcgugagaggaagaugaccugguccaccugccccagacaaacaccuccagcucaccgaaauaacgccccauuccacacgggaauuccucaucaaacccucacucucugacauuugcaggggagggaagcucucggaguaaacccugggagaaauguguuggguugaauagcagcguccuucaaacaagguccaccucccgugaaugugaucuuauuuggaaaagggucuuugcauuuguacuuguuaagauuuccagauaagaucaguguggauugucuaagggggccguaaauccaaagacuaguguccuuggacgaggagacagaguagaaaacagcccagacacagaggagaaggccgcaugaagacgcagugauuggagauuugagugaugcagccccaaacuaagggacuucggggcccccaggagcaggaggagacaaggaaggacccuccccuggagucuucuuugagagcagggcccugcccacacuuugaucuugguucuggcuuccagaacugugagagaaugaguuuguuguuuuaagccgccuaguuugugguacuuuguguggcggccccaggacacucacccagggcaccgucuucugcgguuccacaaggcagaccucagccauucgaagucuaaguggcuuccuuccagaggcagcaagaaagacugccuggacuucagcacugggaagauacucaccacccuccaggcgugcugcugagccucccuuuaucagagagcagcagccucuucuaccauggcuuuccaauuugucuacgcuuccaggaaguucaaagcccaguguaaaaaacugaagucagugaagcauuuggggaagcuccgaggaagcagcaugcucccugggacggggcccugaggcaucacggccucuugcgaaauugucaaaugccaccaugugccagaggcagaggugggcagaaccaggcugugguucauugggaugcuguggucaaggccucugcuggccugugcugugccagccacugugagugugaaaugagcaggagaacagaugggugugcauggugauggccccgggaggagcgccgacagccgcaccucagaacccacucggcgcugacauacggcggcagcgcucucgggccugugaugacaucauugcacaaacauacacaauucaauagacaauuuacagucauuauugaaucacugguucccaguacaguuaucuccccuuuaucuauaggcucucuggccucuccuccauguuugugccccuccccacccugcaagcaggugcccuguguggcuacgauaagcuguggcaaaucuucgucugcaguaggucaaggagcaaccgugaagagagaacgcugcaucugccacugcuaccccaguggggagcuccuccagggacaggaccuggggaaucaaagcaagugaacgccccuuaguguaggccucgucccacugagccaugucggagagcaucccgcaagagaaggaggcggcaccugauuggaggagcagccgcucugcacaggggaucguucucgugcccauccaccguggggacacaccagcauuggccugcuucaaaugcuucacugacugcaaaauaugacucuccucuggggguaaaauuaguugucccacuuuuuuaaaaauauauuuugucauggaagauuucaggaauaacugaauaaaugcuucacuaauaacacaauuaaauguuuacaggaaaauugaauaauucaagauacaagugauccccccaaaaaaauauauauauauacaguugaaaugaccuagauugauggguuuggguuuuguaucugaugcuuguuguuuuauuuucuuggaagaggaaaacaucauaccuggcacagagauguguucuguaaaugcuugugggguggguggguggauggauggauggauggauggauggauggauggauggguggauggguggauggacaaauggauggaaggguggauggauggauggguggauggguggaugaauggacagauggauaaauggguggaaggauggauggauaaauggauggaagggcagauggauggguggauggguagauggauggaggaugaauggguggauggauggaugaauggauggguuuuugggugggcagauggauguguggacaaauggaugggugauggaugcacauaugaaucggaauaagagauacaugaaauaaugugugcagggggcucaguacacaguaggccuccgcugaauaauuguucagacuauacccguguuaacacguuguucucucgcuauuuagggaaugaucacauuaaucuuggccacugacauggcaagacaugcagaaauuauggauucuuucaaagagaaaauggagaauuuugacuacagcaacgaggagcacaugacccuggugaguggcuuauucugccugggugggcagccaggcggugggcuggcgaagcaggucauccauccagcucacacuggaagccaagaagcugaaauuauuagucuucuuggaacaaggugucuauaaaucugguuuucaaggucaugacucuuacuaggaaaguccgggcagggccucccuccugauggguccuccuucauggucagaggcagcauucucccauuccuccaucucuuuuggauuugaaggagauaagugggugaaggccgugcaucucgcucugcuuuccagagaauaaaaccagcucucccaugaaggcacagccccagcauggcacucugaaagcccaccuaugugggggcaacuccaacacagcucccgcuccccaagccagcaucccccaccaggcccacaccauagcccagcaccccuccauaaccaggacaagguggccagagaagggguagggggccucccccaugagaaggugcacuuagguugcccagcaucugccuuuuggaaaggacaggcacugggcacaccaaggcacacaaggaccagagcacgacucaugccuggaauccagcacuuugggaggccacggcaggaggauugcuugaguccaaaaguuugagaccagucugagcaauauuagcaagacuccaucuccacaaaaaaagaaagaaaaauaaaaaaaucagugcauaucuguggucccaacugcuugggaggcagaggugggaggaucgcuggagcccagguccaggcugcagugagccauggucguuccacugcacuccagccugggcaacagagcaagggucugucucagauaacagagagagagagaggugcaugagaacugcccucccggccuucagagagaaagcugguuuuguggagccuugucuaagcaucaggugcaccccuggcauucuuacucugaaauuugauuaucuguuuaaaaucaauagcaucacuuuccaccuccagagagguugaaagauagggaacucucggcucaggcugaccuucuaaccauccagucccaguagguagagucauuaggacucaucgcucucuggagcugaggugcaguuaauucccaaagacugugcgagaggaugggagcucccgcaggcaagggcuggacagcaggcaaaccuccccaggccagggccaccagaagccccuucccuaagagggaaacagucacauagagcggcuuccuggcaagcaaguuucuugcuccugaaaaaccaagggaaggagggaggcgccgccuuguccucuaagauaugaggaaggcagagauggaccugcagucaggggugacccaggccccgccgaugccuuccuccucugaggugggaggagaggucagggaagagacggggaggggcaggaugccagaggaucgggugccagguggucaggacaagugaacccagcugaagguccccacucccaccccacccccagccuuacacacugcagcugugcagaccagaggcaaagcgaggcucagagcccaggguuccguuuaucccaacgaccugcaccgcggggucagaugacaagcagcacggccaggcaucgucucacugcuacggagccccagacggggcuuuaugaacacggguggaggacagagguugggguaaggucucgggggaaagguucugauucaaaaugggccccaauagggaggccucugaggauagugcgggccagcgugggaggugugaggugcagggaguguggccggcagggccugggaccuugaccuuccccagagacacugcugcccuggcccugcccuaggucuggugucgggacagcuccacugaggccggccaggcacaggcuagucauugccucugaucuggagccggacuccacagaggagucaaagaaaggccugaauggcuuccugggaacugauagggcagggaaaggaagggcgaccacagcaggaucccuucgagguccugccgagguuggaaggcaggauccaccaagcaucaugcagacuccgagcugaacugagcugcuccucaccuagucacguuccccaaaccagcaggugcagcccgcagcccgggggcaugugccucagcugggcuuuccugucuaaucagcuucagagccuggauggcaaccaacacuuuggucuggaaaccuggugauuccagacacucauuugugcccggugcaggcagggccacgggacgccagcccuccaccucuuguccuauggcgacauccgggcuaguuuggguggaagcugcugcauuccugggccugcccuaucuccuccugaagcuccuauggcaugcccaacccuggccaagcugagacagagcuaccuguccccugggaagaugagcaaugcacccaccuagggaacagcagaaaauagggggugaccaggcacagggcagugcuucaggggauaucaccugggcugggguggccagaaaggcuggaaggaggggacccaaacaggaccuugaagguucauucuccauugagaagggagccuguccucccugaaggcagccaagcucaguugcaugguccagcagguccuccgucucuuccugccuguaauggcaaguccagacccgagcagcagcagcaggcccguguucuaccuccuguuaccucaauuccaaaaucucuucuuucagcugaagaugauuuugauaaaaugcugugauaucucuaacgagguccguccaauggaagucgcagagccuuggguggacuguuuauuagaggaauauuuuaugcagguaagagucuugcagagcaaucaagccuccagccacucuuauuagccccacuuaguaaggguuugcguuaaacgagcacgccuggguggucccgcauauuccccgggcugccgacaguucagccuccagaaagccuucaggguaagcguacaucagaaacaaaauagguuauaauuugagaccugaaagacaguaacaauccagaaaagcuaauacucuaaaacugucaccugucacugcuaauugagccauuauuacaagcagccuugucaaacaaauugccugaaagucaagaagcaaggacugcagaagcaggagggggcccaggagggccgagacccagcaggucagcucacacagauggccacggggaaggucggggacauagaaaaccaagccagcugaaaacaaccaccaaauauuaauacaacagcuugaugaacccuaggagaagucgggaggcuuucugcaggacgcugcugccguccugggauacauccauccaacucaccucugccuaucucucaggucggucuucccagcuagaccugcacgcccagcucuguuuagcacugaagauagggucaccuucuccuuguucuuacugagacacauuuguggugugguuugguugguuggugguuaacuggcgcaucuugucuuucucugagaacagcgaucugguuauggggcauuucugucucuaaugucacugucugcugcauucccugcagagcgaccgugagaagucagaaggccuuccuguggcaccguucauggaccgagacaaagugaccaaggccacagcccagauuggguucaucaaguuuguccugaucccaauguuugaaacagugaccaaggugaguaacugucaccacaugucacacuugcuuacacucagauacaugcaugcacacacaggcacacacacauauacacauaugcacacagguacacacagacacacacucaugcacacacguacacagauacacacagacgcacauacaggcacauacacauauacacacacgcacacagcuacacacaggcacacacacaggcacacacuugugcacacagguacacaggcacacaaaugcacacacacggcacacacaggcacacacucgugcacacacauguacacaggcacacacaggcacacaaaugugcaugcagguacacaugcacacaaggcacgcagguacacaugcacacaaggcacacaggcacacacaggcacacaaaugcacacacaggcacacacacacacacacaugcacacagguacacacaggcacacaaaugcacaugcagguacacaugcacacacaggcacacacagggacacacaggcacacauaggcacacaaaugcacacacaggcacacacauacacacaugcacacagguacacgcaggcacacacguacagaggcacacacaugcacacacagguaugcacaugcacgcacacagguacacacaggcacaccugcacaccugcacauccugagcagccucuuccccggcugucguggugaccgcugucccuguuccauccagagccugcuccccacagccuggcccgugaccccagcaucucccacucugugcugcacucccugccuugccuugcugggcccuggggggccccucacugcccucacccaucgcugccggccuucaggacccuggaggcagcacuggcuguggacucuccuguccccacucugcgucccaguuccucaccuguggaggaaccccugagcucugugcccucgagcugugaagccccuguccagcucccagucucaccgcacccagccaccgagaccuugcuccuugcacacagcucguuccugcccagcuccccccagggccucugagcugccuguggcccccugccaaggcccccaccucaaggcacccccagcauguccaaaacaggcccaucucuuguuccccccggggaucugggcucacagccucacacccuccgaccuuccugggcuccuacgcugcgcauccuucugcucuagggcaucucuuggagccaacccacccacuucccacucccaggacccucagccgggaggcugucagcuccuuuccccugccccgugucuuuguaagaaccucccaaccugucccccacccucaucucacgggcacgggggacacaggaggcaggaaggggacuuucuguaggaccucauggagggugaugagggccagagacagagccgcaguggguggaggcagcagagccggcacgaggguguccaggagcugggacuggcccagagguuuccgcacggagcaccugacaccuguuuuucuccgacguuucccauugccuuaagaacgagggacucugaauaaauccgugugucucucccagcucuuccccaugguugaggagaucaugcugcagccacuuugggaaucccgagaucgcuacgaggagcugaagcggauagaugacgccaugaaagagguaaaacacacugagaagagccugccuuccuugcggcaagcaggcacgcugcccuccgcacucccgacuccagaagcuuggacgugccaagcagggcaccacugaaggccccguggacaggcacacguguaccuuccaucagaaagccuggcucaguaaaauuagggaaugcgaugagggaaaccaaaacugcauucgccaagaacacgucaggucucaguaccuucgagggaguuuacuggccgugcccuucacaagaaucacaacugucacccacaccuguggacacccaggugucuuuggguguaucagccgccguuagagcaucugggaccccucagaguacagugccuggccuggccccagggcugacuuguucagaggaggccaugggguagaaaggggcccuccccuggcacggggacaaagcgaccacccaccugccagcucccgggcccagaacacacaccggcaccucucaggggccagggagccuggggcuggcuuuagguugcugcuggauagauaucauuuuggaggaagggguccaggucacagccucagggcccacgcagucuuucuacggauuccccacggcugucugcuguccugcugcccaugguguggccucugccccucccagccuccugccuccucccuccagcgcccccaggcagcuagaacagucuuacuacuccugcaggguuugaccccuccuggccuuggccgguguugccucugccacccccgcuccccacagugccacugaagcacccuccaaggcccgucagucagggcuccccuaguuacugugcccaccaccccgucuuuucugccugggcgcuccugaagcccauguggcccacaaugcccuuuugagcacugagccauuuuccaggcguagccuuggguuggucucaucucccucgacugacggccccgugcuccccaugcccacacccgccuggagcgccaugccaggcacaugguaggcgcucagcaauugcuuaggaguccacugaaaauccagaccagcugcccugacuucuccaguugaugucuccuacuggaaagucacagaaaggucucuaaaccucuggaaggcugagagcacuuaugcagagggacagauguagcaagaaggcuucccccacuccacaaccccgcaagagagcugaaggggcuucugccucucucgugggcccuccgagagccauagcccugauggccuugagucucuaguccugagcccugcugcccaguaggggauaguaggguuccuuaaggccucugccuuccccccugucagcccccacaaaaaggagagacacgccaaagaggugaaaaggccaagcccaagccgcaggcucugcacacaccaccaguccccgcggcugugguggcugcagcugggugagcucacuguccaggccccagaugaggcaccaaggguagcgggacaggguaugcagagcugccucugaaaagcccaugucaggagugcuugggcucagaggggcuggggaccacaggcuuucacguugcagcaccuccaggcaacagaagcugcugggagagaggcagacacuccccugcugucuccugcucccugacuuggccuucucuguacucuguuccaguuacagaagaagacugacagcuugacgucuggggccaccgagaaguccagagagagaagcagagaugugaaaaacagugaagguaaugcuugcucugcugaaguggcaucucagcgcauacaaugauucugacaaaggacagaaggaaagaggaaggggagaaaaucugaauuuuggaauaccuuuaaaugaauggaacuuuuuuuuuuuuugaaacuaagucucgcucuuguugcccagguuggagugcgauggcacgaucucagcucacuacaaccucugucuccugaguucaagugauucuccugccucagcccccuaaguagcugggauuacaggcaugagccaccaugccuggcuaguuuuucuauuuuuaguagagaugggguuucaccauguuggccaggcuggucuugaacuccugaccucaggugauccacccaccucggccucccaaagugcugggauuacaggugugagauugcgccugaccaaaugaauggaaauuuuauuucuugcaacuaaucauuagaauuaggcucuuaaggcugguggcucaugccugcaaucccagcacuuugggaggccaaggugggcggaucacuugaggucaggaguucaagacccagcuuggccaacauggugaaacccugucucuacuaaaaauacaaaaauuagccagguguuguggcgugcaccuguagucccagcuacuugggaggcugaggcaggagagucacuugaaccugggagguggagguugcagugagcccacauugcgccacugcccuccagccuggagaacagugagacuccaucucaaaaaaaaaaaaaaaaaaaagugaggcucuuaaagaaggggaacaugcuuuaguuaauagaaaaacaucaauaauuagcauauguaucacuuauaagaguaaguacuuuuuaaaagugcaauugaaguacugaaaacuuuucacaaaucacguguuugcuuuauauggcuuugagcauuuuccucuguacuuguugauacuagucauucagcucacggggaaugcagagcagccguuuguucaccucauaauaaggucacacuaauggccaggcacgguggcucacgccuguaauccaagcacuuugggaggccaaggcggcggaucacgaggagaucgagaccauccuggcuaacacggugaaaccccgucucuacuuuaaacacaaaaaauuagccgggcgugguggcgggugccuguagucccagcuacuugagaggcugaggcaggagaauggagugaacccaggaggcggagauugccgugagccaagaucgcgccacugcacuccagccugggcaacagagcgagacuucgucucaaaaaauaaaaauaaauaaauaagccgggcgcaguggcucaugccuguagucccagcacuuugggaggccaagguggacggaucacaaggucaggagaucgagaccauccuggcuaacacggugaaacccuucucuacuaaaaauacaaaaaaaauuagccgggcgugguggugggugccuguauucccagcuacucgggaggcugaggcggagcuugcagugagccaagaucgugccacugcacuccagccugggugacagagcgagacucugucucaaaaaaaauauaaauaaauaaguaaauaauaaauaaggucagacuccaucucaaaaaaauauaaauaaauaaauaaacaauaaauaaggucacacucuccaugucuaacagauaauucaagagauagugcaucaagcaugcaaggcucagggcaggacaaacgggacauggcucauaagaggagcugcaacaggcuuuggcauccaacacaccugguuuugaguccaggcuugccaauuacaagccgagagaugugcacaagugucccagccucucugaaccucagagccccagucucuaagccagaggcaauaauaccauuguuacugcuguuuuagugauuaaacagucaaagugcuugucuggucccgaugaagugcucagucaauguugccauuuaauuuuuaagucaguucauauuuuucagugggucagaaaagagaucaauauuguuuuacuuugucuaaauguguucagcaauauaucugauggccucuuucuuuuaaaauggucugugugucggccgggcacggugguucacaccuguaaucccagaacuuugggaggcugaggugggcagaucacuugaggucaggaguucuaaaccagccuggccaacauggugaaaccccaucucuacuaaaaacacaaaaauuagccagcuguaguggcgugcaccuguaaucccagcuacuugggagccagaggcaggagaauugcuugaacccaggaggcggagguugcagugagccgagaucacgccacugcaccccaaccugggcaacagagcaagacuccaucucaaaaaaaaaaaaaaaagucuguguauaauccuguaacguuucugcgacugcuggcacuuuuuuuuuuccuucuuuugugagacggagucucgcucuguugcccaggcuggagugcaguggugcaaucucggcucacugcaaucuccaccucccggguucaagcaauucuccugucucagccucccgaguagcugggauuacaggugugugccaccacgccuggcuaauuuuucuauuuuuaguagagacaggguuucaccauguuggucagccuggucucgaacuccugaccucgugauccacccaccuuggucucucaaagugcugggauuaaaggugugagccaccgcgcccuaauucuaacaaaaacaaaucagucaucguuucccuucuuccaggagacugugccugaggaaagcggggggcguggcugcaguucuggacgggcuggccgagcugcgcgggauccuugugcagggaagagcugcccugggcaccuggcaccacaagaccauguuuucuaagaaccauuuuguucacugauacaaaaaaaaaaaaaggaauucaugaugcuguacagaauuuuauuuuuaaacugucuuuuaaauaauauauucuuauacggaa

SEQ ID NO: 192685 - RNA, 16396 nt, Homo sapiens
ggcuguucaggcgcgggugcgcgcgcagcugcuguggcccugcuuggugcgcccgcugucaccgccauggcugccccguguuugcugcggcaaggacgagccggggcgcugaagguaaaggaggagccagccugggcuggcugcgcggccccgagccuacguaggggauggggugagggggcgcggugcuggucagguccgggccuguccgcgaccucuagccguccuaguugggccgcugaccccgcucccugggcccaggacugaccgccacggggccaggcccggauguggccagcgagcgucccgcgguucccccgagccgguccgccgccgccgcugcccgaggcccaggccgaggcuggcgugccccgugccgacgggcgcucccgagggcugcaugccugggcggcagacucggguggacguucccaggugaugcugccgcgcggcuggggucagccgcugugcggcucccgcacggcuucucugaaggacagugacuucuccauuuagccaagagaggaaaugagggaacuuucagggaccugguuaacuugguaacuuacugacagccguugagaagccagcugacaugaccugaccugugaaaaggagaagaagggcuuucuuuucggcaaauaaaaagcuaaggccaaggccgggcgcggacacuuugggauuuugccuguaaucccaguacuuuggaaggccgagccaggcggaucgcuugaguucaggaguucgagacuagccuggccaacaugucgaaaccccgucucuaaaaaauacaaaaaauuagucuggcgugguggugcauuccuguaaucccagcuacucgggaggcugaggugggaggaucccaugaacccgggacgcggagguugcagugagccgagaucauaccacugcacuccagccugggggacagaauaaauaaauaaauaaaauaaggcuaagaccacuucacucucuuacaaauuuuaaaauggcuguuauuacaaaagcaguaacuauucccugcagaauauauaugcguguguguauauauauauauaaauacauauuauauauauuauauauaaauauauauuauauauauauuuauauaauauguaaauauauauuauauauuuauauaauauauaauauauuauauaaauauauauuauauaauauauauaauauguuuauauaaauauauauuauauauuuauauauuuauauaauauauaauauauauuuauauauuauauauaauauauaucauaauauaauauauaauauauauauauuuuuuuuugagacagagccucacucuguugcccaggcccaggcuggagugcaauggcaccaucucaacucccugcaacuucugcccccugggauuaagcgacucucgugccucagccugcagaauaauuuaaaaguacagauagggaaauucauugacagucuaccauuacuccuucaagcaucuaguuccuaacgauuucuaucagcuuuuauauguucacauaagcacauguacucaugcuuacaaucaugaacauacacguuuucauguuuauaugugcacauacaggcaccucuguucuguauccagcaucuagaacauuguacugucuagcacuuaauaggccuuagugaguauaugcugagugaguuggcauaauauaaaauaucacauuuauauuguagacacuuuugaagcaguuuuuauauaccuacaucauuuuaguggccagauaguauuucuucuacucuauuuucuaaggauaagaaaacauuuuacagaaagaaacauagggccuggcagguggcucaugccuguaaucccaguacuuugggaggccaagacagguggaucauuugaggucaggcauucgagaccaacauggugaaaccccaucucuacuaaaaauacaagaagagccaagcgcgguagcucacaccuguaaugccaguacuuugagaagccaagguggguggauaaccugaggccaggaacucgagaccaaccugaucaacauggugaaaccccgucucuacuaaauacaaaaacuuggccgggcauggugaugcaugccuguaaucccagcuacuuggguggcugagacaggagaauugcuugaacccacgaggcggagauuguagugagccgagguugcgccacugugcuccagccagggugacagagcaagacuccaucucaaaaaacaaaauacaaaaacauuagccaggugcgguggugcacaccuguaauuccagcuacuugggaggcugaggcaagagaaucgcuggaacccaggaggcggagguugcagugagccaagauugagccacugcacuccagccugggagucagagugagacccugucuccaaaaaaaaaaaaaagaaaagaaaaaagaagaaacgugguauuuuguagguuaauaaauaauuggagacuacaaaaaaaaugcacuggagaacgucugguugaaguuuuauuaaaccaaauauuaauagugauuguccuugaacucggguguuuucuucuugcagccuuuuuguauuuuacaaaauguccauaauauacauacauuaugaaaacuguaauaaccauuagaaguauaccaugugaauguuuugcacuuacauguagugguaauauguaauauucauaugcacgguaccuacaugcacacaaucccagcacuuugguuguuuuucuuuuuuuuuuuuuuuuccugagacagucucacucuguuguccaggcuggagugcaguggcgugaucucagcucacugcaaccuccaccuccugagucuaagcaauucuccugccucagccucugcaguaccuggaacuacaggcaugcaccaccgugccuggcuaaauuuuuuuuuuuuuuuuuuuuuuugcgacagagucuugcucugucgcccaggcuagagugcaguggcacgaucuuggcucacugcaagcuucaccuccuggguccacgccauucuccugccucagccucccaaguagcugggacuacaggcacccgccaccaugcccggcuaauuuuuuguauuuuuaguagagacgggguuucaccguguuagccaggauagucucgaucuccugaccucaugauccacacgccucggccucccaaagugcuaggauuacagucgcaccgcgcccggccuuuuuuuuguauuuuuaguagagacgggguuguccaggcuggucucagaacuccugaccucaagugauccgcccaccucagccucccaaagugcugggauuauagguguaagccaccgcaccuggccaaucccagcacuucaggaggccggggcuucaggaucgcuugaggccaggaguuugaggaagccaggaguuugagaccaaccugggccacguagccagaucucgucucuauaaaaaauaaaaaauauuagccaggcaugguaguaugugccuguaguccuggcuaugucagaguaucgcuuggacccaggaguugaaggcugcagugagccaugauugugccacugcacuccagccuggacgacugagagagaccccugacucaaaaaauauauauauauauucauauauaguaccagcuauuauaauggcauuacucuaaacauccauauucauuaauucuuuugucagacuaugcuccaggaagcccagguguuucgaggacuugcuucuacgguuucuuugucugcggaaucagggaagagugaaaagggucagccacagaauuccaagaagcaaaguccaccaaaaaguaagauuuugaugguagucauaagggaaagagaaugcaaaaagaaaauagauuagucagccuucgaagcacgacagugaguuuuacuagcuacguaauuuaugcuucuuccuuuucagcaguguccagauuauacaagacacaagaucuauaacagauuuuagaccaaacauuucagucaugucguagucuuugacugaauauuuagcccugaaaugguuuuuccuguauuuucuaaaugccaaaccccaaccugaagugagugaugccuugguaaaggcucuguggcauuuagauggccccggcacagugagcuugccagaaagccaccuuacuuuccauccucugaugcugaguuguuuguuuuguuuuguuuuguuuuguuuuguuuuguuucagucucuuugagacccaucugugguuuuccaggcuuugcuuaaucccaguccaggacuagcugggacuacaggcaugugccaccacgucuggcuaauuuuuuguauuuuuaguagagacaggguuucacaauguuagccaggauggucucaaucuccugaccuuguuauccacccgccucggccucccaaaguguugggauuacaggcgugagccacugcgcccggccuaaaucuuuaauucuuuuuuuugagauggaguccugcucuguugccccugcuggagugcaguggcgcaaucucggcucacuacaaccuccgccuccuggguucacaccauucuccugccucggccuccugaguagcugggacuacaggcgcccaccaccaugcccagcuaauuuuuuacauuuuuaguagaggugggguuucaccauguuagccgggauggucuugaucuccugaccuugugauccgcccgccuuggccucccagagugcuggaauuacaggcgugagccaccgugcccaguccuaaaucuuuaaucauuauaugggguuguagaauaguaauugaguuuggucuuauuuucaucaauauacuauuuccucaguuugaauguuugaaaguauuuagauucuuuuguuuucuuccuccuuggucugugcacagaacacugguaaguuuuuaaauauuuguauuuauacaaagagagugccagccccugacugccucucacaguguguggacuugaggcuuggauuccacgggaauguuauuuaguuuugugcuaugacuccugccucguuuuucaaucauuguuuuuuucucuucuuccuuuuauguuauuuguuuuaagagaggggcucuggcucucucucccaggcuggagugcaguggcacagucauagcucacuacagccucaaacuccugagcucaagcaauccucccaccucagccuccugaguagcugagacuacaggcacauaccaccacuccuggcauaucccuggcauguuuuguugauguuguuguuuauuuuuugaaauagagucuugcucugucacccaggcuguaguacagaggcacaaucauaggucacugcagccucgaccuuccaagcucaagugauccucccaccucagccccuggaguagccaggacuacaggugcacaccaucacacccuggcuaauauuuuaauuuuccauacagaugaagucucacuguauugccuagacuggucuugaauuccugggcucaagcaaucucccugccucaaacucccauaguauugggauuacaggugugagccacuguguccagccuaccuggcauguuuuugacauucucuaaauguuuacugaugaacaauuaguugaauuucauugcuaacauuauccucuccuuuggugaauuuuagucugugucugcaauccuacaucauagacuuaugaauuuggauuaaauggauuuuaaaauaucauggcagagccaaagagcccccuuuuuagauacaugcgucugugugugaguggaaacggagugcuucauucuguggccaucuggguugugguuuggggaggggaacacugaccugggagcgagccuugggcucucauggagcuccugccucuguccuugacgggcccugcaggccucugagccucgguuccuuugugcuuaagcaggaugaucaugccagccuugcugggugguugugagacuggcugcagugggauacacguagcuacugcacacacugcagagagcuuucaggugggaggacaguuuucagaacuaagcucaucaauacacagaacaguuguaucuuguuuuuuuuugagacagaguuuugcucuuuaugcccaggcuggagugcaauggcgugaucucagcucaccacaaccucuccgccucccugauucaagcaauucuccugccucagccucccaaguaacugggauuacaggcaugcaccaccacgccuggcuaauuuuuuguuuuuuuguuuuguuuuugcgauaaagucucacucugucgccaggcuagagugcaguggcacgaucucggcucacugcaaccuccgccuccuggguucaagccauucuccugccccauccucccgaauagcugggacuacaggugcccgccaccaaacccggcaaauuuuucuguuuuuaguagagacgggguuucaccauguuggccagguuggucuccaucucuugaccucgugauccguccgccuuggccucccaaagugcugggauuacaggcgugagccacugcacccagccaauuuuuuguauuuuuuaguagagacaggguuucugcauguuggccaggcugguuuugaacucccgaccucagaugauccuccugccucaaccucccaaaguugcugggauuacaggcaugagccaccgcaccuggccauguaucucauaauuuuuaaaagaauuccuguacaggcugggcguggggguucacgccuauaaucccagaacuuugggaagcugaggcgggaggaucaguugaguucagcaguuugagacaagccugagcaacauagugaaaaccuaucucuagaaaaaacuuuaaaaaguagcuggguaugguagcgugcaccugugguccuaguuacucaggaggcugagacgagaggaucauuugagcccaggaggucgagguuguagugaauuaugauugcaccacugcugcacuccauccugggugauagagugagacccugucucgacaaaaauaaauacugagucuggguaugguggcucacaccuguaaucccagcacuuuugcaggccaaggcgggccgaucacuugaggucaggaguucgagaacagccuggccaauauggugaaaccccugucucuacuaaaaauacaaaaauuagcugggcaugguggcggacgccuguaaucccagucgcucaggaggcugaggcaggagaaucgcuuggacccaggaggcagagguugcaaugagcugagauugugccauugcacugcuucuugggugucacagcgacacuccaucucaaaacaaacaaacaaaaaaucccuguacaaagaaaaauaaauaaugcuuguaaauggauacgugcaggcccauauuuuccccugaaguguugguaguugguaaguguaagauacagaggaacuuuucacccuccauggcacauugccagaucaaaccuuucucagccagaaguggcuuuggaagcucuaacagaaguuuccugcaugcaagugagguacccaaagcucucauccuuggagucacaucucuagucagagugucugccacaggacaagacccuggcgcgaugggacaugcugugccuuauuucaucagagguguccagcuuuccccagcacaugcguucucccugaggaaggcugccggcacagauaucaggggcuggauguucuuggaggugcaccuuggggaaccgcugggcucucuagcuugcuguuuccuugaauccaguacccaggccuaauuuugcaacagucaguaauaaauuguugacugaguaauuucuguguagcuuuuugaagaguauguccagaagccacaguuaauuauccauuugaaguccuuguuucaguuuuaaaaguaaggaauaucuggaaauagaaauuucacguaauuucuauuuacacacaguguaaauaguggcucaguaaaaaaauaggcacaguggcucacuucuguaaucccagcacuuugggaggcugagguggguggaucaccugaggucaggaguucgagaccagccugaccaacauugugaaaaccuguaucuacuaaaaauacaaaaaaaaauuagccgggcgugguggugcaugcuuguagucccagcuacucgggaggcugaggcaggagaaucacuugaacccaggagguggagguugcagugagccaagaucacgccauugcacucuagccugacccaaaagagugaaacuccaucucaaaaaaaaauuacccaggcgugguggcacacaacuguaguaccagcuacucgggaggcugaggcaggaagaucacuugagcccaggaggcggagguuucacugagccgagauuugcaccacugcacuccagccugggugacugagcuagacuccaucucaaaaaaaaaaaaaagaaaacgaaauuuuacguaucaaauuauaacaagcagugccaggcacuguucuaagcacucuucccauaucucaucuuccccaguccucaacaacccagggaguagaugcuacugcuauccccaugucauagacaaggaaguugaggucuggagggacugaccugccugagucaugcaguguccacacaggugucagcggagaagccuggauuugaacccaggcauucuggcagugcgguuuauauuuuaaucacugugcugucuuccuucugaaaauucuugauucucauguguuuauuuaaaaauaaaaugccgggcacgguggcucacgccuguaaucccagcacuuugggaggccaaggcgggcagaucaccugaggucgggaguucgaguccagccugaccaacauggagaaacccugucucuacuaaaaauacaaaauuagcugggugugguggcgcaugccuguaaucccagcuauucgggaggcugaggcagcagaauugcuugaaccugggaggcagagguugcggugacuggagaucgugccauugcacuccagccugggcaacaagagugaaacuccauuucaaaagaagaauuagauaaauaaauaaauaaaauaaguaaaaauaaaaaaaaacuuuuuauagugaaacacuuguagagguuuccauuaccauauaaaauuugaguaacuuuauucucuaauguaauguuuaaaugcaccucuguuucugaaugugccuuguuuccaaaguuaguuuugugauauuuugacaagaugugcaaguauuuuaagguugcuaaucuauguuucacacccuaacccuuuuuacuuuugauagggggaucacuaaaaacuugaaggccaugcccucacuuuucaacuaagcagaaaagagauucaggaaauuugaguucuauuuugaggugacagggaagcaacaaggcgaauuccugcuuucacuaauuacuaguacaguauuuguaaaccuuuauuuuacauaguuuguuauggucucugagagaagagaaacagucucugaaaguccccaucucaggcugugagauaggccuacacagcuagucuuaggucgguaguuuuguguuuuauuauacagucauccuucaguaucugaggggaauugguucuaggccaccccucccaccaggauuccaaaaugugcagaugcucaagucucugauauacagugaugcaguauuugcauaucaucuaaguacauccuccuguauacuuuaaaucaucucuagauuacuuauaauaccucauacaauguaaaugccauguaaauaguuguuguauuguuuagggaauaaugucaaggaaaaaaguuuguucauguucaguacuaaagcagaugauuuucugaacauuuuccauccucaguugguugcuugguggguuucuaugggaccugucuuaggaugauugcauugaagauacugucaguaauaaguaaugugucaugaaaugucuguaauuuugacugaguuuuaaguuguuuuguuaaauaacauuccucuuuaugccguuucccagauguaguggaaccaaaggagaggggcaagcuccuagccacccagacagcagcugaauugucuaaaaacuuaucuucacccaguucuuacccgccagcugugaauaagggcaggaagguagcuagucccagucccaguggcagcgugcuauucacagaugaagggguuccgaaauuuuugucaagaaagacuuugguagaguuuccacagaaaguucugucuccauucagaaaacagggcucugauucagaagcucgucaggugggucggaaagugacgucgccuucgucuucauccucuuccagcuccucugauucugaaucugaugaugaggcugacguuucagaggucacuccucgaguggugagcaaaggcagaggggggcuucgaaaaccagaggccucucauuccuuugaaaacagagccccccgaguuacaguaucagcaaaagagaaaaccuugcugcagaagccgcauguggacauuacugauccagagaagccccaccagccaaagaagaaaggguccccugcuaagccaucagaaggcagggaaaaugcgagaccaaaaaccacaaugcccagaucucaaguagaugaagaguuuuugaagcaaaguuuaaaggaaaaacaauugcagaaaacauuuagauuaaaugaaauagauaaagaaagccaaaagccauuugaaguuaaaggacccuuaccuguccacacaaaaucaggguugucugcgccaccgaagggcagcccagcgccugcuguguuggcagaagaggccagagcagaggggcagcugcaagccaguccuccuggggcggcagaggggcaucuggaaaaacccgugccagagccccagcgcaaggcggccccuccccugcccagaaaggaaaccucagggacgcagggaauagaaggccaccugaaggguggacaggcaaucguggaagaucagauaccaccaagcaauuuggagacaguuccuguugagaauaaccacgguuuccaugaaaagacagcagcgcugaagcuugaggccgagggcgaggccauggaagaugcagccgcgccaggggacgaccgaggcggcacacaggguauaccuugacucgcgcucccaagugcacccugucccuuaggguagugaggcaaaagaacuaauuuacauaugcuuguagagcaguguuacaauuagucaaauucuguacuagaaauauggccuguaacgcugucucagccaggcagaaaaguaugucuuaauuauggacaauccacaucuuuauauuuagaaucccuaaaauauuuaacguucuuuuuuuuuuuuuuuuuugagauggugucuugcucuguugcccagguagagugcaguggcgcgaucucugcucacuacaacuuccaucucaagcacuuccccugccucagccucccaaguagcugagauuacaggcgcaggccaccacaccuggcuaauuuuuuuuguauuuuuaguagagaugggguuucaccguguuggccaggcuggccucgaacuccugaccucaggcaauucacccgccucggccucccaaagugcugggauuacaggcaugagcaaccccacccugcuuaaccuucaucuuuuuuuuuuuuugagacagagucuugcuccaucuccaggcuggaguguaauggugcaaucuuggcucacugcaaccucugccucccagguucaagccauucuccugccucagccuccugaguagcugggauuacagucccccaccaccauguccagcuaauuuuuguauuuuuaguagagacgggguuucaccauguuggccaggauggucucaaucuccugaccucaugaucagccugccucggccucccaaagugcugggauuacaggccugagccaccgugcccggcccccaaccuucaucuuaaagaguauguccuuggcacucuucacuauuucuuaaccgguauaauuuuugaaaacuggcagcuuaacauugucaccacugacuuuugaagguguccaaguguucauugaugaccuuguggggcaucucgcuaagugaaaaggggagccuccgguuuaacuugcauaggugaagagcaguagcuagucgcuuggcgugagagucuuuggguaaacuagaugauugcuuucagcauccugugcacagggcagauucauaguucaggaauuaaagcaguaaguguuguacaggucagccgcugcauacgcauccuuuccccuggacagcguuuccuucucugguuaacugaaaacacaugugggcugcuuuacucuucuagaagacauuuuaugaaggguuuuuuguuuguuuguuuguuuguuuguuuuugacauggguuuugcucuuguugcccaggcuggaguacaauggcgcaaucuuggcucacuguaaccuccgccuccuggguucaagugauucuccagccucagccuccaaaguagcugggauuacaggcguguggcaccacccccggcuaauuuuuguauuuuuaguagagacaggguuuuaccauguaggccaggcuggucucgaacuccugaccuuaggugauccaccugccucggccucccaaagugcugggauuacaggcaugagccaccgugccuagcguguggaggcuuuuaaagggcaacaguauuuauuccuaugauguuaccauuuuuuuuuuuuuuuuuggagauggaaucucacucugucacccaggcugcaguacaguggcgcaaucuuggcucacugccggcuccaccucccacguacaaacgauucuccugccucagccuccugaguaggugccacuacaggugccugccaccacgccuggcuaauuauuguauuuuuaguagagacagcguuuugccauguuggucagguuggucucgaacuccugaccgcgggugauccaccugccucugccucccaaagugcugggauuucaggcgugagccacugcgcccagcuauguuaccauuuucuugagcacgaaacuugauaagaugcaaugcgcuuuaggugggucguggcaaacaugaaaaggcaagcuuccguuuuagaauccauggcucuucuugaagacuucucuaaagugcaugaucccuaacaagcgcggcuccguccugugucugcucuccauccucuguaccgccgccccuugccuuaugugccuuacaugacgccuucuuguucuugguucguugugcgacaggaucuauguguuuuccccccucuccgucugcucuuugaucaguacgccaagugccggugcuugccagacuucccagcccuuaggaacugcauuuccugaugcugcugcuuucacuccuccugcucgaaaauggagacgaauaacacaacucgcaggauaaaaacagaauugggaguuuucagacugcaaaccuuucugaagagaaaguucuaauauuucacggguguguuguuucuuaacuaucuucugugcgcaugcgcagagcccaccuugcagagccgugucuguauggggccgcggucucacuaggcaguccgugccccaguacuggccuuccagguagagugguuuuagaucagaguuuuguaacccacgucuuggucaguuaucacccucccuauaguaacuaaaauaguacguucugcuuugaaggugucccuacaccacaccgaagauacucaccuuguggagauuggaaggaugccagcucuuuaaaugagacaucguuuuugcuuaacguaacuuaaaaaugaaaaacagagcuuuugauauuaauugaaauagugagaaaauaaauguauuuagguuauuuuuuuguggagcaugaauggaaguuaagacagaccuaaugaccugauuuacagaaauugagucaguacaaaucuuaacccaaauaucagccuguguucccgugcugguuuugauuuugccauuauguuauauuguguguccugcugcaggagaccaguacuucuuuugccucaaccccuacuuguaguuucgaauuaccaaauguuuaaaugcuguguuguuguuauuagaauuuaucuaauuuucuuguaucagagauucagaaggcuccuuuaguuuaagcuuuucaaaaaaaauuuuuuauuugacagacgugcucugucccacaggcuggagugcagugaugugaucucagcucacugcaaccuccaccucccagucucaagcaauccucccaccucagccuccugaguagcuggagacuacaggugugccaccaugcccuacuaauuuuuuuuuuuuuuuuuuuuugagacagagucuaacuuugucaccaggcuggagugcagugaugcagucucaggucauugcaaucucugccuccuggguucaagcaauucuugugccucagccuccugacauagcugggauuacaggaguaugccaccacaccugcuaacuuuuguaacuuuaguggagacaggguuucaccuuguuggccaggcugcucucaaacuccuggccucaagcaaucugcccgccucagccucucaaagugcuaggauuacaggugugagccacugcuacuggccccugcuaauuuuuuauucuuuguagagacagagucucacuauuuugcccagaaugaucuagaacuccugagcucaagcaauccucccaccucggccucccaaagugcugggauuaugggcguaagccaccaugcccagcccagauuucuaauagagguagauuuuaucaugcaucucuaaguuaccugaaaguccugcuauaauuguucuaggcauuuucaaacuuuugagaagccuagaaguauacaaacuaagauguuaagacacguuguauggccuggcaugguggcucacgccuguaaucccagcacuuugggaggucgaggcgggcagaucacuugagcucaggaaaucgaaaccacccuggccaacauggugaaaccccgucucuacuaaaaauacaaaaauuagccaggcgugguggcagacgccuguaaucccagcuacuugggagacugaggcaggagaaucacuugaagcugggagguggagguuugcagugagcugagaucgcaccgcugcacuccagccuagacaacagagugagacuccaucucaaaaaaaaaaacgcauuguaauaacuauuccauuucuuaaauuggaaggcuguauguuuuagaauaaacuuccaaguaauaucuuucuuuuucuuuacuguggcuuuuguaggcuuuucuuuuuuaauuagacaauuuguuccucacagauaggguugaugaagaacgcuugguagguaagcaccugugugugagccgagucauucauaaagaacuguucacagauagguugaugaagaaugcuugguagguaagcgccugugugugagccgagucauucauaaagagcuguucacagauaggguugaugaagaaugcuugguagguaagcaccugugugugagccgagucauucauaaagagcuguucacagauaggguugaugaagaaugcuugguagguaagcgccuguaugugagccaagucauucauaaagagcuguucacagauagggaugaugaagaaugcuugguagguaagcgccugugugugagccgagucauucauaaagagcuguccuuguguuggucucaugggcaucguguuuccuccgcagagccagccccagugccugcugagccguuugacaacacuaccuacaagaaccugcagcaucaugacuacagcacguacaccuucuuagaccucaaccucgaacucucaaaauucaggaugccucagcccuccucaggccgggagucaccucgacacugagggcccucggugugaagaugaaccuuccaccgucuucacugcauccuggagugcaaaaauaaaauccacucaagagucacaaggcccgcugugcauaaucgguuucacuuuuaccuuuuuuuuuuuuuuuuuuuuuuugagacagggucucacucugucacccaggcuggagugcaguggcacauucucggcucacugcaacuuccgccuccuggguucaagugauucucccaccucagccucccaaguaggugggauuacagguacucaccaccagguccagcuaacuuuuguauuuuuaguagagacaggguuucaccauguuggccaggcuggucucgaacuccugaccucagauggucugcccaccuccgccucccaaagugcugggauuacaggcgugagccacugcgcccggccacuuucacacuuuuuacagugaguggugaauuagcaacaguaacacugauuauccaacauauauuuuggaauaucuacuaugugcaaggaauuuuucuuaaacucuaagguuaugaaucacugggcaaauccauauaauuagagaauuuuaagugcuuuagagcggugugauucuacugugcucagccuagucaauuucgcauuaaacugauuaucagcuga

SEQ ID NO: 192686 - RNA, 6126 nt, Homo sapiens
auaagccaggcccaccauuccaacucuuucuccuuuuuggcuuguaggccgcaccuacucugcauaugccccgccccucacuccaggugucgcccacuuaacugaagauccaggauccccuccuuaagguuugucugggcucggaauugccuuuuuuuuuuuucuuuuuugagacggaguuucccuguugugacccaggcuggaguacaguggcgcgaucucagcucacugcaaccuccacgucccggguucaagcgauucuccugccucagccucccaaguagcugggacuacaggcgcccgccaccacgcccagcuaauuuuuguauuuuuaguagagacgggguuucaccacguugcccaggcuggucucgagcucuugaucucaggugauccgcccgccucggccuaccaaagugcugggauuacaggcgugagccaccgcacccggcccggaauugccgccuuuagacccucacccacccgcugcugagucuuccugggccccgccccggcccuaagccccgcacaggaccugcuaggccccgcccauuuauuuccccccuuuccaaccucuuccuccccagccuccgcacccuacccuuguuuccugucccugucgcgcccagguguuuaccuggcacucaggugaguggugcgcucuggcuguuuucugucggagccgcccgccucuuccuucagcgcgucccacaaaucccgacggcacggaggggccccaggccaagggcgaugggccccugagcccugacaccgcuucgccgcugcugcaggugccccuggccggcagcgccgccguggucccggagcgcggcgacaugccggagcugguggugaccgcgcugcuggcgccgucgcgccugucgcugaagcugcugcgcgccuucauguggagccugguguucucgguggcgcugguggccgcggcggucuacggcugcauagcgcucacgcacgugcugugccggccccggcgcggcugcugcgggcgccgucggagcgcgucccccgccugccugagcgaccccucgcugggugagcacgguuuccugaaccucaaggugaucgcacgggggcgcuaucggggcugcggggucgcguggggucgagacgguucaagccucgggagagaggguuccccaggcuucaggcugugcccucccccuagagcucgggccugcgucugcacuaugucucggcuggacgagguaacggaccccucaugcuguuucugcacggcuucccugagaacugguacgucuggggccaggggccugaggcccacgggacucgggggcagguggagcuugggcucccaagaggcagggaggagggcuguauagaucgggacaagcugaacauagauggggauagggguacugagccagcauacccaggaucccuaggcccugaagggacaggacaaagggguauugagguugauugaaguucccuggauucaggguguagcuggcuucagccucagccucugccucugccugggauuccccauccuccuuuuaggggaaguuuagagcaggaaggaggguuugccaaugguugcugaugugcguagggugcaggugcaaccugagggcccugacucagccucccucccucgcccgccuggcagguucuccuggcguuaccagcuccgggaguuccagagccgcuuccauguuguggcuguggacuugcgaggcuauggccccucggaugcaccucgggauguggacugcuacacaaucgaccugcugcugguggacaucaaagaugucauccuaggccugggugcagacauacccccauccuaggcguggccucccucauccugcacacacgcauacccccgcuuucuccuugcuggaaccuacuucccccaucccugcuucaguccuacugggcaccucacuuaugcgagcuccuugaauucccacagguuacucgaagugcauccuuguggcccaugacuggggugcccuccuugccuggcauuucuccaucuacuacccaucccuggucgagcggaugguuguggucaguggugcccccaugucgguguaccaaggugugugugggaguccgggacacugggauguacuuaugugcaagggggcagggacaugugucuguguuuucaauucucuguauaccugucaacacaucaggggcugagggugcagcaaucaacccaggucccuucgguuguggaacuccucauucggaaauuaaugacacgccagacccaguggcucacaccuguaaucccagcccuccgggaggcugaggugggaggaucacuugaggccaggaguucaagaccagucuggucaacauagcaagaccccaacugucucuacaaaaaaaaaaaaaaaauguaauuagccaggcauugguggugcaugccuguaaucccagcuacucgggaggcugaugcaggagaaucucuugaaccugggagguggagguugcagugagcugagaucaugccauugcacuccagccuaggcaacaagagcaaaacuccaucucaaaaaauaaauaaauaaaauaaaguauggccaggcgugguggcuccugccuguaaucccugcacuuugggaggccaaagccgguggauugcuugagcccagggguucaagaccagccuggccaacauggugaaaccccgucucuacuaaaaauacaaaaaaaucagccaggcaugguagugcacgcuuguagucucagcuacucgggaggcugaggcaagagaaucacuugaaccugagaaguggagguugcaguaagccaagaucgcaccacugcacuccagccuggaugacagagugagacucugucucaaaaauaaaauaaaauaaaauaaaucacaauacacuuaggaguaauccacauuuuuuuauagcacuuacaguaacaaggaauaugcacacaguaaccuacuuaaggcuccugggcuuaugaagguuguauuauccccauguuccagcuggaggaaacugaggcuggggagguuaacaaugucuaucauaucaccugauguuaauaugcagcacuguggucauaacugugcucucucucucucuuuuguuguuuuuuuucuuuuucuuuucuuuucuuuuuuuuuuuuuuuuuuuuuuuuuugagacagagucuugcucugucgccaggcuggagugcaguggcgugaucucaguucacugcaaccuccgccucccagguucaagcgauuccccugccucagccucccaaguagcugggauuacaggccaccaugccgggcuaauuuuuuguauuuuaguagagacgggguuucaccauguuggccaagauggucuugaucuccugaccuugugaucugcccaccuuggccucucaaagugcugggaguauaggcgugagccaccacgccuggccccuuuuuuuuuuuuuuuucuugagauggagucucacucugugcagugcaguggcgcaaugucggcucacggcaaccuccgccucucagguucaagugauucucuugccucagccuccucaguagcugagacuacagaugugugccaccaugaccggcuaauuauuuuguauuuuuaguagaaaugggguuucagcauguuggccaggcuggucuugaacuccugggcucaagcgaucugccggccucagccucccaaagugcugggauuacaggagugagccacccugccuggcaaccucuaccuccuggguucaagugacucuccuuccucagccuccagaguagcggggacugcagauaugccccaacacgcccagcuaauuuuuguauuuuuaguggagacggguuuucacuauguugcccagguuagugucuaacuccugaucucaagugauccacccgccuuggcuucccaaagugcugggauuacaggcgugagccaccgcacccagccuauuauuguuuacuugucugucuccccaucuagacugucagcucccugagggcagggaguuuuuugucuuuugggggugucuuuuuuuguguuuuguuuuuuuuccuuugagacagucuuguucugugguccaggcuggagugcagugcuguaauugcagcucacugcagccucagacuccugggcucaagcgauccucccacuucugcuucucaaguagcugggacuauaggcacacaccaccacacccugcuaauuuuuaaaaaauuauuuuuuggaggccgggugcggugguucacgucuguaaucccagaacuuugggaggcugaggcggguggaucaugagguccggagaucgagaccauccuggcuaacacugugaaacccugucucuacuaaaaauacaaaaaaaauuagccggacgugguggcgggugccuguagucccagcuaccgggaggcugaggcaggagaauggcgugaacccgggaggcggagcucgcagugagccaagaucacaccacugcacuccagccugggcgacagagcgagacucugucucaaaaaaaaaaaaaaaaaaaaaaaaaaaaaaaaauuauagauacagggguuuccuuaaguugccuaggaugaacagggaguuuugacugucucauucacugcugugucuagaacaaggccuggcaugcaguaguugcucaauaaauguuagcugaauaaagcagaggaaacgcacccuggccugggcagaggaagcacaccuuuggauauggggguucccaggagaugcccccauccuguggauagugaaacauggcaggagggaauguagcuggugcccaggccaggagggguaucuaguaccuucacagacccaggcaggcagcaguggcauuccugaggcuugugucccugaccuggguauguguaggggugcagguguauggggccaccccaggagcaggccuuauaucucucccccaacccucccaccccagacuauucccugcaccacaucagccaguucuuccguucccacuacauguuccuguuccagcugcccuggcugcccgagaagcugcugucuaugucugacuuucagguacagagggugcagguugaagggaggagggaagcaggucggggcugggcaggcugggcacugaagccagaguccugcuguguaccuagauucugaagaccacccucacccaccgcaagacaggcaucccaugcuugacccccagcgagcucgaggccuuccuuuauaacuucucacagccugguggccucacugggccccucaacuacuaccgaaaccucuucaggugagaccaguugccaagcauaagcucaggagauuugcaggggcaggggggugggaggcaaccauccuucugccugucugucugccugucugucuguccuggccacaggaacuucccccuggaaccccaggagcugaccacacccacauugcugcuguggggggagaaggacacuuacuuggagcuggggcugguggaagccaucggcagccgcuuugugccgggccgcuuggaggcccacauccugccaggcauagggcauuggaucccacagagcaacccccaggagaugcaccaguacaugugggccuucuugcaagaccugcuggacuagugguccuugcuggccugcccaggaggcauggauacucaggaaggaacacacacccauuaucugugugugccugggaguccauacaauguccauacaugggugaacucuugaaucgcucauaggcaugggacuccuggaucccacacaagcgcaccuaugggugccucgggacacaccaaccccuauacucacacacaggcauggaugcauguguguguaacaaacacuuugacccugggaacuggguauaccucucuuccaguggagccagaugccgagaccgagugucccaccuccucccuuccuggggccucacucugcgcuuugccaaagucgcuucucugccauagcugcacagaccuuaaacccugaccuuccugucccugccuucgaccuccugccugggucuucagcucagugcuacucugaauacaauacugcugaccacauuuggcuacuucagcuuaaauguauguuaauugaaaugaaauacaaugaaaaugcagugcucaguc

SEQ ID NO: 192687 - RNA, 26281 nt, Homo sapiens
ucgucuuuucaagcaguuuauuuccauuuucaguucuaauguugacuuuuucauaaauauucaccuggaaucuccacuaaggcuccucaugagcagggcccaauuccuagaaugugcuuggugaguuagccccugguauacaguagaggcucggcaaauauucuacagccuccuuucuaaugauuucccaguggccagcguuucccaacaugugagauguacaguucaaaaggccacagggaaacugacacagcagggccauuucaaaaggggaggaucuuccaauucuucugauuuuaggaaauucuguugcgugcuaaccuugaacacaugcuagccucccuuucucagauuuggaaagaucuaaaguaauaguuauuucucuaaaaugaaacauauauuucauuuuauauauauauauauauauuacagauaccuucuaucuauggcaauuuauguuggauuauuccaccuauggcaaucacaucaaguuuucuuuccuuuuuuuuuaagagauggggucuugcuauguuguccagguuggucuugaacuccugggcuuaagcuauccucucaccacggccucccgaagugcugggauuauagguaugcaucaccgugccuggccaaauucucuuuguaaauacauuugagugguaguaacuaauuuuaaaggaaaaaaaccugaaguaaucuagagguggaacacaaaugagguaaaauauuagagaacugauucagcaaggacuaaagauugggacgcaaugcccucugcacagucugguucuugagguugcgguggguguguuuccaguggcguaggucggucagauacuucuggccuuugggagugcguggaugugacgcggucagugccacaugugaaccaggugcugcgaaguccugugaaagucacacaccauauggugcacuacaaagguauagguuaaaggcugaagcuugaaacauacaaaaaaaaauccucuauagagcaagauauauuccuaguauucagcuguucccaaccaaauaaaaaaaaaaauuaaggaaaaaaauaaaaaaggaagcauuccaucaguggcuguauugaacaaguaauguaucaucaagauauaaucacccaaccuuuauuauuccaagugcacuacugucaagagacauguuacagccgcuaaggacaauguacuucagcuuugaaaccugggcaagaagccacacgacugcaugagacaagccgugagaggcacugcucaggaggaaacgcugggucucuucaccaaaauuagauuacagcauauucugggagcacacgcccuuguacugcuuacaaaccaagggagaaagaccaacgcauccaucaucccaacgccuucccuggaacagggaaaugagcaucauucugugggaacagcgucuuuagacucugcaucaguuuguuccacuucagcauccgcggcagcuggggcaggagcaacucugguuugggcacuuucugccucugcugccauugucucggcgccauuuccagccucugcagccucacuucuggccuuggggacgcccuucucaugugccguuccacagggcaccugcucuuccagcagcuguucggcuugaggaucacuaccggccuccgcuguguccguggggccuucguccucagccggcuccccgcugcucucuggagcgggcgcuccuuccccaucuacggcccucacugcugcuguaaucaccucugcuaagacguccgcggccaccuccucaggugucucuuucuuauccucaccuccuaaauugucaucuccuuccauuucuggaucaacaguuucacuggugaaaggguccucacccuggccaaagaggaaacaccggucagcgugguguaagcagagcucaggaggcccaugauugcggggaugucagcuuuucagaaccagcaguccacaagggaaacacuucuguaaauuaugccacaggagugaauccuacauguucucagagccuacagauucagaaaacaccucggggagauauucugcaauuuuuuuuuuuuuugagauggagucucgcuguugcccaggcuggacugcaguggugcgaucucggcucacugcaaccuccgccuccuguguuuuuaguagagaugggguuuccacccaccucagccucccaaagcgcugcgauuacaggugugaaccaccaugcccggcccauucugcaauuuuuuuuuuuuugagacggaguuuugcuuuguugcccaggauggagugcaauggcgcgaucucagcucaccacaaccucugccuccugguuucaagugauucuccugccucagccuccugaguagcugggauuacaggcaggagccaccacgcccggcuaauuuuguauuuuuaguggagacgggguuucaccauguugggcagacuggucuggaacuccagaccucaggugauccgccugccuuggccucccaaaaugcugggauuacaggcacgagccaccgugccuggccugcaauuuuuaaucaagcauguaccagcgaggaaaaguucacaagcccagccuuaacuugauguuuuuuaaaaaagggcaugaggccgggcgugauggcucacaccuguaaucccagcacuuugggaggccaagauggguggaucacgaggucaggagauggacaccauccuggcuaacacagugaaaccccaucucuacuaaaaauacaaaaaaaaaaauuagccgggcaugguggcgagcgccuguagucccagcuacucgggaggcugaggcagcagaauggcgugaaccugggaggcggagcuugcaguaagucgagaucacgccacugaacuccagccuggcagccugggcgacagagucagacuccaucucaaaaaaauaaaauaaaauaaaauaaagggcauguaauaggaaguuaacacuacguaauauuuuaguuucauuaagguacaguggcucacgccuguaaucccagcacuuugggaggcuggggcuggaggacugccggagcucaggaguucgagaccagccugggcaacguggcgaaucaagauucaaauccaagucugacucccucagaagucaaaauucuccuaaguauaugauagaaaacuaucuguagucuaaaacaagcaaacuaaaaguuaucauuaccagauuaggaaacauguuuuaaaauaugaugcuuagggcaaggugcucacgccuguaaccccagcaauuugggaggucaaggcgggaggaucacuugaggccagaccagcaugggcaacagagcaagacugucuuaaaaaauuagccagcauguggccgggugcaguggcucacgucuguaauuccaacacuuugggaggcggaagcaggcagaucacaaggucaggagauggagaccauccuggcuaacacagugaaaccccaucucucuuuucuuuuuuugagacggagucuuggucugucgccaaggcuggagugcaauggcgcgaucuuggcucacugcaaccugcaccucccggauucaagcaauucacugccucagccucccaaguagcugggauuacaggugcccgccaccacgccuggcuaauuuuuuuuuuauuuuuaguagagaugggguuucaccaucuuggccaggcuggucuugaacuccugaccucgugaugcacccgccucggccucccaaagugcugggauuacaggcgugagccaccacgcccggccaccccaucccccugcaaaacauuagccaggcaugguggugggcgccuguagucccagguacucaggaggcugaggcaggagaacggcaugaacccaggacacagagcuugcagugagccgggaucgcaccacugcacuccagccugggugacagagcaagacuccaucucaaaaaaaaaaaaaaaaaaaaaaaaaaaaaauuagccagguguggugguguacuauugcagucccagcuaccuggcaggcugaguggggaggaucucuugagcucaggaauucgaggcugcagagaaucucugcaggaaucucuuggcuggguaccaagagaacaagacccugacucaaaaaaaaagacgcuuagaagccugagcucacacuugacucuggaaacuuuuaccuugcuuaagcugcaaagguaaaauauacaucagucauguuuccucccucuuuuuuuuuuuuuuuuuuuuuuugagacaaggucucacucugccauccaggcuggagugcaguggcacgaucuuggcucacugcaaccuccgccuccugaguagcugggaccacaggcgcaugccaccacgccuggcuaauuuauguauuuuuuguacagacaggguuucaccauguuguccgggcuggucuugaacuccugaacucaaagugauccgcccaccccagccucccaaaguacugggauuacaggugugagccaccacgcccggcccagucauguuucuucaauugguuauuuagauucugugccuuuaauagauggaacugucaaauauggaaguguuuaguaacugagaggagggcaaagguccugaagucagguugugggcugggacuuagccaccugccccaaaugcuaaaguccugggaugaacacugagcaaaauggguuucacaaggaagaacugggagcucuuccaaccagccuucucuccaugagcacccacuuugggacuucgauaugcugcucccaucaugaaggcucugguucuucacuaccccucaccuucaaccucacugucaguuggcucuaucaaugaaaucucuuuuuagcuucucuccuggaaaauucucauguaccuuggauucuuuuuuuuuuuuugaaauggggucucacucugucaccugggcuggaguguaguggcgcaaucguuaacuccucuaacuccugagcucagggauccuccugccucagccucccaaacuauuggcauuacaggcaugagccauaauucccgguuccccgcuuuccuuuauuuucaagaccagucuugcuauguuacccaggcugaagugcagugguaacaccaucacucacuguagccucaaauuccugggcucaagcaauccucccaucccagcuucccgaguagggcuagccuuggguuuuucuuaaaaaaucaccuaaccaucauuugcucagaauuuuaaggcuaaacaaucaggauuuuucaugguaaaaauccauuacgcacugauuaaucaagcagcgccacauccccagaguccccaggcaagcacugacucauuagaaaucccaguugucauguuccugagcuugaugcauuccagugucccucaacugucaaaagacucagaaaugcuaaaugcugcacucuggauucaacucccugcuccugggguucaucuucccuuuugaaagcuuuuccugucugugguacuugcaagcacaaaccuugagguauuuuuccagcaucuucacuauaugucuguuguucaaaacacucuuagccacauggagacugguuuucuugaacuguucagcagccaacugcaaagggaaccaaaugugagcucuuaaaaauggcaaagauuaaggaagagaauaaaccagccaggcucugccgagucauccugagaucagcccuaugcagagaagcgaaucucaaaacgccagccuccaagaauagaaggcuccagagacugugcaaccaagacuaacaaacuggaaaagcuaggcaaucuuaagagauaaaugcaaagaugcaccacugauacccauguagcacaugcagaauugggggugaaacaagagcauuuacaaaugaaaggcuguguggacucaguggaggaaaaggacaagcucuuucuuuucaguuuuugggguuacauugauuucauaaguucaacaacaaaaguaugaauaugcuggguguggcagcucaugccuguaauccuagcacguugggaggcugaggcauguggaucacuugaggccaggaguucgagacaagccuggccaucauggugaaacccugucuacaaaauauaaaaauuagcugggugugguggugcacacccguaaucccagcuacucaggagacugaggcaugagaauuugggagauggagguugcaaucagcugagauuguaccacugcauuccagccugggcaauggagugagacucugucucaaaaaauaaaauuaaaaacaaaaacaaaaacaaaaaacaaacacacaaccaugacugcaccaagucucuguuuuagagccugacuuguuugcacaauggucccuuguuuguauacugcuuuucagcugaucuuuaacaguacuggggcugggugcaguggcucacaccuguaaucccagcacucugggaggcugaggcggguggaucaccugaggucaggaguucaagaccagccuggccaacauggugaaaccccgucucuauuaaaaauacaaaaaauuagccgggcauuguggugggcgccuguaaucccagcuacuuaggaggcugaggcuggagaauugcuugaaccugggaggcagaaguugcagugaacugagaucgugccacugcacuccagccugggcaacaagagugaaacuccguaaaaaaaaaacaaaaaaacaaaaacguaaaccaaaaaaccaaaaccaaaaccaaaaccaaaacacaguacugugagaugggugagcagcucuugaccuccccauuuaauagcugaguaaacuaaggagagagcugcuaacccagggccagaaagugacaggcugcagagcaaacgcagccacaggcacucuucacugucugcuuuucugcacugacagcagguagagcuguugcuggauagggccucuauggucugcaaugcuaaaaauacucaugaucugacucuuuacaaaauaagguauuuuuccagcaucuucaacacuugaccccugggcucaacauuuagccugaagccccagcagcuagguaaggacagaaccaguccuuuaguccaaguccccugggccacucagcuuucaauggcccuucggucucagcuuauggaagcccccaggccuuccgcuagugggaaaacugaccaacguggaaacacuaucaggagaaucucagcuacugcauuuaaucgagucuaagcaacacauuuucucacauuuuuauaaaaauugagacgaaucuuacgacccaucgauggaagugauagacuugaaacauagcaagaaccccuaaagauguuguuauuccccauaagacacagcaggcucugagccgcagcccugcaaugagcaccccaggcaguguggggaggaagacucacccugcgguugugauugugguccacggagugcaggugccgcuggaggagcugcggcugugcaggaauuagcaugucgcaggccaggcagugagcagccucgaucuucuugaagaagugcuccuggccaaucccugccaggaaacgcaugucuuguaggaucugggacagcaagugaugcuuuccuccuacuccccaucugggcccacguuuucucccugcaacucuaaggaaucagaagggcacagccugccuuucuauggggaguaugggucagcacaucggccucuauagcugugaauucugcacuuuucagcuuuucuguuccuccugguuguuucuuuucaaaccaaggaggaaaagauaugaaagugcuuaaugucacugauauaagcugcaaucuaugcaaggccacauccgaagguuucuuuccauugcugcugagcgcucuucccacgggucucgucaucaccuucucagccaacuugggcuggcuucaugccacuuuuuuuuuuuuuuuuuuugagacagagucuugcucugucgccuaggcuggagugcaguggugcaaucuuggcucacugcaagcucugacucccagguugacaccauucuccugccucagccucccaaguagcugggacuacaggugcccgccaccacgcccggcuaauuuuuuguauuuuuuuaguagagacgggguuucaccgugucagacaggauggccuugaucuccugaccucaugauccgccugccucagccucccaaagugcugggauuacaggugugagccaccgugcccggccucgugccacguuuuacggguccugucacaugccuuacuaccauccaggaaagcacucauccugggaugacaacucaccuuugaaaggaucugguuuugguuuugcgguuucuuucuccaucaauuccugacgccgcuucucaauuuucuuauuucuguuuacaauguauuccuaggugggauuggagagggcauaaaguaaaaugagaggugggcgcaugugggcauuucucaacugccagggcuaggcaggcagcuaucagagcagcugcguggggcagcacagcacgauggcuggagcucccgguugucccugugacucagggacuuacacagcuacucuaucugggaaaggaaaccuuggccaaguauagccucugauuucccuuccuccuucaagggauccggcaccugcgggaugggcaagagacgcggugacggggcccagguuuccuuuaccuggaggaacuccacggucuugucgggcagcuuggugcuuaugaaccgcagggucucuuugugaaauuugcuuugcagaugcuucuggaucucuucgucaucaaagcuacggaacuugcauacagaacaggcaaacugaauucuguagaaggaaaacaaggaggggagugaagcagggagcaucagcgagugaagcagggggcaucagcucaccucugaggagagcugaaauagaaacaggauuuucagcucucccccucccccucucccucuccccacggucucccucugaugccgagccgaagcuggacgguacugcugccaucucggcucacugcaaccucccugccugauucuccugccucagccugccuacugccugcgauugcaggcgcgcgccgccacgccugacugguuuucguauuuuuuugguggagacgggguuucgcuguguuggccgggcuggucuccagcuccuaaccgcgagugauccgccagccucggccucccgaggugccgggauugcagacggagucucguucacucagugcucaauggugcccaggcuggagugcaguggcgugaucucggcucgcuacaaccuccaccucccagccgccugccuuggccucccaaagugccgagauugcagccucugcccggccgccaccccgucugggaagugaggagcgucuccgccuggccgcccaucgucugggaugugaggagccccucugccuggcugcccagucuggaaagugaggagcgucucugcccggccgccaucccaucuaggaagugaggagcgccucuucccggccgccaucacaucugggaagugaggagcgucucugcccagccgcccauugucugagauguggggagcaccucugcccugccgccccguccgggaugugaggagcgucucugccuggccgcccugucugagaagugaggagacccucugccuggcaaccgccccgucugagaagugaggagccccuccgcccggcagccgccccgucugagaaguaaggagccccuccgcccagcagccaccccgucugggaagugaggagcgucuccgcccggcagccaccuuguccgggagggagguggggggaucagccccccgcccggccagccgccccgucugggaggugaggggcgccucugcccagccgccccuacugggaagugaggagacccucugcccggccagccgcuccguccgggagggaggugggggggggucagccccccgcccggccagccgccccguccgggaagugaggggcgccucugcccggccgccccuacugggaagugaggagccccccugcccggccagccgccccguccgggagggagguggggggggucagccccccgcccggccagccgcaccguccgggagggaggugggggggucagcccccucgcccagccagccgccccguccaggaggugaggggcgccucugcccggccgccccuacugggaagugaggagccccucugcccagccaccacccugucugggagguguacccaacagcucauugagaacgggccaugaugacaauggcgguuuuguggaauagaaaggcgggaaagguggggaaaagauugagaaaucggaugguugcugugucuguguagaaagagguagacgugggagacuuuucauuuuguucuauacuaagaaaaauucuucugccuugggauccuguugaucugugaccuuacccccaacccugugcucucugaaacaugugcuguguccacucaggguuaaauggauuaagggcggugcaagaugugcuuuguuaaacagaugcuugaaggcagcaugccaagagucgucaccacucccuaaucucaaguacccagggacacaaacacugccaaaucucccucugcgagaaacacccaagaaugaucaauaaaaauaaauaaauaaauaaauaaauaaauaaauaaauaaauuggcagugggcaaaaaaaaaaaaaaaaagaaacaggauuuucaguaauuuuuuuucuuuccuuuuuuuuuuuuuuuuuuuggagauggaguuuugcucuuguugccgaggcuggagugcaauggugcgaucucagcuaaccgcaaccucuaacacccagguucaagcgauucuccugccucagccucccgaguagcugggauuacaggggcccgccaccaagccuggcuaaauuuuuguauuuuuauuuuauuuuauuuauuuauuuuuuugagacggagucucccucuguugcccaggcuggagugcaguggugcgaucuuggcucacugcaaccuccgccucccagguucaagugauucuccugcgucagccucccgaguagcugggauuacaggcgcccaccaccacucccaguuaauuuuuguauugugaguagagacgugguuucaccaugguggcuagguuggucucgaacuccugaccucgugauugacccaccucagccucccaaagugcugggauuaaaggcgugagccaccgcgcccagccuauuuuuuuuuuguauuuuuaguagagacaggguuucaccauguuggcuaggcuggucucgaacuccugaccucaggugauccaccugccuuagccuccccaaagugcugggauuacaggcgugagccaccgcacccagacuuuucuuuuucucgagaugagauuucacuguauugcucaggcuguucucaaacuccugggcucaagcgauccucccaccucagccucccaaguagcugggauuagaggugcaugccaccgcacucagccagggaaaguggcugcugaaccaagaguuccgacuucccaaagggcaacagaauggcaguuacccaaacuuccccagcugaagaaugggaacacaggcuugcagguaucucaggaaaaugacucgcauaguaaucugcuggcacugcagccccucuggccccaaagccccugagaaaacaccagaaagcugcaacugcuuggaacuggggacgcccuaggcucuggcuggcagcucuuggggcccagcaucuagcuucacagcuucucagaugaguuccucucugcaggaacugggaugacauaaggcaaccucauuuuacgugcagacaaaacaccucgcacaauucaaaacacaaaacccaguaucaguucugccaugagacuacacguaaagacaugucacaucaaauucuacagauaaaaagugaggcuucuuugucacaggcuuucaaagucuccccaaaugcaaccacgcugcauggcaagggagagcagccugcaggcccccaggccaccacacuggggugcucccucccuggcucucuccuggaggcuccugccccuucugguguaggggugcaggcccuguggcacucaggacuucaccucugccaacuccacaugccuggcuucugaccucugacaagcaacaugaagacaccuccgcuucugcagacagccccuacguaggcggggaggggacaaucucccggggcucauacacagcacugucaggaagcuacugaugagcugugugcuucccugcuacaccucugccuccccgugagaauuccuccaagucccuucgagauccucagucauggccaggcgcggugguucaugccuguacucccagcacuuugggagaccaaggugcguggaucaccugaggucaggaguuugagaccagucuggccaacauggugaaaccccgucacuacuaaaaguacaaaaauuagcugggugugguggcgggcgccuguaauuccagcuacuugggaggcggagguaggaggaucacuugagcccaggagguggacuguugcagugagcugagaucgugccacugcacucuaggaugggugacacagcaagacuccaucucaaaggauaaaaaaaaaaaaaaagaaaaagauccucagucacuagcgcacacucugaagguuucuuuuuuuuuuuuuaaaaaaagucaccuguucauuggaagaacauacaagaugaaaaaaaagcaaaaagaaaaaaaaaaaaagcaaaaaguaguaaaaaaaaaaugucaucucuauacccuucucccaguacucugggaggccaacgcaggaagaucucuugaggcuaguucaacagcccaagcaacagagaaagaccccuaucucuuuauuagauuauuuaaguuuaaaaauaauuaaaaagaaaaugucaucucaguuuccaugugacaugaaaagucaucuacucuauccauuuaucuguuuaaaauaacaaggguuucaauguuccuguaccacuuaagaagaaacaguucugcguuugguuccuggcuucguuuugcuaagcauuucucucuuuuuuuuuugaauccuugauuuaagguucacauggaacagugauuuucuuuuuuuuuuuuuguuccugagauggagucuugcuccgucgcccacgcuggagugcaguagcacaaucucggcucacugagauggaguuuuuauuugagauagaguuucgcucuuguugcccaggcuggaaugcaguggugugaucuuggcucacugcaaccuccaccuccuggguucaagcaauucuccugccucagccucccgagcagcggggaauacaggcaugcgccaccaugccggacgaauuuuguauuuuuaguagagacuggguuucuccauguuggucaggcuggucucgaacucccaaccucaggugauccgccugccuuggccucccaaaguggugggauuacaggcgugagccacugcccccagcccguuucuuuuucuuuuugagacagagucuugcucugucgcccaggcuggagugcaguggugcaaccuuggcucacuacaaaguccaccuccccaguuuaagugauucuccugccucagccucccgaguagcugagauuacaggcaccugccaccaugccuggcuaauuuuuguaauuuuaguagagauggguuucaccauauugaccaggcuggucuugaacucccggccucaagcgauccgccagcucagccuuccaaagugcuggaauuacaugugugagccacggcaucuggccccuuuuacuaagcauuucuuugaacacgacaaucacugcccagacugggcgcaguggcucacgcuuguaauaccagcacuuugggaggccaaggcgggcagaucacaagaucaggaguuuaagaccagccuugccaacacggugaaucccgaccucuacuaaaaauacaaaaauuagccaggcguggugucaggcgccuguaaucccagcuacucgggaggcugaggcaggagaaccgcuugaaccuaggaggcagagguuauagugagccgagauuaugcuauugcacuccagccugggcgacagagcaagacuccaucucagaaacaaacaaacaaaaagaaaaucacugucccaugugaaccuuaaggucaaggauuccccagcaucacaugaucacuggugauuucaguuucuagucagaagccacuuaacuccuggcagggagaggcaggcacauggugugcucacaaugacauccuuugggcucaacauuuuugcaauccuuuucuauugugggacaaaaucuugaugguaggaucaucucucuaccugucuccuagcugugucaaacuccagggguggucuggauuuggauaaggugaacacaggacagugucugagaugccagacaccaggcuagggggcagggaugccccucaggccugcaggagaguaacagagcccgcugcugagcaguuauggaccacacagacccaccagcaaggcugggauuccagaggaauagagacacaggagucaaacaccaauccucuaaagcaagaacagaaaccuaaccaccaaagcaacgucccagccauccuagaagacagguagcucgugugcugggagcacgagugauggucuuuucugcacucccaauuguuuacuguuuugccucccacugguuuggccagaggagucaggccaccaggcccccagcauuguggagcgaggacaggugagcucggcagcgccuccaccgcacgaguccaccuccuccuguggggucgugugcccgcgccucaccugucggcugcacggucccgcguccugucucuucuccuuugcuuuucccuucucuucuucacauccucguccucguccuccuucucuccuguaacagacaagucccuucgagacgcucugaguggccugcaaaggagcugagcuccagggccuggucggggggcugcagcuuggccaccgcacccugugcccugccacugccugcaccacgcggcaggguccaggaugccccaaggcacugucagagacuccugguggacacgggccuggagugagagcccggaguagucaccaaacuccccacauggccugaggcggccaggaugggcuagggacacagccugcccaccccaugugcaccacagcccccugcucccucuguccuccccauucugcuuguccaaucucaugcccugcgauggggucuucucccaauaucacaggagaagccaauucuccccggaugaagaggcggcagcugaaggccucaggaagugaagcagcugcuccgccgcccucuaucccaccucuagguggacugugacgagcguccuggcggccccgucugaacuagggccucagcaggucugacaguccuugcuggcccgaccucuaucuuccacucacaaaaaccgucaaucuagggcuuucccagggcugcgugggaagcaauccuagaaaaaaauuugggaagagaccaauugguccucccguccgucccccggggccagcagaggagcuccucggagagccacgcggccaucaucccagcaugaggccagggacggacgcugaaaaaagguuggagaagcaucugaacuguaaccccuaccccugaugccagucccgagacugucccacgaagauggcgaccggcgugcgcugcucagaagccucucaaaagggcgugugggauuuuuggcaagaggucacugccugaaacuaugacugcuguuuaauagcaaagucaucccggguagguagcaggaccugcgcgcaacagacaugucaccuuugcuuuagcauugugccgcuaagcgcucggggcgccccgugcuauggacaggacugcugcgggucgcgggggggaggaccgcagagggcuggcaaagccugaacaggaggaacaucuaagccaagggccuucagaauggaugggagcagggccacugaggagccagccuaugauccuugggguaaccagcuacggaaagacccacaggacagguaaagaaacgaguggcuucagggugagcuccaggccgcggcaccucaggccgcucugccaugagggauuuaagccugcucugcuguugcugcagacccucuggucuccugcauuggacaugaagagaccugcugaagggcgcccgccucucaaagacccagugggccugggugcucccgaccccgcaggugucugcugucacacacucgcaggcacgaagcaaugugcagugcagcugccaguauccccaccacagaggcccacagcacagcccagggcaggcgacugaaggaacuggacaaaaggaagccccagagaaaacacuucagggaaaugcacuggccgaggagggcacagaagaugggcugggggccucuucucucauguuucuccuucccuacaaacuucgacugugguggacacccaaggcugccccccauccccacugcagcccacaucgggucaggcagacagacccguuuccaguaaaugcugccccagacacuuugaagcaaaguguuggcugaucgccacggucaaggcccaucugguggcugcagccccucuucccccacagccacgggccccuccauccaggccccuggcuugcucagaagcugggcaguaagugcggggcagcugggaagacacaggaaagcugcaagggacacggugaugccuaccucuuugccucccagagucgcagaguucauccuccuggaaaagaguauacacaaaguccggcagugagcugguguguccagacucuccacaaccagcccagucccuggccacugccuggugggcagucucacccaagaccuagguugcuaugccaccaagaaugagccacaguguguuaggaccagccuccggggcucaggacagggccuguguguccuguuauuacuccuaguugccuucagagauucugugacaaucaccuugcuaaaaagccauucacccacccucucucgguuccuccuaagcugcagaacugccugccccaugacaaagacccacccguacaauucuaugaauggagccuguucaccaaccguagggagauagagucucacuugggggaugccaguucuggcauucuucauagaaaauggguuccaccacguuucccgagcuuuuguuuauauuuacccaaugucuuuuuuuuuuuuuuuuuuuuuuuugagacggagucucgcccugucucccaggcuggagugcaaugaugcaaucucagcucacugcaaccucugcuuccuggguugaagcaaauccucugccucagccucccgaguagcugggacuauaggcgcaugccgccacauccagcuaauuuuuguauuuucaguagagacgggguuucaccauauuggccaggauggucucaaucuugugaccucgugauccacccgccuuggccucccaaagugcugggauuacaggugugagccaccgcgccaggccuauauuuacccgaugucuuaauaacaaucacguauagauaaaaacgauucaacugagaaucugaacagagcugacuccuuaggcagugaacauacggcuaaauuaacaaucagcagguuuacagagauuccuaaucucaagaccagcaaaauagggaucaagugagacucugaaaaccugaaaagccaccaucuccugccuguucccugccugugugacucuaaggacuuggggaaggcccuccuucccacucuggaccuccaggcccuacaccuccaacuuggaucagaaucuacacugggguggcugaggcaccuccccaagagcuugggguggucccggcuaugaacuggccccacgugcugccugccugugccuuguugugaggauggaaggaugaggacaccagucagcggcacccggcacggagcuggcggcaaaugagccuccagccugugcuuggaggcuucagcccacagucccugcacuuacuggccuagagaccagggagaggaacugggagcuuuuuucagaaaaggaauguuuguuguaaguugaaaacuuuuuuuuuuuuuuugagacggagucucccucugucgcccaggcuggggugcagugaugcaacgucagcucacugcaaccuccaccucccagguucaagugauccuccucccucagccucccaaguagcugcuacuacaggcaagugccaccacuccuggcuaauuuuuguauuuuuaaucgagacgggguuucaccauguuggccaggcuggucuccaacucucgaccucaagugauccacccaccugagccucccuaagugcuaggauuacaggugugagccaccgugccggcuaagguggaaaacuuuuagaaaucuagcuaaaagucaggguccugaauccacucagagguagucaaaucuaccauggcagcugcuccugccccuuugugaggaagggugauuaaagaaagaagaaaucccacacuagaggcaaaagggcugccugguggacuuacacccuugaauucuucaucuccugagcggaagucaccagcugcgucaucugccagacacaaagaaaggaaaagucaguccccggagaacggucccauccgguuuccgcccucccaagcucgccauccagggugagucugcccugaccacagugggguugaaacaugccaccugcgaguguccacgacacagauggggcaagcagagcccccagcaggcagccgacccauccuacaucugucuggcccaccuggcccccaggacauaccauuuucggagaaaucuccuucacugucaacccgggccaguuuggugucuggcuccucguaaaguuggaacugcuuccguuuccugcccgugccaucugguccgaagcggucaaacccucuccucuugggcuacagacaacaagcacaccccaugagcuacuuacgagggccaugaagaugccccacagaaaagaacaaggagguuguaggaucagacaacacaggcacaaaaggucuuuucaaaaagcaaagagacaacauaauuugaaacuaaaaagaaaaucaugcugagugaaaagaagccaggaacaaaaggccacacguuucgcgacuccauuugugcaaaaugucuagaacacacaaauccagagaccaguggugguugucgggggcuggugggggcggggaagagacaggggugacuaaugagaagaaguuucucuucugguugacauaaaugcuaagauuagacugugaugguggggaugguugcacaauccuguaaauuaacuaaaagucgaacugcgcacuuaaaaacauuuaagugaauguugagauggggaaauuuuaccucaauaaagcugcuaaaaagagaagcgaaggcggccggaaggaaccuugcgagggcuuacccgaucccgaucccgcauccgaggcugcgagcggccacauccguagggcauggugcugucauagccgcccgcccccugcaugcccaucacgccguagucgggagccauggacugggagaagagggacggagguggccggcugggggagggcccucccaggccccguccacccacguaguucagcucguuccagggcguggacaggggcucagaggacgcagcggggggcacgaaggggucgcugcgcaugaaggugccaggguugcuccgguccuggaagcggcccuggccccggccccgcaugaagccaucaagggagccccgcucccgggcugggucucggcauucacuguacugccccccaaagcugccauugcggucggaccccaggucgaacucauagucguagcuguagcuggggcgguagggguugugcuccggcaggcagggccuggagucauaggacucgaacggcuggaagcggaaggagcugcaacagaagcacagcccaucaggggcggucaccccgaucacccacugccacacucccucaguauaaccucgacgccccuacauucaaaacagcaaaccaaaccacccugcaucccaccuaagugcugggaugaccaaaacugaccaacacccucccuggaacacugcugagcaggggacagagccccuggccacaggaauagcaugauguagaaaaaaggagucucggggagcuuagccaacaaccacgcccaagccccgccaugaagaaaagcaaggaaguccuacuguaacaucacugaccccccacgagcccaacucgucaaugccacacccaagagggaggcggggacaggcccucccucaagagugggugcccacucccaugcgcacaaagguggggauguguggggucccgggggagggcuuggguccauaaucaccucucccgguccuguaugcccuccccaccgccgccgcucccgccccugccuccuuccuuggacaucauguccaaacgcugguugaucuuggcaaugagggagucggaauugucggugcauggcucugggccguaagaggccaugugcauggcaggggccccggccgccaggccgccaucauuggccuuggcggccucccacgaggcugggccguagcuguagguugcgccuguggugacacugguguucugggcgccauaguaauuguaguuuucauaaccugucacagggggaggagccaagucagacuucagcagccacgaggccuguccaugguggacacaaccggggaggggcacccgcugccacggagaaggaaaacgggugugggacccagugcugcuggcaucacuucacacugcacugugaccugccaagaggcagcaggagguggccagagaaaggggcagccucagugccgagcggcggguuuuccaugccagacgcuaggaccuguuccccauucaaagccgggugacugagagccugggaacagcaguuccggcugcugacaggccccacaaaggaccgcugcucccaaagcacggucgcaguccuccccaucaugcuccccugaggccgcccaccacagcccucugcaguccccccauauacacaacagcagccguggcugacugcguccucaggaacagagccagaaaguccacgccagaccucccugacgggcugacccgccuggccuucagaucagaggcccacuugcccgcccacagaccccccccacagaagggcuuaccuugccagcuggccacaccaguuccauaugcaccuuaggggaaacagaaacacacaagagcccuguuugcagaacgaaggcacugacaccccagcugucaccuugcuccacccuccacagccccagggccagggcuucccuccgcagcgcucagggagacacccuuggguguuuuuagcucacucaacuccuacagagcacuaggcugagaggcugagcacaagcaagcccucuaucccgggcaaggccaaccguccgucagggcaagggaagggacgccgcacgcuccccaggaagcucguccacugugggcugcuggccaagagguuggccaggccaggccccaggcagagaccucguaaagggucaguucccaucagaagccagagugcaggcgcugccaacugcacagcgaagcauuggugcaaagucacguccucaacucaagcgaaaaagaggacguuaugugccacgagcgacuuggaaggccuccuccugaaacaccgggugguggcucaaaagcagccccacuccccauguugccugagucagaucucaggcucagaaaacaaaggaagcccucgugcccuaaaacacgggcuggcagaaaggagaaagccucgccagcagagagcaugcacugguucgccacacaagccuagcaucauggcccugacucuaaagcagggaucugcaaaaaguccagccacacccagcccacuucccgccuuggcacagcccuuaggauuuucgaauuucggugcccauaaauaaguaccagcacacugcccguagcccugugcucucaggcucugcccucagcuaaggaugaauuuuacguuuuuaaaugguugggguaaaguuucuaaaguguauucaaugacaaauuuugacaugagauacaucacuuacacacuggaucaaaacucagagaacuauacaaauuaacaaaaacuaugagcuauagugaauaauaucacaucaacauugccugauuaauuguaacaaaugcaucacaccaaugcaagauuuuuuuuuuguuuuuuuuuuuugagauggagucucgcucuguugcaugggcugaagugcaguggcgcgaucucggcucacugcaagcuccaccuccuggguucacgccauucuccugucucagccuccggaguagcugggacuacaggcgcccgccaccgcgcccggcuaauuuuuuuuguauuuuuaguagagacgggguuucacuguguuagccaggauggucucgaucuccugaccucgugaucugcccgccucggccucccaaaaugcugggauuacaggcgugagccaccgugccuggccuuuuuuuuuuugagacagggucgugcucugucacccaggcuggaguacaguggcauaaucacagcucacugcagccuuaccuccugggcucaagcaaucuuccuaucucagccuucugaguggccgggacuacaggcacgcacugccacgccccacuaauuuuucauuaguuggauaaaaggaucacuugagcucgggucucgaacucccaggcucaagugagccucuugccucagccucccaaagugcugggauugcaggcgugugcugccucgcccagcuaaugaaagaucuuacuaaugaggccaggcgugguggcucacgccuguaaucccagcacuuugauuaugggauugauuaugaggucaggaguucgagaccagcuuggccaacaugguaaaacccugucucuacuaaaaauacaaaaauuagcugggcgcaguggugggugccuguaaucccagcuacucgggaggcugcggcugcaguaagccgagaucacaccacugcacuccagccugggcaacagagcaagacucuguaucaaaagaaaaaaaaaucauacuaaugagauuuuuaguacacucacuacagguguaguguacacucaguacaccugaguggaggugggugggcguaugaaacuccacuacucaaucuaaagcuguacuaaaaagucugguaauuauagagaaaaaacaccucggauauacccucagcuauuuacucagaauaacaaaaauauuuugccaaaauagaguauucacuaacacgcaaaaauuaggaacuucaaauuguauugucuguaaguaacuacuggcauugucccauccacucuuucacacauuuaugacugcuuuccugcuacagagacuguggagcccauaaagccacaaagauauucacuaucugaucuuuuacacaaaguuugcugaccccugggcuacuacucucccuugacccaaguucagcucugccaugcuagggccuugaguuaggggaagcccacgccucacccgcaaagcagagcccacuuacccuggguguuggcagguccagcacuccacgccccguagccugcaagaagaccccgugaguuaaaauucuauuugucacaccagagaacggguccuuuuggggguacuccuaaagggaucuccuuacaguucagugccagccuuagaagaaggaagacucccccccaccccaccaaaaaaaagccaucacacaacuggcuaauggcgucaucgcauuccaccuggcugagaucaaagcagaaaaagaagggugggaagugggcuuggaagucagcuccgcccugcagagggaccuuggccaaggaccucaccucuccaagauuucauccacaacugaggcuaacacaagacaauccacucagcaugaggacacguucccccacccaccacacagcuaggaaaccaguucagagugccaucacaaguacuucguaacugaaaacaagcaugggaauuuagugacauaaauugcaucuuucuaagcugcacuuccugccacuuuuuguuuuuuugaggcggggucuugcucuguugcccagguuagagcgcagugccgcgaucucggcucacugcaagcuccgccuccuggguucacgccauucuccugccucagccucccgaguagcugggacuacaggcgccugccaccacgcccgccuaauuuuuuguguuuuuaguagagacgggguuucaccauguuagccaggauggucucgaucuccugaccucgugauccgccagccucggccucccaaagugcugggauuacaggcgugagucaccgcgccaggcccuuccugccacuuuuaaggccuccacggauccccuggaccuuuaagucccagagccuucgccuggcccuaaggcaucagacagcacucuucaccccuccacaccccccgcccacuauggcaucugucuggucccuccaggaaggagaaugggaacuguguucucuuuauuucugugucccuggggcccagcacugagcugcgcgcggguggccaccaugccuguuaaaugacuucacuuugaugaggcaggaacauauccaugucucccucaccagaacaacucccccgcccccggcuaagugccuagugcgugccgauacaccgcaagcacccagcaaacccuguuguccggaaugccauucagagacaagggagcuaggcucauggguuacgagacuugacccagucauacugcugaguuuugcccucugcuaugcuacgccuuccccuccgucauaccgcaaaaccuucuaaauucgcauccgugcagcagaaaggcagacugcagauuccaacagcaaguaaccaaccucgagagacugcuucucugugaagcucuaguguaaguggcacgcacuauuaaccuuaaaacgcucccggaaacacaagaaaucagggaagcuuaacuaucuccagugugucugaaagguuuucggcagguaggaagaggggguaaaaaaaaccucuccaaacuaagaaugaaaagaaggaauacaauaccugcagaaaagaucugaugggaaagaagggaaagaauggugaaaucuacccaggcugcggaagaccaggagagccaggcugagccuucgcuaggacccggaagacaccaaagcacaccgcgcacgcugccgccucaggaccgaaaccucucucugcaauuucuggugcugggauacuuuugcccugccacuucucaagaucgacaacuucucgagcuccugcagccaggaucagaccacuagcuucucuacaaccagucgagcuccacccagcaugucccaacuauccccugugggcaaacuuugcucccaaaaggcucugauuccagaagcagggagcaggcagcucgagaagaucggcccuacugcaggccaagcgcuaaauccuaguggggaaaggacacguucccuccugcacagccccucggccccuccaggccaccacaacagacugccuaaaggagaacugccaaugucaccagccccagggcacaucagguuuccagcuuuauacgaacacucagcaucugccccucaccauccugucccaagccagcacgcgccggguacagagcuggagcccggcgaggcugacucucgcgccggcagcacucggccccaccgcgcugcaccggggacuaaaggcccgaccccgcgcagcccgacggcuuccgggacaggcgcccugggccacgugagcccagcggagacccuacacggccccgcgggccuagggcaggucgggagagaggcggcccccgcgguccgcccgcggccccagacccagcuccccggguccgaccucacaaccccacgcuguagcuccgccccccuagcgccgccauuuuguggcgucuucggaagaggaagccgggagugcaaaccccggggucgcugggggccggaaggacuccgccgaaggugaggggcaaaaacggcccacacugucuaagacgcccccacgaagcccaccgcggcgucugccccaaccccgagucccgcccgccuccucggggccuggcggccaauccgcacgcagagccccgggagcgacggcgccaaagcccaaugagcggcgcgcgcgcgcccuggccgccucuccggagggcccagcuggggcaaccacgcucgggacgaaggcccggccggcggcagucugcgcagcggcugcgucgcccgcacagagccuucccuccccgcuccgcacccagcagccaacacaaaccuccguagcccugguccaugucuucgacgcggcccaccagcagccccguuuacuaggcgaccacagcacgcaugcguucagcgcaccuc

SEQ ID NO: 192688 - RNA, 14113 nt, Homo sapiens
cauucaaccgccgcucugcgcggcgccggcuccgcccccgucggguguuugugguggggcugcggagucgccgaucccgccggaagcgccaggacaauggggacccgggacgacgaguacgacuaccuauucaaaggugcggccgguggggcacagacgggcgaagucguggcggcgaggcggcgggcagacgggccaaggccgcgcuccaggccgcugggcccaggccggagcccggggcuuggggcccggcgggucaggcagccgggaaggccggagccgaccgggcagcaucagcuucgggcuaggaugcgcggcuauacggagccggaggcccggagagaccugggggaccuaggacgcgccggggcggggccagagccuagaggggguggggcccggagcggugggagaggcuguuagggcggggccuccgcaggggguggagcuuucccaagauuuggcgggccgggcugggcugaaagcgugauucgggaugggggcgggguuuuuaggggcggggcuaaggcgugaugggcgugaccaauagguggguugggccugggcaaacggaggcggggcucucacgaggcuuguccugauuggggcagcguguuuggggguggggcccgggagaggcggggcaggcaaugggggcugggccgagaugagggccugggggugaggugugugguggugggagccuuggauuggggugcaaagcugggauugaguggaaaggcacccgugugugcagcaagaauuccaucucuucacucagaacucucaacagugcuaagccaguacuugcacuuuucugagcacuuuacccgaauuaacuaaaauccucacugcagcccuuugagguugauacuaaccagccucucuuuuuacacguugggaaacugaggcccagagugacaaagacacaguuuauaaguguuggaacccgauugagcccaggccaccuguaggccuuaccacuuaggaagcgugucuuagggggcuuguggccagcaucugggacuuuggguuguuggaccaacuucuuccaacacgugcgcacugauggccggggccccagccagccugcuggagggucuuccccgcccgagggacugagggggcucuaggagcaucacauaaggccuagguagaucaggcagccauugcccauuuagggacagcuggaggaagccggagucccuuguuucucagcugagccuucugugcccagcuacacuuuggccuaguggucugcccugguugcugggcucccuggcugacaauggcagcccuugagggcuaaccccuggauccaaggugccuucacccugcggccugcucuaugagggccugcgucgcacaucagcuguugguauccucaccucgcugagccguuccuccgagugugcucuguggcuugcaccaggccuagcugggccuugugucuggucucauccagcgucuucugauuguggggaaugaggcagaggucuccccaccugggcuguccguguggcgaaagccuuccggggggagggagaggaagugccucuacaagggccuagagucguccuguggcacugagggcucuggcagcugcacacagguugauaaugucacuggugggugaggcucuguggucagcaggugcccggcccaaggucucgccccucguggcaggaggaagcuuuggaaggguuuuggagacugggauucuaaggggccgucuggagacagggggacuaaacuuuggguccugcugaucgggugccaucuccacucagcccaccgugaggcagcugcucccagguccuggcugggcacccacccagacguggcacugccagggcagggguguugcuccccacaugccccauccagguuucugugguuauccccugcuuguuauuuuugcccuuuugcuguguuaaaugacccagcuccgagugcuugcucaagucaugguuuugcccuuuagauuauuuccuugaagugcguucccagcagaacaguuacugggucaggagcaauggagaggcugugugguucccgggacuugucugcagagacugcuuccuggaaacacugauuuagcuucugcggcaucuggcauuuggcgggcaggcgguguggggugggggggggcggugccugcccugcugcccuccccacacuggccuccuuuuacugagucuagcaggugcccugcugaccuucucaagcuaguugguagcaaaaaucuaacccacaaguucagcuuuucccaaacuggucaucugccgucucaccuucacagcugugccucaucagaggaccuccucuauucucuuucaauauuuuucuuuuccuuuuucuuuucuuuuuuuuuuuuuuuuuuuuuugagacagaauuuuacucuagucacccagccuggagugcaguggcgcaaucucggcucacugcagccuccgucucccggguucaaacgauucuccugccucagccucccgaguagcugggauuacaagcacccaccacacccggcuaauuuuuguauuuuaguagauacgggguuucaccauguuggccagcugaucuugaacuccugaccucaggugauccaccugucucggccucccaaagugcugggauuacaggcaugagccaccgugccuggccucugcauuuuuuuuuuuuuuuuugguggccacaucacgcacuggcucccuugacuucagcggccaaggccagcagaucccccgggugaugccccgugugccauuuguuuuccuucgugaauguucuuuccuucccccaggaaugacacuguugauuuguaccuaauuauagagccucacauuuauccuccuaacauuuucuccuuuagccaugggccauuuucauagccugccacuaauugccgugggaccccagauuucuuuucugauggacucgguacuccaugguugcagcuguguccccaagggccacugagguccucucagagcccuuccccuacccuagaggcccuggccaaucagggcucaccuggcccuggaggacaugggucgugggggaaacgggccgcagcugccccaggcccuguccucugggucuuguccaccccuccccugcccaaggacaagguggccccuguccccagggaaggggccugccuggugcuucccuuucugugcugaggcuccugaggcagcucccagcccucaagccugggcagaccucacagugggccugcuguuccaguugcuguuuggggacccaaacauaccaucuuccccauuuagaaugggggucccuccagugcccuggcucuguacaccuccccauagaagagcugagacaagaguggcccccagugccggucccuggggccuaggaugcuuaggaccagcuuccaggggagggaugggggcacugcuuggcuccgccaggcucugccggaaugggggcaccauuccccugaagagucucucagucugccugagcauuagggucugggcccccagggccaccacacugucauggggcaggccagggcaccuaggacuucucagaggugccaguucuuuguuuuugccaaccgggcuugccugcucugucagccaaguggcgugucugggguaggggggucgcuucccagccagugaagccaccaacuucuguggaaaugcucggagcuguguccucaagggcucuuuauuuccccaagacaacagauugcuuguguccuagacaaugaaguuuucauccccagccugcauccuggaccagcccgccacugccccgcuggccaccucucugcaucgggcacccagugccagggacugguugggcagcucagccucuuugccauucaccuguuuugucacccagacuggagugcaguggcuuagugucagcucacugcaaccuccgccuccuggguucaaaugauucuccugccucagccuccugaguagcugggauuacaggugccuaccaccaugcccaccuauuuuuuguauuuuuaguagagacgggguuucgccauguugacaggcuggucucgaacuccugagcucaagugauccacccgccuuggccucccaaagugcugggauuacaggcgugagccacugcaccuggccugucauugaucuguucaguggccauuuggccuuugcucugacuuggucacucuggguugaguguccccagcuguucagggagaaugauaauauuuacaucugucccuggggcagcccugagaauguggacagcugaggccugcaaagcacuggggacccagccuggccaaagugcuugagggcaaaacugauggggcugggugccauggcucacgccuggaauccuaguacuuuggaaggccgaggugggugaaucacuugaagucaggaguuugagacagccuggccaacauggcaaaaccccaccucuacuaaaaauacaaaaauuaucugggcgucguggugcacgccuauaaucccggcuacucgggaggcugaggcaggaggaucucuugaacucaggaggcggagaguacagugagcugagauugugucagugcacuccagccugggcgagggagauuccaucucaauacaaacaaacaaaaacaaacaaacugauggggcugaggagccacuaaggcuguacagcuggggcaaggcuggaauggugugaaggugucgggaaugccugggcagggcccgaguuuccugucuuauuuccugaggacgugagaacugagcagaccucccuggccuuggccaggcucccguagcugccguggaaaggagguuaagguuggugguguagaugggggcccucacagugaguccaucuuggcccccaguggccugggagccgauucucaucccuacuggcuugguugggaggugcugggccacacgccuacauucacuccaccucuuuccaucuuucuuuuuuuuuuuuuuuuuuuugagauggagucucgcugugucgcccagcuuggagugcaguggcacgaucccggcucacugcaaccuccgccucccagguucaaaugauucucuugccucagccuccaccaccacacccggcuaauuuuuguauuuuucauagagacgggguuucaccauguuagucagguuggucucaaacuccugaccucaaaugauccgccugccucggccuccccaagugcugggauuacaggauuacaggcaugagccacuguacccggccaucuuucugucuuucucugaaguccacuugguagcccugugcggggcacccauggugacgugagagaaugccagccccguugucuuaggucuuucacgccaggccaagcaguggucuuuggggagaggagaggucugagccgaggggucuugaaggaugaguaggaguuugcuggccgccccagggggacaggcugcccuaugcggugggagcuggggugcccagagccucaaugcccaccccauaaggcagaaccacgacucccgagccacgugcugggguuugggguaggacagugaguguggcagugaguugcgaaggaagaacuuggacuguggaugcagaagaccuggguucaaauccugccuggcucacuucccaggcgguggcuccagacaagucacuuggggagcaccguugggaggugagggcgagcccacaaacaugcauagcuucaggguccugcucugccccgcaccccguuccccauccaagccucaguuuccucaucuguaaaaaugggcuacaggaggcuucugcgaaguaacgcacaucaagagcuuuguuagcacaagcucaucgaauauucuccuuguucuuguuauucuuggcuuccaagcagccaaccagagcggguaccaggugggguuguaggggcugccugauccugcccuccucaccuguggcccaaggguggugaccuggcauccucuagguauggggcaggcggcaugcgugggaggcucugccagccuuuuuggcauuuuguuuguucacuugacagacauuuucuuggguguuuauugugugccaagcacugugccaggaccugauuccugcccuuggggcagacuggcaaaagauaaaugccaccugacaggugagagaguggcaagagugacggaggaagaacuggguccgggagcaggguaauucggagaguagaguuuuaguagcauagcagggagggccuucuuggccaaguggcauuuaaggggccacacgaaggggaugagggagggagccaggugugugccuggagaagagcguuucuggcagcaggagcaacccgugcaaaggcccugaggcaggaucgcaccuggcguguugggggaacagcauggaggccuguguggcuggagcagagugagccggggggggggcgggagggaggaggggagggcccugugggcagcggggaggacuguggcuuuuccccugcggaaggugggggccacggaggguugucugcagaggagggagggaggugcccuggcucggcacucacgggcgcucucugguggcugcugcaggaggacagcguuuugguuggugaugagcgugaacacagggaccgcacagacaauaccuuccagggucugagagucuggaauggaaucgcccagggagacaugguggggugcaccccucguccucccuucucuuggaucuguuucggaugugcugaaggauugauucugagaugcgagagaaaggaaggagucgagaaugacuccagguuucuggcaugagugccugguaggaccaagccaaaguuaaccaagauaaggaggguaggugagcggugggugagcaggcuuagggagugaucgggagcuuggcucugcucuucuggguaugaggggccuggggccccugaggagacaugaaggagacaaugggcacgccagucugggcuucuagggagagagguaauauaggaguuaccagcccauggcugguauuuacagccaugagccuggauggggucaccuggggacuggguguggacagagaugccuguccugaggcucccugagguucgaagguagagugggagacugagugggagugacugugaggagaggagucgggguguggagccccugcaggcagggaaggagggagagcuggcugggugccugcugcacaggcccgggggaguggggguagcugaggcugacacugacugugggggcgaaagcgugcuugguuugaguucuaggacugggggacaggagguggagugagugaguguagaugauaccuuccagugcccgaggcaggaaguugggucaggagagaauguuuucuagagggaaaauuccaaacguguagguacagccccacaguguggccaggggaagggcagaggagggcugccuggugggcuccagggccugcucccucaauguagcaggggucccgaguggggccagcggaccucugggucagccagggcucagccuggcugccagcaccuccccgagcucaggaggaacagccauacccaucucuucccagacaaggaagccucauccucaguggaugcccccuaacucccugggaccagggaugaccaagccacugagccaacccacccucaggugccggggcccaaggcccacacuuggggguccacggggcuucuggcuggggcgucugguuggcuguauucaagugcacacacacacacugaucuuccccacaugguauguucugggucuggggacagcucacccagaccccaccccagagccuggggcggcugggcccauagggacagugcuuccauggcugggacaggaaacaguuuacaaggcagcucaccccuggccugaccagcaggcaccugcucugcucagggaaaguguuccugaugcuccuuggccagcaugagacaggccugcugcacaccccgugucgacugggcucaggcccccgucccugggugcuguugcccacaaacccucaucucuguucuguccacgcugcgcugacuccuuucugggccaggguuugcaucuuggcaagcugcucugcugugcaccccccuccugggacaaugcauaccuguguuggagccuugugaggagcugugcacacacguggacugccacacggacugccccuugaaugaggacuuagccuuggcuggagcucccugcagcucagcaggggaccugacccuggggacagggguggugggagguggcugcaggcucuuuccuccgggcugcguccucagggcacauuccuguuucccacucagccaucugugccgaagcuggauguggguuugcugcaccaggagagguggggguugaggugggaguagcuccucauguccugucacuuacauaccuggagcagugacccuucccaugcccugaccagaaaccacaacaaccgugacagcugccuacucgugucccuuccugugcgaugccugcucuuuucguggggggagacagaaucucuguugccuaggcuggagugcagugauucgaucucggcucacugcagccuccaccuccugggcucaagcgauucuccugccucagccuccugaguagcuggggcuacaguagccaccacgcccagcuaauuauuauuauuauuauuuuuuuuuuugagauggagucucgcucugucacccaggcuggaguacgguggcgugaucucggcucacugcaagcuccgccucccggauucacgccauucuccugccucagccucccaaguagcuggggcuacaggcgcccgcuaccacacccagcuaauuuuauuguauuuuuaguggagaugggguuucaccacguuagccaggauggucucgaucuccugaccucgugauccacccgccucggccucccaaagugcugggauuacaggugugagccaccgcgcccggguacuuuuuguauuuuuuauagagacgggauuucaccauguuggccaggcuggucucgaacucccgaccucaagugauccgccuggcucauccucucaaagcauugagauuacaggcgggagccaccgugccuggccaugccugcucuuacuuccuccuccugugacugccuuccuguucacacauuuggaaaaaguaguccagaggugaagugacuugcccaaggucaccccgcucaggagccuucucaagccgugucuggcugcccagccaccaggcugcagguggaggcucaggguugauggaucucaagcugcucugccugccuggcugccuggguccccuugccccagcugggacagcccugcucugaggaccagacacaggcagguguugugcuauccgcaguggcuguuucuggaaggcaggagccugccuucacuucugcaccacuuagcacagugccugcaggcccugggcuccaggcaucucucgacuccuccacaccguuggcagccgcguuggugcagcacccagggaaccggcgggaagguugugggggcagucguggguggaguguggggauucacagaaccucgccuucccgcccaguggugcucaucggggacucaggcgugggcaagagcaaccugcugucgcgcuucacccgcaacgaguucaaccuggagagcaagagcaccaucggcguggaguucgccacccgcagcauccagguggacggcaagaccaucaaggcgcagaucugggacaccgcuggccaggagcgcuaccgcgccaucaccuccgcgugcgugucggcagccugggcagggacgcugagauucgggggcgugggcuugcagcgcgugggcuuggaaggauguguaggaguugggcaggagaaggggagagugugcucccaagaccagggagugaggcuggaagaacgcuuuagccaugcgccgugggacccucaggcugaccagcgcccagccuucgccacaccaggguaucucuggguaccaagugcagugaggaccuagcucaggccacuccgccuugccgcugccccugcccagccagcaucccagccuuccuccucccucagcuucccuccucacuggugcccacaccuggucccacacgccuccuguccucccaccugggccuggccuccauucccugcaaaggcuucccagccaucaggacccacucagcugccuuuuucuggaccccucccaagccccccagccauucccaccaccgucuugagauccucugggcucccucccaucuccuucaucccucagguacaucugucucucugucaccuccucuuguuuuuuuuuuuuugagauggaguuucacucuugucgcccaggcuggagugcgauggcacgaucucggcucacugcaaccuccgccuccuggguucaagcgauucuccugccucagccucccaaguagcugggauuauaggcacaugccgccauaccaggcuaauuuuguauuuuuaguagagaugggguuucuccacauuggucaggcuggucucaaacucccgcccucaggugauccacccucucggcuucccaaagugcugagauuacagguggcgugagccaccgugccuggcugucgccuccucuuuuuuggagacagacagggucuugcucugucgcccaggcuggagugcagugccacaauugcagcucacugcccccuugaccucccaggcucaagcgauucuccugccucagccuccugaguagcuggggcuacaggccugugccaccaugccuggcuaauuuaauuaauuaauuuauuuauuuuuuaguuuuaguuuuugagacagagucucacucugucgcccaggcuggagugcaguggcgcagucucagcucacugcaagcucugccucccagguucacgccauucuccugccucagccuccugagcagcugggacuacaggcgcccaccaccacgccuggcuaauuuuuuguauuuuuaguagagaugggguuucaccgcauuagccaggauggucucgaucuccugaccucaugaucugcccgccucggccucccaaagugcugggauuacaggcgugagcgacccugccuggccuauuuauuuauuuuuuugagauagagucucacucugucauccagacugaagugcagugucacaaucucggcucacugcaaccuccgccccccgccccccaggguucaagcaauucuccugccuuagccucccgaguagcugggauuacaggcgccugccaccacgccuggcuaauuuuuguauuuuuaguagagaugggguuucaccaucuuggccaggcugaucuugaauuccugaccucgugauccaccugccucggcuucccaaagugcugggauuacaggcaugagccacgacccccggccaauuuuuguguuuuucuaguagagaugggguaucgccauguugcccaggcuggucugaaacucccagccucaagugauccacccgccucagccucccaaagugcugggauuacaggcaugagccaccaugcccagccccuucuucccuuuuuuugaugaccucacgguaucuucuauuuccagcucccaaacucccuccucagacccccacauuucagagcuggauccagggagcagcgcuggggccuccagacacacacccuucccuugaggccacaaugacugccccuuggcucggcccuggacgacccacccugggcgugaugugugcuguuaucccgugaggcugccgcugcccaugguuguccuccagagaggcucaugggccccugacccugcagguacuaccguggugcagugggcgcccugcugguguacgacaucgccaagcaccugaccuaugagaacguggagcgcuggcugaaggagcugcgggaccacgcagacagcaacaucgucaucaugcuggugggcaacaagagugaccugcgccaccugcgggcugugcccacugacgaggcccgcgccuucgcaggugagcagacggagacgcaggcaucagagaggugucuggaaggcaggaggccccucacaguguuggggcccuggccacagcccuggcuucccuucccugaggaguggccuugggaugggccaggugggugggcggggucccugagagcaugugggagccugucacccugccuccccacucaccuaggcaguauucuuuguuccagaaaagaacaacuuguccuucaucgagaccucagccuuggauuccacuaacguagaggaagcauucaagaacauccucacagguggccggggaccagauggguguggguagggcaccagccaggcaggguggaacacggccucugaaccuucgcuuguuuuguucguuugcuuguuuuuuucuuuuuuuugucggggcaggauggauuuuugcucuuugcccaggcuggagugugguggcucgaucucagcuuacugcaaccuccgccuuccagguucaggcaauucuccugccucagccucccgaguagcugggauuacaggugccugccaccacacccgcuaauuuuuguaauuuuuaguagagacaggauuucacaauguuguccagguugaucucgaacuccugggcucaagugauccuccugccucagccucccaaagugcugggauuacaggcgugagccacugcaccuggccuguuugauuuuuuuccaccaccaccccuaaccuuugcuuuuuaaaccugccgguccaccuggacacuucacagggucagaccaggucuagcccuugcuggcacuggggacacagagacccccuggccccaguuccuggggaugggcccugccuuaacucuuggcgcugcggggaggcggguagccucagggaccuggagccuuuuggcuucugggaguuuaccucugagggaggagggcgcuucugaucuuagggagcgagaggccggggcuggcugugaccagauguggguccuggcugggugcgcagccccuguccuuguuaccccugaugugaugggggcgcugugggggucuggagagggccucuggaguccugcagggagggguuccccucggcaggcagggcacgugcuggcucaccccacgucccccuguacccccuuugcagagaucuaccgcaucgugucacagaaacagaucgcagaccgcgcugcccacgacgaguccccggggaacaacgugguggacaucagcgugccgcccaccacggacggacagaagcccaacaagcugcagugcugccagaaccugugaccccugcgccuccacccagcgugcgugcacguccuccgcccgcccccgccacgguauccucuggccccucccugcugucccucuguggccggcucguuccagcccucccagugagcucugcacggccgggccggggcccaggaaggacaggagccagugcuaccccguccugcccggggaaaagcuagaagccccgguuugcugcacccaugaaacucggguccccacagcgucuuggcgggguggggagggcggcaggauggacggggcuggccagaggcgaggaggacgggcggacggcgccgccuucuccccuuuuccuuggccgacucuagggagcgauugccucccucccuccgugaccggguggcccagccagcccgucguccccacccagaaccgugcucugggccaaagcccgaagaaccaggcagcgggggccggggcaggcggaccccccgggcucucagcgcccacccgcuccuccgcacacagcagcucgcacaggccucccaccucugccuguugauugaugcagggagaagcccgucccccccucuccccucuccccuccccucuccugcacgcaacgcgcccucucggcccucccugucccccuccucugucucgucuccccaucuggucuggaaccuguuugcaagugaagcaauaucuccguguuuuguauauacaaccgcucuuguagccuuugguuuuuguuaauguagagaaacacagauucuuuauacacuuuguaagauuuacgccaaaccccagcucucgaucucuucuucucccuguggccccugcgcuguugccccguccccgucaccccgcccguuacugaaauguauaaucugacuuccuguacagaa

SEQ ID NO: 192689 - RNA, 14693 nt, Homo sapiens
uuggaagcacuggaauacagcuuuauuccuacacgauuagacccguuaccccgugggucuggccgaccguccugacucggagaucccugagcugcgccgccgcuuccuucgucaacauccagcagcuacuugaugagcgcccuccagugggccuuaggucccuaugccggcgcgggguuacagcaguggacagacaggccagucccuguccucgaggagcccaugauccgcggggagacaggcauuuaacgacgacucacacgaucacuuaaauacaacuguggugaaccgcacaagagggacgcgcggcggucugcggggaaugacgaggccgaccucgucugcgacccagggagggcaaggguggaccaggcaaagggaacagaggacugggaccuggaggugggcgggaggcguuugguucauuggaggaaaggaauagcccugugugugaugagcauugagaggaggucuggcgagcaccaucuagggcugaagaacuaggcaguggcuccagcgcggggcggugggggggacaagugagccagggcaagaagaauggauuuggcccuagaguacggguucuccaaauguaaccucggcccuacagaucucugagacuaugucaggggguuugugagauuuuauaacaaaauuaagauguuaguacaauaucguguuucgccgccgggcgcgguggcucacgccuguaaucccagcacuuugggaggccgaggcgggcagaucacaaggucaggagaucgagaccauccuggcuaacacggugaaaccccgucucuacuaaaaacacaaaaaguuagccgggcgugguggcgggccccuguagucccagcuacucgggaagcugaggcaggagaauggcgugaacccgggaggcggagcgugccgugagccgagaucgugccacugcacuccagccugggcaacagagcgagacucugucucagaaaaaaagaaagauuauuugcagccgggcgcgguggcucacgcggguaaucccaauacuuugggaggccgaggcgggcggaucaccagguuaggagaucgagaccauccuggcuaacacggugaaaccccgucucuacuaaaaaauacaaaauauuagccaggcaugguggaggacgccuguaguccgagcuacuugggaggcugaggcaggagaauggcgugaacccgagaggcggagcuugcagugagccgagaucgcgccacugcacuccagccugggcgacagagcgagacuccgucucaaaaaaaaaaaaaaaaaaguuuuuugccuucuucauucuauaaguguacaguggaguuuuucagaagcuacaugauauguauugacaccaugguucccacgaugaauagaaugugugccuauguauucucguguuuuaaauuuuucucacuuuuaaguucuaguaccauaaauauugauagcuauaacccacauacccaaaagcuuuuugggguccuugaugauuuuuaagagguccugagagaaaaaaauuuugagaaccacuguccuagagcuccaagaaggugaaugccauaagauguguguuuuuuaaaaaagcauuucucgggccuggugugguggcucacgccuguaaucccagcacuuugggaggcugaggugggcagaucaccugaggucaggaauucaagaccagccuggccaacauggugaaaccccgucucuacuaaaaauacaaaaauucacugggugugguggcaugugccuguaaucccagcuacuccggaggcugaagccacagaauugcuugaacccaggaggcggagguugcaguaagccaagaucaugccacugcacugcagccugggcggaagagugagacuccgucucaaaaaaaaaaaaaaaagaaaaauuaucccuuauauaagugaaagaaaaaaaaaaaagcauuccagccacucaguggagagagauuggagggauuaggagcagaugauaggguauuauuuuagggagcuacuacagaagcuugggccagagaugaugguggcuuccacaggauggcagugagugcccucacucugcuuucuggaagagaggaagguggugaggaauucaggauauuaaaaggcaguugagguguacauggucaguuuagagacauauaaacuaucaugggcacagaugaugggagaaggaugaggcuaauauuuucugcccuccagacacugcugagugcuguaucuccugcaucuucuuaaggagauacacugucuuccuuaauccuccuaaaaguccucucaggcuccgcuguccaauaugacagccaccacccacauuaggcuauugagcauuugauauguggcuaguccgaauugagaugugcugacuauuuaaaauaaacaccuguguuugaauacuuaaggugagaaaagggcugcaauuuauuuucuuuucuuucuuuuuuuuuuuuuuuuuuugagacagggucucacuuugucacccaggcuggaguacagugggacaaccuuagcucauugcagccucacccucccagauucaagcgauccuucugccacagcuccccaaguagcugggacuauagcugugugccaccaugcccagcuaauuuguuuuguuuuguuuuguuuuguuuuuugagacagagccucacucuguugcccaggcuggagugcaguggugcgaucucggcucacugcaaccuccaccucccagguucaagcaauucuccugccucagccuccugaguagcugagauuacaggugugcaccaccaugcccggcuaauuuuucuguauuuuuaguagagacgggguuucaccauguuggccaggcuggucuugaacuccugaccucaggugauccgcccuccucagccucccaaagugcuaggauuacaggcgugaaccaacgcaccuggccaagacuguaauuucuuuuucuuuuuuuuuuguuguugagacgaaguuuuccuuuugucacccaggcuggagugcaauggugugaucucagcucacugcaaccucugccucccagguucaagcgauucuccugccccagucucccgaguagcugggauuacaggugccgucacaucuggcuaauuuuuuguauuuuuaguagagaugggguuucaucauguuggcuaagcuggucuugaacuccugaccucaggugauccucccgccucggccucccaaagugcagggauuacaggcaugagccaucgcacccggccuguaauuucuuauauuguuuacauguugcaauaauauuuuggauguacagguugagcaucgccgauccaaaacucuaaaaucugaaauguuccaaaaccugaaauuuuuuuagugccaacaugaugccacaaguggaaaaucccacagcugcccucaugugaugggucacauauauuauuaaaaauauuguggucgggugcagcgguucacaccuguaaucccaacgcuuugggaggccaaggcagcgggcggaucaccugaggucgggaguucgagaccagccugaccaacauggugaaaccccgucucuacuaaaaauacaaaaauuagccaggcgugguggugggugccuguaaucccaacuacucgggaggcuaaggcaggagaaucgcuugaaccugggagguggagguugcagugagccgagaucgcaccauugcaccccagccugggcgacagagacucugucucaaaaaaaaagagaaggaaaaaaaucuucaggccauguguauaagguguauaggaaacauaaaugauuucuguguuuagauuugggucugaucccaaagauauuaaauauaugcaaauauuccaaagucugaaaaaauccaacauccaaaaacacuucugacccaagcauuucagauaagggaccagaauuauuagauuaaauaagguauauuauuaaguuaauuuuaccuguuucugcuuauuuuuuuaaugugaguacuagaguauuuaaauuuacauauguggcuugcauuaucuuucuauuggacagcacugccuaaguaacuuuuuaaaaucccuacacccaaggaaacauauagauuaaguagcaugcucaaagaguccuacaguuaggauauagugccagguuuuaacccagaucagugugaauuccaagccuagguucugccuaccacaccagcagccucccuccauggguuuugagauaggaugaggagauaaagugacaagggaaagauacagagagguggagcacuguaccuucuuugaauccuugcagguggacagguagacagcuguggggaaagauugagaagggaugggaugcuggagugguagagguggagggcagagggaugggugucaggcucuugggaguagguggggaaaguccaccaaccucaggucauggucaggguagggcugacacuuaccagcccagcccagugccuugaagagcccaagcagaagaaaggcagacaggaaaaggccuacgcuguccucaagggagggcccugaaagaccuggcaggcagaaggggugagagugagcuccugucuuccugggugcuggcucagauuccgcagagcucccagcucuuaccugcuaccuccagggugaccucagcgcugcgccccgaggcaggcaggcugggauggugaauucgacaggcauagcgugccccaugcugcucaguggugacugggggcggcugcaagugcccagagaggcugacagagccaucggaaugguggcgcagggccgagagccaccucugccccucggccuucugagagcggcccccugggccaccccggaguucccacuccaccuccaggcccccagaaggguagaagugggacacaaggcagagcaauuccgggggugccuccccuggggcggcccgugcaaggguugcuggcaucagggacacuuugggggguucuggggaaagaggacgaaaugagcauagggaaaucaguccauacuguccucccuaagagacccucaguuugccugcuggcuuccucagaacuaaagaagguuagguuucuucuccugaaauagggaacccacugucucuccauuggugcgucacagaaauacccaugucaaagccccucaaauuuccaggaaacuucuagccucccauuaccccucuaacucccaggaaccucuuucuaucucuacuuacuugcccaggcacccucuuauccaucaucccucccccuauuacgguccccacaauccagugcccacccucuaccccuggagaccucugucccccaacucacuguacacagcaagcuccagggugaccuguccuugcagguauggcagguguaugguggccagauaggugcccuccugaaaggguugaacuguaggcagccagaaggucccauuuccgguccaugggccccauggcucaucaucaucccaagcagcaaaugccacggccccuucuugggcugcuggcaucuggccauucagcccaggaguugcagccaggagcagaugucccuuacccaggugcuggcgucgccacucuagcccaaagggagggggacccggagccagagaugaggcggccucggagguggggggcauguaggcaaagcucaaguccagcagagcaucuugucccagucucacucgaggggcaggggugugggugaggacagucaguaccacugaggaagacagggagaugagggguugggaggggcaugagggagagaaagaaggagaaaaaaauagagaaaugcaguuauuggggagggcuaaacugcaguuuacccaccccucagaggacaccuuuucugauacucaccauuuccuagcccucccugcaaacuccuuuugcucugcgacuggguggcaccuaguguggcugagggugagcagagaggucuagggguggugaguaggggcaaugaggggguauggccuuugaagccuacucugaacacauagcacacucuagcucgggggacugcagaauccgaggccacuucugacacaaccugaaccacucuaucuccaagcaccacccuugaggaaccaggccuuucuugauuacaggcgaagacaaugauugagccaugacugucagucuuguggugcuguacagaauauuuacugacucuagaagguuccagcucuagccuagaccugagcacagaccucuaugcucuacugaagcaguacagugcaguggcuaagugccuggagccuggcugaccggguucaaauccccucugcagcuuauuuauauggccuugggccacuuccuuuuuccauggcucagcuuccuaaucucuaaaauuaaaaguugaugauaauaauaguaccuacuucaugagguuguugugaugguuaaaucauuaauaccucuugcuacucaagucuauucaguucccaauuuuagauaacagagacaccuacccaugaagggugcuuacaacacugucuggaacacaguaagucuacacguguuugcuauaguuacaccuaacuuagcauaccccaagucaacagcaucucugcaacauuccccacccugcuccaaugcccaucuucccugucuuugaugaaugaucaccaagcccgccagacacuaaaagcaaacccuuggaguuacucagacucauuuauucauucagcaacuauugagcacugaagauguucaagguauccugguagaagacagaauggugaacaagacaagcagucccugcucucaaauugccuauaguccaaugacagacaagcaaauugucaaaaauaaugugcuaugugcuauccccaccaggaccuaacagaucucacaucuguuuccaauuuagguucucaucaauguacguuuagacaauuacaacagcccuccugucuggucucccuauucucagucucuccuucaacuccuucuucacacuguagccaaacaaagugacuacaagucugaucccaucaccuaccuguuuaaaaaucccaaauaugggccagacgcagugguucaugccuauaaucccagcacuuugggaggacgaggcggguggaucaccugaguucgggaguuugaaaccagccugaccaacauggugaaaccccgucucuacuaaaaauacaaaauuagccuggugugguggcacaugccuguaaucccagcuacucgggagaccgaggcaguagaauugcuugaacccgggaagcagagguugcggugagccgagauugugccauugcacuccagccugggcaauaagagggaaaccccguuucaaaaaaaaaaaaaaaaaucccaaauacggccaggcgugguggcucacaccuguaaucccaacacuuugguagccugaggcggguggauuaccugaggucaggaguucaagaccagccuggccaacauggcaaaacccugucucuacuaaaaauacaaaaauuagccaggugugggggcaggcaccuguaguccuagcuacuugggaggcugaggcagaagaaucacuugaaccugggagguagagguugccguaagcugaaaucaugccacuacacuccagccugggcaacagagugagacuccgucucaaaacuaaauaaauaaauaaaauaaaaaucccaaauaccuaggaagucagcugauaaaggcauaggcugaagcuauauggccuggguucaauuucuagcccugcuucuuuuuuuuuuuuuuuuuuuuuuuuuugagauagaguuuugcucgucaccuaggcuagaguauaguggugugaucuuggcucacugcaaccucugccucccagguucaagugagucuccugccucagccuccugaguagcugggauuacaggcguccacaaccgugcccagcuaauuuuuguauuuuugguagagaugggguuucaccauguugcccaggcuggucuugaacucccgaccucaggugauccaccugcuuuggucucccaaagugcugggauuacaggcaugagccaccacgccuggccucuagcucugcuucuuacacacuguguguccuugggcaaauuauuuaacugguuuguguccuauauuuauccauaugcaauacagggauaauauuaaaaccuacaaccuaugguuguugagaggaauaagugagauuaugcauauaaagugcuuagaacagggccuggcauauagaaaauacuugauaaauguuagcuguuacuauuuucauuaccuucaucacuaucauggacuugcugguuaacuuggaaaaaucauuuaaccuguauuuuccucacuaguccaaagaucugaccuuugccuaucuuuuaaaagaaucaaguaaaauaacaggcuuuuuccgggcaugguggcuaacacauguaaucccagcacuuugggaggcugaggcgaguggauuaccugaggucaggaguucgagagcagccuggccaacauggugaaaccccaucucuacuaaaaauacaaaaaaaaaaaaaaaaaaaauuagcggggcgugguugugggugccugugaucccaucaacuugggaggcugaggcaggagaauugcuugaacccaggaggcagagguugcagugagccaagaucaccccauugcacuccagcaugggugacaagagugaaacuccgucucaaaaaauaaauauguacauaauaaaaacaggcuuuuuagaauaacacgcccuccaaaagaacuucugaugguucgcucucaccuacagaacaaagcccagcuuucaagguauuugaacauucagccccuaacccacccuuccaggcuucuccugcacccuacaaaccagccacauagaaccccuuucuugugccuaguagaaguggucaucauuggucaucucuuugcuuuggucaugaggucccuucaguuuacauugucuuucccauuuucucccaaacaucuaucaagcuuguccaaccuccagcccagggaccacaugcagccaaggacggcuuggaauacagcccgacacaaauucauaaacuuucuuaaaacauuaugagauuuuuucacauuuuuuuuuuuuagcuuaucagccaucguuaguguucguauauuuuaugcauggcccaagacaauucuucucccaguguggcucagggaagccaaaagauuggagaccccugaucuaaauacuccauguacaugaaggucacuuucacugcuguuucuucccagaaaugucuagguccuucagguagaaguaaucuuuuucuucuuguaauuauuuuuauguucuuuuuaauccuagcuucugaggccuauaagguuaaacuguucucaucuucauggaauuguucaguagaguaaaaacaguaugcaauuucacuuaguuugucaaaauccagaaacauacuuuugaauuguuaaaaaaaaaaaaaaagauccacaggcugggcacaguggcucacgccuguaaucccagcacuuugggaggccgaggccgguggaucaccugagguugggaguuugagaccagacuggagaaaccccgucucuacuaaaaauacagaauuauccgggcaugguggcacacgccuguaaucacagcugcuugggaagcugaggcaggagaaucacuugaaccugggaggcggagguuguggugagccgagaucaugccauugcccuccagacugggcaacaagagcaaaacuugaucucaaaaaaaaaaauccauagaauuaauaaacaaaaccuggcugggcaggguggcucagacuuguaaucccaguaccuugggaggcugaggugggaggaucacuugaacccagcaguuugagaccagccugggcaacauagcaagaccccaucucuauuuaaaagaaaaaauuuaaaaaaauaauaaacaagaccuaaagguuuuacaguuuaacucuuuuuuuuuuuuuuuuuuuuuuggagacagggucucacucugucacccaucaaaggugcaauccucccaacacagccucccgaguagcugggaccauagguacaugccacgacacccaaccuuuuuuuuuuuuuuuuuuuuuuugagacaguuucacgcuuguugcccaggcuggagugcaguggcaugaucuuggcucacugcaaccuccgccucccagguucaagcaauucucuugccucagccuuccgaguagcugggauuacaggcaugcaccaccaugccuggcuaauuuuguauuuuuaguacagacgggguuucuccauguuggucaggcuggucuugaacuuucgaccucaggugaucugcccaccucggccucccaaagugcugggauuacaggcaugagccacugcgcccagcauuuuuuuaauuuuuaguagagacaaggucugguuauguugcccaggcuggucuugaacuccugagugcaaaugauccucccaccuagaccucccaaagugcuggaaguacaggcgugagucaccucaccugacuccauaauauuuuaaaagaauggugagaauuaaacacuauacacacaaaguauauuaagaaaguauaggccuggcgugguggcucacgccuguaaucccagcaauuugggaggcugagguggguggaucaccugaggucaggaguucaagaccagccuggcuaacaugaccaaacccugucuccacuaaaaauacaaaaauuagcugggccugguggugggcgccuguagucucagcuacuugggaggcugagacaggagaauuacuugaacucaggaggcagaaguugaaaugagcagagaucacaccauugcacuccagccugggcaacagggugagacucugucucaaaaaaaaaaaaaaaaaaaaaaaaguauauuuggggccaggcagcucacacguguaaucccagcaguuucggaggccaaggugggcagaucaauugagcccaggaguccaagaccagccugggcaaccugacaaaaacccaucuccacaaaaaaaauacaaaaauuagcugggcaugguggcacaugccuguggucucagcuacucaggagacugaggcacgaggaucacuugagccacggagguggagguugcagugagcugagaucaugccacugcucuccagccugcacugcacuccagccugggcgacagagggagacccugucucaaauaaauaaauaaauaagcauauuugucaauaaacauuuaaaaauauuugauaagacaaguauaaauguauauuagcaaaaucaugaaugaucuuggacccuggagagauuucauuucuaauuuuacaucaguacaacagcuuucauuuucuuaaaucccugaucaagcagaaaugcuugaaaagaaagagcacagcaggccgggcgugguggcucaugccuguaaucccagcacuuuggaaggccaagguggguggaucaccuuaggucaggaguucaagaccauccuggccaacauggugaaaccugucuccaauaaaaauacaaaaauuaggugggcgugguggcacaagccuguaaucccagcuacuggggaggcuaaggcacaagaauugcuugaacaugggagacggagguugcagugagccaagaucaugccacugcaacugcacucuagccugggcaauaagagggagacuccgucucaaaaauaaauaaauaaauaaauagcaggcaggcgcaguggcucacgcuuguaaucccagcacuucgggaggcgaggugggaggaucaccugaaguugggaguucgagaccagccuuaccaacauggagaaaccucaucucuacuaaaaauacaaaauuagcugggugugguggcaggcaccuguaaucccagcuacucgggaggcugaggcaggagaauugcuugaaccagggaggcggagguuccggugagcgugagaucacgccauugcacuccagccugggcaacaagagcaaaacucugucucaaaaauaaauaaauaaauaaaauaaaaauaaauaaauagcacagcaccuugcuuugaccccaguuguuugugaaauacagacaaucuuaccacccgggcacuuccagggcucccugucugcauguccuucacuuucuacuuuacauuaggauuauccguggcaaauacgcccagaaccuccuggagagcagagucuacaucagaucaucuuugugacccuuaagggcacccagggccaccccagagauucugauuuaaucggccaagcuaagcaugggauugaaucagguuucaguauauuuuagaaaccuccaacaguguggacugagaacugcugaguccuaacucauucuuggugcuaaaaaguauuuauugaaucaauggauaaauuaacacagugccaucucuugauagucacaacaagaaaagcagcugggaaauaguauccacauuuuacaguuggaaaaacaaacucagaaagcaaagaccauucucaucaucaccucgguggagccaguagcccuaggaaauauuccaccccaccagagagagcuacugucuacacaagagcaguguuccucagcuucugccagggugggggcuugagacuaagaauggagguauaggcagaggugaggguuucagcguggguuucaagucugucucccugguucuguggguaauucucaggaggguggagggaagggagggugcagggauugguugggguugcccuguccaucgggcugugucgcugacauaaaauccagauagaaaagcuaagaacucuaccgguauucuaccccggaauaccccgccuccgcugccaggagggagagcucccagauauccaggucagacucuccucauucuugaauuaucugcacagucccucccacgucccagccuagaaaagcuucugacuccugggccucaaacugcaaugcaccuuucagugcaauaggagcuauccaaucuccagccgcguccauccgcccacucgagcccaccuguuugcggaccacagagcggcagcacaucccuacacggggcugucaggcaaggucaacgcgcuagagugcaagagccuuugcuuugcggauugccgcagcgccgggugugggcgcagguggggauagagugcuggguuuugaaagagugacccgcaaagcugagggugcagagcaagacacagaucugggaagagcagagaaaaaacgcuccugcuucugaaccccucccaccucgcaucaccugacaagucucucaaggucuggugucgggaaaccccaccucuucaaagccccgcccuucgaaacaccagaaaguaaccccccugcccggcccugcuuucccccuacccccugccaagcugcaguuuuuuuuuuguuuuuuuuuuuuaacugggugagggcuagaaggagcgguagagauugauucauucuagccaaaccaccucucuuaacaaaaaaaggaaacugaaccccgauuggcgaaaugucuugcucaaguccauaaagcgagaccaccggcugaucuggacccuuagaaucuacccacccuucuccaccuccccuccccagcuaccuguugccauggugaugagaacaggcuccugcugaggcucuggcuguggucgcaagaggcuggagaggcugaggacugggcuggauaugcugaccaucagccaagccccauccagggcccgcgggcaguucugcgcgggggucaggccgcuggcccauuucgcagaggcggggagaggcacgaagcggcucaucucgcaguguggugcgggggcgccccggggauaccgccugaaggcagccuggagggcgcccgcggggucugaguguagagaaggaaguugcagcuguagagucaccgccgggaaaggggcuggaagggcagcguucggggaacuucaaaugcacagacuaccccguagugagacucacuuuacaaaggggaagcugaggccugaggucacugccggaucuaaagaggaggggguuucgguggaggcgacagagguaggggggcggcgagucccuagagacucaccguguacacugagauagagcucagggucgagguccggccggggcggcgguucccccggucccuggcgcaacagcagugcaccgggucucuuggccaggcccuuuccgcucgcauccuccacgaaccaacacucgaucaccgcggguccugcugagacggcggucgccaggccuggcguauagggacgcgagugaggagcgguuuguaugucuggugaccugccccacucccacccuggcaucggcuccaguggggccaccucccuccgcuucccucuaguucuugggcgaugagucgcgggguucgcucacccaaagccacagcgaggagcagagacagggacuucauggcgcugcgaccuccucagccaugaagccuccucuuccuccuuucacuuucacuuuccuccaaagggcggcaugaggggcgguggaaauccccgcucugguuaggugaaggugccugggggaccgguguuuccccacuggccaggcagggacccggguagauccucuccaguucucaccaggacaccccagccuuaccgcgcccuccuggacuacccagcagccccgaguucgagcccuccccaaccccaggcccucccccgccccccaacuccugugugugcucuccaacauccacuugcccgaaaaccauuacuccggcuucccccuaucugugccgcgucccc

SEQ ID NO: 192690 - RNA, 4430 nt, Homo sapiens
guauauaaacuauuuauuaacagacaaggccuacagacuuauuucuucuuggacacacccacggugcggccacggcggccaguggucuuggugugcuggccucggacacgaaggcugcagguaaaaagagaagagucacaggucaugcacagcagaaacaaaagguuggggaaaaagaagagcgaguaggaggaaugcugagucgagguaggcagggagaugagaccccccacucacccccagaagugacgcagcccucuaugggcccgaaucuucuucagucgcuccaggucuucacggagcuuguuguccagaccauuggcuaggaccuggauucagaggagggggcaagggauguuuuauccccugaccuccuaugcccaauucuguuaggacccuccacccuuccucuaauccugcccucauuucaguacacaccuggcuguauuuuccauccuuuacauccuucugucuguucaagaaccagucugggaucuuguacuggcguggauucugcauaauggugaucacacguuccaccuggcaggcagaccaaggucagaucuagauggaccccuuucugaggcugaccccacccccagcccccuuccuuguccucaccucauccucagugaguucucccgcccucuuggugaggucaaugucugcuuuccucaacaccacaugagcauaucuucggcccacacccugaaugaagugagggguuucggaauuaguguugaaucugauuuuuaaauuccuuuauagccucauucaaaaagcucacaaagguaggaucugcaauaaucuauuuugcaauccccuaggucacccuuuccucacccaccuuuccagauauaaaccguucgacagaagguuaacuuugggccggucgcaguggcucacgccuguaaucccagcacuuugggaggcccaagugggcagaugacauugagggcaggaguucaaaaccagccuggccaacauggugaaacccugucucuacuaaaaauacaagaaaaguugcugagcaugguggcaggugccuguaaucccagcuacuugggaggcugcagcagaauagcuugaaccuaggagguggagguugcagcaagccaagaucacgcaaccacacucuaaccugggcgacagugagaccccgucucaaaaaaagaaaaaaguaacuuuguucagggguaugacugaaucaugaacacagaauuuaguauuacagacaacccuuugaaagcaggcaguaucuuuuuuuucccccauugcucagcauauguaguugucacuaagugccuucugauucuugcauuuaggagaacaaggggccugccacuccaagcugaugcaguaaaccagggucuuaugaguuacaggcuuugauuaagguauugggcugucaguuccucagaaucucuaagggucacaauuauuuaggcaaaucacuguauccccauaaucaaaguauuccaagaucacaaacucaauuuugucagugcccagaacugacugcccaaguuauuauaaaaagaaacuaaugcuuacauugguagcaucacaucaacaccagcacuagcacccaugccaucugaacucaugaaccaaagugauuuggagagugaaggaggaacugaauacugagcccugccccucauuuuguccaacuagaacaucagaauguggcccuauuuggaaauaaggucguuacggaaauaauuagguaaaaugacguuauauuugauuagggugggcucuagauccaaugacaaaucaugagagagacacgaagaggaccaugagaugacagcaacagauuggaguaaugcagcuacaagccaaggaacacuaaggauuacugacaaccaccagaagacaggaagaggcaagguaggauucuuaagugccuccagcgccaagaguaauuuucugcuuaguuuauaugaacuuguuacaguaggcuccaggaaacuaaaacaaauggcaguuccuaucugcaagaaagagaucaaggguuggcuucaccguggcucaugccuauaugccuguaaucccagcacuuuaggaggcugaggcuggaggaucacugagcccaggaguucaagaccagccuggacaacacagcaagauccagauuagccagaugugguggugcacaccuguagccccaacuacuuggaaaguugagguaggaggauugacuugagcccuggaggucgaggcugcagugaagagugauuccgccacuccagccugggcgacagucucaaaaaauaaauguggcugggugcaguggcucacgccuauaaucccagcacuuugggaggcugagguggguggaucaccugaggucagaaguuuaagaccaguuugaccaacauggugaaaccccaucucuucuaaaaauacaaaaauuagcugggcgugugccuguaaucucagcuacuugggaggcugagguugcagugagauaagauugcaccauugcacuccggccugggugacggggugagacucugucucgggauaaauaaauaaacaugaccaagggucaaauuauuagguugauucagaagagagcagggucuuucaaauuuauuaauuaaaugacgagguuucaccauguugaccaggcuggucucgaacuccugaccucaggggauccgcccacuucagccuccgagugagccacugcacuaagccucaaauuuaauuauauguuuacaagugaaaagauuuacuucaaaaugggugugggaagagauauagaugaaauaagauuucuaauuuuuaguuagauacauccaugaagguuauucucuauuacacuuaugaaugcugcaccucuacuuaagccucacagccggucucugaaauaaguacaguauuucacacugccuuauuaguuucacagagcacccaacagaaggaauuucccucuacaaauuccucaacagagccaacaguaucccuacuacuauccauucccuaacgucgccuaaguaccuaccaugcaacagaagccaagaagacaggccuagcccugcacgcauggacacauacugguaggcuauuuccacaacuaacuacacauucugacuuaagggaaaaaaaaagaacguuauguaucuagaaagccaagaauucauuagguuuguggagagaaauacucaagugaaauaauauucuugcauucauugauucgauucuuaaaagccaaagaaagauggauguacuccuucacacuucgacaggaaaggagugucaauuauggcucaucugaguaaaugucccacucagacuucuuccacccuccaucuacaggcuucuucacacuuuuuaucuguugguauuucuacuuaucccucaagaugcccaauaauccuccaauucucagggaauauaaauuucgcaggaaggguugcuguuaugauggugggauggguaaagaaaccgaaucuagaagaaaucucacaagcucgugguucaggaaaaucuuagcgaauucgggugagcaaccauaccuccuccccacuuccccaggugaaauguuuuggcuugaccuuagaccacuaucuuggcuuuaaucacuuauuuucugugguaaaugcuaaaggggucagucucucccuaaaccacuuucuuuucuuaauccagcagucaaggugaucuggaugagacucaagucuccccagccuugcuucauuuuugcuuaugucuucacaacccaauucucauuuacauucccuauuccuuacccuacuucacuuaccuuaauggcagugauggcaaaggcuauuuuccgccgcccaucgauguugguguugaguacucgcaaaauaugcuggaacuuuucagggaucacuagagacuaguugaaaaaguacgggggaagaaaucagacacaguaaacuaucaaacaguaaggccgauaaggcaaacgaacuucauacaaaaagguuaagccugucacacaaguggcaagacacccgccccccauuccuuagguuuucacaccacagagcaaacuccucaguccugcagaguaggcacaugaagcguucaagcuugggaaaaugcaaccucuggagagaggaagcaggucuccugcccauucccaaaagugcguggcaaaagccagaguuccccauauacgcccaagccuuagacagcuuucgugcgcccgagcagugacccuuccucgggcccgcucuccggaauuggaaaucuuuggugucccuuuccagggacgcgauccaaggcuccauacagaaagucgcaggcccucagggcaggacguuuccagaacccugacagccggcuuuccuugcccgagcugcgaugccgcuggaucacggcacggauuccagucuuaccauggcugcagcacaagcggcggcguguaggccuccuguggaagagag

SEQ ID NO: 192691 - RNA, 12254 nt, Homo sapiens
gccagcugcugcgcaugcgccggccggggccccgcccccaugcgccgcgcggcuccagggccacguuccagggucggguuugguggauuccucagucccugccgccgcggggcgcccugggauagcggcggggccuccuggugagcgcgcgccggggcggccuccgggaagugggagacgcugcggguccugggcccaggccuugggaugggcgggaaggcuuggccgcgccgggcugugggcacugcaggaggccccugugcagguggagaucgccgcggcccuggcgggacuccuugcuggcucuugggcgcgcugaugcccaucaucucccugaguuucugagcccuaucucucaugugucaguggucaccgccgaauccagacacuccggcccuguuccggaagagcccugauauccguggcuccauggcgcugucugucgauaccaugcacucuagcucucaaggaggaaagguuuuguggaagggaauagagacuuggaauaacagaccugugcuaauuagagacaggaaagauggaacaaggggagugacccuucuccacccccauauccuaaugugcucucucucuauccagaacagaucucggccccuuuccaaacacuccugaugccucauuugccucucgccucuuuucgaccaccauuuugggggcugaggcacucacggggccuccccagguuucacuccguuucuacacagucggagccccauggaucucccaucucccggaggaaccgugaagccaaacagaagcgccugcgagagaagcaggcgacucuggaggcugagauagcaggggagagcaagguuaggggucagacagcuuguccuuggguuucugagacuugagaggggcuggaggagaccggcugaaaugcagucugggguauacuggaucccagccucuucugcuuucucuucucagucaccugcagaauccauuaaggccuggaggccuaaggaguuaguauuguaugaaaucccuacgaaacccggugaaaagaaagguaaguagaauaaguaagaaggccuuuucuuucacauauguguugcccauuuggccugccgaaaugcagccugggaacaaguucagugguuaguggagcucuccucugccuucacagaugucucugggccccugccuccugcauacagcccccgauauguugaggcugccugguacccgugguggguacgagagggcuucuucaaaccagaauaucagguuaguaucuggcagggagggguccuaaauugucuccaggacagaguggcccuugaauacaacuggaccucagaguugagcucacauuguagaccuugucuucuuucuggcucuggugucuccaaagauuucucuuggcagguucccccuggccaauucccuccucuccacucuccucuuauuugcaggacaguucuuccuugaaguucuuucuguucuggagacaguagagggugcucuuuccccaauccaauucucucuugccccuuugacuuuuuuucuuccucuaggcccggcugccccaagcuacaggggagaccuuuuccauguguaucccaccucccaaugucacuggcucccugcacauuggccacgcacucacgguggccauacaggaugcccucgugcgcuggugagaggggagugggggcugcuugaguucuuggaagggaaauaggaagggcaggaaugagugaggauaaacauuuaagcucaggggcucacaggagggcauuuuuguugcaggcaccggaugcguggggaucaagugcugugggucccugguucagaucaugcaggaauugcuacacaaguaugucuuuuguuaccuguuccuuuucuugggcaaaagcaauuucuucccccaaagcaaccaagcaaccugacucuguucauuugcccugaauccaacugcaggcugugguggagaaacaacuguggaaggaacggggagugaggagacaugagcugagccgggaggccuuccuuagggagguguggcaguggaaggaggcgugaguaugaugggcaggacucggggggcccagauggcagauuugguuucuugccucccaccacuaucacuccugacuuguaauccuuggcucuucccgacacagcucugacuuccucagagauggaagcucuggagccuguuaacauuugguggaguuucuaagccuuauguguguggauauuauauaugcauuagaauauucguguguguguguguguguguguguauuuauauauauauauauauuuucuuucucuuuacuuaccccaauuucucuugucuaaaucucaccuucuuccacucgcccauucccaccuuucaauucccauggaauuacccucauucuucugggucuguuaucucaugccaucucugugaagcauccuuggauuucccacaauauggcuaucccuccucucuuccuauagaaucuuuugccucuuuuaauaucuuagaaaaccccauacuggguuuguaaguccauuucuauuagccucuagaggcuagaucaaugccauccucacuugauuuuccuccaacaccuggcauugcugggggcaucgcugggccugguacauaggaagugcuugggaaguguuugcugacaaggaucucucugggcacaggaaagguggagagaucugugagcagcugcgagcucugggugccucccuggacugggaucgagaguguuuuaccauggauguugugaguguucugugccuuggucccugugagugaugggcgauguuuagggaucuguguggggcagggaggaagcaaugccugggucccugagcagggugaugggcugagaaguggcucuuagagguggacacucaggucauuccagggcuccucaguggcugugacugaagcuuuugugcggcucuacaaggcgggguugcuguaccggaaccaucagcuugucaacuggucaugugcuuuaagaucagccaucucggacauugaggugaggcggagagagggaagcagguuugugagagcucugaggcagaguggucaaugauuaagagcucagacucuggagccagggugccuggauucaaaucugaugccugccuguuacagcuguguggcuuuuggcaggccguuuagucucuuuaagccucagcuuccucagucuguaaauuagagaugauggaaugcuugcaucguggggguguuguaaaaauuaaaugagaauucacauaggugcuuggcaagauaccuggccauggcuuaagugcucagugaauauuuauuagaagugugacugcacgagcauugggugagggcagagggagguagcucccgaauccuccaaauggcuuuuagauggauugcagggaggcugggcagauggaugaguggcagagugaagccugggcaugagccuugcagaaaggcugcccucugacccagcuuucucggugccuccagguggagaaccggccccugccuggccacacacagcuucgacugccuggcugccccacccccgugucuuuuggccuccuauuuucuguugccuuccccguggauggagagccuggugagcauaguacucugcagggucacccguuuaccuccauuuuuccuguuuucugaagcccauguugggcugcuaggaacccaucaguccaucucucacauguaccuugguaguguucaccucagcgugggcacuuacccagggucuucugggggauguacaaaaagugcauguggucacugcccuuugagaguguggugugauucuucaggagugcgcuacccaggaaagagaucaguucuaagguauguuuuguuuuguuuguuuguuuguuuguuuugagacagagucucacucugucacccaggcugcagugcaauggcacgaucucggcuccugcaaccucugcuucccagguucaagcgauucuccugucucagccuccugaguagcugggauuacaggcgcgugccaccaggccuggcuaauuuuuguauuuuuaguagagacgggguuucaccauguuggucagguuggucucgaacuccugaccucgugaucugcccgccuuggccucccaaagugcugggauuacgggcgugagccacugcaccuggccucuaaggugugguuuuuacgguaaauguucugaagagcucagagaaagggaagacagaugagcuggaauugucaguggaagcuucuuguaggagcuggugcucccccugaggaauguacagcauuugugauuaggacacugagaauccccaguguccucugggcacccagcaagaauucuauuauaguugcuuuaauuaaugcugcccccauuucuuccaugcaaauuaucagggaauucuuuagcaccagagacccucucagaccucuggucaucagcuuaugggaaacccuggguuccuauaaacacugcuccuacuuuuuucuagucacuccugggggccucuuccaccuugacuacucccugccccuuccccuuuccaguucuacugccuuuagcuauguuggcagugagaggugaggaugaugaccagcuguaaguguuuaaauguuuaucuucagaugcagagguugugguaggaaccacaaggccagagacgcugccuggagauguggcuguggccguucauccagacgacucgcgauacacaguaauacccagugcgcuccugcacucuggcccgccccgccaauggccuucucuucucuuggguuuuaaaugguggcucuuucucucuugcuucuacuuccuuuuccugagacuucucucagugguucugauuggacucccuccuccucuuauaguuuuucuguagcucagggguugacaaacuggcccaugguccuaauccagcuugcggccuuuuuuuuugagacagagucucgcucugucaccaaggcuggagggcaguggugugaucuuggcucacugcaaccuccaccuccuggguucaagcaauucuccugccucagccuccugaguagcugggagcguggcaccaugcccggcacgugccaccacacccagcuaauuuuuuguauuuuuacaaaaauuaguaauuaauuuuuuuuaaguaauguaauuuuuaaguaauguuauuuaguagagacggagugucacuguguuagccaggauagucucgaucuccugaccucgugaucugcccaccucggccucccaaagugcugggauuacaggcgugagccgccgcgccuggcugcuugcagccuuuauauuaucuauggcugcuauuauauacccucuccagcucugcugcaguggcauaauagaguaauugugcugagaaugaauuugucucuaggcccaaaagccuaaaauaucuacauucuggccccuuaagaguuugcugaccuugcucuagcuugcuaccuuccacuuucuaccuucuuauuccugggguucucacgccccagcccagacccuuccaacccucacaggugccuguccuugaucccucucccuucccuucagcaucuacacgggcgacagcuucgucaccccuugauggggcagccucuuccccucaucacagacuaugcuguucagccacaugugggcacgggugaguggaagucaggggagggagagaaaguuggggguccuggaggagaggggagggaaccaggaggaagaggaaggugggagugggagauccucauauaggguggucugaguggggaaugggagggaggcacagacagagaaagucgcaggggcuggggcggugcaggugaugaugauacaucuggaaaagcaaaagccaaggucagguucaguacucaccauggcugugcuccccaaggggcagugaaggugacuccagcucacaguccugccgaugcugagaugggggcccgacauggcuugagccccuugaaugucauugcggaggaugggaccaugaccucccucugcggggacuggcugcaggugguaccacccuauguuaccccauccuuugggggcucucugucccccuaauccuccuccuaguuucuuauuucucuagaggccuucagucuuuacucuugccgcuuuuucuccagggucuucaccgguuuguggcccgggaaaagauaaugucugugcugagugaauggggccuguuccggggccuccagaaccaccccaugguacugcccaucugcagguaaccucauuuuaacuccuuuacuaagggcuaccccaaaagggaauguauggagcuuaagggugacaauaggaugggcucugcaccccuccguuagaauacgagcuccgugucgguuuuauucgcuauuguauccucaguaccaagggccuggcauggcauggggucuugugccccugggagaagucacagggccggaagagcaguggacucacccugucucucuuucagccguucuggggaugugauagaauaccugcugaagaaccagugguuuguccgcugccaggaaaugggggcccgagcugccaaggugaggcugcaguguaggaaggacuggggccagggguugggggagcucccugagaauuggaaugaagaaaugggaagcaggagaccuccugcccugaagaccucuccagcugugguaacugagaggaugugugggauggaggcugggcggcccagcaagggcuggcucauauccuuacucaagcccagaaucuuggcaagaggcuugggagguccuuucugaguuuuaaaaugaccucagaggccacucguccuaucuguggaggugcggccgugcaggaagggcaacauugucuaaaguccccuuucucuccaggcuguggagucgggggcccuggagcucagucccuccuuccaccagaagaacuggcagcacugguuuucccauauuggguaaggguaggguaaggggagcucuuguggagauggggaggggggacugacugguuauucuaagacuucacgaauguccucccggcagggacuggugugucucccggcagcugugguggggccaucagauuccagccuaccugguuguagaggaccaugcgcagguggguaggaagaagcacccggagggccgaguguggcacagagcaccuagcccaggagucagagcuccgcagggccaagucccgcuccugccuggucaugugcuucaugcucauagucauguaaccuucugcgcgaucaaggcucccugaaguggcauuucuuuaucucaccccugggggaaccuggccacucuaagaccacaugaggacgugaaaaccaagugacauuuacaccugucagcuguucuuccucacucuccccaaccccuuccuacuuuugcagggagaagaggacuguugggugguugggcggucagaggcugaggccagagagguagcagcggaacugacagggaggccaggggcagagcugacccuggagaggggugagugccugagcuggggagggauguacaggggagcgggggccugggcaucugggccuuugaggggaacagaucccaagauacagaagguagggucaggaaaguugggaauggagccaaaggggacagcccuggucucuggggguggggguuggccuagaaugguggcagcaguggucugagguccuagaagccaagguuccaacuguccccauucuuuuucuguuucccagauccugauguccuagacacaugguuuucuucugcccuguuccccuuuucugcccugggcuggccccaagaggugagguggguugagagggcgaaagugaaggggaaacgauaaggaagggauggcugggcccccacagaggcuugaggggggccuggggccugggccucuuacugcuccucuucccccuagaccccagaccuugcucguuucuacccccugucacuuuuggaaacgggcagcgaccuucugcuguucugggugggccgcauggucauguuggggacccagcucacagggcagcugcccuucagcaagguaagagcccuucagugcccugccgcuuucugugacuccaguguuccccaaaccuuguccucccuucuaaccccuaaugugguccuuuccacguugcugauuccuuuuuccuaauucacuuccuacccuacccccaaaaguauggaggccagagaucccaaggcaccuccaaggaaaccccccucuguugaccccucccugcccccaggugcuucuucaucccaugguucgggacaggcagggccggaagaugagcaagucccuggggaaugugcuggacccaagagacaucaucagugggguggagaugcaggugaggacgaagcacccacuagagggacaagguuugcaggguuugcaggagagaggaaggcaggcugagggaggagugaggccagcaggugugacccuuauagaggcagggccuucgaccugggucgugaauugcccccuuccauccccaggugcugcaggaaaagcugagaagcggaaauuuggacccugcagagcuggccauuguggcugcagcacaggugagucaucgcugccugccccccaccagcucuagcucaccaccucuggcuuccucugcaacccagguccuggcccugcagccacaaaggcaucugccacccuucuucuuccucugguugcagaaaaaggacuuuccucacgggaucccugagugugggacagaugcccugagauucacacucugcucccauggaguucaggguaagccugggcgaggggugucggggugagcagagggcagcgggcaccugugcaggggcagggcaggggcaggacuucuggugcugcugccaccuacaugcagacuaccucgauucuucccuuccagcgggcgacuugcaccugucagucucugagguccagagcugccgacauuucugcaacaagaucuggaaugcucuucgcuuuauccucaaugcuuuaggggagaaauuugugccacagccugcugaggagguaagagaaaacagaggugcuugggaguaggguagucaggugucagagggccaagguggcaucuggaaggaaaggaggcaggggagggggagucaggccauccugcccccucugccugcagcugucucccuccuccccgauggaugccuggauccugagccgccuugcccuggcugcccaggagugugagcggggcuuccucacccgagagcucucgcucgucacucaugcccugcaccacuucuggcuucacaaccucugugacgucuaccuggugagugaggcugggggaggcuugguauucccaugccugcuucuaauuccucuggaaauuuccaaggcagagagcucuggaguuaauaaguucccaauuguccccucaguuaggagaggagaggagacgagggagucucaguuccccucuuccugggacugguuuuggcagugcagcccaggcacuguugccugccugucaccuggggagaggaggaggagggagacuucuagaaaugucugacaagucggugucagaaggcagaggggaauuuuuucagucccuguaguugcugaguuuggcccaugggcaggcugcgugcugagagaggccugggagggacuagcagcggucuuuagaccagggguucucacgcuguccuacguccaaagcaccuggagggcuuguugacgguggaucccccccgcuccacugccaccccagaguggcuccuuuagcagguuggggugggggugggugguguaaugaauauucauuucuugucccaaguggugcugcugcugcuggcuguggaccacugcccuagcucagccuuuuaaaaaccucuguccccuguugauaagcaaaaaacucaaugauuuuuuucccuaaacuacauguuucccuggaaauccugucccuguguacugcagagaauugcuguccuggaguccccuucuuugugcugaguguguccugggacuguggaucauaucagaagugcuaagugcuucugccugucccucucucccaggacccauggccugccccacuggcggguagcaguggcuguagggaggagggcuguggcccuggaccuguccucugaccauuggcuuccucuccaggaggcugugaagcccgugcuguggcacucgccccgcccccuggggcccccucagguccuguucuccugcgcugaccucggccuccgccuccuggccccacugaugcccuuccuggcugaagagcucuggcagaggcugccccccaggccugguugccccccugcccccagcaucucgguugcccccuaccccagcgccugcagcuuggugagucccaagcaccuuggagugggucugugggugaaugggggggagcaccuucugaagggguuugcugcagggggcucaucugcaggaaugguucguacuuuacuguggagcccuggggaagauggauuguuccugcaggguugcugcgaugacccuagggucuugagggacaguauuagcguagugcucaagagcaggacucuguugcuagacugcuauuuuugagcugugugaucgagccucaguuucccgcauguuuaaacuaggaacaguaauaguauauguuaugguugugaugaggguuggauaaguuaguaauaggguguccccaaaaucucagugcagcuuuaauaacuucagaaggauaaaugcuaugaacucacccaaaaauuauuuuaaaauuuaacuauuuaaauuuauacuuauuugguuuugaguuuugacuaauucauuuuaaauucuaauuuauuuuugguuggccauuucaaucacagcaacuaaacaggcaucaaacacugaucaucuaaaaccucuuaaaugacgccucacuuuuugucauguuccuugagauaguggauuuucuguggugcugaggacagaucucauugcccuaaggagaugggguggaugggucgagaagagagccagcaggguugguacugagucucccaggagccccuuugccaauucugggucccccccauugccaggagcacuggcgccagccagagcuggagcggcgcuucucccggguccaagaggucgugcaggugcuaagggcucuccgagccacguaccagcucaccaaagcccggccccgaggugaggcaaggcggguccugggcucggaucccugcaggaaaagggggcugguggggaaaagagcagagccugaagggccaacccccccguuaggaggugcaggguaggaagggaggcaggagcugaggccuugccccugacaguuucuuucuuuccagugcugcugcagagcucagagccuggggaccagggccucuucgaggccuucuuggagccccugggcacccugggcuacuguggggcugugggccuguuacccccaggcgcagcagcucccuccggcugggcccaggcuccacucagugacacggcucaagucuacauggagcugcaggugaccagaggggauggggaggguuagggcaggcuugggaagcaugcugggaggaagggaggggcugggcucuauaaaguaggggaagggaccuucuaauggaggauggaggccuggcagcaggcggaugucugagccuuuucucccuguucuuccccagggccugguggacccgcagauccagcuaccucuguuagccgcccgaagguacaaguugcagaagcagcuugacagccucacagccaggaccccaucagaaggggaggcagggacucagaggcaacaaaagguaaggcugagggaggcccccagaaggcuccaccccugagggaaugugggccaggaggggccucauuccuggauccucaccuccuuuucuccucguccagcuuucuucccuccagcuggaauugucaaaacuggacaaggcagccucucaccuccggcagcugauggaugagccuccagccccagggagcccggagcucuaacucaucauccccaucaguuuuccucccucucagaccugucuuugaggacaaacagauuugucagcugucagggugcagugggacgucagagacuaugugguccaucgccuucauuguguaaaugaggacacagacuggcuuggucgcagugacugugguguccuugagaugcucacauuacugcccggccugccucccaccuggaagucugggaaugaggagauugagauaaacuuuugaaaucccaa

SEQ ID NO: 192692 - RNA, 20140 nt, Homo sapiens
uuccaagauagaagguaugaaucacuuugcuuuuuccuugcgugaaggguugggggaaaggaauccuaugauccuuaaacagcaaacacugucagcaagacugcaaacaagauccauuuaguggggaagaggggacuauuaaaagcugcuagaaaacugaauaaagcaaaucaagacugagaacaguuccaacucccaucaaucuccaaacagugacaggucggcagcaacuccuuuccuuuauuucuuccccuuguaaagggaaauucaaguucagcagcauuccuuuccugccccaaguccucaaccagacaagaggcugcaggcaccaaaucuugggcuggauaauggcaaaggccucagaagcucaccuccagcucugagcuucaacagcuguuuguaccagugagucagcauuaaauccaccagaaaagaacagcaccacccaaagacuggggggcagcugggccugaagcuguaggguaaaucagaggcaggcuucugagugaugagaguccugagacaauaggccacauaaacuuggcuggauggaaccucacaauaagguggucaccucuuguuuguuuagggggaugccaaggauaaggccagcucaguuauaugaagagaagcagaacaaacaagucuuucagagaaauggaugcaaucagagugggaucccggucacaucaaggucacacuccaccuucaugugccugaaugguugccaggucagcugcaggccagaggcagucuucagaggaggggagaccacagaggacuucuaggccacacaaauaugucucucgggagacuucugggaaggaaagcucacucucggggccggcugaccaugacuucacccagggccuccaacaccucccgcuuguagucuucaaagucaccaucgauuuggcuaacacucugcuccuccaccacccacagcuggcaauugguuucugugaugagucgggcaucauggcugacaacgaucacagcuuugaagaaagauagcaacaacagagggcaggaagaaaggagaaagaggggaaucagaacaugaaauaagggaguccuaggcccuucuguagugaaggacacuacagcuugguccccauggagcagggaugagggcacacucucagcugacuuaccacccuuguauucauugauggccuccccuagagcaucaauagacucuauguccagguuauugguuggcucguccuacauaggaggaauuccaugacugagcacugcaacucccgucuuccauuacuguuacccuuaucccuuuucccacagcccagcucacucaccaagaugaggacaucagguucccgacaggccagcucagcaaacacaacucgcgccuucugaccaccuguagcaaaggaaggggagggcugucacaccuagcaccucacauucugaaggcaaacccucaagaugugccaguuugugagcugaggcucccucauucucgguuccucuagguacaguuuguagacaugaaugauaaggugaagggcacccucccuggccccugaagugguaccagagaguuugcagaucuggauggugugggcgugacucuccaggccgaagcggcccaggcacuugcgggcauccugguagggcagguugaagccccgcugcagguacucagugggcgucuccuccaugcgcagcugcucugcauacugcugguugaagaagccaauuuucugcccgagaagagagggagguggucgguuaaagucacacuuccuccaucagauuaucauucccuaaaucccaaugccaacuuaccagccggugguucuuucucauuuccccaugggucugcaagggaagacaaaguaguuaagaggagggcaagggaaaaaggugcugcagcuccauacaucaacuuuuuuuuuuuuuuuuugagacggagucucgcucugucccccaggcuggagugcaguggcgcgaucucggcucacugcaaccuccaccuuccggguucacgccauucuccugccucagccuccccaguagcugggaauacaggugccugccaccacacccggcuaauuuuuuguauuuuuaguagagacgggauuucaccauguuagccaggauggucucgaucuccugaccucguccauacaccaacuuuucugaaggagagacaaacaccagaaaugggccagggacaaguaugcauaagaaaaggaauaggggcugggcacgguggcucaugccuguaaucucagcacuuugggaggccaaggaaggcaggucaggaggcacuuaaggucaggaguuugagaccaggcuggccaacauugugaaacccugucucuacuaaaaauacaauaauuagcugggcauagugggacaugccuauaaucccagcuacucaggaggcugaggcacaagaaugguuuuaacccaggagguggaaguugcugagaucgcaccacugcacuccacccucggggacaggggaagacuuugucucaaaaaagaaaaggaacagggauguuccccuaauaugacaaaggcauggugagcaaaguaaaagaguuaagggacaaaaggggaguuaagcaaaauggaggacaagagggacaagcaggagggacuaaccacagccaaagaacaccugcucuccauacagcgagacucacgaaugguacaucguaagggccucauguggcaaguuuaguguuuuggggagaaucuaauaauaccuuucuaaagaucuaaucucuggauaugagaaaauggccucucaacacugcuagagagagcagaaauggcuacaaacuuucuaacacacuagauggcaauauauuacaaaaguucaaauaaaaugguagaguuugccgggcgugguggcucacaccuguaaucccagcacucugggaggccgacgcaggcagaucaugaggucaggagaucaagaccauccuggcuaacacggugaaaccaucucuacuaaaaauacaaaaaauuagcugggcgugguagcacgcgccuguugucccagcuacucgggaggcuaaggcaggagaaucgcgugaacccaggagacggagguugcagugagccaagacugugccacugcacuccagccugggugacagagugagacucugucucaaaaaaaaaagguagacucauaugaaauaaguaauugcauggaaaaaugcuugauauauuuggaaaaaucuagcuacacaacaacucauaugacagcccauuuuuguuaaaaauuauaugcacauuugcaaagaaaaaaggagaaagauauccacuaaaacauuaauacugguuaucucagcugggagcgguggcucacgccuguaaucccagcacuuugggaggcugaggcgggcggaucacaaggucaggaguucgagaccagccugaccaacauggugaaacccugucucuacuaaaaauacaaaaaguagcugggcaugguggggcguaccuauaaucccagcuauucaggaggcugaggcaggagaauaucuugaaccugggagguggagguugcagugggccaagaucgcaccacugcacuccaggcugggcgacagugagacuccgucucaaaacaaaauaacaaaaaaaaaaaacugguuaucuccagauuuuucucuugacuuaagcauuuuuuuuuuuuuuuugacagagccucacucugucacuuagacuggagugcaguggcacgaccucggcuaacuggaaccucugcccccuggacucaagcaauucuccuaccucagccucccgaguagcugggacuacagucgugcaccaacauacccagcuaauuuuuguauuuuuaguagagaugggauuucaccauguugcucaggcuggucuguuuuuuuuuuuuagacggaguuuugcucuuguugcccaggcuggagugcaauagcgcaaucucagcucacugcaaccucugccuccuggguucaagugauucuccugccucagccucccaaaauagcugggauuacaggcaugugcaaccacgucuggcuaauuuuguauuuuuaguagagaugggguuucuucauguuggucucaaacuccugaccucaggugaucucccaccucggcuucccaaaguguugggauuacaggugugagccaccacacugggcucaggcugguuuuuaacuccuaagcucaagugaucugccugccucagccucccccaaagaguugggauuauaggcgugggccaccacgccaggccaauuuuuuuuuuuuuuuuugagauggagucucgcucuguugcccaggcuggagugcaauggugcaaucucagcucacugcaacccccgccucccagguuccagcaauucugccucagccuccugaguagcuaggauauaggugcgcgccaccgcacacggcuaauuuuuguauuuuuaguagaggcgggguucacuauguuggcuaggcuggucuggaacucuugaccuuaggugaucccugcugggauuauaggagugagcuacugugccuggcccguuuaugcaauuuuuaaucguucuauaaaagacauauauuucuuguauaaccaaaacacgugggugugcccccuaguucuaucuuaauucucuuagcucuccccccugaacugaucuaagcucuuuccuccucuacugccccucuuagggaaaugaaucaucuaucaugaguucuguauuuaacucuacauucucgagaggcucccugauuccagcuucuggcaaaagcagcugugucuucacauuucucaugcucucccuccuuggcuccaggacucaccggugucagcuugccagucagcagcaggaguagcguacucuuccccacaccauuagggcccacaaugcaaacugcaagauggaagacagguggucaaagagguccccagagacucucccuguggcuccugcuacacaucccugaggcaaccccgccaacucacuccuugaauccaugucgaugccaaaauccaaguucuuaaagagugguuucugucccugguagccgaaugucacaccugaaagccacgaaaagaagcaauuuauauucuuuucagucccugcaaagucccucucaugugcuggccuuggagaacaggagcaaucucagccuugguggagaauuuagggugcacauacaugcuuccggugcuuccuguggagcagcagaggcccgcggcacucaccaugcagacccagcacuggagggcugagugguggggggucuggaaaagugaagcgcacaguguacuccuuagggcgcuucaggagcucaggggccuccugggauuccucaucuugguuuuuccgucggcauuucugcugcuuccgagucagggcuuccuucguuuguuuuuccuggagaggaagaggaaaaaagagaaaccugagcccugcgcggcaguccuugaaauguaggccagcguuccagagucuccuucuuccuccacugccaggagagaacaguggcccccagcccagaagucccucaggugcucaccgccugcuugguggacuucccgccugccuucagcuccuucagcuuuuucucuugcuucucauacuguuucagcaguucuuucugcuucugcugguacaucuuuuugaaggucacuggggcagaagaggggaccaggcaucagugguugcuccucuucccagcaaagggacaaccagggacugguggugaugggguaggcaucacugucuggaauucugacaggauucaguuuaucuaaauaggcccucccacucaggccucuuuucgagguucuaucucuucccugcauccacacacaauccuacuuacuguaauugccccuauaguaguggagccgcugggcaucgagguggaugauaucagugcagacaucauccaagaagcccuggucaugggagacgaucagcaaggucuuccgccagcccuggagguagcuggguuucagagaacaggguguaagugucacaguggucaagugagagagaauucagaggaagcaggcagacaacgggggcugggagggaaaggggggucugaauagagcuccacucacaggcacaguggagaagggcuaaaggaaaacagggcagggagggaaggggaagaaagugcagaaugggaaccaaugaugcaaaggccguaacgcacuuauuaagccagaugacagcguugagguccaggugguuggugggcucauccagcaucagcagugugggcuccaugaacagugcccuagaggguggguagcagagggcagggucagggagagaaagauccuugcucagacaaccccagagaaaacucggagauagagccugagaccaugaacacuccuucccaagcucuccucagagaaguucucgggcaggauacgguuuaauuuuuuugagacagggucucgcccuguugcccaggcugucgugcaguggcacaauaagggcucacuguagucuaaaucucccaggucuaagugauacuucuacuucagccuccagaguagcugugaccacagcgugcgccaccauauccagcugaucuuuaaauuuuuuguagagacagggucucccuauguugcccaggcuaggauauguuuucuucccccuuuugugaagauagagucucacuauauugcccaggcuggucucaaacuccuggguugaagauaauccuccugccucugccuuccaaagugcugggauuacaggcgugacccauugcacccagcugcaggguauguugaugagaacucaccaccaaguagggagauaaauagagaaagacccuaaguucucacaacacagauaguaaggagggagagguaagccuugagccucccuauuggccuuggaagaaugagaagggaaagaggaaaagggccccgguggucugaggcuggaagggagggcagugaggugaauggcccaccuggccagggagacacgcaugcgccagcccccugagaacuucugugugggucgauucugcauuucagggucaaagcccaggccagccaggauccgccgugcuuuggccucugcagcugccgccccaguggcccgcaauuccucauacaccugggaggagggagaagaggacacacgucugagggucccaggaacccccaagucuuugcccguguccccugcgccaucuccucuaccuucucuagccucucagcagcugugucauccccuuguuccagcugucccugaagccgccgcuccucuuccagcagcuucaaucgcuuggugucagcucgaagaacagccuggacugcuggugucucaucugcuaccaccucugggaggcagagggagaacagucaggcagccucaagagccaagagucucaucuuucuuucccuucaauuacauuucuguuuugccugacccugcccagcucuuuguacuuguuccaaauaaaacacucucaaguuccucauugacccuccccuccuuuccuuagcaucccuuucccggucuccagucucccuccacaucccuuccaacuccauagccacaauuucuucuauucuuggcuggcuggcuuuucuacccaacugcccaccccaccaagccccuuuucuccccaguggucucacccugcucacacagcaacacaucaauguugggagggaugcucagggcucgguuggcaaugugcuugaggaguguggucuugcccuugcuggggaauaaaagcuauuaggaccuggccaccacugagaaaucucuucuuuucccuccaggcccuuuuuugccuccagcucccuccucuucucacccauuggguccuaccagcccguagcggcggccggcuacaauguacaggucugcauugacgaacagcuccuugccaugagcggagaugcugaacuucuccagcugcagccaucaggaaagagguggcagagggaagggaugaucacaugaaaauucucccuuugggacaggagcggccacuuucucccugcagggaagccucugacaaaccgcuaccuccagcauaauccccuuccucuccccacagccgguccccgcccuguucgcugccuguaaugggagccccaugcauccucagcuagucuagucugucccacacuauuuucugccaaggguggaccccacuucuacugguuuuucuaucuucuugcucaaguuggcagaaccuaagguguggaaaaugccuccaaucuuucuucccacugaacuaacccauucacacaccacagccacucagggaagaugagagaacuggcucuucccuagguaaguggacuggaaggggccccuugagaccuuaccuugaugucagaugcauuuucuaacauggcuuggcgggaggacaucuccgccugggacacggagaagucauuuucagcugcauuggcugcuuuuaaugaagccacuuggcgcucauacuccaucugagaagguaggaaaaacuacauuugaagccacagucuaccaguuucccaucaccaugaaacagcccaugcuggcugggcaugcuggcucacgccuguaaucccagcacucugggaggcugagguagguggaucucuugagcucaggaguuugagaccagccuggccaacaugcuaaaauacugucucuacaaaaaauacaaaaauuagccaggcaugguggugccacccauagucucagcuauucgggaggcugaggugggaggaucacuugagccugguagguugaggcugcagugaacagagaucacgucauugcacuccagccugaguaacagugugagacccugucucaaaaaauaaacaaaaaaccccaaagugaaacagcccaugucaucagacauugagauaagguucacagaacacaauuauuuucuuacuccgauuguuuuacuuggaguagcccccaaaccuuuccuucguguccccaaucgcauguccccuaguugaaguauuuaaaaauccccuacuuuugaccgcuaagaaccaaggucuuaccuguuuuuucagcuuuuucuucuccuuuuugcuaagaugagcauagggaucaucugccuuagacucuccuccuuccuccuccucuucuuccccuucuccuucuuccucugaacccugugagaacccggggauggucaaaacuagggacuccuggcugggcgcgguggcucacgccuguaaucccagcacuuugggaagccaaagcgggcagaucccaaggucaggagaucaagaccauccuggcuaacauggugaaaccccaucucuacuaaaaauacaaaaaauuagccggacgugguggcgggcgccuguagucccagcuacucgggaggcugaggcaggagaauggugugaaccugggaggaggagcuugcagugagccgagaucgugccacugcacuccagccugggugacaaagcaagacuccgucucaaaaaaaaaaacaacaaaaaaaaacuagggacuccuucuagaacucagauuucacaucaucugcccccugucccugccccagcucuuuccuucacuacucagaguccuaaaauaucuugggauccucucucauucucauacccagccccuggucucccugagguccuuuauuaauuucugcuaccaggaaugguacaagacaaaugguaugaauguguauuuaugaaaugugacaacgcguuaugucccuauaaauguaacucccaauacaauguaacugaagguggaguaaauggauuucaagaguuucauuuguauaaaaugaguuucugugguuuccuuguuaacaugcaaagaaaagaucagguagccguccgggcacgguggcucaugucuguaaucccagcacuuugggaggccaagauggacagaucacaaggucaggagaucaagaccauccuggcuaacauggugaaauccugucucuacuaaaaacacaaaaaaucagccggucaugguggcacgugccuguagucccagcuacucgggagacugaggcagaagaauugcuugaacccgggaggcagagguugcagugagcugagauugcgccaccgcacuccagccugggcaacggagugagacuccaucucaaaaaaaaaaaaaaaaaaaaaaagaucaggaagcucuagugcacagucagaggaauccagcagaaucacagaauuaggaagugccagacgcauagggacccuagagaucuccggacuccuccuucuaucacacaaaggagacaagugagacccaaggggaugggaagauguauucaaggucacacagccagugaaggcagagccaggacccagaucaucugagauaaauuccaggcccuuucuucacuggauuagguguugcaaacuacagcccaugggccaaggcugaccugacauuuauuuuuauauagcuccugaacuuuauaaaaauaauuuuuguauuuucaaagaguuguuaaaaaaaaaaaagaauaugugauagagauuguauguggccugcaaagccaaaaacauuuacuauauggcccuuuauagaaaaaguuugcuggcuggcaugcuggcucacaccuguaaacccagcauuuugggaggcugaggcaggaggacugcuugagcccagaaauucaagaccagccugagcaacauagugagaccucaucucuauacuaaaaauaaaaaaauuagccagggguaguggugcacacuuguagucccagcuacucaguaggcugaggcaggagaaucuguugagcccaggagguugaggcuucagugagccguguucacaccacugcacuccagccugagugacagaguaagauccuguguaaacaaaaacaaaaacaaaaacaaacgaaccaccaccccaacuacucccccaaaaaaagaaaagaauaaagguuugcugggauaauaacuauauccccagauucuaacucucccauaaggacccuggaagcccuagucccucauuccaccuugccccaacaccaaauacacaccugcucugccuucuuggccuucuccuucccuuguuugggaggcuccuuuuccuuuauaauuucuucuucuuuauccuccucuucauuguccagagcagcgaauuuauuuugaggcuaauagggaaaagacaggucugaugaaauguuuuuuuuuuuuuucuuuuuuuuuuuuugagacggagucucgcucugucacccaggcuggagugcaguggcgcaaucucggcucacugcaagcuccaccucccggguucacgccauucuccugccucagccucccgaguagcugggacuacaggcgcccgccaccacgcccggcuaauuuuuuuuguauuuuuaguagagacgggguuuuaccguguuaccaggauggucucgaucuccugaccucgugauccgcccaccucggccucccaaagugcugggauuacaggcgugagccaccgcgcccagcccugaugaaauguuuuaauuccugggccccaauaccuccuccugcuaguuacucucucaccuuagccuucccuuuugacuucucuuccuuucccuuuuugcccuugagugcaggcugcuguuccucagauacggccuggaggagacacacauacacauuacacacauacauacaaauuauugugcuacuuugcuguguaauaagcauuucuagagagucuacuguguuaaccauacacaugcuccuccauuuacgacagguugcaucccgauaaacccaccagaaacuuaaauaaaaaaugauaguucuuggccgggcgugguggcucacaccuguaaucccagcacuuugggaggccaaggcagguggaucacaaggucaagagaucgagaccauccuggucaacauggugaaacccugucucuacuaaaaacacaaaaauuagcugggcgugguggcacgugccuguaaucucagcuacucaggaagcugaggcaggagaaucacuugaacccgggaggcggagguugcagugagccaggauuacgccacugcacuccagccuggcaacagagugagacuccgucucaaaaaaaaaaaaaaaaaaaaauaguuccaacuuaugauggguuuaucuggauauaaucccaucaugaguugaggaguacccuaaaugaguaugacuuucacaccaucauaaaguagaaaaaucguacaccgaagcagaaguuggagaccaucuguauugagugcugcugacgaaaaaugagacccagaaaaacccuacccuccagcuucagacuagauagcgaagagauaacuagggaacgucagcaaggcuaaggauuauaagucaggcaagugcgccaccagagugaguggcacuagcacuggaggcuuucucaagagcucaaauggacauggacuaagaugcacacgcagaagagucacaaguagaagagcaaggaccuggggcuuuguuucagguucugugcuuaaagcaacagaaucacuguagauuucugagugauaaaaauggcaugguuuuuuuuguuguuuuuuuuuugagacugagucuugcucuguugcccaggcuggagugcagugccucaaucucagcucacugcaaauuccaccucccaaguucaagugauucuccugccucagccuuccaaguagcugggauuacaggcgcacgccaccacgccuggcuaauuuuuguauuuuuaguagagaugagguuucgccauguuggucaggcuggucucgaucucuugaccucgugauucgcccaccucggccucccaaagugcugggauuacaggcgugacccacugugcccagccugggcauguauucuaaaaagaugauuuuaacaguauaaguaagacagaccgagaagagcuaguuuaaaagcgggaaauuacuccaccauggccagaaggugcuaaauggagugagagugacugaucgagccaccacugucaccuuauugauccgauucuucuccggcuuggcaggcuuaggaggauguuuuucuuccuccuccucuuccucacucugauccugaaucagggcugcaaaaacauuaccacccuagagaaugaaagggccacagaagucaguaggauggucaagguugcauccuuggagucuccguuuaccacacagauggcuuaccuugguuuucuucccuccgcgggguuuuggggcggguacugaaaugacagggggagaacaugagauaggaaagaauuacaaugucuggccccccaauugaauccaacuugaagaucaggguaugagguaucacucuccaugacucauggauuccagguacccauucccccucaggucauuuaccuucauccuccucaucacugguuggcacugagagcuucuuaagacgcuccaugagcucuuucucuucuccaucaucauccacauccuucuuccgccugccuuuucggguaucucgcuuuuuuuuuugcugcugagagcaaaagaacagugagaaaaugaagcccaggccccugcuguauuucugccucacagaggguuccccaucagcugaauggagcaacaugggcuggaaagggguugguggaacccagaugccucccaggauuggugggcccuguggcacuuguaccugcuguugcuguugcugcugcugcugcuccuucuccuugagcacuuucucuucuuccccagccuguuuaucuucuacugccagcucuucaaagaacuauaaagggaguuaagcuacagguaaacauguuuccaagagcaauccaagcaggcugugcucugccacacauuggcccacuggcccuccacuccacccucaccuuaccuccugucucucucuuuuuuuucuuuuuguggagaauggagugugcaggucucaaauuccugggcuuaagcuauccucccaccucugccucccuaagcgcugggauuacagguguaagccaccgugcccugccuaucuccucucuugacaagaucuuuucuccucccuuggaccucccaccuccuucacauggcuauuuauuuagcuuggaaacauccauagucauuucuuauccucaacccucauuuucucaccguuuuuuugaucuucuuguccuucuucccuuucuucaccacuuugucuagaaaguuaagcggacaucgugaaugcuuaucugcaaauuccaaagcagucugauccccccugcaaagaucucuguagccucuauccuauuuuauuauuuuucuagcuuaacuaucacuccuuaaauauuuguacugucucacaacuccugcagaaauaaucauucccaucucuauucauucauccacuaaguaucuacuaaacagcuaccaugugucagauauugugcuagcguaggggaucauagcaaugaacaagacaaauguggucuccucuggagcuugcaggcuauaggaagagagauuuuuaaauagguaauuccagguguacugaagguuccaaaagaaaagguaaagccuacuugguggugggggagaggcuggcuucaucucugguggcggccucucuaagaagauggcauuuaagcaaauaacugaaguaaugaggaguaugagaaguuagucagacacaugguguaauuccagugcugugcacaggcccagcugugagaaagcacacacacugagagacagggaaagguuugguauggcuaagcuuacagacugaggggagaauggugcaagguaaggcuggagugagggccuuguagcaagguuaaggaauggggacuuuauugguaugaucacuuucacacuuuaaaguuucacucuggcuucagaguacagcaagaaucggagggaauaagcauagugggaaauccacuggggaggcugucagaguagucugggugguggugacaagcggacauaaagaagaauucauaggauggggcuagagguggggaauaaagagcacccggccgggcgcgguggcucaugccuguaaucccggcacuuugugaggcagaggcaggcggaucacuugaggucaggaguucaagacuagucuggugaacauggugaaacccagucucuacuaaaaauacaaaaaauuagccaggcauaguggcgggcgccuguaaucccagcuacucaggaggcuaagacaggagaauugcuugaacccaggaggcggagguugcagugagcugagaucacgcuauuguacugcagccugggugacagagcaagacucuaucucaaaaaaaaaaaaaaaaaaaaaaaaaaaaagagcacucagagaugacuccuguguuuuuagcuggcaaaauuagcugggcuaagugguaccauuuauuaauuaaggaggcaguggaagagaaggucuuauaggaaggaagaagauauuauaaauucaauuugggagauauguguagauacacacacauguauacaacacacacacacccuccuuuuuuuuuuuuuuuuuuuaagagacagggucuugcucugucacccaggcuggaaugcaguggcaugaucauaacucacuguaaccuuaaauuccuaggcuuaggugauccucccacuuuagccuccugaguagcuaggacuacaggcaagcgccaccaugccugccuaauuaaaaaaauaauaauuuuuagagaggaggucucacuauguugcucaggcuaauccugaaccucuggccucaagcaauucuccugccucagcuucccaaacuguuggaauuauaggccugagccacugugccuggccagggggacacguuguuuguaaaaccuauaggccauguaaauagaguuaucugguaagcaaaugaacaccucagucuaugccuuacuuguucugcuugaauauuauagcacaaaucacauugugucauauuuaccugucugugugcuuucauucuagagaguaaccugagagacuguuuagccuguguucccaguaaagccaaaacagauucaacagauucuagcucucccccucuccauccuuguuucccugaagguagaggaccauguccaacucccuccccuacuggaggcagccucaugauuucccuucaggcuuaggccuauuuauuaucuucucuuccaaaacaucccuuccauucacugcuaucuaauucuacccuuaagcauuucaguauuuaauauuaaaaaaaaaaaaauuggucgggugcggcggcucaggccuguaaucucagcacauugggaggccaagguggguggaucacaaggucaggagauugagaccagcuuggccaacauggugaaaccccaucucuacuaaaaauacaaaaauuagcugggcguggcagagcacgcauguagucccagcuacuugggaagcugaggcaggagaaucgcuuguaccugggagguggagguugcagugagccaagaucgcgccacugcacuccagccugggugacacagcgagacugucucaaaaaaaaaaaaaaaaaagaaaaaaagucaaugguauccgccaucuacuacauuaaaauauucucagacuagaauuccauguauuucaaaguaaucauuuauucaggaaaguuuuauggugcaucuacuucuccaaaaaacuagaguuaacgagagacaauuccaauaauuaaaggcuucacagacuaaaauggcccuacccuaucuuuucuguuucccuacccacaccucuggucucgauacuggcuucuuucuguuccuuuaugaagucccaggcacgcuuaugucugucuuugcuuaaucugcauccuccauccagaacacauuucaaaguuuggggcccuccuccuccccaaaaaacaaaccacaaaaaacaaacaaaaaaguuaaagaaaaaaaaucugagcccaguauugggugacuagugugagaguugaaaaauugugcaggauuaauaauaaaaggcuuuauaugcuauuccaaggaguuuaauccuaaaggcauuaggaggaaggaucuacugaaguaccuaagaaggaaaaaccugaucagcucaccuuaucaacacagaugacugacucaucccagacacuaauuucuccccaaggacuaacacagccauaccaucucuccuuccuuuaaaucucuuuuguggccaggcacacuggcucacgccuguaaucccaacauuuuggggaccaaggugggaggacugguugaggccagagguucaagauuagccugggcaacauagcaagaccucaucucuacagaaaacaaaaaacaaaaacaaacaaaaaauaagccaggcauggcggugugugccuguagucccagcuacaagggaagauggcuugagccugcgauugaggcugcagugagcugagaucgcgccacugcacuccagccuggagugaggcuccgucacaaaaaaaaaaaacccaccaaaaccaaaaaaaucuuuuguacuuuaaucacucuuauccacuucauuauagggacaggaaaagccuccgaagaguuucauugugagaaaguauaauccccaaggaacugaaaaagauuaaguguggcuagagauauacugugucuucucuccuuucguauaucgcuuaagcugcuccuucaaggcaagaaagcaagccuucuuuacccuuauaccccucucccccauuacuguuucguauucuuguccucauugggucucaaaaucguaauucacaagcuucacuuucucuucucccauaccuuugaaacauacugcaaucugguaucaucuccgaaugaacacuacuucugccaaaguugccacugaacccuuagcuccucaaaccacaaaguauuuuuugguccuuauuuugccugacuucucugcagcauuccaugcugccuaccuccacaccuuuuuuauucucuucuaucauuauuuaauuucugggaucuugcucacuccugguuugccuccaguuucucuggcuguuugccuuucucagucucaucucuucagccuccuuccccaccugcuuccugcaauugcugaaguucuuuaggguucccaccuuuaaccuucuuuuugguucaaucugcaaacacucucuaggggacucuuccauauccagcacuucaacucuacuugccugugucuuuacuccuaguauaguugucucuccacagugacuaaacaaacucucuucuugccauuuccuuuuagaaauccucagaaacgccuaacucagcauucagaaguucaccuuaucucuuuccacuucuuacucuccuguccauuacugcuuucaguuaauagucuacuagucacuggguuacuuaagugucaaccuuacuucucccuucauuuaaucaguucucaguuccgaucaaugccgccuccuuaguaacucuuuauucuucaggccuuggcuuauccccuuaccacuucucaccuagaucauggccagagcccccuaaauggucuccccgccuccaucuugaccaguucaaggccauucauucuccauugcucagugcuacaggugaacuguucauaaucauuccuuaugcacuucaaugggccuuccuucuuaaugucuuuaggauuaaacuccucggaauggcaucuaaagccuuucauuaucugucuccugagcaucuuucugacuucaucacacuagucaccaggcucuagugggaccagucaggcuugccuacaucucuaccuuccacaaacuuccuuggcuuggaaugcgcuuccccuugcuaauucacgaugaucuuucaagaauaaacucuggggagcagauguaguggcucacgccuguaaucccagcacuuuuggaggcugaggcaggagaauuacuugagcccaggaguuugagaccagccuaggcaacauagccagaucuugugucuacaaaaaauuuuaaaaauaaggugugguggugcaugccaguagucucaacuacuugggagacugaggcaggaagauccuuuaaacccaggagguggaggcugcagugagccauguucaugccacugcacuccagccugggugauggagcuacaaugugccucaaaaaaaaauacucagcuauuacauauucuugggaggcuuugcugacacucccuuaccugucugaguagaugcuccuccucucuucuacagucccauaacauucuuaagcaccuucaucauacucugacaaccacugucugucugguuaaugcucugacccuucaccauacuggguugucccuugagggaaagucuuaucuuuuaucucuacauucccacuuccuccacacaguaccugguauacaguaggcauccaauaagugcuuuuaaaauuaguuacuguguaccuacugggguuaguuguguccauuuaugucccccuuaaaacugacuucaacccugggaggauaucuucauguuuuuuuccuuccccucucaaagcacaguauauagagugcuuaauuaaaaacaagcgcuuaacaaacuuucgcugcuuuuuaaguaaaccuuaacccucauuccaacaucaaaaaucuacacucuugcuccaguugagugagaggggugucuuaagaaagaaaccaugaaggagucacccucucuugagaaacaagggggaucacaggcucccaagguguguguaugcgcgcgcagggggaaggggaggucgaggcagggcucauauauuccugguggaauacaguguaugguggggcggauguccaaauuuuuuaagcaagguuuucccauuucuccccaucucucccucggugccauaugcucuuucuuuuaucucgcccagucucacuuaggucacgugcgacaucuggaucucuuuccuuuaaccccgauuccaaacccacuccuccccggcaaacuccucccgggcccacggcacgcaugcgcaguaacucccgcaggggcccggucagucucgugccccaugacccucucuuaaaacacgcgcagucuccucucucuucccccucugcucguuucuuccuugccuaccagccucaccugaugggcucgugcucucuccguccccgauccacucgggcuccggcggcugcugcuugggcgccuucggcaucgcgguggcaguuacagcuacuguggcggcgcccggugcuauuuccgcuuccggcggcggggaaccccgauggggcuggcucuccaagcuggcgc

SEQ ID NO: 192693 - RNA, 16886 nt, Homo sapiens
ucacuucaguggauccuuuguuccauauuauuuuaaccaaccaaaguaucuugccacaaagaaccacagucaaggcacaaagguaagaggaggagagucuggacaaaguccuguugaggugguaggaggaacugaaaugcccucaguaaacugcagauucuucucucagucauuucugugaagauuacccgaauagcagauaauccaaauugguuuaguuugguuuggcaugcaucacuuuuaccuuuuaugacaacauauguacccuauaaguuguuuauuuuggccuaacaugaaaaucauuuacauucucugaaaagggaaauggcaaagggugagggauggcaacaaacaagcaaaagccuggcuuaacaccaguuccaggccagaugcacacaagccaaaugaaguugccuaucuggcccuucccuauauaccacccucuuccacccuguccuuagggugagaaagacuccauaaccuuuuuuccuuucuggcuuggacaccuuggccagguaagaaggcugacaauuugggaguagcuacuaaguaacauucuuuaaggccagggcuuuguauacaaauacccuucucuuuccucuaauaccugacucuccuuuccaaguucccuugggaacacugugaaaggauagaugugucuugcaggaucucuuccacuuugccucuggagaggagcaaggugacugacuuauugguauagaggcaggcaauaagccaacucugcugaaggcugaggcagggaccuggguucuccucugcuuucuuuucagccucuccuucuccccacauuccuaccucuggccaaucuuacccauaaucgcaaccuuacccuuggaauagaagaccaaagaaaccucccuccucuucauuaaucucuaggaaucuguuccuuuagcccacuucccugacccuucuagccuuguugauguccaaucucugcccucagaaaaacuccucaauaucuagacccaugagagcaucugucauucaucucucaugaauucagagguacacagaccccugugaucuaccucaagaagcaagacuauccugggucaaagaacccccuaaaaagaugugcagggguuucuguuuccuccucugguuugagcaagucagacccucacagauuuuuuguuucuggaaaagccucuccuuccuuccugacccguccuugugcaacagaaaaccugauggacuucaggguagacaauccucugggaaccagcuccccacccugacaguuaggaggaagucacagcugugcucucucauccagcccaguccuaccucccccuccacacaaaaccauccuagaaaccaagguguuucuccaagaugauucaggacuggacccagguggacacgaagacguuccagcaggacacgggaaggaggcccguagcacuugacccugccucaccccagucauucccacaucccaaccugucacucccaaucuguugggggccugaugguaaguggugcagcauucuuccguccagcccggaugccuggguagaagaggggccaaaguuucucaguaaaaguaucagugaagguguagauaugagagcggucugugacauuguagaaagacagugugccggccucauagucuaggaauaugccuacccgcuuggguuucaccuugaugugcaaagggguaaaagguguggugguggcugcauauuuguccccauuccauagccgcacccgccaguagccagucucagggaguggagucaacucgcccuuucggcucacggagucccggcauacacccacugcccagugggucuugucgcccaccuccaccucccaguagugucgaccugaggugaaacccucaguagccaggacgcaaggguagaaggugaaacgccuuggugugucagggagaucccggagucuugucuccacgaacuugacgcucuuacgauccucugacaggacuagguuaggaugagcugucucaggguccagggucacauccgcuggcgggagaagccagaguggggagcuagaugaggaugggaauagcuaaaugccccugccucacucuuccagccugccuuuacagagccuggucccuuaaagguccccagaacaaccugguuugguuaacuuucucaauccauggugucaccuaaggaaggggagaaagcaauggcucacuucucacccugacccuaaaguaaacagauaauaaucucuugagucugcaguggcugguaaucuagguucccgccugguccucucuucaucucccucugacauuaucauuuaucucacuauguagagaaguacaagguguagucugaggggcagaaaaaaacggaaaguguuaagaaggaugccgagcaagacagcauauggucuagggauagggugaccauguguguuuuccaggaacuggccugguuuaugacuauuuucccugcauauucacauuaauauaaugacacucccuuucaguuucuuucuuuuuuuuuuuuuuugagauggaaucucacucugucccucaggcuggagugcaguggugugaucucagcucacugcaaccuccgcuucccagguucaagcaguucuccugccucagccuccagaggagcugggauuacaggcgcccaacaccacaucuggcuaauuuuuauauuuuuaguagagaugggguuucaccguguuggccaggcugaugucgaacuccugaccucaagugauccaccagccuuggccucccaaagugcuaggauuacagaugugagccaccgcacccggccuuugaagguuaugcaaguuuacaugguaaauuauauaaccacucuacccgaugacuuuggcaaauuauuuaaccuuucugggucucuauuuagaaaagaauggaccuaagaguagauaacgcuuaaggcuuccucucacuccaaguucugugacucagggugagacuaaaagccagauaaagggguaggugugugugggaguaagaaaagugagacauaggauaacugaaacccauauaagguaggaccuaaaaacuuucuucucucuagugguuucuucuaguuuccuuuugggaacaacucaccaauuagcuguuuaaggauuuuccuuagggcaaaguacugucggggaaaauugcugaaguucuuuuccagcucuauggauacugaagucaccuccauggucuucaccuuuucacaucuaggagggauagggagauaggggaagaaagggcaggguuagggagaagcuccagccaagugacuauucagauguuaacauuuuuagggagaaauuaaaauucuccaucuucccacuuucuuccuccucccugaaaagcucaccuguugauuucuuuuacuaauccaaggagagccuuaugaucccguggacagaucguugagagugagccuccgaacuuucuaggaauauuccuguauuucaugcaaauggaugauugcccucccugcucucccaaccccuuccuccugccaucuuguuuggacacaauuccacccacuggcacaaguagaaucugauucuaccuuaucauucuccuucucaagaaguccugauguucaaaggggaaaagggauuauuauucccaauaauuuguucucuaacuggcuucaugggcacaaugaacauucucccauacccugcccagacacacuacaugacuuucccaaccucacccccaacccaaacuccugacuguaccccuccucucuaagccaagaccuaacucacucagagagauacaacaaucacuuacuuuuccaggguacuuuugacauccuagaaggaaggagaaaagaaagcaauauugguccugguauucagugguccugaaggcaaaagguucccccuccuccccaaaguuccacagcuauaaaauagggauaggauaaacugagggucacacagugcaagaagagcuccagcgggaccugaaugcacuucucccaaccuaaucccuacuuucaacuucuggucaucaugaagcuuggucauuuauaucacuucccaaugauuucuuuuaugcuugucuuugcuccucaaggaugcugggagcucccuauaagggacagggauuguaucaauucuuuacucugucccccaaguaccaaccacauaucucacucuccuugaggauaaguacagagaguuccagacugguggcauaggaacaaaucacacauuccuguuacgguuugguauccccugucuugcauuaguuaauaaacaucaauaacuggcugggcacaguagcucacgccuguaaucugagcgcuuugggaggccaagacggguggaucacuugaggucaggaguucaagaccagccuagccaacauggugaaacccugucuuuacuaaaaauacaaaaauuagccaggugugguggugugcgccuguaaccccagcuacucaggaggcugaggcaggagaaucgcuugaacacaggaggcaaagguugcagugagccgagaucaugcacugcacuccagccugggcgacagagcaagacucucucagaaaaaaaaaaaaggaagaauaaacacauuaauaacugugugcuaauacugauuugugaauacuugggguccagaagacaaagaagacaaaucucugucccacaaggauuucccaguuuaauauggaaggcagaacacacauacaugaaaggccauaggaacaaauaccaagcaauacguaacauaaaaauaaauguacaaugaagccucacugcuucaaaugcugguaaucuaaucucuaagauaaaaaauauguucccuaguuuugcuaacaccauucauuuacguaagagaacaaaauauuucaaacacuuuagagguauuauuaauauauacauaucaaaagcaauauauuauuuaaacaauuucaggcauaccucauuuuauugcaccucgcuuuauuguguuuuguugacauuguauguuuuucagauagaugguuuguggcaaccuguguugagcaagucuacuggcaccauguuuuccaacagcauguguucacuucaugucucugugucacauuuugguaauucucacaauauuucacacuuuuucauuauuauaucuaguaugaucugugaucagugaucuuugauguuacuauuguaaucguuaugggggcacugugaacugcauccauauaagacgaacaacuuaaucgauaaauauauuuuauguguucuaacugauccacuaccagcuauucccucaucuuucuccaucuccucuggccucccuauuccgagacacaacgauauuaaaauuauaucaauuaauaauccugcaauggccucuaaguguucaugugaaagaagaaucacaugucucucacuuuaaaucaaaaccuaaaaauguuuaagcuuagugagaaaggcacauugaaagccaagaugggcugaaagcuaggccucuugugccaaacaccaagccaggcugugaaugcuaaggaaaaguuauugaagaaaauuaaaagugcuacuccagugaacacaugaaugauaagaaagugaaacagcuuuauugcugagauggagaaaauuuuagugaucuggauauaagaucacaugauucccuuaagccaaagcccaauccagagcaaggcuguuaacuccuucaguucuaugaaagcugagagagguaaggaagcugcagaagaaaaguuuaaaguuagguagguuguuuuaagaaaagaagccaucucuguaacaaaaaugugcaaggagaagcagcaagugcugaugcagaaguugcagcaaguuauccagaagaucuugccaagauuacugaugaagguggcuacacuaaacaacacauuuucaaugucaacaaacagccuucuauugaagaaggugcuauccagggcuuucacaguucgagagaagucaaugccuggcuuuaaagcuucaaaggacaggaugacuuucuuauuagaagcaagggcagcuggugacuuuaaguugaaaccagugcucacuuaccauuucaaaaauccuagggcucuuaagaauuaugcuaaaucuacuuuccuugugcucuagaaauggaauaacaaagccuacaugacaguacaccuguauacagcaugguauacugaauguuuuuaauuaaaaaaaauuaccuuuuguagagaugggguccugcuauauugcccagacuggucuugaauuccuggccuuaagcaguccuccuggcuugaucucucagagugcugggauuacagaugugagccaacgugccuagccuuuacugaaguuuuuuuuggggggauggaguuucacucuugucacccaggcaggagugcaacugcaugaucuuggcucacugcaaccucugccucucggguucaagcgauucuccucccucagccucccgaguagcugggauuacaggcgcccaccaccaugcccagcuaauuuuuuuguauuuuuaguagagauugggcuucaccauguuggccaggcuggucucaaacuccugaccucaggugauccaccugccuuggccucccaaagugauaggauuacagguguaagccaccgugcccaacccuuuacugaaaauuuuaaguugagaccuacugcucagaaaaaaagauuccuuucaaaauauuacugcucacugacaaugcacuugaucacccaaaaguucugauagagauguaaaaugagauucauguuguuuucacguccgcuaacacaacauccaaucggcagcccauggaucaagaaguaauuuggacuuucaagucuuaauaaauguauuucauaaagcugcuauaaauagugauuuuucugauagaucuaggcaaaguaaauugaaggcuuucugguaaggauucaccauucuagaugccauuaagaacauuugugauuugugaaaggaagccaaaauaucaauauuaacaggcauuuagaagaagucuauuccaacccuuauggaugacuuuuagggguucaagacucccauguuguaaguaacugcaaauguggguuuucaaagauuuucaaagaaguucuacuggugaguaaaaugcuauuaaacagcaucacaugcucagagauaucuuucauaaaaggaagaguugaaaguaaacuucgucguugucuuauuuuaagaaauuaccacagucaccccaaucuucagcaaccaccaccucgaucagucaauacuaacacaagacccuccaccagcaaaaauaugauuccacuaggaaacccaacaauuaaugugacuugcuuuaucaagauacucgcuuuauugaagugguauggaacugaacccacaauaucucugagguaugccuguauccuuuaaacuauguuucuguccuuuuucagcaguacauaaaucaaauuucaggacuuaaaaguaaugguaacugcauuuacaaaauuuuuaaugcauaguuuuucacuaacucaggcuagacuucccuccuuucaaaagaaugaaucuuuucuuuggaacagauuaagcacauaauugcugaccagagauaagaacacaaaaaugguuagaaggggaugggagaaaucacuuuuccguagcaaagacccuuugaguacaccuggcagaaagaacuggauuuagagaaggagagcagaagaaugaguaucccaggcugacaaaucccaggcuacgcaaagcuacgcugcacucagccugaggggcuaugcaggggcaaaggucgaaccuuaagcaucucgaagccugacuguaagcacuugcccuccaccucggcagccaagugggccaggucccggcgcuuguccccaaggugagcagcauuuucucggagucgcugcagaauguccuguuccucuucuuccagucgugaaagcaacaccugcugcucuucauccagccgccuaugaagcucuucaaacucccucaagaucugcugucggcgacuuuccacuagucucugagaagagagggaagauguuguaucagcagggucagugugguauaaggaagccuuucucucacccaccauauguaugaauuaacacagacuuccaguuucauugaaaaugguuuaacaaaggcuggguguggugacacaugacuguaaucccaggacuuugggaggccgagggagguggauugcuugggaugagaaguuugagaccagccuagguaacauggugaaaccccaacucuacaaaaaauacaaaaaauuagcugagucugguggugcaugccuguagucccagcuacuggagaggcugaggugggaugauggcuugagcaaagaaggcagagguuggaguaagcugaaauuguugcaccauugcacuccagcuugggcaacagaucgagaugaaagacagacagacaggaaagaaagacagaaagacaaagacagaaagaaaagaaagaaagaaaaugagagaaaaugguuuaacagaacacucauuuuuuauuccauuggaauuuccuucuguaaagaauggcuccaucacuaucaccccccuacugaugacuugguagugaagaccacugcggauauauauauuuguuuuaauuuaagauaaagaacucaauaauaugaugacauuaacuauuacagauaucagagauaucuguguuauuaucaacuguaaaguucuaguuaauucaaucugucgagaaaaggaaaguauaggcucagcaugguggcucaugccuguaaacuuagugcuuaggaggcccaggugagaggaucacuugaggccaagaccaaccuaggaaacauagugagaccuuguuucaacuaaaaagaaaaaaaaauuagucgggcauggcaaugcacaucugcaguccuagcuacucaaaaagaaucaagaggauggauggccugaacacuggaguuugaguuagugugcugugaucacuacugcccuccagccugggugagugagauucugucucaaaacaagcaaacaaaaaacaacgaaacaaaaaggaaaguacaaauaauaaaaaguuaaaaauaagauugucauccuuugcauauugcaacacaugcaccagauaaaaaccagagaacugggaaaguguaagaaucaguaagaguuauauggguuauuauaaaauauacauauguagauuucagggcugaacuuguuaaauuguuucaagucacuucagagaacuggcaauuccuaccccaggaacagguuacagaaguuuguuaguaauuuaguuucuugaaauuugaaacaugcuuucuuuaagccagcacacagacuuaagccucuaacauuccugaaauuugauaauauaggacucaaacaccagccauaacacuuucugagaauuaucagcacauccucucuucugcaucuccacuacaacaaauagugaucucccuaaagaauuccccaagcaucaugugacugaugaugaagcaaagugagaagcagagacugggacucuagaaggaaguggauagggaaugaaaggcaggcuugaggguggagagagaguggggaugcaaagccaggaugggccugacaagcguggcauuuguggauucaagcuaguuccuggcagaggcugacuagcucuucuaguuuagggccacuugcugcuucacuuuccaccacugccuucucaguguacaucugaacaaaauauauucucacauuugcccucaauaaaacacagccuuuguguguguguguuugcacaugugugugcaugcauguguguuuguuuagguauggguguaaguuuaacauucaugacugugauaaauaggaagcaaaaaggcccuuccucuuauaaaccgguaaucuuuucucuuuuuuucacucuauauuuuagggcagugguucuugaugaagcuguuaacacacucugaggauauuuuggaaauaggcacaucuucuuguuuuccaugguuggggaaguuccugacaaugacgcaagcacuccuccaaugugugagacaauccggcauagugaacugaccugcaacauuuucuaauguucugcuggauauucaaaaacacaggccugggcggccaggcacgguggcucacgccuguaaucccagcacuuugggaggccgaggugggcagaucacaaggucaggagaucgagaccauccuggauaacacggugaaacccugucucuacuaaaaauagaaaaaaaaaaucagcugggugugguggugggcgccuguagucccagguacuugggaggcugaggcaggagaauggcaugaacccgggaggcagagcuugcagugagccgagauggcaccacugcacuccagccuggaugacagagcgagacgccgucucaaaaaaaaaaaaaaaaaaaaaaccacaaaaacaaaaacauaggccugggcuugaaugccauuuuauauaguauaaacacagaguaauucuuacaugguuuuacuauacgugaauuuuucagcaauagcugaauaaaacccaagauuauauuguuauacuuagaacuuuaccaaaaguuauuacuaugaaaaaucauaucaccaagagcuaagcuacuuaugguauuucaaucauauuggcacacauccaucucagucugaauuuguauuuauggcguugcugauaaugacacauauaggggcaagcauauaaccagcuacacuguaaagucguucaggguagucaugcccaaauauuacauaccacauuuuaucaucaauuauguuucauuauauuauauuuggacaugauagacucuuuaaaauuuaacauuaugcacauagguuauauuaccuguaauuuucaguucagcauaauuacaaauuauuuuuuaaaggggcauugagucugaugagggagaaggagggagaauucaaauggucacaagaggaauguuggugguaguuuuggagaccacugaaaugacaauuuacaguuuaaaaaacaggacaguucuguucaagcauuuagaagguuuuaaaaagguauauuucucucuccauccuuuaccuucaagaaggugaucaacaugaagaagaaaguuaaugacuagcaauaagcaccauuuucauauuuuuagguuucuuggaaggccucuaaaagaacaaaaaacuuuaaaaguucacauuucuaaccaaaauugguucaaauuuuaaaauuucaaaugcuuacuuugcuaaaauguauaaggcacuaagguaauaauacuugcuuucugaugaaauguuaucauucauuuaaaaauucauguuucuaugaaucaaaacuuggauuuagcuucuggugaucucuacaugucaacucuuaaaaacucauuacuucuucgggaaaccuuuaaugaggccaaauuucuauguugucuucuuaugaacuugcagcugugcauuuugugccauuacuuauuuucuccacuuaacuuuaagcucaaggagggcaggaacuguguuuuugcucaucauuguuccccagugucaaauaccggguuuggccuaaaccaggagcuuaacaaauauuuacugauucacgaagaacuaguauuccugguuuugccacuuacuggcuuuaugaucuuggacuagucacuuacccaagguccauuuccuucuguguaagcugaagguaauaauaccuaccuuaaagaauaucuagguuuaccccuacaucuuacuaaagauggccucaggauuuccuucugucucuuucucguagcuuuucuaugucucacuuaucccaauuuggccugaacucuaagacccuaacaacccuauaaaucuggaauguuacggauaccuaaugaauuaaugcauaggacucaauucuaguuauuuuugcuacaaaugauaauuguucacuguucaauggaagacagacagacaccaaaauaccaugcuacaaauaaggcaaugcuauaaaagaggugcaaaauuguaugaaaauuaagaauguuaauuucugaagggucaggaaaggcugcauaggaaguggcuuucaucccgccugagagaugaauaagauccuaugguggaggauggggagggggagaacauucuagcauauguaagcuuacuugaguuuuaagaaugugguccuaaugucauuagauaguucuucugagacucuuggucagcuccuuuucccuuucuccccagugaaucuuccauauucuccucucuucaaguccucuaagaaacucccaucccugccuucucagcagaaagccuccuuugcugcuuuaacaaaaaaaggagaccaagaggcacgaacucucucagcucaccagauguaagauauucugucuguucuucaucucuuaaaucccucuuaauacuuaauucaugacaaguaauuuaaguacaauguuuaaugacaaucaagccuaauaaaaugccaucauuuuugagagaacuacauuguucuuuuuuuuuuuguuuguuuuuuuuguuuguuugagacagagccuugcucuguugcccaggcuggaguacaauggugugaucuuggcucacugcaaccuccgccucccagguucaagcaauucuccugccucagccgcccaagucgcugggacuacaggcaugugccaccaugcccggcuaauuuuuuguuuuuaguaaagacaggguuucaccauguugcccaggguggucucaaacuccugagcucaagcaaucugcccaccuuggccuccagaauugcugggauuacaggugugagccaccauguccggcgagaacugcauuuuucuaaugaaccggaacugguggauuaaauaguguacaguuaauucccucauaggcaaauacccuucagagcagccuacaugggauugccugccuuuaccuugagcucaccaggcuucuucuccucagaggacuugcagcgagugaucuccugcagcuucuguuccaggggcuccagacacuucugcaguuuuuccugagggguagggaggaagugggagaggugacauuugggguugacugguauaccuaccauucagagauuaaaccauuuguuuuaaaccauuuauuugcuuccuagccaucuuacugccucuugaucugacuuccuuccuugccugucauuugggaugucaacuuucuacagucccuccuccugccacuagccuguccacaucaccuucucugcucacccaacuguccuuuuacugaaucugagauagcugucaucaacucuguguccuuucucaacucuuuccauuuucuuacugaggcaacugccuauuaccauccaagcaaccuucuguacccuaauaucucucuuuaaaccuguccucccauccaccucuguccaccuacaauaaaaacaugguuauuauacuguaaguuaccugaaaucuuguuuucaagaguaacauaacuaagcaaaguauaugauaaaaugcuaacacauucauaucucuguucccuuuauucaaacauuuuccuuugucucagcaguaaguuaaaugauaugccauguuacccauuaccuagagaagcugcaaacaauugaaugguucagcuuaguccgguagguaucagucucaagcgauauuaccuaugcccaauaaccagugugaaaacaaggagcauucugagcaggcaggcagaaugaagaaaccagacuacuuuucaguucuuccuaaguuuaaucuuuuccaugugguuucauucauuuaugaaaaauaugaccacacauaccaauauucacccauaagacucacauguauugcaaaagucagagagaaauuuuagggcacuucucaccauugcucuuuuucaggcuagaggacaacugaucacacauacugugugccccugcauaugcagcucugagaauacaaagugaguaguaggagcuuacgaucucuaccuagggaguaucucauccucugccgcuucucccuuuuuacccacacugacaucgugugucugcuuccccaccuuguacuccuguguagcaucguccaguggcacaacggugugggcccggugggugugggaaauugcacauaucaagcauacagccuccugguccucauaacagaaaaggcugagggccucaugguguugggggcagaggcucucaucccggaucuuccgcuugacggccuggagcugcuuggcaauuuccaccauacugccuaguugccgauuaggucggagacugcgguagcgggaugucuuucgacagacaggacaagggaagucccucucuagguccucccaccagcgggugaugcaagcuuugcagaaguugugcccacacucaaugaugacagguuccuucagauacuccaggcacacagagcagcucgccuccaccuguaaguucuccaaagccgcagcuguagaggcugcagaggccccagccucuaacagacuugucucugccauaauuuaacuugggaguggggaagaggacagagaaaauaaaaauauuaauuggagguuuuuucuuuuuuuuuuuuuugcaucccugacccgacauuuaucccuauguuaaguccuaacuccagauuugccccuucuuguuauucuccaucuucucuuccaaucaauucaaccucuuuguuucuccauuuucaaaacuugugacucccagccaucaaccuuuuuuuucuuguuaguaaacugacacacaacccccaauugaucuaucuugucucuuaccucugcuuucucuuguuagaaagagaagcuuccuucaacucuagcucagcauacuucuccugauccaggcucauuccacuuauaucuuagaaccaauaguuccagacacuguauccucguuugacauacguuucuaacagacaagaaaggaaucugagaaguaaaaaagucauaaaaauauuaacauuucuuaaauuaaccauauuuuaaaguuuaauguuauaagagcuuuaugauuaauccacuggagucuaagcuugauucucugacacuguucucucauucuucuaaaucacaauauccaaccuuuuggcuucccugggcccacuggaagaagugucuugggccagacauaaaauacauugacacuaaugacagcugauaagcuuaaaaaaaaaaaaguccaugcauaacuuuuguucuaucaccaccacagaagguccaugcauaauuuuuaucagccaccacagauaagcaaagagaguccucauauugaaaggguuagauaccacugcucuaaaggcuaacaaauggaaugaaugaggcaaaggcaaccuccucuuuucaggaaaaucugaaauuauucuuccuuuuauccaucagacuagccuaaaggaaaucugcucucuucuuggaaugacauuucacgcaacauuccauuucucuuguguucaucuggacacucagaacugcugaaaacugauaaauuauggcaaccauauuaaauauugcugagcucaggccaacgacuucuugaaaagagagcaacgagucuauuuguagugacuggaaucuuucaauauagcuauugauaacuaacacccugggcauagugugucuccaacuuauagguccuggagugguugcgaauuaagagacacaaaagaggcaaugagaucucccucaagcgcagccucagaagaauuggaaaugcauaggagagauuuauaaaacacaaggcuggcccccuacuccauccuuaaaacauccauacuuuuagccauggguaaguugauuuaacuauccccauaaccuuuucuccucccgacccccauccuucuccagggaccuacuggaaggaaggaaauuugguagaucuaugugcugagagauaaguggccauguaaugagguagguuaacaacaauuguuccuguauauauuguuggcacacacaaauguguuugauuuggaguaggaacugauaacuucuuuggauuugaauuucuucugucagcaauaggagagaaguucagucagaugauuucuaucugugggaauccaacuuugacuuguggugauccuaccccuuccucagucuuuuacaaauuaaguggccuccucaccugagacgaguagaacuguaugcacaguaaggcaccaggacggaucuagacuggcaaagaaguggugagagaaauggggaaaggguuagggaagaagggagaggacucucaacuacagucauagugagaccuugagugccucugcguuaguccuuccucuuccucuacuccuugugucucagcugaagggcaaacuucagggacaaucucauuuuguuucuaccacuguucagggucccaccuugcgacccucuccugagagguuguccacaacucugucccacccccguucuccaucuucuuccgccagaucuggggcuggggcauuggagaggggaaagaggaaacgucguggcuggcaggguaggaagggaugcguguccaggugagaaagaggugugacgugcagaugggaugcccgccgcuaugacgcugccgagacccgcggugacugcgucagaguuucacccggggaggugagcagcagcgggacgggggaacggcgggguagccaagcaacgccggacgcgcugacgucgccggggcggcaaaacguccgcccgggcccgaggcgggcggaggcagcugugguuacgugcggggggccggugacgcagucgcggggcgcugggacgcggcuugcggagccggccggcgagcgcaggccccaggcucgggcgcggcggcgggacagcaccuaccuucccggcuucggguccgggagugcggggcgcggagccgccggagcgcugccucccuccuuccuccuccccucgcccccgccccgcggcgcgacacacaauacucgccggaagcggaagccgcgccgaggcucgugucaguggaagcuggg

SEQ ID NO: 192694 - RNA, 3651 nt, Homo sapiens
gggcgcagagcuggcgcucuagcccacggaguugguuaacuccucucaccggccccuggaaaggguuccaaguccuuuaguacccgacgcugucugggaauuccgggcguuucggcuccuuggucgcagaggcaggaggcgugcguggcaggaggguucggguuauauacuccuagguccugggacagaauaguuacgaccucugggacaggaacucuucucucuuuuguuaauaaacuuccaacucccuccucagacccgaccgcaugucugucauggaccucgccaauacuugcuccagcuuucagucggaccuggauuucuguucagauugcggcucgguccugccucugcccggggcucaggauacggucaccuguauucgcuguggcuucaacaucaacguucggggugagaggcuuguacgcagggguccuggcggagggcgcagggucggaagcuuggggaacucaagaucgguuggguugaggaggggauccuagagcaggacaucaggcgguuguacauuuggucuagcgaugaaaacugagggaaaggauguagggccuccuggccuaaccagccaggggaaaggggagguuuccggugucagcucucucugguugucuccauaaccaguucuuacuugccugugcagacuuugaggggaagguugugaagacuucgguuguguuccaccaacuggggacagccaugccuaugucgguggaggaagggccugagugccagggaccugugguaagcuaaugagaucaagaacuggcuccauaagguggguaggaaagaaauggaggagugauugcaaagcucuggagaguuuugugcccaauuccaagagggaaaagagauguaaaccaucgacguuugagaggcgugaucgccugauuccugugggaaguaaggggauaugaccaggccucccuaacccaccaguuucuucccagguugacaggcgcugcccucgauguggucaugaaggaauggcauaccacaccagacagaugcguucagccgaugaagggcaaacugucuucuacaccuguaccaacugcaagugaguauucuuuccccucccucugcucagucuguuugcuaacuaaacaaauccagugauuuauuuuuuuguacgaaauggccguuucccuuggucccaucccuuauuucugugcaguucugguaauagggagauuuguaguuguuuuuuauuuuuuuaaguuacacuuuuuuaaaccuuuuuauaaccagugaaauaaaccuuuuaggauuuuuuuuuuuuuuuuuuuuuuuuuuugacagggugucgcucugucaccuagccuggagugcagcgaggcaaucuuggcucacugcaaccuccgccuccugggcucagguaauccucccaccucagccuccaaaguagcugggaccacagacacaugccaccacgccuggcuuuuuuuuuuuuuuuuuuuuuuuuuuuuuguauuuuuaguagagaugggguuucucuauguuucccaggcuggucuugaacuucugagcucaagugauccacccaccucagcaucccaaagugcugggauuacaggcaugagccaccccgccugaccuacuuuuaggauauuuaaaaggaaaugaagaaaaaaaaaacaacauaagaagcagguauuguuuaguggucagcaucuuauacugcagucuucaaccgcagucaagguagcuuucuuuggagagaauuagucacacaugacuuagagaacaugggcuuucugaaugcuuuuaagaccucauuuuugucuuugguguucugcagucacuauaguauaucaaaauacgauuuucuuuuauucuguuugggauuuguuggacuuucugaaacugagaguggacuuuuuuuucaucaaccuuggaaaauuaucagccaucaucucuuuuaauauucucuuucccccauguucucaguccucacauucuggaccucgaauuaguuacuagaaagagguuucucucuucuguccuccauuucucucaccuucuuuucauauuuucaauugcuguucucuuuaugccaccuucugaguaauuucuucaggucccucuuccaugucacuaauucugucuucaguuuauuucaaguauuauuauuuuuuacuauuguuauuauuuugaguucuauuuaauuacuuuucaaaucuccuuaauuuuuaaauaauuaucaguucuuuaaucauauuuuaaauuguuccuuuuauuauucuuuaaauauauauuuaaaauauuaaauaugguuauuauauucuaugucuuauaauucugauaucugcggauuuugugugucugaugcugcugucuuuuguuucugcugucucucucauagugcuuuuuuucuuuguuuugugauuuuugacuauaaauucgaguuuuuuagaacuugaacuguaggaauucuuugaggccuugggcgagugcuguauucucagcauuuguguuucuuuucuaggugccuugaagcacuaucaagcuggaauuacuuuaaauaaauucuuggcuucauguuuuuuggagcagacagauaguaugaauuugagcugcaaauccauguaagggcuagcuuacaguuagaaauucucaggagagaguuuucucucuuucuaccuacugagacagucaaauuccccuucuauagaguugaauuuuuucuuuucuuguucacuuuuacaagaaagggcagccuuuugcaguucccaaauuuaugcacgggaucuccuaucagaccuuauacauuuugucccucauuuccuaugcuuccagugacugucaaaacaguauaaagggcaccauagugucacugucacguuucauagggacauuaguuuuaacuucccugucuggauuucugguuuuacagaacuuuuaaccagugugcagauugccuuuacuuucuugccaucucaucaaaggauuaaaaauauucauagucagauauaucuuuuaaaaguauuuuuuuccuaucacugguugucauuuuaccaaaaaaaaaaaaauuuuuuuuaaauaaaaagaagauuuuuuuucccagcguguggcuugccuauuuucuuaacccucuuuaaaugagcagaaguuuuaaguuuuuauaagguucagcuuauccuuuuuuuuuucuuuuacagcuagugcuuucuguguccuaagaaaucuuugcuuugagguuauaacucauuggauauauuuuuaaucccagaauuuuuaguugucuuggaauuagaauuggaaguuuguuuaggggagccaguccucaaugaugucauaaauaaaaguccuuccuugauuauuugauugcauaucuuaucuuauacuacuagaaacucaucuuuuggugaauauaacaaguccuuucuuuccucauagguuccaggagaaggaagacucuugaccuuuuuccugggcaacucuacagucccucccuccuuucggaaggugaaggauacuggguuuuuagaugccuuguccauccugucugguugcaauguuuugcucccagaagagaaucagaucaucauguggggauuaccauuguuccuggaguacuccuacccuuaguugaauuuccuuauuaaaguuauauuuuucuauaagacccugaca

SEQ ID NO: 192695 - RNA, 3187 nt, Homo sapiens
uaucuauaaaaagauauauuuuuauucuuuauuuuuaaaauuuauguauguucgugaggcacaagugcaauucugcuacauugauaucuugcuucucagucccacacaaggaagcugucucacacuauagagaaaauauucaugaacaaauucguaucagucacagugagagguaacacucuaaauagcccauuucaugcucaagacauccaagucaaagaaacccaauagcacagcugaguccccucuguucccccccaacaccccacucacaucagggccccugcccuggagugucaccuuuauuagcugugagagacaccccagagcccugggcacugucagugauugggguagaacaaaaacaggaccuggucagagcccacagauguggcuagaggaacuguggggugggugagcucccucauaggcuccugaccacaauaucccaacaaucucagggaucagccuccuucaucuuaccugcagccugagaguagcucccucuguuucuaucuaugggaagaaaauguccugugagaggccagaaaggaggcagggccauaagguccuagagcaaaccccuagucuuugaucccagagaaguuuccagaaaaguguaacuguagauccagggcaggaucaagaaauaugaagaaagcagauguggguccuggaccaacugcccuccugaggucugucaucagcagggaccuuccccugugauuugugacugcugggaucaggucccaucaccaccauaaucaucgaagugaagaaucuguccuucauuuucacaggagcuuuacaaaugaguaggugcuggcacacagggcccaggcuggguagacccaugaguguggauggugcuucccaguaaugaggcagggcacacuucuacuuggggcuugcaacccccagugggacaagaaaacucagacuccacuccucaccccuuccuaccugagcucuucuuccuccacaucacagcagcgaccacagcuccagugaccacagcuccaaggacaacaaggccagcaacgaugcccacgauggggauggugggcuggggagacugcucugggaaaggaagggaaggugaggggcccugaucuccaggccucagcccugacccugcugaagagcuccagaagggcuccugcuuucccugagaaaagacaugaccccucguuccccucuuuacccaucucccuccuuaccccaucucaggaugaggggcuggggcagccccucgugcugcacauggcauguguaucucuguuccucuccaggaggcaccaccacagcggcccacuucuggaagguuccauccccugcaggccuggucuccacaagcucuguguccugggucuguuccuccccaucccgcugccaggucagcgugaucuccgcaggguagaagcccagggcccagcaccucaggguggccucauggucagagaugggguggugggcaacgugugccuuuggaggaucugagaagagucagaaaauucaggcacuuugcacuccucaugggaaaccccagcagcacccaugugaccaaccugagaauggacaggacaccugggguggggaagggagcacagaacccagacaccagccuggacacagacaccugggaaaaucuccuauuccuuggaaaguuagagucucugaggggggagcagggacuucuggcccugaccuaaguggaggccgagggacuggaaucagagccucaaacacauugagugugaggcagagaacaaaacuugagagaaaagucacggggcccaaggcuguuggagggcucaaaggggaccgcggaucgguauuccagggacugucuucccuccauucccucagaaauuucaucccuuaauugucccagagagcagggcggacucucacagucacucucugguaccggaucucgaaagccaggaagauucuuccuacucaggacuagagggagggcgauauccuagcauuggguccacuuuccucccaaccuugugcgaggccaucccaagagaucuacaggagauagggaaggcgcccauggccccugguaccugcgcgcuguagcgucuccuucccauucuccaaguaucugcggagcaacuccaggcacucgcccuccagguagguccugaacuccucugcauauuccucugccucauagaagcgcugggugaucugagccacgguguccgccgcgguccaggagcgcagguccucguucagggagauguaauccuugccgucguacgcgugcuggugauacccgcggaggaggcguccgucgggccccaugucgcagccauucauucccuggagggugugagacccuagccgguccccgcagucagccccgcccagcuagccccgcccccuccccgcccaacccgcggggauuuuggccuaaacugaaaaugaaccuggguaaaggcgccugggacucucccggguggagggucugggcgggucccgcugccucgggguagauuucggauccggagacucugagggacccgggcgguccguggcggaugggggguggucgugaccugcgcccccggccggguucacucaccagccucgcucugguuguagcggcggagcagguuccucagggccacucggucagucugugcguuggccuuggcguacccugugguccacucccaauacugcggccccucuugcuccacccacggcucccgcggcuccauccucggaaucgcggcgucgcugucgaaccgcaggaauugcgugucgucuacguacuccacggcgauguagcggggcuccccgcggccgggccgcgacacagcggugcugaaauaccucaaggagugggagccugggggcgaggaggggcugagacccgccagacccuccuccggaggcggcucccugaguccugcgcccccaccgggcgggccccucacuccuccccacagaggccguuucucucuggaccccgcacucacccgcccaaguaucggucagggccagggccccugagagcagcaggaggaggcuucggggcgccaugaccccaaccuccgcgucugggaaaaauaugagucccgcggggugcgugggacuuuagaaccugggaacugcggcgacacugauuggcuucucuagaaacgcgacgcccaaugggagugagaaa

SEQ ID NO: 192696 - RNA, 4763 nt, Homo sapiens
uuccuuccuuauccacgcaccugucucccucuacuccagccucauuaccccagaggucaguccucaggaaaacuaaacacaaagaaagagcucagucagaaaggccauuuauuuauguuucaagaugcucacugccuccuuuguuuugucuccuuugcaggccuucucucuuaggccucuucuccuggggguauggauccuggggggagauugaucaccuccaugcuuccauuccuccccagccauaguggggacaucaugagagaagccaagccacuggcccaggaucacccggcauuuaugguggcugcucuggcacagguccuugccuuuauagccccuccagugauccauaaggcccucuuucuccccaaaggagaggucacagauagggcaaagguagcucuucugcuuccagugggucugcuggugucugaccagccuggaaaaugagcugaaagacuugcugcaauggaagcaguaguugggcggcucugugaggugggccuucuggugucuggagagauaggauuucuugcuaaaagucaaagaacaaugggggcaacagaagacauugagucuugagggcuucacuggaugagaguuggaucuggcauccugacagaggguuccagugaugggugccuggguccuggucacaggugcuugguucuuaaguacagaugccugguucugggccauaggacccucaguucuaaauauggguuccugggaccuggccacuggugcaugguucacauccaaaagccccuggauggaccucuggcuucuggcgaugggugucuggaauucagccugggugccuggaauccucaaaguacacuccugguuuccauccacuggcuccugguuuugguguaucuucugguggcguuugagcucagacuggucccggaagcucuucccacacacagagcaugaauggggccgguaacccagauggacgcggcggugacgacuuaguccagaagcaucacaguaggucuugucacagagcgugcaacagaagggccucuccccaagaugcaugcgucugugauagcugagggacuuggggcuccgaaacaacuucccacacugacugcagcuguuagucagcuugggauugugaacaaacugguggcuauagagguaggagcgccugcugaaacauuugccacagguguagcaaaaaaaggguggcccagccugggaugcuugaagcacccggguccuguccauagucccagcuggggcagauagggggcacuggccggccccucugcaugcaaggaagaccuugucaucacuaguccccucaucucucagacugggauguuguucucgaagcucuuucuucuugccuucuacagugaaugaggaagaauaacacaaaauucacuguaagaacuccaacagaggcuuggcaugguggcucacaccuguaaucccagcacuuugggaggccgaggccagcggaucaccugagguuaggaguucgaaaccagccugaccaacauggugaaacccugucucuacuacaaauacaaaaauuagcugggcgucauggcaucugccuguaaucucagcuacuagggagacugaggcaggacaaucacucgaacccgggaggcggagguugcagugagccaagauggugccacugcacuccugccugggcaacuagagugaaacucugucucaaaaaaaaaaaaagaaagaaagaaaaagaagaagaagaaggagaaggagaagaaggagaaggagaagagaaggagaagaagaagaagaaggaagaagaagaagaagaaaagaaaagaagaagaagaagaagacgaagacgaagaagaagaagaagaggaagaagaagaacuccaacacagcacuccauucagccuaacacacuucuugucucugcccuugcucucccacccaacacauucauccuuacccuugggccucauaggcuagaaauaagaagaaaaaaagaaaaaauuggcuuuucaaauuagaagcaaauaaaaaguuaacuggaaucuuucaacacugucagaaauguaaauuuuaacuuacaacaacacuucuugaaaucuaucuuaucucauucucaauauugcucaaacucccauagacaauccacagacacccacauaauaaugcaucaugaacacugggccacuugagggugaaaagagguguuauuaauaaucaagcugggaugagaaguauaaaccaggacuguccuggaaaaccaaaaaguguaucagccuggcuugauaucucucucaacuauuuacuaccagggacaagccucccuuacuccaacccagcaugaaaccuaucuccuuugcuucucuuuucucuuggaaagaacauuuuaaucagagcacuaucauggacauaagcaacuuucaugucaucucucaaucucuagaaacugaagacaucuacuucuccugaaagacuuagaucuucagccagccaggcacgguggcucaugccuguaaucccagcacuuugggaggccgagguggauggauaaccugaggucaagacaucaagaccauccuggccaacauggugaaacccugucucuacuaaaaauacaaaaauuaucuggacacgguggcacaugccuguagucccagcuacucgagaggcugaggcaggagaaucgcuugaacccgggaaguggagguugcaguaagccaagauugugccacugcacuccagccuggcaacagagcgagacugugucucaaaaaaaaaaaaaaaaaaaaaaagagagagagagagagacuuggaucuucaacuugaagucaagggacuugagccuaugauauuaagcucucuuucaacuccaagucugaccaggcuggacagagguacacuaggagagcaucuauagagcauucauccucuucaucagcucuccauccuuucagggguuauccugggcccuuuuccccuuccucccugcuuggcaauucuuaccugaaaggccuucuguguuugggagauggacaaacucucuccacuguuccucuucuugcucaagcuuggugauuagcucuggcuuaugcagaaagauucuggcugaugugugggaaugagaaagaguugaguuggucccagguauggccccuucacaucugauggggacaacaggcuaccuccuguagccuuuguuuaagaaccauaaccugggacauguagaugcggaaaggagacauuaaaaggccagcugcuagcaaaguaccugguucucaggagugacuuaguaaauauuuguuugaugaauggaaaaauuugcauauuuugagaacacugucaucauguuacaaguguuaucuuugccuucaugcaggcuaucauuucuucucuuuaccacugagcuuagugacucagaucuuucacaccuggaaagcauagaaccaggggucagugaaacuaauuguaagcugaucuaccuguccagggaaaccagauguuccagggcccuuaggacagggggcuugcugagggaagcccagccucuuacccacagauguuagauucuuaaagguuuccgacauaacauccugguaaaggacccucuggcuggcaucuagacagucccacucuuccugggugaaauucacugccacauccucaaaggugacuggcuucuggaagaacaggagagacucaagaaguuuauauaaauauauauguguguguguguguguguguguacaagauuaacauccagucucaagauucagagaauuaaaaccuaagagaaagauaaaaccauggaaggaagagagaaauauuaaaagacagacacaaggccagcaacugugaaguauagaaaggaaaggaggccggacgcgguggcucacgccuguaaucccagcacuuugggaggcugaggcaggcagaucacgaggucgggaguucgagaccagccugaccaauauggugaaaccuggucucugcuaaaaacacaaaaauuagcugggcaugguggcgcaugccuguaaucccagcuacucaggaggcugaggcaggagaauugcuugagcccgggaggcagagguagcagugagccaagaucgcgccaccgcacuccagccugggugacagagcgagacuccgucucaaaaaaaaaaaaaagaaaaaaaaaaaaaggaaaggaaagaugaagagaaagggagaaagauaagaugugggggagaggaaagaggauaugcagauaugcagaauauaaacaggaaagcaaagcgaaggaaaaaaugcugccacucuaacaaauuucaggaaguacuccaugaaggaugccaggauggugcgggagauggagaaaggucuugcagcuccuuuuucuggaugucguucagucuggaacaaucugagauuucauuugaccugcaggcaggaguauguaugaaagagcuccuggaguccaggaccuggaccccaccucucucuagcuuagucuccucaccuucuucacccgugccucccuccagcaaucucucuucauggcuuccugcaggguggcagcuaccucgcccacccaugggagcgucuucuguacagguucgauuggcuucagcuguucaaacaucuucucuucuguggugucucuuucuagcuuuauccacuccuggccuggugcccaggccugacuggauuccuuccuggggcuaucuaccucccaguaacugggcagauggagaggcccagcaaaggccccaggguuugauguggcuuccugu

SEQ ID NO: 192697 - RNA, 15392 nt, Homo sapiens
uuagaagugugcuuaugaaaacuuguauuauuauuuuuuauuuauuuauuuauuuauuuauuuauuuauuuauuuauuuauuuuugagacagagucuuacucugucacuccggcuagagugcaguggcacgaucucagcucacugcaaccucugccuccuggguucaagcgauucuccugccucagccuccggaguagcugguauuauaggugcccaccacuaugcucaguuaauuguuuguauuuuuaguagagaugggguuucaccauguuggccaggcuggucuugaacuccugaccucgugauucgcccgccucggccucccaaagugcugggauuacaggcgugagccaccgcacccggccaaaacucguaucuuuauuaauuagcaccuagcuuguuuguuugugucugaccaucaaguaguaguuguugaauaaacaguggauacucugauagauaugaagauaggagaaaaggaugagaggaaggaaagauucugagaccuguggaagauguguaaguagaaggaaaacauucuaaagcaggcauguugcccagcuuucguuuuugcuuccccaggucccuaguaggcugccaagacaaggaggagcucuggcuaguauucuguagguuucuccccaucuccagguuuggguuggggcuacucauauccucacucuucagcucacucagcucucucuucaauguuuugcacucuuccucuuccuucccuucacaugccuuucaguuuugcgcaaucagggcuggagucuuggaagaaacaaccaccauuugcaaaguuaccauacuguaauuuucagugaggagauuccuggccuccaguucauggcagagaccauccuguguugcucuccaguacagguguccucugauggagagaggggcaccugccuguccuuagccagagagggcuuccagguggaagacuggagagagaaauggaaagaaggguaauaaaaaugggaaaaugaagagaaaagguagaugacagaagaagggaaaucaauucuacuuggaauucagaguguuccugaaagugcaaauuggaauguccccauagcaaagaugccagugagugugcaacuugauggaugagauguccccaaggacaaaucccugggcaaccaggcucuccuccaccccugccaagaugugacaucacucagaagggauuuccuagaagaaggagaaaauaacuugaaaaacguaugucaguaguuuguaucauaaaaccauugaacuagggagaagaaaagcccuuggggucaucuugucuccauuccugccucaaugguugaucugagaggugaggcacugggcaguugcuguggaaugggcaaugagaccagcuaggguuggauuccugcuuaggggcagugaaggaggaauggaucagguggcagauaggagugccuccagcuucucugccaccuguaaaugugucucuaacagcuggcuucuuugcccucuaccucccaggaggagucuucccuccacccaggcucuccagcuccuccuuuccucugggaaugugaucccucaauagcccgccucuuccucuuguugcuucugucucccuuuccuggcuuuuuauucucugcuuauaacagagagaagagaacuuacguagcucuucaaggaauugcccugaaaacaaaaagaaacaaauaugugauuaguggaagaugaauagcaccuuccccacauccucccuauggacauuuggagugacccacacugcccuuuccacugggggaucccacagauccaguaagugguucucuucacaguuucucagaagagccugggguugggcauggggacagaggaauaaggaaaucccagcuccccuaaucuugaguccugguucuauucucuuuuggcuucccauucagagcugacuuggucccccacuauuugguggucuugccugcugcccagccacugcaccugcuagucuucgauguagccaguuguagcagaugaucaaggcaaccaaggguccaagaaccggcacaauuacaaacaggguuaucuuccagcagggcacccucagaaaguggggaucugaauuguucaccagaacaaacaggguuaacauguguucccccucaugccccacccaccugucuuuuuugguuccuuaaccugggguccuagaacaccaaaggacucuggggacaaaauucagaaaguccaugaacuuggaugagaaaaguacugccuccuuauuuucaauaacuggauuuaacauuuucuuucauuaaaaauguaacaacugccaggugugguggcucaugccuguaaucccaacacucugggaguccgagacggguggaucaugaggccaagaguucaagaccagccaggccaacauggugaaaccccaucucuacuaaaaauguaaaaauuaggugggcgugguggcacaugccuguaaugccagcuacucaggaggcugaggcaggagaaucgcuugaaccugggaggcggagguugcagugagccaagauccugccccugcacuccagccugggccacagagcaagacucuuguugaucccaccaacacccauucccccaagucuuggaaaaaacaaaacaaaccaaaacauuuuacaacuaaccacaauaugagcaguaccugugacuuaauuaccaauggaagccacagauguuuucauucccauuagaguuauugcagaaaucuugaaauacuguuuauguuuauuaguauguugaaauuaaagguuauugggcugggccugguggcucaugccuguaaucccagcacuuuggaaggccaaggcaggcagaucaccugaggucagggguucaagaccagccuggccaacauggugaaaccccgucucuacuaaaaauacaaaaauuagcugggcaugguggcaugcgccuguaguuccagcaacuugggaggcugaggcaggagaaucgcuugaacccaggagguggagguugcagugagccgagauugugccauugcacuccaucucaaaaaaacuucaucucaaaaaaaaagaaagaaagaaagaaagaaagaaauuacagguuauuagacuugcugcuacauuacuuaauguauuacuuuggcuaaagaaauauuuauggccgggcacgguggcucaugcccguaaucccagcacuuugggaggccaaggcagguggaucaccugaggucaggaguucgaggccagccuggccaaccuggugaaaccuagucucuacuaaaaauacaaaaauuagcugggugugguggcgggcaccuguaaucccagcuacucaggaggcugagaaucgcuugaacccgggaggcagagguuucagugagccuagaucgcgccauugcacuccagccugggugacaagagcaaaacucugccucaaaaaaaaaaaaaaagaaacauuuauguuacuauaucacaaaugugauuaucgguugauaacuguauuuuaguacaaugauuguuuuugcaauccuauguguucuauuuuauguguauauuuaaaaacauucugcaaagggguccuuuagacuucacuggagugccagagagauucaugguacaaaaaggaguuaagaccuuucauagucaaguccuccaaaacaaagauacuauuccuccucuuuggguguguaaagaugugugugugugugguccacacacuggucuaauuuccuaaaucguacgauagaacucugugugccaggugacaagaguagagucaccuacagccucgggaggaggagcugugaaggaaguuugcucagagaagguaccaucugugcccuaaugacaccuucuagugucugcaacauuuaucuaacaaauauuugggugcucuucuguugccauuaucuuuaggcauugggcaaucugcagugaacaaaaaggcuagaaaccauguccuugaggggucaauuccuaguggggcuugguggcuuuucuauuccucuaugaggucuucucugauuagucauguucuguacucauggaaacauccugaguuuguaaagcagaaauauaaguacaggugauacaguugugucuuguuucuguuuguuucaccuccccaaccagacaucagguuuacguguaaacgaucuauuuaccucuguuuugccauuccugaaaagagagaucaugugcauaaggaguuaaacagaauaagauaacauuuuuguaaaguaguuagaauagugccuggcacauaaaaacaguacaugaguauuuuuauuaugauuuuaccaauccuaaaugcaaaugacuucuuauuuaaagaaagaaaagagaagagaggaagggacucaaccaggagccagggguccuuguucccccaggugacuggaacuagagugaaauaccaaguugaccugggagggccuagacaugccggaacuuaccaaaaguccgguggagauucucugaaagagaaacaaauggaaauggauuuaguagggcacucaaaaaggaucuuuuauccugagucuuuguuauuuaauuacuuaaaacuuguucuaggcacgacacacccacuguagagaaagggaaacugaggggaaaacaggguauugagagggagagacgguccaagaacgggaccauuuccguuaugccaaaaaaccaaaaggcaagaauugggagaaacgaugacuggaacucaccuaucucugcucgaaguuuuccuaaaauagaaaaaggcaacauuuuaguuccugcauguucuggcucucgguggggacccucccacacccagcgccugggccccuugugcaggcuauuucucugcagccuggaaacaaccucaggagaguaggaagagcacuggauuuaaagccaaugguugcggcucuuucucuagcuauagucuagauacaauagcgaauaaagaaugugagcaaugcuccaagccagcacaagcauccaauacaucccagcugcucuucgccccuuuucuuggauucucaguucacagagcugcuccagcccacugcguugccacuuuguuuaucuaaagccacuucccaucugaaugaggagggaggagcugaacauuuagugaguagcuagcuacuuugugacuggauuuguaguaggcacuuugcaugacuuuaauccucccuacaauuuaggacgaaggauguuuucucuauuugacagacaaggcaacugaagcuuggagaaucuaagaauuuugcuauagaguucaguaccugagauggaauucaaacccaggcugccugacucuaacauucagauucuuucugcucagccaugagggcugaaggccuuuuuuuguguggaagaaguaaacaagcaggcaucugggaugaauucaaggugagagaaaggacuuuguuguugaucgcaccaacacccauucccccagaacauuccccauacccuccuugcuacuuucuccucuccucuuaguaacaaaugggagguggggcauggggaggagugaagacucuuccugcucuggcauuggggagacacuugguaggaggagaaggcucagaaugaaagcucuaggcaaaaaagaggagcuucaucagcagcugaaccugaguccucaguguugaauggagaaagaggaaacaauuuucgaacgccuacugugugguagagacuuucacuucaguaucuuuauucaaaacuccuaauagccuagaccugucugacuucgaagcucacacucucccaaguugcauggagcugcuagguaugauacagaggccucagcucuaccacuuauaaguuauaucgguuugaguaagucacugaacuacuccuggccucaguuguauccucuguaaaaugggguuacuauauggcauaguuagcucauagggaaaugcuagguccgauuauucauaugaaagcauuccguaagauguaaaacucuuucaucauggaguuauuuuuuuucuuuaucacucaauagugagaagaacuucugaacccagaagucacucacaaauacauguuaagugguguagcuccaagaagccagcucauuuaaagaaaggauccugauccacccacccucugcccuguaccucucagucuguacugcaggcagaggaagaugaggccaacagugaucugcaggaggagcacaggcagcaccgcgaggagaaccagcacuccagggcucacccaguagaaaggaucugaaaggcaggacugacauuugacauuguccagagcugaauccccaacacucagcauggugucuggggcccaauaaaucaggucaaauaaagaagugaauaucaucaggauucaaagaaggugacacagaauuggucccugagcuuagcccugaaggaaaaauggcuuuuuuuuccaggaaaugcuagugauuuagaaugacaagugguuuaaagucaagauuguguauugggucaggcugggggaguuuuaacgagcagcuaagggacuuacaucugaagucccucaagggacuuuuuauugacgacaaagucaaagguucucuucauauuauugugguguaucgccuacaagcauaauuaaaauaaacacuaaauuucaguuuaaaguuuacugaaaauaaauauguauuucaaauauguaguucaaggcugugguggugcacugaaggauuccaagcugagaagugaccacgucagauuuagcaccuacaggacuggagaacauagggagaaauguuaagagacugugauaacaauuaaaguaaaaaacaacaugaaccugaacuaggacagugguaaugguauaggaagucaggggauucaaagcuuaaauagggaauaaaaaauacauauuuauuuucaguaaacuuuaaacugaaauuuaguguuuauuuuaauuaugcuuguaggcgauacaccacaauaauaugaagagaaccuuugacuuugucgucaauaaaaaucacaaauauuggccaggugcgguggcucacaccuguaaucccagcacuuugggaggccgaggcgggcggaucgccugagguugggaguucaagaccagccugaccaacauggagaaacccuguuucuacuaaaaauacaaaauuagcuggacgugguggcacaguccuguaaucccagcuacucaagaggcugaggcaggagaaucgcuugaacccaggaggcggagguugaggugagccgagaucuugccauugcacuccagccugggcaacaagagcgaaacuccaucucaaaaaaaaaaaagaaaaagaaaaaucacaaauauuuucacgucacauuagaaaagucacagaaaucucaaacuaucacuuauguucauuacuauuuugaaauuacacuaauuaauagggucacccuaacucuuguuaauuuaauauuuugauaacuguauuuugguauaaauguuuuauuugguguauuuaaaacauucuucuggcuaggugugguggcucuccccuguaaucccaccacuuugggaggccaaggcaggaagauugcuugagcccaggaguucucgaggccagacugggcaacauaaugugagacccugccucuacgaaaaaaaauuaaaaauuaccugggcauggugacacaagccuguggucucagcuauucaagaggcugagucaggaggaucacuugagccugggagguggaggcugcaaugagccaugaucgugccacugcaaccaauccugggugacagagugagacacugucucaaaaaaaaaaaaaaaauucugagaugggucuaucaacuucaucagcuugcggaaggugcaugacacacaacaaaagguuaagagcccucuucuagagcuuuuaagaagguaguuuacagcgggcaugguggcucacaccuguaaucccagcauuuugggaggccaagguggguggaucacuugaggucaggaguucgagaccggcuuggccaacauggugaaacccucucucuacugauaauacaaaaauuagccagacaugguggugcagccuguaaucccagcuacuuggaaggcugagggaggagaauugcaugaaccugggaguuggagggugcagugagccgagauugcaccauugcacuccagccuggguaacaagagcaaaacuccaucucaaaaaaaaaauaaauaaauaaauaaaagaaaaaagaaaaagaagguagcuuacacaggauucaguaacugaacagaugugcagaccuggagauguggaguagguugagcaaugagggagggggaccuucacuucuguggcucccaucuauuucccauucuaggucugcuccucagcauccaaaagccccacucuaaucuccaugugccaugcugcagcugaagcccuuuucaucuugaucucugcuuuaagggagcugaguaaggauaaugacaucaaagguagggauacaucacagcuaauaacauuaaacugguccaggaggguugcuuagguauaauuacaauccuucaagcuguagacuaaggcuccugucuaucauuguguucccuaggggaaaaugcagcuaccuuuacuuucaaguucuuaauggaaguuaccuguagcaaugugauuuagcgaguauguacuuaaggguuuuuuucucccaaccccccacauuuuuccuuucacaaauaauuagaaaagagagaaaagcagacauuaucagccuccggauguaaagcaacaagaaguauagaguaucacugaugaacuauauuugccaaaguaaaucaaacacaaaugucauugcaccuccacaucuaucaguuuacagaaaaacacagggcauggaggaccguauuacauagcaacaugggaaugucgucaacaaaauucagacccugggaaacccuaagggcaaaggucaacaggugggucucauuugaaucucgcuaaaagaaaccaacuguaagaguauauuuaugaaacaaucaggaaaauuugaacacaaacuggguauuugaugauauuaagaaauuuuuguugaguuuguaagaugugauaauaguauugugguuauuuauuuauuuauauuauuguguguggggagggggggcuuuuuuuuuuuuuuuuuugagucucacucuguugccccaggcuggagugcaguggcaugaucucagcucacugcaagcuccgccucccggguucacuccauucuccugccucagcucccaaguagcugggacuacaggcgccugccaccacgccaggcuaauuuuguuuuuguauuuguaguagaaaugggguuucaccauguuagcuaggauggucucaaucucuugaccucaugauucgcccuccuugggcucccaaaguacugggauuacaggugugagccaccgcgcccggccuauuuauuuuuuaaaaaguguucuucgcugggugcaguggcucgcgccuguaauucuagcacuuugggaggccgaggugggaggauugcuugagccuaggaguuugagaccagccugaucaacaugguaaaacccagucucuacaaaaaauacaaaacauuagcagugugugguggugugugccuguggucccagcuacuauguaggcugaggugggaggauggcuucugcccgggaggcagaggcugcagugagcagagauaugccacuacacuccagccugggugacagagacagauccugucucaaaauaaauaaaaagaaaaaaaagaaaugaucaugcugccuaggauuuaccucaguaauugaguaggggagggugguaaugaguggggagccggugagguggguggucccuggauugacaagugcugcagcaaggugguaggcacuuggaggcucauuauaauauuaucucugguuuguaugugguuuuuuuuuuuugagacagaguuuugcucuuguugcccaggcuggagugcaauggcgcgaucuuggcucaccgcaaccucugccucccgguucaagcgauucuccugccucagucucucaaguagcugggauuacuggcaugugccaccacgccuagcuaauuuuguauuuuuuaguagagacgggguuucuccauguugaucaggcuggucucgaacuccugaccucgggugaucugcccgcuucggccucccaaagugcugggauuacaggcgugagcugccgcgccuggcauuuguuuuuauguuucauaaugaagaauuuaaagaaaggauuagagacaacuaguaauaaaaucacaaaaaugacaagaaaaaaauaaguaaacaagagaaauuagaaacucuucagagaaagagcagagguaguuacaccugagacuugcaauaauaccauuacuucaucucauuccuaaauuugucucaacuuccuggcuccaaagccuagacaaagcgucccuuauuuacuuguaaaacaguuucuuaggcaugcagacgaagaggugggaacaggagguuggaauguggauagcaacccaaaagagaacuuucuccccugaggcaaagucuuuagcugcuuuucuuuuugucuuccuuguuuuuuuuuuuuuuuuuuuuuugagauggaguuccacuuuucuugcccagacuggaguguaauggcacgaucuuggcucacugcaaccuccgccuccgggguucaagcgauucuccugccucagccucccagcugggauuacaggaaugcgccaccacgccaggcuaauuuuguguuuuuaguagagacaggguuucuccauguuggucaggcuagucucgaacucccgaccucaggugauccacccgccucggccucccaaaguuuugggauuauaggugugagccaccgcaaccggcuugucuuccuuuuuugguguggugaaacugagggaguuuguugggagaggcaguuacugagcuaggaaguuguugagcaggaaggagaaaaaucugcaaacuggagagggucucacuaucaaacuuuucggcaaguagaauuuccccaauaaaaacagcuguaugaagaacauucugagacacauaaagcuauuuccauaucccugcaggcagucucuagaaauagugcuuuguuguuccacauacaaugccaucuucuggucccagcacugcaauggucacucccaccuccaagauacaauagugaucaauugucugauguuugcacugcagguggggaggaggaaaaggcagaggaucugacccccaggcucucaaagcaguuuaguuccucaauuaaauagcaaguaacuuucaaagcucccccuccaucggcuucaccuuguccacaucuuaaucauccugcgauagagcaaaaaauauucuccaaaaucacccaucaugcaaaacauguugaaaaugaaauucugaggccgggcaccauggcucaugccuguaaucccagcacuuugggaggcugaggcgaguggaucaccugaggucaggaguuugagaccaaccuugacaaccuggugaaacccugucucuacuaaaaauacaaaaauuagcugggugugguggugggcaccuguaaucucagcuacucgggaggcugaggcaggagaaucacuugaacccaggaggcggagggcgccauugcacuccagccugggugacagagcgagacucugugucaaaaaaaaaaagaaaagaaagaaaggaaaaaaaaaaagaaauucugcaauucugcagaaugaaauaguggagguacagccaaaaagugacaucuccuuucuauaauuauauuuagacauuugauuuacuugcuuauucacuaggaccaagcacaggugugugugugugugugugugugugugcgcucacaaauacaggguuuuuuuuuuuuuuuugagacggagucucgcugugucccccaugcuggagugcaguggaaggauuuuggcucacugcaaccuccgcuuccggguucacgccauucuccugccucagccucccgaguagcugggacuacaggcgccugcuaccaugccuggcuaauuuuuuuuuuuuuuuuguauuuuuaguagagacgggguuucaccguuuuagccaggauggucucgaucuccugaccuugugaucugcccaccucggccucccacagugcugggauuacaggcgugagccacggcgcugggcccaaggguuuuuuuguuuuuguuuuuguuuuuuuuagagacggguagggagugggggugaaggucuuugcucugucacccggguuggagugcaguggugcaaucauagcucacuguaacugcaaaccccugggcucaagccagccucccgucucagccuccugaguagcugcgaggcaaaccaccaugcccuaggguuuuguuuuuguuuuuguauccuacagcagcuugcucuuaucacucaauaauaccuuauagaaggccuccaaaccaucuggccuagugcuaaaauaaucuuuuuaaugccugcauaauauucacaguauggcuaccauuguucauucugucacuuaccuacucaaaggcauugauuuugaucccaauuuccuugcuacucugaauaaugaugcaacagacaucccuaagcaugaguuucuguuuauugauguguacauuuuuauggaaaucauucccaggacugagauguuuggguugagggaucucaucucaguugagagaauaauuguucuuggccacccaacaguuaauaccuaauauuauauggcacuacucaccuucuacuuucaauuccauugcugccuccucuugguaagaaugaucucggaagaagcaggugaaaccuccuucaucugagaaccuuacauuccggauccugagagucaccuuucccucaccaauagcaucuuucagcagcucuguccggccccgauauucaggugccuggucuccaucuugguccuugccauuucuguagagaugaaccacccuagagaagggggggcgguaccaccccaccuccaugccuguagcguucuucccaggagauaugcgacauggcaauuccacuucauccccgaccagagcccggauagggugucuugguccuaucacucugaacugcccuguccaagacaccaaaaggaagagauuuaaggucagagggaaccuuggcaagcaagccugucaugagaagggcugcuucaaaacagggaaggaagaagacacucgacuuuuaaaugacauucuagagccagggaggauugcaauuguucuucuucuucuucuuccuuuuuauuuauucauuuauuuuuugagacagucuuacucucugucgcccaggcuggagugcaguggugcaaucuuggcucacugcaaccuccgccucccugcaaccuccgccucccagguucaagugauucuccugccucagccucccgaguagcuggcauuacaggcaccuaccgccgcauccagcuaauuuuuguauuuuuaguaaagaugagguuucacacuguuggccaggcuggucucgaacuccugaccucaggugauccgccugccuuggccccaaagcgcugggauuaugggcauaaaccaccacacccggccucaaguuuccuucuugagaacaacaacgacaaaaaagacucugguuauagagauacugugaauguccuggacagaacauuuuagcaaucaucuccucucagcaucugcccaucuuuuugccagcuguagccaucucugacucuucagcccagccuuuagguucccucuuggaauguggcacagcaucuugagguugaauccuccuaugggccucccuguuaggacuuggccaaauugcugccuauucuacccuuagagguuuugcuuuugucacuccaucuacuuuaacugucucuccaucacuucucacuauucaguccuuguucauaccuuguuucccaaauucucuucugagaucuuccacccuggggauggcucuauuucccucuuccuuccccuguaucuuccaccucacuguggcucccggacccugacccgaaaaaguuccuuguuuuuuucuauguggauguguuucucaagucagauucugagcuacuaagaaauaaggcugcuuucuccccuagaccuggagaguggaugcacugugccucugucagucagguggcucccugaggaugggaaacuuucuguuuauuucuccucugcacgugacagccggguuccuuuauaaaaaccuacuggugccugauuaugcagagcaaagucucaaacaugacaagauauuauaauuccacaaacauuuauugagauuuacuauggacaggcacugcuaagcauguuacauaucucauuucauguaauccugaugagaacuccaagagguuguuauuauuuuaucucaauuugagaggugaaaagacaaagcuggaaagacaaguaagaaguaguucaaggaaagccuugaguuagucacauuaaggagucugggucagacgcaauggcucaugccuguaaucucagcacuuugggaggcugaggagggcagaccacuugaggucagggguuccagaccagccuggccaacauggugaaaccccaucucuacuaaaaauaaaaaaauuaggccuagugcaguggcucacgcccauaaucccaguacuuugggaagcugaggcgggcggaucagcaggucaagagaucgagaccauccuggccaacaugugaaaccccgucuguacuaaaauacaaaaaaaaaaaaaaaaaaaaagaaaagaaaaaauuuagcugggugugguggcaggcgccuguagucuccgcuacuugggaggccaagucaggagaaucgcuugaaccagggaggcugagguugcagugagccgagaucaugccacugcacuccagccugagcaacagagggagacucugucucaaaaaaaaaaaagagucuggacuccaucuugaaggcuguaagaaccacccacggaagguuucugaggaagggaggcaugucaguaggucuauguuuuagaaagauaauauagcaacuugaggauguuugaaggagcuaagccccaggaaacuagccuuucuguuuucagggucuccccagggcaggaaaaaaaacaugucuuaccugcauagcuggaagacacuuggaggaggaggaggaggaggaaggagcagaggcagcugggcagagagggucuugauaagcuugccaucucuacuguuccuggggacagagagcccccgcagcaaggucaggccaaguggaggcccuuggggugcauguccccuuacugcugaaaagcccaagggaagaucuuggagggcagugcugccugggcccugccuccacuccgguaauugcugcagcugugcccgcagaaacagccccacgucacccuugccaggcacucacacaaaagggcuacagacugaggggaugac

SEQ ID NO: 192698 - RNA, 34508 nt, Homo sapiens
uaagggucaaacacuggauuuagaacagucacaugacaaaaaacaucaacuggaaaagggucgccagagugcagucagcacauguuuugugggccuguuuaugcucaggauugucuuggaaaguccaaagcaccuguggauagaggcauggaguuacagguuuucuuccauuacaaaacuaacaauucucaaucaauacacucgacccccaaugcuuggcuaugacaucugcccaugagaccaccucgggacagaagacacauccacuccaggagauacuuugccugcccuccuuuccacugugaagccucucaaaauccuguucucuggacuccuccaguuuuguuuuguuuguuuguuuguguuugaggcaaaguuucgcucuguugcccaggcuggagugcaaguggcacaaucucagcucacugcaaccuccaccucccagguucaagugauucuccugccucagccuccugaguagcugggauuacaggcacgcgccaccacacccagcuaauuuuuguauuuuuaguagagacgggguuucaccauguuggucaggcuugucuugaacuccugaccuugugaucugcccgccucggccucccaaagugcugggauuacaggagugagccaccauacccggcggacuccuccaguuuuuacacuauucuuugaaguuucuuuaacccaccagaaagguguagcaugugcauuaagggcacugcuggcugccaguugucaagcuccucaaccucuuguaucucauuuuucaaacuguuggccuucuccuucacccagaaaggcaagcugugggaagaagacaacacccugaguuguaguuugaugcaaaauuuacaaacaccaacagcggauaagaaauuaugugcuccaaaaguaaaaagaccuccaauuuaggagaccagcuucaaaauaaaauauguuaguuguucaccguuugcuccugccucaaacccucuuguucagcccuucucugccaagaggcugaccuugcagcuaguaucaccugggcuccucugugcuuccacauuuuuuuuuuuugaaacaaagucucacuccaucgcccaggcuggaaugcaguggcacaaucucagcucacugcaaccuccgccucgcagauucaagcaauucuccugccucagccucccgaguagcugggacuauaggcacaugccaccacaucuggcuaauuuuuguauuuuuaguagagacaggguuucaccuuguuggucaagcugguaucgaauuuccgaccuaaggugauccaccugccucggccucccaaagugcugggauuacaguugugagccacuauacccagcccauauuuuuuuguuuguuuuuugagacagagucucacucugucgcccaggcuggagugcgaucucugcucacugcaaccuccgccucccggguucaggugacucuccugcuucagccucccaaguagcugggacuacaggcacaugacaccacgcccagcuaauuuuuguauuuuuaguagagauggggcuuuaccauguuggucaggcuggucuugaacuccugacuccaaaugauccucccaccuuggccucccaaagugcugagauuacaggcaugagccaccauccccacccgugcuuccaccuuugagcugggcuuggcugauggcaccgauaggagaucagaagguggacagaaauuagggcauuucuuaccuaguuccuccccugauguccuaucucccaaggcaccccaauucuggcagugccacagcuccuguugggcagcccuucucccggagcuccagcgcuuacuguucugcaaacugugaucccucuucuugcugcucagacccaagaguaguaacgcuucccacugucaugagccucugggugcuucacccucccauguggguucccccaacccugcccacacacccauaaauagucccuuuccuuaagcugucuucagaaucccagcugagugugcuuucuguuuucugcugggaccuuggcuaaugcagauacccagagucuucccagagccacugagaccugaaaggacauuucugggcugcaugugguccaauagguaguaggaagugugacucugggaugaguuggagcaggcagaugcaaaauguuuucaucuuuuggaagcuagaauucuugugcuuuaggggagaaauauaccacaauuggcaaaaugcccugauaaaacugcuggggguagggaagucccugcaagaacgaagaggacgguuaccacauagguaauuggugaaagucaaaguuaucacuuaaagccaacaagccaaauaguagaaacccaaauaagaaaagcaggacuaagagcaauguauaaagauacuagcguaaagaacuacuagaacaaaaacacgagcauuucuaaauaucaaaagaaagcauuuuucagccuuuguugaaacaaucaaacacugaaagacucacacuaaauguaauacaguacaccuaauaaauguaacaaauaauguaacagaacugaaaucaaauauaucagucuaaucaauaaaugcaaguggccuaauucaccugaauuaaagaaaauauuuucaagcuggcucacgagcagaauccaauucuacccuaaaagcaaagugcuucaaaagcaaaagaaugggcaaaaagaaugggcaaaggucagaugcaaauaaaauagagaauuagaaccuuaauaacuggcuagguauacuuuaggacaaaaaguauuaaaugagaaaaauaaagauacuuucauaaugcuaaaagacacaauuaacaacaaaaauagucgaaaugcuaauauucagacaccuuaacucucacacuaacucucaguccaaacuaggccaagugaacaaaaguaaggaaauauaggggcuaaacaauauaaccaauaaagucaaucuucuguauauguaucuaacuuuccauccugauuaaguggaauacacuuucuuuucaagcacauguggaaaucuaaaaauaaauauuaagugaccuaauauagaugcaucccauaauacuuuguccuuggaagauacauuaacugcaaugccucaucuaggacccagaucaaguaccaccuccucugcaacauguccucaacuucccccaugucuuuccucuauguacacauuguaccauauuugcuuucaauuguuuuaugauuacucaucuaguggucucuccccacaauagacaaugagccuugaaacaaauaucauaucuuauucaucuuugugaucccugccuccauuaccucaccaccuucccauuucuccuguagauuaagugcauaaacgguacucaaaggaugucugcugaguugaauaaauaaucccuguaaacguacugcacauuauagggaccuuuucaauaaguaaucuuaccucccuaauuuuuauucuaauucuggcucucucugucacuaacuagagaagacuuggcaacuuuaucugguucugguuaucagguuuuguucuuauuuuacagguggauuguugcauuugcagauuuaacauucuuaaauuuccaagcacaauuacuacacuauuuaaagauaugaacaacuuugaugacaguaauggagcaguacaaaacugauucaucaaauaacuugggaaaaaaccuacaauuuuuauuaauagaugauagauaauaacauuucuauucauagauaauaauuccagccauaaugaaguagcggggaucagauuuacucuccugacuuaaacaaguagaaaacuggacaaaauguaugaaauaacaauuuucagaaugagacaacaggcagcacaggauugugauccuaaagaaaaggaaagcaaaugaagagauuccuguaaucacccagcuuugccuggaggcacauucaagaccacagcguaggaugagcaaccccacacagagcauggcauucucuaugaguuugaggagccgaagauccaaguucagagagucuuggaggacuggaagcugcagggcagaguucuggggaagaaggaacuuuacaaaaaaaugaaaguaagaaauuuacacagcacuuccuuugagucuuugcugaauauuaagacacacauguguaggguagaacuccaaaagaucagacaauagagugacugggaacugaaugggcucacaaagggcuaaaaaucauuuuaguucccaccaacuaaagugaagacuccucacugaucacucaagguauucugcagagacucuaaaagggccacaucuuacuuaguaauggaguuaaacuaucccuaaagacugcuuuagacacgcccuaacaaagcuugaaaacaagccucaaaccaaacugcaagugacuuaacugccugcuacagcaaagaccagcacucuuuaaaagaagaccacaaggccuguugcgguggcucacgccuguaaucccagcacuuugggagcccaaggcagguggaucacgaagucaagagauugaaaccagccuggucaacauagugaaacccugucucuacuaaaaauacaaaaauuagcugggugugguggcacgugccuguaaucccagccacucgggaggcugaggcaggagaaucccuugaaccuaggggcggagguugcagugagcccagauugcgccacugcacuccagccuggugacaaagugagacuccaucuaaaaaaacauaaauaaaauaaaaaauaaaauaaaauaaaaaaagacaacaaaauccaaauacucaacaauauaaaauuauaauguccaguauccaaauaaaaauuacuagacauaccaggaagcaggaaaaugugacccauaaucaggagaaaaaucagucaguagaaacacacccagaaaugacacaaauaauagaauuagcaaacaaaaaucuuuuuuuuuuuuuuuugagauggagucucacucugucgccaggcuggagugcaguggcgugaucuuggcucacuucaaccuuugccucccggguucaagugauucuccugccucagccucccaaguagcugggacuacaggugcgcgccaccacacccagauaauuuuugugcuuuuaguagagacagggucucaccauguuggccaggauggucuugaucucuugaccucaaucugccugccucggccucccaaagugcugugguuacaggagugagccaucaugcccggcugcaaacaaaaaucuuuuuuuuuuuuuuuuuugagacggagucucgcugugucgcccaggcuggagugcaguggcaccaucucagcucacugcaagcucugccucccagguucacgccauucuccugccucagccucccgaguagcugggaccacaggcgccugccaccacgcccagcuaauuuuuuguauuuuuaguagagacaggguuucacuguguuagccaggauggucucaaucuccugaccucgugauccgccagccucagccucccaaagugcugggauuacaggcaugagccaccgcgcccagcccacaaacaaaaaucuuuaaacagcuauuacuauguccaaguauuuaaggaaaacaugaaaauaggaaagaacaacagauauaaaaaagaaucaaauagaauuucuaaagaucgaaauacauaaucacuggauaggacuaacagcaaacuagacgcuacagaacaaaauagagaaucuaggaaacaauaaaugcuaaauccagcaacagaagccuuugucacuucugccaugacuaacugguuaguagacuuuuucauuagggugacugucccugaggaaaggguccaagucucacaauugucuuauugaccauagcacagaggaauaugcugaucgacuucucucucuuuuuuuuuuuuuuaauuugagacaggguuuugcucuaucaccuaggcuggagugcauagcacaaucguagcucacugcagccucgaacucauagacucaagaaacccuccugccucagccucccaaguaccuaggacuacaguugcauaccacuaugccuggcuaauuuuuaaaaaaaauauuuuguagagauagggucucacuauguugcccaugcuggucucaaucucuuggcuucaagcagucccccugccuuggccucccaaagugcugggauuauaggugugagccacugcacccagcuagcuuuguacuucaagaaaaaaaaaaaaaaaaccuuucuuuuuaggaaaaccagacuaauugguauucugggguuuauacauguaaaaacauauuugcauaugaaagguaauguacaaaagcuaaaauaguagagugaugaaauguaggcaauugcuauuauuuggaauauucuagaauaguguuuauuaaaaauguaaaguacagacaugagaagcccuaaucgugugccauaaguaacaaugcaacauaauaaagacauuaaaaucucaaguuuggaauaaaagguuuuuauucccacugagcuccagaguggguuagacccugggacacaugcccacucauaggagacuguuuuguauuagaaaguaaaaaaagaaagaaagaaaagaaaauaucucuuuauaggucagaaaccugcuuagguaaauaagugagguucagaauggagugaagcaaaaguaugaaauuaaaggaaugauauuucccucaaacacagaagugcucuguuagcuuucuuucugccucuugaaacucuaaccauucucgccaguugcaaucauuuaaguaugugucuuuuuuucccaacauacucauguucuaggaaucaggaacccugucuuuuuguuccaugugaacucuccuauagugcauggcuagcacaacacauggcaucugguaguuugucaauuacaucuguugaauaugugaccaucccaauugcagacucuacagaaugucuauccaaacaccuuccuuacaaacugccccacccuccugcugggauucaaaagggcccuguguccugguuaucuaccugcuccuccacauaaggaaacaauaaaauaaucgauauuuaauaaagaugggauaacacaaaacaugacaagagaacucacuugggaauuuguggaagaggcucaaguggaauaaauguaucaaauuucuuuucauaaggcacucugaaaaacagaaaaggcaaucauaaaacugguaugccaucuacagcaaagagaucaauacaucauuguauucaauagaauguccuguuuuccgauuuuaauuuucaaguauugacuucaaaacuguaagaaccgcagauuuuauuuuauuuuauuuuauuuuauuuuauguauguuuugagacagggucucacucuguccccaaggcuggagugcaguggcacaaucucagcucacugcagccucgaccuuucaggcucaggugauccucccaccucagccucccaaguagcugggauuauaggcacacaccaccaugcccagcuaauuuuuuguauuuuuguagagaagggguuucuccauguugcccagguaggucuggaacgccugggcugaagcaauccuccagccucagccucccaaagugcuaggauuacaggcaugagccacugugccuggcccacagauuuuauauuauuuuauuuuauuuuauuuauuuugagauggagucuuaacucugucgcccaggcuagaguguggcgcugcaaucucggcucacugcaaccuccaucacccagguucaaauaauucuccuuccucagccuccugaguagcugagauuacaagcaucugccaccgugcccagcuaauuuuuguauuuuuaguagacacgggauuuuaccauguuggccaggcuggucuugaacuccugaccucaggcgauccaccccaccccacccuuggccucucaaagggcugggguuacaggcgugagccaccgcgcccggcccacagauuuuaguuuugaucauuuuuagucaacaucauuauaucccacaugguuaauuuuuuaaaauaauauuuuaaauguaguacaccaacuacccagcacuuugggaggccaaggcgggcggaucacgaggucaggagaucaagaccauccuggcuaacauggugaaaccccgucucuacugaaaauacaaaaaauuacccaggugugguggcgggcaccuguagucccagcuacucgggaggcugaggcaggagaauggcaugaacccaggaggcagagcuugcagugagcugagauggcaccacugcacuccagccagggcgacggagcgagacuccgucucaaaaaaaaaaaaaaaauguaauacaccaacuauuuuucuuuuaauguaaugauccucccacuuuucuccaucacuuuggucuaaguuuauuuccaaguuuaaguccacccacauaguagucacuauggccaacaaucugauucaguaugaaaauuuaaaaguuuucaaaucugugauaauagagauaggaacaaaauuaacaaccacuuuuuuguaguccaaguccuguguguaauuuuaauuauacacaugcaugugugcagacauuaauuaacuaaagaugagcuuuucaaggaauuuucauccaaucacaucuuguugacaucuaucccuuuuaaaauauaauuucuguguaguagagagacacaauuccuuuaaaguuaacuauauaaugcuaguauuaacauacacuuacauugaaaaauucacuggugggagcauugauccugcuuuguggaagccuuuacucuguucuggguacauauauggauugucgccuggaguuaacuuugggauuccauuccugggaucaauaucuguggagaagguuugaaaacaaaaucauacaagggcugaagaugauccacagauuugcuguaaguauuggcaugacaauggaaagaggauauuuuaguauuuuauuauaaauuacauagaaguuucucaaaguucuguuugugauuaucuugccuuaaggagaugagccuauauuugggacauuuuccaaaaaguguuguuguaacuaccucacccuggaaaagaauuguuagauucagauggaguguuuugguuuaaaauauaaggugaaucagagguuucuuugcaaugauccaaaaaucucugaccuaaaaaucucuucauuccugagcauuagugcacuuugaaucccugagucuuaggaagccgaagaaacaagugucccuggggcucugccucucugacuggguccaggaaggaaaccaacuaaggaugucuugcuccuucugccucaaggacuggggccaugcagcagugggagguggcuuccuggagaagagcaagauuacucagcagagguucuuacacccagcucagccccugcuaaagcccugggaacaagaaacuaaucacgggaguggaaggcaucagccuaguguagggugaucauuuaaacccacacaccuaaaguccuuaaaauugccuauuuaaaaaauuaaaauuuaaaauaaauaaaucaacccacacacuuacaccagaugcaucuccuaagagaauaagccuggacuacgagacucaucacccuugggcucagaagcagggacacguggcuggaagcaugaccuccaucuuugccacacacccagauucuucuagcuaacucggaaaagccaucagcgugacagguggaaguucuuggguuaccagaguauuuacuuuuuugucuuucucuuucaaaaaccuuuucaauaacugacuguauuacacuuuugauuagcucuucuguguggugaaauaacaucaacugcacccaugcauugagugccugcuggguaugagaugcugaggauucaaagcagagagaguggagguuuaaaauauauacugaauccccuugaggccaggaguucuagaccagccuggccaacacagugaaacccugucucuacuaaaaauacaaaaauuagcugggugugguggcacacgccaguaaucccaguuacucgggaggcugagacaggagaaucgcuuaaacccgggagacggagguugcaguaagccgagaucaugccacugcacuccagccugggaaauagaaugagacucugucucaacaauuuaaucaauuaauuaaauauacagugcaucugaaaccuuuugcauaccaaaccagggcacugacaaguaagaguugggugacaagagguggugggaagaguuuggacuuuggagucugucgcaccugaguucauacucacuccugcaauuucuaguucugugcccuugagcuauuuauuuaaccuuacuaagccuuuuuaaccucauuuauaaacuguuuauuucaaauggcuacuuugcagaguuaucaugaauacuaaauaauaaugaugugagcauauaacaagcacccaagaaauaguagcaauuauuauuauuugaaaucagaacuggacuaauaccccucaucccaauuauuuuuuaaucuggaggauacgauugcuauauagcugagguauaaauuucuccccagggaaucuuaucuagauagggagacauauguaaagacgaagguaacacuacaaagcaguaaaugccauauacuauagaacagugguuccaaaauuuuagcacaccugaaaaucaccuaggaaacuuguuuaaaaugcagccuuuaacccaagaaauucuguuucagaagaucucuaauaguucccagaaccaguaauuuuuauaaacuuuccaguugauuaugauauagguggucuaaggagaacaccuagaaauagacuaugguggccaggcgcaguggcucaugcuuguaaucccagcacuuugggaggccgaggcagguggaucaccugacaucaggaguucaagaccagccugaucaacauggugaaaucccgucuccacuaaaaauacaaaauuagcugggcaugguggcacaugccuguaaucccagcuacucaggaggcugaggcaggagaaucgcuugaaccugggaggcagagauugcagugagccgagaucgcaccauugcacuccagccugggcaacaagagcgaaacucugucucaaaaaaaaaaaaaauauauauauauauauagacuaugguaaaagauaucacaagauaaugucaggaggaagaaaaagaggcaauggugugaugucaguauaagguguuacuuuuagggggaaaaucucccaaacaacacuucugagauaacauguuuguuuaagcuauuaaguacaauauggggccuugguauaauuucuggauaucucaccaaaacagguaucagcccaaagggcuggccacuauguaucaauagcugauggacccauaacacugcaugaucaguucuaaugcuuguuuguuuuuagacagaccauccaauuuccuggauguagacauucaggagguagaaaaugggaaacauacauuuagagacaaauaaccauauaagggagcgaaccguucaccaaauaacuuacucugccccacauuucagugccccgaugcguuuagguagagccauguucugacugauagauugugagcagagaugauaugugccacuuuaaaaagaagcauuuaaggagcugaugugaaaaaccuuccagcauuuucucuuuacccuucuauggcaaucuuagaagccacagguugagauggaaaggucacagauaaaagcagacagcauccuuggaaaggagcuguccuggagagcugcuggauccacaguggacuuuacaagagaaaggagcaaacuuuagugcuuaagcugcagagauuucagggacuguuacugcggcagaaucuauccuauucugacuaauacaauaugcuguacugugggaagagcuacacaauagaaaauuguauuuucagaucuauuucccuaccaccuacaaucauagauggcauuuuguucuguggcaacagcuaggccuuuagggaacuccaccaauauccugguuauggcugauggauaacagucaaccauuauuuaaagauauuuugauugauuuuuugauauaauaaugcguugcauuccaguuuaaaauggcagcugguuggcagucccugagccuaccacuucaucucauccaagaaauaaugagugggggccaggagugguggcucacaccuguaaucccagcacuuugggaggccgaggcggguggaucaucugaggucaggaguuggagaccagccuggccaacauggugaaacccugucucuacuaaaagacaagaauuagccggcagugguggcacaugccuguaaucccaggaggcugagacaugagaauugcuugaacucagugggcggagguugcagugagccaaggucacgcuacugcacuccagccugggugacagagcgagacucugucuaaaaaaaaaagaaagaaagaaagaaagagaaaagaaaagaagaaaaagaaaaagaaagaaagaaagacagaaagaaaaaaagaaagaaagaaaagaaagaaagaguggggagagaauuucacaaaggaagaaguauccagugucaagcuugacaguaucaagugcugcagugagaucaaggaagagaagaaauggaaaaagaccauugcguuugauguuuaaagaagucacuguacaucaccuaagaaguaaucauauacuaaaacgaaucaagccuguagacccaacuaccacuucacaggaaauacacaggaaagaggaaccuguuaaaugauaccaagcaauguaaucagcaaaguccugaucauggugaauacugcaggauaaggccuaguuucuucaccauacaaauugcaagaaaaaaggagggagaaagaaacuuaacagacauaccaaccaauuucaaucugugggccuuacuuggauccugauccaaacaaacuaaauauuuuuaaauuguggcauuuaugagacaaugggauauuuggacacugacuauauuaaggaauuacuguuaauuuuuaaaauaugauauuaugauauggaauugugguuauguuaauaaaauaauccuuaucuaucagaggcacauaugauauauuuagagaugaaauaauaugaugucugaaauuugcuuugaaauaaucccugggaggaggaguaaugaugaaacaaguuagccagguguugaucauuauugaagcuaaguggaugaguacaucggguuucauuuugcuauuguuugaaaauuuaccuaauaaguuuuucuuuaaaaaaauaugaaauauggguuaccacuggaguuggaggaggaaagauggaauauucggggaagaggauauuggagccuucaaauauaaaguuagaauuuuauuucuuaaguggaguaaaagaacgcaaguauuugugauauuucauuuuauauagucaacaaauguuucauaaauauaucauugcauuuacucaguauuuauaaaacccuaaaggaagaagggaaagaagaaaugaaaggauggagagagggagggaggaaaggaaaaaggaaggaaggagggaaggaaggaaggagggaaggagggaaggaaggaaggagggaaggagggaaggaaggaaggaaagaaagaaaaagaagaggaaaggagaagaaagaaaaagaaaggaaaggagagggaagaaucauaaacauaaaauucaggauaaggugguuuacuuuugagccaggagggcagugauaagucaagauugagauuuaggucauuaugauaaucccauuuacuuuugauagguacuugcagcucaagagugcaggguaggcuggcugcaguggcucacaccuguaauaccagcacuuugagaggccaaggccggcuaaucgcuugggcccaggaguuugagacuggccugggcaacauggagaaacccugucucuacuaaaaauagaaaaaucagccgggcaugguggcacaugccucuagucccagcaacuuagaggcugagguuagaggauugcuugagccuggggcuggggggcuggcauucggaacugcagugagccaagaugguggcacugcacuccagccugggccacagagcaagaccuugucuuaaaaaaaaaaaaagugcugggcacgguggcuuacgccuguaaucccagcacuuugggaggccgaggcaggcgaaucaccugagguccggaguucgagaccagccugaccaacauggagaaauccgucucuacuaaaaauacaaaauuaaccgggugugguggugcaugccuauaaucccaucuacuccggaggcugaggcaggcgaauggcuugaacccgggaggcggagguugcugugagccaagaucgcgccauugcacuccagccugggcaacaagagcgaaacuccgucucaaaaaaaaaaaaagugcaaggugcaggacuccucacggauuuccauaucaaugaccacucucccagcucauuuaguauggcuuucuacguauuuuucuacccaaauaaauaaaagccucaauucucaaaacuauuugucucuguugugaguuuaagucuauuuuaaaacucaaaaaugagaacagucuacuucuuucucuuuguauuccugcuacagcaauccuauuuauuucuggagcaaugguugccuccuacacagagauuuauauagaaaaaugugucauaaauggucaguugguacucagcaacuuuugagggucuuucgguaagucuauuaugaguagguuggggcaaagaacucacugagcuacaaaccaaggagauauagauacacagguagauauauauucauuucaauagccuuuaauuaaaucagcaauaaaauaaaaacaugcacuucaggcugagguuuaugggauguuuuccuuguggagaauauaaaguacaauuuaaauguguaugccaggcagcaucuaauuggaacauaaauucuuuucuucagacuucaauggagguuucuauuaauaaguaucugagagaacuuaucugaugacuuaaaugucacauuugcauuuuaugaaauucagagaaaaaagaaaauguggauuagcaucugcugugagcucuuugccaaaacgugcagccugcaaacuguccccuucacuuuucugucuuccuggcugcacuaggggaacauggugacucuacagggcugcccccagcuacagaaugcagggccuauagaaucacgacucgagaguuuuucggggacugcacagucaagacccagaaggaaacaucaccguauuucuuucucccaaagcacuuguccaccguccucucugauagagaccucuuguugccgaggaagacuccauuaaagaagcacugcuuuccgacgugguagguguggauguugcugcuaaaccuuggguaaaauguccacucaggacgaugcccaucuucugcaauacaccagaaagccuuccauuagcacuguucccagccucauaaugcaacuggaugacaaaaagcugugaaaacuccacaggcacuaucuggcuauauaacuuuaauuaauguguauaaucccuugguucuacaucagagacagugugaaacucugugggacuagacacaaaaggaagggaagucaggggagagcuaucuaagaggccgucuuuguuuuuguuugcccucuucacccucuccuucaaaaauaaagccaacuuuauguuuggaaguuaaguauugauugggaagcucagagacagucuuacaaguaccugugauacaaucuucacucugauaacgguguaggaaaaauagaaugccaucaaccagcaaauggcuaggccagugccauccacauggcaccucaaguggaggaaacaugguguuggcugcaacaauagcacgcgcaugugcuacggugacaccgggaaauggaccugugauaauuucaaaugagaaaagcugucgugagaccccaggcuaguuucuggaccuugcagugccuuuguuucaucaucugauacuuuuccuguaagauggcuaacagugacuuuaaacaauaaaagauccccuaguagcucuaggggugcuugagaaaugugggcucugggauauccaagaagagcacaggcuucgaggcaagcaaguguggguucugaucccauugcucuacuuccuggccauguggcuuuauggaugacugaaugucucaaagccucaguuuccuccuuuguaaaauggguaugucuauauuaaccauauagaucuauauguauugacacagaaagagguccaugaucuauuuauaccaguuuguauacuaacccauuuauuuuauaucuauauauguacacguguauguauacacacacacauacauuucaaaauauuggaaaaauauauaucgacucuucacagcuauggggcagaauagggauauuguugaaaaauauuggggaaggaguuuuuauacucuauauacuucuauauuauuuuaaugucuuucugcaguauuuuaauggguuuuauauaaaggcauuuuauuuuugaaaaacauauaauggcuuccuggcagagguuuugugaauuuugagauaaaguacaucaaaugcuugacaguugugggccuucgaugaggguggccaacaguauggcagacuucugaaaagaccuggggcacagaagcauguggaggagggucugugacuuacucgucugcaacuuaagcaggcugaauuccucaggauauuuauccuuuuggacuucaggcaacgacauuucagaggagugaucagaaugugagaaggagaguuuccgauccaagucagcaguggugcuggaaagaaagcagaaggauucuuccacgugcuuaaacugguaguuacagccugaucucacauaguuuacccuagaauugcccucgcuuaugagaacugggacuacuccucuauaaaaguccuugagcauaucauuuauuuacucauaauuugaggggacugaaacuuauugaaaagauggguauucaguggcacacgccuguaaucccaaaaccuugggaggcugagacagguggaucacuugaggccaggaguuugagaccagacuggacagcauagugagaucccgucuuuacuaauuuuuuuaaguguuuaaaaauaauuuggugguuccucaaaaaguugaacacagaauuaccauaagacucaguaauucuguuucuagguguauaccuaaaagaacugacaacagagauucaaacagauacuugcaugugaauguucuuugcagcauuauucacaacagccaaaaaguggaaacgacccaaguguccaucaagagaagaauggauaagcaaaaugugguacauaacacauacaauggaauauuauucagccuuaaaaaggaaugaaguggcugggcaugguggcuuaugccuguaaucccaacacuuuggaacgcugaggcagguggaucacuugagcucaggaguucaagaccagccugggcaacauggagacaccccaucacuaccaaaaauacaaaaauuagccaggcaugguagugcaugccuguaaucccagcuacucaggaggcugaggcaggagaauugcuuaaacucaggaaguggaggcugcagagaucucgccacugcacuccagccugggcaacaaagugagauccugucucaaaaaaauaagaaaaaaauaaaggaaugauguagugaugcaugcuacaacauggugagccuugaaaacauuaugcuaaguaaaauaagccagacacaaaaggacauauuaugugauuccacuuauaugaaauaucuagaauagguaacuucauagaaaguagauuacagguuaccaggggcuggggagaggggagaauggcaaguuauugcuauggucauagaguuucuguuuggacugaugaaaaugucugaaaauagacaauggugaugguuacacaacauuaugacugcaauuaaugccacugaauuguacacuuaaaaaugcauaaaaucaggcaggcgcaguggcucaugccuauaaucuuaguauuucgggaugccaagguaggaggaucacuuaagcccagguguuugagaccagccugggcaaaauagugagaccucaucuccacaaaaaaauuuuuaauuagccaggugugguggugcacaccuguaguucuagcuacuugggaggcugagguggaaggaucacuccaccucauuccagccuccaggaaguggaggcugcagugagcagugacuaugccacugcacuccagccugggcuacagagugaaaucccauuucuuuaaaaaacauuuuuuaauggauaaaauggcaaauguugugccauauauauuuuacuacaauuuuuagaaaggaaugauauauauuacaacauguaugcaccuugaaagcauugugcuaagugaaagaagccagacaccaaagaccacauauugauaauccuauuaauauuacaugucugaaauaggcaaaucuauacagacaaaaguagauuaaugguugucucagacuagagggauaggaagauggggcugcagggggaugauugcuaaaggguauggauuucuuuuuguggugaugaaaauguucuaaaauugauuguggugauaguugcacaacuuuaugaauacacuaaaaaccaucgaguugugugcacaguuuaagugggugacuuuuaagguaugugaauuauguuuaaauaaaucuguuaccaaaaaaagcauguuuaauaaaaccauuaaaugcaaauaaaaaaucaauaaguauguaaagaagacgaagaaauaaucaaaaacaaaccuaggcugaaaugauuacaauaauagagcauuauguuuagcgcugaacuuccuagcaguuuauaaaggcccacaacaaacuauuauaggugucagcugaaaaugcaaucacuucugguuuaaauggcuuugcgucugaaaccuggccuuggacaauguuuucagguacaaugaucuguuaucaagucacaggaucuuuuuucauaacaaugcgucacucauauuuaaauggcaucaaagcaacuucauauugcuugucuuguuugcucccuacuaacaauccugugauguagguaggaccaauaacucagugcccccaccccugauucagaauauaagcaauuuuggagguguguuaguuuccaugacaagaguauagcuggggacaacuggaauugggguucaaugucucagaacugucacucuccucugcuuauccugacaccuuggcuuccuuucugccaauugcagaugagcuucuucacaagagcaaaaaggccacugacagaccagauucaaauucucaugucuuccaaccaauuuuuacccguaucuccaaugugaaaaaucucagggaaggacucacuggcucagcucagaucacacguucucccuuaaaucaaucacuaucaagaaguggagauaaguaagaugaugguagcuccuauucagaauacucauuaaaacuggguaggcaggaguucgagaccagccggggaaacauagcaagaucuuguguuaaaauguuuaaaaacugcauagggaagggcugggcacaguggcucaugccuguaaucccaacacuuugggaggcugagggggguggaucaccugaggucaggaguucaagaccagccuggccaacauagugaaaccccaucucuacugaaaauacaaaauuagccaggugugguggcaugcaccuguaaucccagcuauucagggagcugaggagggggaaucacuugaacccaggaggccaagguuccagugagccgagauggcgccaauggacuccagcugggacaacaggagcgaaacucuaucuaaaaaaacaaacaaacaaacaaacaaaaacuggguaaggaaggagugaaaaucaauuccccagaaaaaggagaauagcauagacgacgccacuggaaagucaguggaagccaagcagcuucuacaauaugugaacacagcaaggcauuggaggaagccacuucaagcaaaggaggcaaugugagcaaaggcauagaaggaagaaacaucagggaaaugaagaaauuugaugugguuguggcaggaguuuuugagauaaagguggagaagagaaggagacagaucuggaggacuugcaguucauaugaagggggacucuuuuuuaucaagcuuuaauggaauaucauuaaauaaugguaagcaacgacaugacauggucacaugugguuagaaaacucuggaagcugugaaaggaaugggcuuugagaauauaaaauuuaagucagggaguccacuuaggagaguguagcaggcagccucugacauggcugccagugaucccugacucuugguauuuauucccuccuguaaucuucucucuuugaguauaggcuagaccuacugacucacuuucaacaaagagaaaacagcaaauguuaugggaugucacuucccacauuagguuacaaagagacuguggcuuugucuuaugugcacuccugcuugcuuguaaggagagacagcugcuauguugugggaugcccucuguagagacaaggaacugagggaagccugugggcaacagccaguggggaacugaacucucagccccagcagccugugaggaagugaauccugcuaucaaccauaugagugagcuuggaaguggauccucccacaguugagccuucagaugagcccacagcuguggccaacaccucgauugcaaucuugugagagagaccuugagccagaggcaccgaucuagguuauacucaguuuccugaccuguagaaaaugugagauaauaaauguuuguuguuuuaaguaacuaaguuagggugauuaguuguguaccaauaaauaacuaaucuagaagguauuacagugguccagguaagagaugaucagggccuugagugggaccaugguaauauagauggaguagaagagauggacuuauacgguguuucagggcuugaucccccauuggaugagcggcaggagacaaguaugaucugucaaucuauaccuuuggagcuguaugaauacugagauuaucaacugagacaaggaacacagaaggauuugguuuguaaggaugggugaugagaaguucagucaaggcauguugaguuugggggccugugggacuucagguggagauaucuggaaagcaguucaauauaucaaucuaaagccugaggcuaugucuagaguggagcuuuagauucggcuacacaugcuuugacugaguuagguccuccguaacccaggcaucaugaaagauaaaggggacuuauuuaggugggaauuaggaauguagaaguggcagcaaucacgcaguuccccauccuacaggaugugaaccucacauuccgggcuuucuuucccucccaauacauggucccacuacugcugcuagugauauacaccuguugcagaggaccuaaagaggcagagcuuaagaauuaugccagccucuuccaugucuagugcugggggcagcaaguccacuuggagcagauuuugugauauaaagaaucacuugagcaacuucccuuaacuuuaacugaauaaauccauuucuaggaauuuacuuuuaugauauaaccagagaugggcaaaagcugaauguacagggacacgcauuacagcacuauuuacaauagcaacucuuuaaaacuauaggucacugguuagauuguggucuauucaucugacacucaagcaccgcagucauugaaaaccauguucuugaaaaacacucaaagguaugagaaaauucucuccacauauugcucaguggaaaagcugccuuuauaagauguccuucaguaagugaaugaauaaauaaacuaugguacauccagacaauggaauauucuucagcaaugaaaaaaugagcuauuaaguggugaaaugacaugaaggcaacuuaaaugcauauuauugagggaagccaaucugaaaaggguauauacuauacgauuccaacuauaugucauucuggaaaggaaaaaacuauggagacaguaaaaauaucugcgguugccagggggugggaggggugggaagggaugaauagauggaacacacaggauuuuuuag[450 bp omitted]gguaauaaaugucccacucuggugcaggaugugauagugggggaggcuguacauguguuggggcagggaguacauaggaacuuuguaccuuacuguuaauuuuucuguguacccaaaacugcucuaaaaauaguaaaacccuuaauaaaucuuuuuaaaaaguagguuuuacaaaagaguaauauaauaugaucuuaauuguaaaauaaauauauauuuuaugugcaaaaaauauguuuacuugcacauauaaaaaacuaauaucaaaauguuaacauauucucuaagaugugaaauuauagugacauuuauuuauuuauuuauuuauuuauuuauuuauuuauuuugacacaaguucucacucugucgccuaggcuggagugcaacggcucgaucauggcucacugcagccuggaacuccugggcucaacugaucuucccaacucagccuccugaauagccaggauuacaggugcacacccccaggcccggcuaauuuuuguauuuuuuuguagaguggagucucacuguguugcccuggcuggccucgaacuccuggccucaaccucccaaagugcugggauuauaggugugagccaccaugcccagccaugugacuuuuuuuuguuuuuuuuuuuuuuuugaggcgaagucucgcucugucgcccaggcuggagugcaguggcgcgaucucggcucacugcaagcuccgccuuccuagguucacgccauucuccugccucagccucccgaauagcugggacuacuggcacccaccaccacaccuggcuaauuuuuuguauuuuuaguagaguugggguuucaccauguuagccaggauggucuugaucuccugaccucgugauccaccagccucggccucccaaagugcugggauuacaggcgugagccaccuugcccggcugugacuuuuauuuucaauacugucuucaucuguucaaauuuucuacaauaaacuuaaauuacuuccauuguaacaaaaauuauuagaaaagcauuuucaaaacuuuuuauuguaaaagaaauauaaacagggaaaguacauaaaacacaaagucaauuuuacaacuaauuacaaagccaacauccuggucaagaaacaaaacguuagcccggcccagugacucacaccuguaaucccagcacuuuaagaggccaagaagggaagauugcuugagcccaggaguuugagguuaaagugagccaagauaacaccacucuacuccagccugggugacagagagagaccccugucucuauccaaacaaaagaaacaaaacauugccaguccuucccuuccccacuccccagaaaccaucugugugggucccuuuccgggaaaaguaaccacuacccuaauugugacucuuacgauaaucauuuauuugcuuuucuuuaaguuuuaccacccauguauguauguacauaucccaaaaauauauaguuucacuuauuuuugaacuucguaauagcaagcacuuacacagaacuugcugugugccaggaagucuucuaagcucuuuccagcuauuaacucaauuaauccucacaacaauccuauaagcuaucaucagcauuuuacagauaagaacacugaagcccagggaggugaaguaauuugcucagauucacacagauacuaaguggcagaaccgggauuugaacccacacagucuagcuccagaauccaugcucuugccaagcauaccaugcuaccucucagacuauuggcuucuuggucagaaucuccccaaccgugacagcucugcaccagacccuuacuuacucuacguaagcagacacucuggggaggccaggaggcucacugacacuugggccuguuuccacagaagaugaggaacugacacuuuugccagaggguguuguguuggcaaaacaucccuuagauuccagaaaaucacugcaauuagcaccuguaacacagagauaucaccauuuaauuacauuauugaaaauacauuccacccuauuuuguuuccuagauuauaaauaaauuuuuaaaacagcuaacauuuauugaacauuuacugugcacugaggauuaugucaacaccuuuacacauauuauuccauuuaucccuauaacaacccacaggcuuagguauuccuuauuauccccauuuuaugguugagaaaacugaggcugagaaggcuaagaaacuugccuaugauugcauaaaaaguaaacaucuaggcccggcgugguggcucaugccuguaaucucagcacuuugggaggccaagguggguggaucagauaagauccacccugacuugaggucaggaguucgagaccaaccuggccaacauggugaaaccccgucucuacaaaaaacaaaaacuagcuggucaugguggcacacucuuguaaucccagcuauuugggaggcugaggugggaggcuugcuugaacccaggaggcagagguugcagugagccgagaucacaugacugcacuccagccugggcaacagagacucugucucagaaaaacaaaaaagaaaaaagaaaacaucuaggcccauauuugauuacagcucuugugacacuaaagccugagauucuaagcccuguacuagacugcuugccccuacauauaguucaccuacucugaacuaaguggaagaccuaggaucugaagugagcuauauagcacuguacauuguauuaagcaucucaauauaauuuuccaaaggauuuguuuauaaaaagacugaugaauauaaugcugaucacaacccaaagaaugcccucagaaacuucuguggguuccccucacaguucuuauucaucuuaguagaauccauaacagugccuggcacaaagcaggugcucaauaaauguuugagugaauaaaugaaaaagaauuauaacuccccaaccacccacaguuacaaguaagggaguccugaaaaccagugagugucagacauagaagaauauccauuaucuucacucugcuauacuauuaauacuucaugaaagccaauuuguucuguuaucaucucauacaguuauguaccucauccagccacaaaaauaaaaaguccgaugaaaagauuaugcauauuucuuuaugcauaauuucguagagcacuaaagcucaauagauggcaauguaaccucugguuaugagaaaauuguaagaaauaagagucaaacucugauucuugaguacauuuuuagacugacuacuauuccaccuacacaguaucaugcuucacacauauagagucaucuuuugguaucgacgggggauugguuccaggacccccgcaauacaaaaauuacaaaaauccaaagaugcucaaaucguuuauaugaaacaguguaguauucgaauauaacauaugcacauccuccuguaugcuguacuguaaaucaucucuagauuacuuguaauaccuaauacaaugcaaaugcuauguaaauaguuguuauauacuuauuuguauuauuuuuguuguuauauuguuguuuucuuuucuuuuuucuuuuuuuuuuuuuuuuuuuuuugacacagagucucacucugucacccaggcuggaguucaguggugugaucucagcucacugccaccuccgccucuggguucaggugauucuccugccucagccucaugaguagcugguauuacaggcacucgccaccaugccuggcuaauuuuuguauuuuuaguagagacaagguuucaccauguuggccaggcuggucucaaacuccuggccucaagcaauccaccugccucagccuccuaaaguguugggauuacagguguaagccacgacacccagacuuguuguuuccuuuuugaauauuuacuaugggcaguuggucgaaucugccaaugcagaacccguugauaugacuguauaguguaaacuaugcaaauucccaccaucuaucagcaggacugcuacucagagaauuuuuuauucauuuccucucaaauucauaucacaagugaauaauaccuuuuccauucuuaucaagucccgaucuaucaccaaaccuuucacuccuaagaggacuuugccuguuacucuacaaagcuuaaaguucagcugagcuacucccucccuucaaaauccucccacucuggggcuucucaggacauggcgcaaggccuaucugcaucagaauuacccaggaagccuguuaaaaauacagauucucaaauuccaucgcagaccuauugaauuagaaucucuccaagugaggccugggaaccugcauuuuaaauaagcccccacccucaccccugcucuucauuuaggcucacguuuggcaguaaucuccuucuugaagucuaguuccaucacugcacuguauuuuauccaguuccacuuccagauucccaacugcacagaacuuccugaauuugcccagucacgagaauccccuugggguacuuguucaauaugcaggccccagggcucugacucagaccuacagucugggagccaggauauuuaagaagcaccucaggugauucuuagggucagccaagugugggaagugcugcucuggaauaugcccuagagccuagagcagcccccagcacagugagguccaacugguugcuugagguguaacugggauggagucaagcccaggggagguggcaggcaagcagcaggugaggaugaggagacggguccccaguaaccaaaggaagaaccacccauauaccaagccacaaaacaaguaucaacaauacauagaccacacucucugaccacaaugcaauacaauuagaaaucaauaauaaaaagacagccaaaaaguauccauaagcuuggaaacucaaaccacacuucuaaauaauucacauacaagaagaaauuguaauggaaaucaugaguugcuuaaugaucaaugaacauugaguacuauauaucaaaacuugugggauucaacuaaagcaguaauuagaaaucuggggccuugaaugcauaugcuguauuucacugaauauaaggcaccaucaauuguaauagcaucguuauuuuauguaucacaaagaacaaaggcugccaauuaaaguaugauacaugcuuuuaucacuuagaauuuuuauuuuauacuuauugaugcauucuuuuaauuuauuuauagauuuuaaucacauaucacucaugcacauauauaaagaaggaaaauauaagcacaauagacugguuaaggcauuccuaaaucuuaugcacauucagaaaucugacuacuaaaccacuuucaacucaaucacuauuguccacacuuuccaccuaauacugaccuaauauuucaauaaaaaugugaguugagugaugcagcauuucuuucuuuuuuuuuuuuuuuuuuuuuuuugagccagagucgcccaggcuggagugcaauggcauaaucucggcucacugcaaccuccaacuccaggguucaagcaauucuccugccucagccucccgaguagcugggauuacaggugcaugccaccacacccagcuuauuuauuuauucauuucuuggagacagagucucgcucuguccccccggcuggagugcaguagugcaaucucagcucacugcaaccuccgccucuuggguucaagcgauucuccugucucagccucccgaguagcugggauuacaggugcccaccaucaugccuggcuaauuuuuguauuuuuaguagagacgggguuucaccauguuggccaagcuggucucaaacgccacaccucaggucacccacccaucucagccucccaaagugcugggauuacaggcgcaguggcgccaggaccaauuuuuguauuuuuaguagagaugagguuucaacauauuggccaggcuggucucuuagccaggcuggucucgaacuccugaccucaugaucugccugccuuggccucccaaagugcugguauuacaggcgugagccaccgcgcaaaagugcuucucuacugucucuggaguuuuuuccaagcuaugaacacacguucuacaugcuucagugcucauacagcaaaaauuauuacaacuacauccuaccugcugcugggcccacagaccugguaacauccagucccuacuucaaagaugcaaacugucuauccaagaauugauggauuauaguguucaaaaucaaaaauuccaaaaugaaugagccaaguugucaauuuaagaaauaagaaaaaaaaaagaguaaccccucuccccccgaaaagauuuuaaggaauaaaaucauaaaagcagaaaugaaugaaauaaagauuaucagaacuauggcuucaugcaaaagcugauaaugcagauaaacaagguucaagaaaaaauuuuaaacacaaauaaauaauauuagagccuggacuguaaucccagcacuuugggaggccaaggcagguggaucaccugaggucaggaguucaagacugccuggcccaacauggugaaacuccgucucuaccaaaaauacaaaaaucagccgggcaugguggugcacgccuguaauccccguuacucaggaggcugaggcaggagaaucgcuugaucccaggaggcggggguuacagugaccugagaucaugccacacugcacuacagccugagcaacagagugagacuccaucccaaaaaaaaaacaaaaauaauaauaauaauagaaaugaaacaaggccauaauuauaaauaaaauagagauaaauuuacagauaaagaaauuaagcuccagaaaugucaaauaacuuguucaggguuacauagccauggaguauaauuuauaaaauguagucuaauguucaaauaaucaagacaguacugacaaaaacccuaacagacaaaucaauagaacaaaauaguaaacauaaauagaauaaaauuguauaugaaaacaaguggcauuuuaucuuggugaagaaaggauggguuauucaaaaaauauugcuggaacaacuaauuaaccauuuggaauaaaaauaaaauuaauccuuucuuaucccaaacuggaaaauccagaugacucacagauuugaauguaaaaauugaaauuaaagauguacccgaaaaaaguaagugaaaguuuauauaaucuuagagugaagaaguuauugccaagaagauaccaaauacaggcaaaauaaaggaaaagaggcauagauuugaauaugccucuuuaaauauaaacuuaaaacuuucauagcaaacuauaaacugggggaaaaucuauaacaacaugauagaaagaaaaaagagugaguagucaugacaaauuaugagcuuuuuuuuuauacuuuaaguucugagguacauguguaaaacguacagguuuguuacauaguuauacacaugccacgguaguuugcugcacccaucaacccgucgucuacauuagguauuucuccuaaugcuauccuucuccccucccccaaccccacgacaggccccagugugugauauuccccucccuguguccauguguucucauuguucaacucccacuuauaaguaagaacaugcaguguuugguuuuccauuuuugcguuaguuuggugagaaugaggguuuccagcuucaucuaugucccugcaaaggacaugaacucauccuuuuuuauggcugcauaguauuccaugguguauaugugccacguuuucucuauccagucuaucauugauggacauuuggguugguuccaagucuuugcuaugugaacagugccgcaauaaacauacguguacaugugucuuuacaguagaaugauuuauaauccuuuggguacauacccaguaaugggauugcugggucaaaugguauuucuaguucuagauccuugaggaauugccacacugucuuccacaaugguugaacuaauuuacacuccuugagcuuuuauaaauuuauaagaugaaaauaaauauccaaaaagaaaaaaaaagggcaaaagaugugaucagguaacuuauuuuuaaaaacaggcuggacaagguggcuuaugccugcaaucucagcacuucgggaggcugcggcagguagacugcuugaagcuaggaguucaagaccagccuaggcaacauauggagaccuggucucuacaaaaaacuaaaaaguuagcugggcgugguguugcacaccuguggucccagcuacuugagaggcugacaugaggacugcuugagcuggagaggucgagucugcagugagcccugaucauaccacugcacuccaaccugggugacagagugagaccccaucucagaauaagauaaaauaaaauaacacauacauauagccaauauguauuugggggaaauuucauccauccuaauaauuggguuugggggagugggugguuauuuuguggguuuguuuuuuuuuuugagacagggucuuguucugucacccaggcuggagugaucucgguucacugcaaccucugccccuaggacucaagugaugcucccaccccagccucccaaguagcugggaccaugggcacacaccagcauguccagcuauuuuuuuguuguuguuguauuuuuuguagagauggggucucaccauguugcccaggcugcucucaaacuccugagcucaagugauccacccaccucaaaagugcugggauuacaggcaugagacacuguacguggccccauccaaauaauugaagaaccgaauuuaaaaugagaugccauuauuuguuauccguuugcaaacacccagguguuuggcacagcuuggaggaauggcauuccuaucauugcuggugggaauguccccaucuuacugaagagcaauuuggccauaugugacuuccgaagccuaugagaagugcaugucauuugacucaauaguucuacaucuagaaauguaucuaugaaaaagccaugaaaugcauguuuggagauguagaauggauucacauaugugaaugaaaugaaaucaaggccaaagauguccucuaugucaauaauugcaugugaguucugagguauuuacaguaagauuuacuuaugguaauuuuuggccauagguuuuaacaguggcugccuuucauagcauguaaacauuuuaguuguauauugccacuauaggacuugagaguucacccaagcaagaauugguuggcucuauggaugguaucagagaggguccuuucccaagcuuuuuguuuguguuaggaacaaaauguaaauguacugcauuucccuaagcagcgagcagugaaacacaccuaaaacuuuagcacacuuccuugcuugcuugaaaaguuuuguggcagcagcacucuagaaaguggccuguggccacuauaauggggaaagcuugucugauggacaaggaugggaagagcaaucucuugcuaaacuggcaaacagcacacucucuagaucaagcugacuacggcaucuuccugagaguaacucaaccucaaacuugagcuggagacacuuaaacauguucucaagaugccuccccgccccuccccugguaaaagaagauuagcuggaagagaagcuggaauugcaagccugaacacuuacuaauacugacgcuaauacuaauacugaugcucccacugcauagaguaccauccagcuacucugagcaagucaauuacuucuccacgcccagcucccaguggcugcccucucccccaucuagcucagaaggcuguggggagacaaacacacuaaggagauacacccugcuugaaaguuucaccauuuaucaugaaaauuguuauucaagcgcaauaaaugucaaguaagccagaagucagaaaauucuaacaaguuucuaaaacacugcaaaauuaagaagaaaugauguaauuaaaggccaagagaagguucugguaaccagaaaggaauucaagggaaaaaagagaauuuggaagaaagucuguuucuuuauugccaucuguggaauucaggauaauuauuuccauuuuuuuaggcaggaauaacaccuuacauaaccaaagcacuuucauauguuugucaucucagcugauugucauaauagcucugucuggcagggagaaaaauaauacaucaagccauguuuguuuaacauggauacucauuuaaccaaacacuauuucccaccccugcuuaucugcuucacaaggggccuaaggaucaaggacagaaguuuuuaacccguuuuuugauucuauccucucccccaugagcaguaaugaaagcaaucgguucucugauggaaaaaugcacacacacacacacacacacacacacacacacguaucuucaauugguuuguggagccccuuccuugcugaaauccauagacuccauguuaagcuaaacucagauguauucuccugaauagacucaccuacacagcaggaaaggacaccaugggucuuucauuaauguggucugggaccugguacccuucugcuaccccuaacucgaaaacauggauccucccuaggacauccuuaaaacagcagcuucuuccuuuaccccaaacuggaaacugcaggaaggucuggagcuuaaaguuagaaucccagaacccuuuucuccuugcuguugcagacacacuuggacaauuaauagcucuaacuccuccagcuccuccuucucuacgguccuagcuuauauuaauagcuggguggaaugaguuguaccucccuccuuucuccccacugugaaggagaaugaggagaucacacacccagaauacagaagaccagggagaaagcuaagaucugaucccgcaaagucuggauauuucacaaccccuuuuugcagcacucaggccacucacccauaacagguaaaugagaacuugagcgcaggcgcacucugagcuuuucugggagacuguggcuguucagcgccaugacacuguucuccaaaggcaaacgugcccccaaauacccuccucggccuuaaccaauuauggagcuaccagccauuauuuaauuuuuagaguguucauaauucucaccugaacugucccauccaauaaacaaugacacaaaccuacuaauaucugagcaaaggaaagaugaaaggacacaggcucgaaaguauggcagacucaugucaaaucccaggcucaugucaaaucccaggcucaccuuuuauuaacccaagcacugggcaggucaaaucucuggcucccuuuacucauagguaauauacuucuccacugcugugagauccagugagguaauuuaugagacucucugcuuugguggugcucucugccuaaucaaaucuuggguuagcacaaacauaagcuacuauucaagcagcucuuuuuacaugcccccaaacuagcuuccuucuaaacuucaaauggugccccccaccugcccccgcccccggguguaguauacuuggauguggccaccaacuccacagccuggauuucuuagaacucaacuguagguccucuccaccucggucaugccagagucccuuuuuucuggaaccuucuccagcugucugccgcaggucgugcuugagauggaggggagacggcagccccguggacuguuuccagugagcauggauggacucaucugugcccaugaugauuuuaaauauuagaagcaacccagagacaaagaaagucccucguaagaaagguaucagucaaaacaaacaaauuccacaagccaccgaaagucaggagggcaggacuggccucuaaacgggagccuuacucccuccaccugggcguuucgugguuuggaagcccugggagccccagcgaguccgcccccagcccgaaccaggcucgcugcagcccccauccagcucaaggugcuccuucuuuuccaccucggggucuucccacccccuuccccaggggaggcccgggucugugcucagaggccuccacggaccaacgaaccaacuggcaacugaacugccgaacgcacgccgcacgccgaggccugagaaccgagagccuagggcaaaagggacaccgcagccgccugcuucucccacaga

SEQ ID NO: 192699 - RNA, 17562 nt, Homo sapiens
caugauccaagucaggucauuuuaucccacagaguucucagggccauuggcaguuaugguugacaugaaguggcugggauucagggcccgcuggcgggcugcuucucgguuugcguagagggccuggccaaugagguacucgcuuuccugggccacaucugacaggcgcaagucaaauuccaggagggucuuguugucugacaugccuuccaggagcugcuucccaccguccugggagaagggugcaaaggaaggggucauuuacaucacuacccaggaucugacacacauacuacacauuuucagguagaugugacuaaaacaaaaguuucacaaaacaauacuuaaccuauuugugacgcaugaugacauauucuguucuuuuccauuugaaaaaugguagccaauacccacuaaauugacaucucaacccuacuaguuugaaaaacaugaaucucuggcaaugaagauaauuccauuccuuugguucagccaugggcaugugggacaaaucuaaugagaugugagggggaagcugagagaggguggcuucugggaagcuucuccucauuccaaaaagagaagaaaagggagcagguguucucccgguuucugccucugggcaugucccuguaugagaugucagaacuguggcagccaucuugggacugacagaagcacuagcgaggcauuggccaugagacuggggugggcagagcagaggguagcacugaacccagggguuuaccgacccuacaacccucuaauucugguugugggagacacugaauauuccuccugcuuaagccauuucugauuaagcuuuuuauuacuugcagucaacagcacccccucuagaaacugugugugugugugugugcgcgcaugcacgugugugugcguguaugugccuguguaggugagcaaggcuguucucauggggagguuuaguagaggguucagugaccuaauggagggcccugcucaauggucaucacagcuccaaccccugcugggcugggugggcuagccccaaugugaaagaauuucacguugggaggcagaaugcuaccauucugugguugugacccaguaguguguugcaaagucaauuuaaugggucacagaagcauuuuaaaaaauacaauagaauggaauguaaaggaaaauaucagcauauaucacgucauaaauuucaauauuauguuuaugucaguguucauguaaauugcauuuuuuuuuugagacggagucucgcacugucacccaggcuggagugcaggggcacgaucucagcucacugcaaucuccgccuccuggguucaagcaauucuccugccucaggcucccaaguagcugggguuacaggugcaugccaccacauugggcugauuuuuguauuuuuaguagauaugggguuucaccauguuggccagacuggucucgaacuccuggccucaggugaucuacccaccucagccucccaaagugcugggauuacaggcgugagccacugugccuggucguaaauugcauuucuuacucucagacuugguuaagaaaguuuuagagacacagucuauuagaaaggacucaggcuuucaaucaaucuuggguuugaaucguagccuugccacuugcuacugacuugaugcccuugggcaacucacuauccucucugaaacuuaguuuuccaucuagaaaguaggguuaaauauacuuaguuauauacuuaaauauauuuaggguuaaauaugcuuaggguuaauauacaguuacuuagguaacuguaaggauuaaaggaaaaauaaucauugggauacacaguaugugugcauacuugaugcaguauguaguauguaaacucugugaucuucacaauuaucccacaaguaccccuggcaguuggauuccacacccacccucacaagcccagaauagguggcucaccagcccgaugugguugcaggacagguugaugcuggugagugugguguugauggcgagcaccugugacaggaguguggcggugggcucagacagcucauugccaccgaggugcagcguggugaggcacuuguuggucugcaaggcaugggcaagagccuggccacccucauccucgaugcaguugagacguagguugagggaaaugagguugguguugugugccagagcgugagccagggacugggcaccgggugcacgcaccugguuguuagccagguugagcacacgcaggcggcuguggcucagcagcuuggcagcaccucgugcaccacggucuccaaugagguuuugugacaaguccagcuccucgaggacugggugguccagaaggcuucgaauuaugaugcgugccuugucaucauccaccuugcuucgggucagcuugaagaucugugggcaggcagagggucuacagcaacugccagccagggauaaucagccugcccaccuagaucuuuggcaaacuuggcucaccuaguguuggccaccuggcugggucuuggagggggccaggccuaccagcauggcagaguaguguagaauugguggcagguagcagggaggaaagaucacuguuuauugagcaauuacuacaugcuggguaugcugcuugggucuuccuuuuuuaucuuuuuuuuuuuuuuuuuuuuugagacggagucucgcucugucacccaggcuggagugcaguggcgugaucuuggcucacugcaagguccaccuuccggauucacaccauucuccugccucagccuccugaguagcugagacuacaagugcccgccaccacgcccugcuaauuuuuuguauuuuuaguagagacaggguuuuaccguguuagccaggauggucuugaucuccugaccucgugauccacccgccucagccucccaaagugcugggaauacaggcgugagccaccgcgcccggccgcuugggucuuucacaaccauuaucucuaaccuucagcaucucgaugaagaagagaaaguucucuccauuuuacagacagaaaauggaggcuuacauuauuuccccagaguaaugcagugauugaagcaguugagacagguuuggaauccaagccugccugaggccucagccccucacugcauccuccucucccagccaagauccaccagggcaaggagaggaccucuuugaaggagguugccagggcaagaaccagggagacaguggggagguggagaagcaggaaaaggaugagauaaaggaaugaaggaaaggggauggggcuggcaguaugaauauuguccaugggaaccucucccccucaccuucccgcuggcuugucccacuccucucucucccuugagaccucugagugucuggccucucucucucuacccuucgguucacuccuuuuuauaccccucuuacccagcugaguccuuugugucucuucucuuuucauugcgucucucuggcaaagcccuaacccuggaucagccccacucucuauuuucugcaugccugugcgcaagcaacugacaaaauagaaaacaucagcugaugggacugguugcuaucaccggaaacaccaauaggcuuguaacgcugcaugccaaucuaacuauauuucucuggccaaaauacccucuuauaaucuacaacaacuauuucagcuuuuugcagccuccucagaauucaggggccuccuugcugagcccccucuuucagcaggugaacucuccucuugccuucucagucauugaaugggaaccugucauuuuccugauaccaagcacugacuuauuggucuaugaacccgugccucucuucuacauucauccccuuucuugcaacuggauggagccuuacacugguuuuaaacauaugugaguuauucugaaggaacccaaagcucucaucgguuauggcuguaccuuuuccccuucgcagccaaguucuugaaaaagcugaucacagccacccauuccucacuucccacucuccccagaaaccacugcuaucuggccucugcuccugccacuccacugaaauagcucccccucagugaccuccauguucacuaaauccaguccucagcucuauuccaccccguugcucacucccucuacuugaaacauaccccucccuugcucugugacacaaugccauguuuccccauuuccuccucccucuggcuuccuggcaagcucuucuucuuccacugagaccacaugccaggccucuuguugucuugcuuuuggcucuccccugugagacuccauccaaacccagggcugcaacugccaccuucaugaagauggcacacauucccacauucaauucagaccucucaucugagcuucggacccucuacccaacuaacgaaaugaccccuucuuugagaugccucaaacugaaacuuacacucuucccccucaaaacugauccucuucccacauucccugucucugcacauggucccuccagccauccagccucacaagccagaggucuugcaccucaccuccuucuccuuccuucuccuucagauccucccugugccaguguggccaggugcaugccagacacaugucugccuaaauauguguugacucucuccacuccuuugagucuccacagacacuacccucgcugaaaugacccucacccucaccuggauuuggcagugaucuccuagguaaucugcauguccacugcugcccugcccaggccauccucccucacagacggagugacauuuucacaugugaaauccaguaaugguaccuacuuuuuugccuaaaacccuuggauggugucccagagcuccuaaggauaaagauagccuccuggacaaagccuccuucacccagcaaggcugaccaccucacacucugcgccagccacacagucuucucuuucucuuugagcuggccauguucacucugcccauagagccuguaugcacugcucccucugucuggaacgcuccucccucugagacuguaacucguccuccuccuucuaaucucuauguaagugacauuuguucagggaagccuucccuugcaaggucaaaugcuccuuuacaaucucucauaagaguaucucuucuuuauagcauucaucccaauucagggguaccagaaaaaaguacaggaugcccaguuaaaaauaaauuucagauaaauaagaacgccccauggaauauucgggacauacuuauaaaaauucuuugcuguuuaucugaaauucaaaauuuuuggagacagggucucauuuuguaacccaggcuggagugcaguggugugauugcagcucacugcaggcuugaacuccgaggcucaagggauucuccuaccucagccuccucagucucuggaagacuacaagcgugccuggaccugaaauucacauuuaacuggauguccuguauuucuauuugcuacaucuggcaacccuauucuaguaucaauuuuauguuuauaugauugcugauuagugccuuuaucccaucagacuguuagcuacagagggcacaaaugauaaucuugcucauccuugaaucuucagcaccuaggacagggccuggagcgcagcuguuuguucaaugaaaccaacuggugaacugggagagcagcgccuuguucaucucuacacccccagaaccguguaucuuggugcagggugcauuaaaaaacacuuggccaaugaaagagaaggaaauaggaagaaggcaauaauagaggaggaagaggaggggagagggaaucugagagaugcugagaagggguggggggaaggcugggagcagacaguaccuugaggguguggcaugccuugauggcggcugccaaggagaggcagucacgguaggugaagaggaagagauuccacucgaaauucaugccgcaguccuugacaucguacaccagguccagcuccuccagguggcucaggccagcuaccagaucgcccaguugguaguggucaacggugggcuccuccaucucucccucgcugccugagucggacuggucgcccggccggagcugggccgggagcugcaccggcggaaggaacugaucgacguggacccugcgcacguaauuccggcagagcggcagcaggucgaggaucaccgcagggucuguggugccugggauaaagugcuuuagcagguucuccaggugccgcucgaagaacaugcguuuccagcugccgccauggugggccacguggcacacgggccagcgaugcaugcagcagcggagccaguaguucucacugucuaucagguuggcggucacagccagugguaggucaggggacaggugguucaggaccuucugcugguguuccgggagcaucugcuucaggauaggguuuucuuugggaacagaggaaggagcgcagggggucacaguguugggggacaccucaacaugaugccucaggcugggccugccugggagcaccaggcaaaggagagacccuucccugcuuaggggauagacagccucugcucucaggggggcucaagcagagggugggacacagccuuuagcuuugggauguucccugccugaagguggacaucucagcaucuguucucagggaguucccagacugaggaagacucucagguccaacucucaauuaucaccuggucugaugggggauacaaucccugaggucagaggcuuccaaucuuauuugauucauccauuucaaaacaagaaauuuuuugagcaccuacuaugugccagacacuggagguagcacuaugagagacuacuaugucccacgugcuggagauagaagaguaagcaaacagggcucucccuuuuggaguuuacauuccagugaggggaggcugacaauaaacaaguaaaaugagugagacugggugaugauaguugcuguagaugaaauaauggcccuguccucagacagcgccccaucugguaggagaggcuggcaguccaucuuuggaaaggaucaauauuacagagcacaaaauauggaacaaaccaagagcccuuacauggcauggaagacuccaucagaguagagggcgguucacuugggaaggcuuucuggaggaggaaguagauauggcucaggcuggguuuugcuggagagaguagaaaaggcaaggagagggcagaggcauggagggugcagugugggugggagucuggugggaccugccagugggaacagaaggagaaacugucuuggcccuggguggaagggaaguguugaguggguaugaggaugccauacgggagagcaggggcugccccaggacccagcuucugcagucuuggcuccggacaguccccacccaccuagccccccucuuggccuucuccugcccaccuaaagcagggacagacucacucuggaaguuccugauaaugugcugaaugcagagcucugugaggaggggcacgauggccagugaccacucaggauccucagcaaugauccggcgcauccgacggauauuggcccugggauguggguuccuggacuuugcagggacuggugugauugaaggcuuugagagcugugggcuugugcuugaaguguguccuccaguggaggaauuguccuggguggagacugaggaguggcugggguccaacaaugcugaugucguuacgguauccugcaugcuggaggcuggcaagguaggggugcguggccccuggauggccuuaugacaagaagcuucucagacuggcagguccuugaaacagguagggaucuggagcaaaaggaagaggguagagguguuacuuuggugggucuuggugggcauuuacuaagagaggugguacagaauagugcuuaacgaucagucccuggagugaagcagauccaaguuaucuguguggccuugggcaaguuacugaaccucucugaauuucagauguugccucugagaaaugaaggucgcaguuccaguaggauuauuuggaggaguggauaaaauaaugcauccaaagggcauaauauaguaucugacacaugaaacuagcaaggagcagccccaaauuuuagauaauagcucuacagcaauuacaguaauugcucugugccagacaaucuuuuuaguucuuuaugccuauuaauucauguguccucagaaaagccuuuuucagaaaaggcuuuuucagauaggugcuuguauuauucccauuuuucugcugggaaacugaagcagagaggcuaauugacuugcccaaugucaugcagcuuagaaguaucacggguggguuuaaauucagucugucaaauucaugcucugaacccuacauuggaccggcccucugagggugagggguguauauugccaaaagacacagauauaauaaagagccauucagcucauaacaggacccugcacuaaguauuucauagaacagcaacugccugauccguaggaugggguugagaacagcucuggccaacagaaauauaaugcaagccaaaaugcaagccacauaugcuauuuuaacuucuuuagugcccacauuuuaaaaaguaaagagaaacaaggcugggcgugguggcucaugccuguaaucccagcacuuugggaggccaacgugggugggucccuugaggucaggaguuugagaccagccuggccaacauggugaaauccugucucuacuaaaaauacacagauuagcugggcaggguggcaggcaccuguagucccagcuacucggaaggcugaggcaugacaaucaguuaaaccugggaugcagagguugcagugagccaagacugugcuacugcccuccagccugggugauagagcaagacucugucucaaaaaaaaaaaaaaaaaaaaaaaaaaaaagaaaaacaggugaaauuagcuuuuuuuuuuuuuuuuuuuugucuugcucuuguugcccaggcuggagugcaauggcgcgauuuugggucacugcaaccuccaccuccaggguucaagugauucuccugucucagccucccgauuacagggauuacaggcgccugccaccacccccagcuaauuuuuguauuuuuaguagagacgggguuucaccauguuggccaggcuggucuugaacuccugaccucaggugauccacccaccucagccuuccaaagugcugggauuacaggcgugaaccacugugccugaccaugaaauuaauuuuauauuuagcccaguaugucuaaaauguuauuuaaacauauaaucaauauaaaauuauuaaugcgacauuuuauauacuauguuuucauaugaggucuucaaaauuugauggcucaaugggcacauugagccuaccguuucaauguggcuacuguuucagagagugcagguugagagagaaaggagaggggaacaagacccaugcccugcccaaggugccagcacccuucucuccuccuucccacugagagcucaaacuccaggucccuucccuuccaucuccccauccagucuuccucuagcucucccagccucccagcauuccagacagcagugggcaagcgugggaggcgagaagacagcuaaaucuggggcugaagacagaagauagaggaugugucuugguccggggacccucccccauuugcccauuccugcacccuugcacuccugcccugagaucugcuggaggaaagcccaaauggggcugcuggcaccuaguuccuccuccaggcaguuucccaucagaugugcacccucacgacucagugcacuggguaguggccggugggagggaacacucugaaccagcaaaggcguccuuggcagagggagggaccagauggugcuucccagccugccaggcaucucaaggaggaaaagccugguugagaggcggguggcagggagagagauagugcgggaaagauaucuagguauugugacauccccuaugcaaaucaaaugcaaauucacacacagauuguguccagaauuguggaauaaccagauagugcuuuuugacuaauggcaucucagaguguagggcuggaggggguugcugcuuagugguaccggcugacuuugcauuucuggcuuugucaguuaugugcuuugugaccuuggccaaguuacuuaaccuaucugagcuucaguuuccuuaucugagaaacuggauaauaauaucuuccuacaugggcuguaguggagaucccccugagauaauggucgguuaauauugaucauuguaaagcauacaggguguguggagagugaagguacuaugaggggcaggggucugaggcugcagagaccacauccaggagaccugcuucuugagugcugaccugagaugguaucuuugggugagugcaaaguuucugaggcccuucccuauuuccaggagugaugugaagggcaaggaggcagggugguguugggggcucauagacaguacgacagaggcaaaggaggaaggucagaggcaacaggccagcccaacuccugcuugguuuuggccuaaaacauucuauaauuucccuuggucccagauaugucccuggacacccaugggccacacccagggagcaggaccaggcuuggcagggggagccccagguugcuggugugcauugcccuggaguugacucuuuagucauuccucacagcaccauccagcuucaccauacuggcaggcagucccuucuccuucuucuccuggggagccacaccugggaaaccccaccuggggccaggugggaugccucugcaaucaggugacucuagucccaccgucuagcaccucacuuucaggaccuggaguucuuccuacgaucugguccuaauuggucuugcugcuguuuugugccugcagccugccucugggcaugacacagcaggacccaucggggcauguuccagggcccugaaccaacuucucagaaggaaggggcagggccucgcuccauaucacauggcugccgugugcauggcugguauaaaaaugagccccuacuaccuucagccuuuauaggaacauccauaccauaaggccugaugucauuuuaaggcaaauguugaaaaaauuaauugcauaagaucagaguugauaauuuucaguuaaucaucucuugauuuuuuaaaaauggauaucacaaaaauauuuuggcaggcaaauuauuaccagacacacaagauucuucuaaggaggauuuuaguucuaaguguuuaaaaaaaucuacuuuuuaaacuaacaacauagaaaacaaaguauauuuaaaaggauaacgagcaaaacuaacuccuugcugccccgcugucacuguuaugaggauguggaguauggcuccucccuuggcagguugccuucugaccccugcccuugggggacacccuuuggcgugccacucucuuggcucuccuccuacuuuccgaccauucuuuuuccaaaagucuucaccacagacuucucucccucugcccaucucucacgugccaaggucccucagaauuccgccauggucguccacucauuccuucugauggguucuagcuuucaccucuuccaggugggguuucccagcugugacaucccaggagaagcagaggguacuguuaccaggauggugaggcuaggggguggugguguaaugccagacucuccuacaucugcauuccagacucaaguccacugggaugcugccuaggucccucaaacucaauccauccagaugccggcaccagaaaccagggagucaccucucucucuuucagcccucccgccccaccccaccaucuaguuacugauucaguuuugucucccacccaggcagccucuccuuuccugcugcugccuuagcucagggccccagugucugucuggaucacagcuucagcuguuaggcauguggucucuggcauccagucugguucucucacaucuagccuucacacagccgcuguggcaggcuccauguaagcccucuagcagcucaccacugcucacuggguaaaauccagccuccucaccuugguguguaaggcccuccguggcuggacaccuuguuggaaauaagcuccucuuugcaucugggacauugcagcccaguucaugcugcccagcccuugcucaaguuguucccucugaaaugccuuucccaccaccucagccagggaaagggacaaucacuggucuucugagucugagcucaagcaccacuuccucucugaaggcaaggugcuucuuugucccugauaccccaaaacaaccccucccguugucagaccccaucuuuccaguaccugcaucacuccaguaaccugacugcccacccguuccccacacccacacuagacugugagcuucuugagguguaggggcugucuccuccucauuuuugucuccaauuucuagcccagugguaggucugcuuuaggcgagguagcugguguuuggggcggcuccacuggcuucugauaauagauucuggccaaaaggagugucuauuggucagggcaacuuguugggggguggcuaucugauauaagccaaucggaguccuucuugagauuuguccaaguggagggagacagaaggacauauguccuugaaggaucuggaucuccugcugcuggaagucauuucucuccacacguacaaggucuguuugcggugggagggaaucaagccugggggagaccagcagaaacgauagauagacagagacagcauccugguaucuucaauccccaugccuaguucuggaggcucccagagcugucuggcucuuuggcagugccuucagcucugagagcuaacuuggcagccuucuaauaagucccuuugccaaagcuaagaguuggguuucuacuccuuuugaccaaaagguccugccccauuuugaccaaaaggcucacaguuuggugagugaaaauaugggaaaaauccucaaucaguagaugaaagaguucaaugggauagcugagaauggccaaaggcccccagguuauuacucacaggaccugauucacuccuguggccucuuccucucuugacuacauugagccucuagucucacaucccaucucuccagggcugggacaguaucagcaccuuacaacuguccagcacuuaacaguuacaagguccuuucaagguccuuucagaacuauccucucaaaaaaaaaaaaaaaaaaaaaaaagucugggugugguggcucacaccuguaauccuagaacuuugggaggccaaggugggaggauugcuugaggcuaagaauucaagaccaaccuggccaacauagugagaugccgucucuaaaaaauaaaaaaaaucuucucaugugacucuucaaccacccuauaauggagcuaggaugggcuuucuuauccccauuuuacagaugaagaaacaaggaaacaggaaaugacuggcccuaaaacaccuaugagagcuggggccagcgucugagggcaggucuccuaccucuagccacaauacacuaccccuccacagucacucaguaugucccccuccccucacuguuccugcccuccacuaggcaagaagaaagcauauucuugcuccuugggaaguggggagggccuccccgggcuaagugcgcucccaggccuuuggcacuccacuaggggaauuucacggcccuaauguacagucuucaucccuguuaggguaaaugcauuuucccccuaaaugaaacaaaauuuaauaucaauacuuguaugccuauauccauauguuaaccuugaacugcuuuuuaaaaacauaucucaucauuuuaggucaaacaaaagcauaguaaaucauaaaauguauacugacacuaauguagcaaacuuuuuuuuuuuuugagacagaguuucgcucuuguugcccaggcuggagugccauggcgcaaucucagcucaccgcaaccucugcauccuggguucaagugauucuccugucucagccucccgaauagcugggauuacaggcaugcaccaccacggcuggcuaauuuuguauuuuuaguagagacgggguuucuccauauuggucaggcuggucuugaacucucgaccucaggugaucugcccgccuuggccucccaaagcgcugagauuacaggcgugagccacugcacccagccuaauguagcaaacuuuuuaaaaaguagaaguuguaauauauuguuucugacaguuuaagugugcagaaauuacauauauaauacacaugacuacauauaagauaucaggauauauguauuccacaccuuagugugaaugaguuucagauacaaaaagcaaaguuagaaaaggggcaagggaggcgggauaugguggcucaugccuguagucuuagcacuuugggaggucgaggaggguggauuaccugaggucaagaguucaagaccagccugaucaacauggugaaaccccgucucuacuaaaaauacaaaaauuagccaggcaugguggcacaugccuguaaucccagcuacuugagaggcugaaagaggugguuuauaagauaauuaggggaaaaaaaugaagguugaacccaggaggcagagguugcagugagcugagauugcgccacuacacuccagccugggcaaugagagcaaaacucugucucaaaaaaaaaaaaaaaaaaaaagaaagaaagaaaaagaaaggaggcaaggagaauaaccacagaaaggagaggagguggggaguggguaaaggagaagacaggagucugagagagcucugccuguuucacagauuggucuuagucuggccuggcagucaucagccugcagcugagggugcaaguagguggcacuaucuucccugggagccugcagggauggguggauacccaauagcugggggccccgggcacauggacaguccccaaggacccacagagggcaguccuggagguggcugaagggucaccuuccucuccggagcuuucuuucccugggaaccuguugggccagucagagaaugccagaguuugaagacuaggagcauguucaagacuccagucuugaacaugggcagggcaggaauccugacauuccagagaggucagggccaccaggaguggguacgucuugugccaccaccuggugucuccauccaaggaugugcugcgcucucagagggggaaagugggagaguggggacacgugcaguggacuuucacuucucuggggccugccucaccagcuuguuuggcuucacaugguugugucucuaaccugggaccacaguccccagggaaaggccaauccuccuccccugggccccuacucugcauccucaggaccaggguccaggguccugaaaucacacacagggaacaacgucuauaccaggacauuaacucaaaggauuggguguggacugcucuuuccaugcccaagcacagguaauagaaagugacaagauguuccaguuuggccaggguuguccucauuucugauggcuugaaucugguggacagguguucugggaaccauacccuuggcuauauauagcuaugauuuauugagagcucuaggccuucaauaacauguacauagcaggaggcaggacagcagcuggcuaaguacucaggaguugugcugcugccucaagucaaaucuccacggugccccccacuaucugugcaaccuugggcagguccccacuugccucaguuucuucaucuauaacguggggacaguacuuaauaguaucuauuucauaggauuacucagaagauuaaggagcuaaugugugugagacauuucauauagugcugggcccagagccagcacucaagauguguguuagauauuguagugaagaugcuagauaccuuacuacauaauuuuauuaaaaucucaaauuaauuauugaggauuauuauuuaacacuauuguccccauuucacaaaugaggaaacugaaacuuagaaagcuuaaguaacuuacuaaaugucacuagcuaguaaguggagaagcugagguuuuaguuugugucugucuaaugcucuuacuuccaugagaugcugggguugcuuauaaauugcucccaacucagucauucauagcacuuuuccagugggucucccacuuucuccagcucaugagcucucuuguucaccaauauggagcccaggguuauacccuuggugcugaccuaaauaguccaggcucccucuuccaguucacugcuggguauaggagacuuccgcaaggcuggaccacugccugcauccuuuggagggugcaaggagcccaacagagugcugcagaguggugcucuccugccccuggcauauucccuccacaggaagucucaggucuucuccauccuuccucagguccccagcuaaaucuaaccauucuggguaggagcuccuuccaccugcccuaaugggaacacgaggaagaugcuguagguuugcauucucaccuucuugugcaucacaguucugguccucaacuguccccuccucccuuccucuuaguggagaaguggagacacccggcccucuuugggcagacagcgccucugugcccgggacacuuccccaggagcuggcuuugcacccacugcucugacugccuucucugccuucucagccgcucccaccccagauccccucaggagagcccuccucuguucucagggcucugggcuuuugucuacagccaccuccauauccuucaugcccaccaugucuuacuuugggguaagucacucccaaguugggaauuccacuuguggaagggcaaaaaacuuucuccaacugagccucggcccgugugcuuggacuugggcugggugaaaccgccaguucacuuaccacagccccugggcuggccuccucccaacuccugaccacucaggucuguugucucaaaagugacuccagcggcucuggagucucccaccccuccucccuaccuucagcucagacaccccagcagagaagcucagcuccaaaggccaggagucccucccccauccuaccugggguguagaggcgcuggcuucuccuugguaacccagggaaaccggcagugcagugggagguagggagaugaggaagcuuccgcacccgcgggagggauuacagcccucgggugaugggaacggacggccuuucggagaagccuagggccccagggcuugggaccgcucuccuccacgcccuacggaugccccacuuucccccucuucuucccagucccuccccucgccucacucggauccccagccccgggccagacgguuugcagacagugacugugguggggaggaggcgcggggcguccucgcguggagggcguggggucucccguggguacggaccggcgcuuccccgccacggaaaacgcaacccaggcaauggccgcccgugggcuucgggccggugugggcagaggacgcuagaggggcucccgggcccagccggccagagggggccccgauaagggagaccggggcuggguguccccacucccggaggucgccucacccgcuccgggagccccggcgcucgccucacgcagagucccgcgcgccggcgcaggucuuuguc

SEQ ID NO: 192700 - RNA, 33374 nt, Homo sapiens
ugagauuaaugcauuuauuccaaguaauuaacacauuaaaaauaaaguuaaacuuguccaagccaacucauaaauucuuuaaucuuuuuaacaaaauauacaaccccaaacaucguacuaugguugaaauuaauugggaaaggaggagguagaggaaaggauacauauggguuuguggaacagggaaugaguucaaucucaagacaaguuucagagaucuucuaccccuucacaacacaaauggcugcuaaacaauuuaauacaaaguguuauuggaucacaauacaaugaacaaaggccauuucaaaaauaaaagugaucucaaaagcauaucugcuccuggcaaugaaccaugaauaagccuuaccgauuugucgucuucuaaaaguaagccugccagauauucuuccauguuuauuuccaaacagguuuguggguuagcaggacaaugcaucucaagaaaggcaacagaguaagggaaguacaggaguugacaugccaauaagggguguaaacaguaaacaaaagagcuacucacgcugcauuucaaacaauguuaaggcaggcccauccaaauggaagccuaagagaugaacaauucuuccaaguuuuccauuucagcaagcuuucugguguuuuucccagagaugcaucaacugcccaggaaauuggguaggaauacaacacagcaacuggagaggucagcugccuccauccucccccacauuucagaaauggcagagucaaagccaaaauacaaucaaagcacacuauguggugagccaguuagacaugugauuuuaaugacaaagugggagaaaauaaauuggccaaaaaaauuaacaaaauacauuuuuacagauauauauauauauauauaaguuguuaucgauuugucugguguuuuaaggggaaagggaaaaggaaaggagguaaauuuuuuagcuuccaugaacauuuacuuuaagaugcugacugcaucucuugguguagguuccagaugagauaacaaacuagucuuggaucaucugggcaucugauuucuagaagccaaugauucacucacaaguagcucuagguauuuauucuuaguugugaacacuggauucugugugguccuggauggcaccaacuguaguuuccuguucaggcauucccugagggaccauauugucuucaauuaccugcucccuuggaggggaccuugacacuggagcuuuaaccaaauucagagggucgccacugucaucaucuacuugcagaauugccaccucugugguggaugcauucgauauuucuagcuguaauggccccaacuccagggaacuacauuuagaagggucaccuggcucagagaguggagaacacaguuuaucuuuuugaacuccagagguccgugugacaaagucaacaaggucuggaaggcaaggagauggcccaaggccugcagaauuaauuguuuuuaauuccaauccgagugacucuuguuugucuaauugggaagauucuuuuacuuccucaggcaucauuccuccugcuaacaggucaagggccugguguguucccucuaggccccccaagccacggucaacauuuucuguaaguccaguuuucaaaauguuaggagaagggauccuaacacuccugggauuaggugaguuucguucacccucugucucaaagucaagcaccaagguuuugggagaaucuaacggaaacccagaaaaagaugggauugguucgaagucagcgggaucggaggaauuacacccuauaggugauacagaauuuucuucacacacuuucugacacaagacaguuggggaucuaugugcugggcuuacccgaguagugcagaaaucaacaggcauaucccccagauuccccagggcaguaagcuccucuaccuuuaagucuguagcuucaaagucuucuagggccuugcuuucuauugucacuguuaacucuggauggacaucuuguagcuccagugcuucuguuuuugguuucucugggcucucccaggucucuggccucuucuuguuuucaucccaaacagccaacucauagaucuuuuuaacuugaaagucuuuugaucuuucucucuugaguuugagacuucuguaccuagaaguucuagaagcugauucuggagcugaauucucuagccccuccucacuaacaacugaaacuccuugcucuuguggacuaccuguuaaacacauagcugaucuggcuggggaaugaagcagcaacucuggggcagaaauuuucacagguguaucuuguggguugaguaaagaccuagcuucugauaaaaaugagucuaauuuugccuuugugaaagagcaagccuguggacucaauuugaucacuacuuuacuuggaguuucacuuccugucaucaauuuauuggacuguucagccucuuugucaaucauuagcaaguugggcuguuuuacuucucccucccacauguaucuguuuccaugguucaaauuagaaucaucuaugcugugggguccaaugcugguacuuacucccucaucaacuauccccucagacagcuccuuuacccuuucuuuuaguucaguguuugucucuaucucacuuucucuacaauccucagauuuacggagcucuuggcuuuccuuauccugguuaacagauucucugagguggauuucuaccaacuucugagauucuuugcacuguauaucuaacaguugaggaggugguucuacaccaggugguccuggcucucccaggucaagcucacucuucucuggagauauaucccuacuagugucacucuggaaggaacuagagguccauauggccaaagugucugucuuugggguaauuguuucauaaggccugcuuuggcacaaccuugucagaggcuguaggaagccauaggugcugccugugcuuuuugggccuacauguucuacaacugaccauuucccuagggccaccagaguuuuugcaaugggcuuuucagaguugcuaacuauaggagcagcgaccaaacccucaucuugaugcaacuccucuugggaugcacugcuguucaaaggagaaguagaagaggugucugaacuuuugguucuagagagguugcuauuuuccccauuggccaauggaccaccacuuagcuuagucucaggggcccccuuagucucaggggcccccuuuccaccacuacuauagaauaugucauacagguccuuagcauuggcuguggcuaagcaugaauuucgcuucucuaauuuuuuggcuuguucacugaacacacuugagaggggugguggaggacguacuaacacagagaacagggucuggucucggucacucucacucaccccaggagcugucucaucagaaggaauggcagcuggcugugcugaggccaugauggcuacaggcaacacuggguucaaaauguuaggacccacgaagccagggcugagagucugagauacaacuggguuugauuuuacuggagccaagauagcauuugcuugagcagcagacggggcagcuggaugagguauaacggggggugguggaggugguggaggugggggugguggaggaggugguaguauuuguucagguaaaugagauggcucacucuuuucagccaacaccacuuuuuccucuggagacccuuuuagaaucaccucuuccccuccaaaugcuuuggagaugaugucuggagguaagaggagaucagcugaagacucuuuaaccacuggcagagguuuagcagugguuccagaggacuuaauagacagaaagguguuaagaggagcuggcuugcucauuguggcugaacaugacuugcggaguacuguggauggaauaggcagguugggucggaucuuagucuguguggaaguugucacaacaggcauccaagggcugguaugugcaacaacaguuuucccagagagcuugauuuugauaggcuuugccuucccagcuucaguuuugccauccucuuuguccuuacuacuuucuagaaucucuucuuuagagauacuuggggucaccaaugaacuuuucuccucuucuuuuucuggcuucuuccagcugaauuucccaaaagaagaugauguuggugauuccuucuuuaccucuucuuuuaacuggaguuugaugccaguguuccuuuuauuuucagcuuuuucaggggaguuccuacccucagagaguuggucuucuaauuucucagagaccuugucauccuccuuuacuucuuucacagccuuugccuuuuuuucuuucuucuccuccuuugguuucucacuaaguuugcgcuuuagcucacucugccgucgccguucugucucuaggaccacagccaagccagcuuggcgguccagauuccgccgcuccucauauaauggguuuucauccacauauuucugggaagaaaaaagauaaagacucaaaaacuggugaaaauacaagagaaaaaaaucuuggccccgcuacuguuagaauucauuuaguagaaauccccagaauuaucuuccucaaggacauacgggaugcuaucugcugagcaucucccacuaggauugaggagaacuuagagguuauauggaauuugaagugucaauggcuuuuucuggcucggacgccauuugacaaagucaaaauaauuacuucagaaaaguuggaaacuccacagccuacuacaaagaccaaccuuguauuucucauuguguuggugacccuucacauguugcuccccagaaauuggaucccccaaaaauuccucacagagcuggcaauaaaauccacugaugggaaccagaaacucagagccuggaagaaguagaaaaaagucaaggaaauaagucgauuccacccagaaugacagcaaccaauggaaaucccaccaccccuuugcaguaaaaugguuacaguauagagggccuuacccacuuugaagucagaagcaguauuuagaugaaucccaauggcacagucuuuccaaccuaaggcuugaacuacaguccucuauuucuucuaccucuugggaacauuauacugguuaauuuaggaguuuccugugccagauuaauuccuguugcugagucuccucaaacccuaacuagcaccaagcaucucaggaaauauaaaaacuauacucccaaauagcccauuaccauuuuaugaugaucucucauguugguauuaauuacugaggaaacuaucuucuguaaaucucaaggguauaguagcagcacuagcuacuugugaagguaagaaauugaaaaguuuaugggcugagcacaguggcucaugccuguaaucccagcacuuugggaggcagaggugggcagaucacgaggucaggagaucgagaccauccuggcuaacacagugaaaccccgucucuacuaaaaauacaaaaaauacaaggcaugguggcaggcgccuguagucccagcuacuugggaggcugaggcaggagaauggggugaacccgggaggcggggcuugcagugagcagagauagcaccacugcacuccagccugggcaacagagagagaccccaucucagaggaaaaaaaaaaaaaaaaaagaaauugagaaguuuaaagacaaaggaaguuucugcuucuccacuuaccccuuaauaacaaugacucaaaauauuguauaguucuuaguugaaaaggcaguuaaauuacugcaucuccuguccuuuuuaaccuggauuccaaacaaguaagauuuugggcccauaagccaaugacaaagacaauucuguuuuaagugacaugucuauguuuaacaucugugaauagauuuuuggccauauggguagagaucauggucuuauagaucucuuuauagcuucaggaccuaguacacuguuuuguacacagaaggcauuccuacggcuuuguuaaaaggaauggcugucucaugcuaugcugcuuccuacaauguuaguucagggacaccucuuccucaacugaauguaaggaaaccacaaagguggcaaaaaggaaacauaccuuuugcaggaacaguuaucuugucagugcgcuuuauggcaucuugcuuggccucacucugggucuuugaagcccaaggucuguuguagggauccagugucuauuuguaagaggcagaggugcucacacaacagcacuaaaagcucaaugacccacuuuucucuuuuuuuucccccauaauaagaccaggggaccagaagcccccagcuacccacccccacccccucugccaacuguuuuaauggaaaucaccuguggaaaagguaaacacauguuagagcaaguaccagaaaaagguaaaaugaaacaaaaaaaucagguacucaaggaaucaaaagaggcagaaaccucacuuacacuugucaugguguuuaguuacagccaaguccccuggacugagcccuggggauggugucuccuuuguuggugucucuuggcucuucagacuggggcuccugcccauaugagaauguuuccuuuuccagcuuugcaaugcagauagggguauagaaguuugaagagagugagggugggagugaaaauaacagagaguaggauaccaaccugugugugcuucuuauugugcauaugagugaagaaaucaaacauggucccacagaugguguugcagucuuugcaccagugauugccagcaucauaauacucauaagcagcagugggcugauccaacugcuuaguggcugacugggggcuuucggcaggcuuggggcucuuaguacgaaacuucucauuguuuacuuuugauuccuagaggggaaaaaucuguacuuacaaggaauucaaggcaaucuagacuugucuucuguuagaaauaguaaguggccauaauaauagaaauagggccauaugaccauauuuccaauguuuaaagcugcacaaguuggggggaacccuaacagaaacaugucucuaagacauagaacuauuugacuucauagugcuaucacagcauaaaaaguaaaucauaauggcaauauauuuacuuacauauccuaaaauaucucuagaagaacagccaagguuguggaaacauuggcugccucuggggaagggaaguggagaacaaggauggguaggagucucuucacuguauacccuuuaguaaauguugaauauguuaccuaugcaacuaaacaguuaaauuugaaaaucaugacagcuagggagggaagaaaaaccaauauggaaaagguaauugacaggcuaagcaaagcaaaugcagaaaauaggugauagugaacucaucacaugcauccugguaugaaaaacuggagagaaggguugguguacauagauaaaguagacuauacaacuacacauagauaaagucaucuauguagaaugauuuaaaggaaucuaggaaaaacauuccuaacugccuaaaauaucacuuuuagaauuuaacaacuuuagaggccaggugcaguggcucacaccuguaaucccaucacuuugggaggucgaggugggcagaucacuugaggccaggaguucgagacaggccuggccaacauggugaaaccccaucucuacuaaaaauacaaaaauuacccgggcaugguggugugcaccuguauucccagcuacucgggagguugaggcacgagaaucacuugaacccaggaggcggagguugcaguaagauaagauugugccacugcacuccagccucagcaacaagugagacccugucucaaaaaaaaaaaaaaaaaaaaaaaaauuuuaacaccguuaacauguauccuuuuuaaaaauauaucaacuucuuaauauuaaaguuaucaacagcaaauacuuuaauaugaauuaauuuauuaccaagcuggaacaaggcacucaggaaaugagaauuuugguuaauguucaggaguaaggcacaggaaaaaaagauaauuuuugcaacucagaggcucacuaugaaugggguucuauaguacacaagaugaagagcuggguaccuggaauauuggcucacgcagggaaaaagguaggauacagaaagggaaacaauuggggcuucaaagauacucuuucccuaccugaguccuauucaagaaucacuaaagaaaucacaccagacaggcaggggaugggagaguucauacacuccuggugggaguauuaacuggcaccaucuucuagaagauaaucuaggaauacauuacauaccucaaaauacuguauacccuuuaacccagcaauucacuccuugacauuuauccuauggaaauuaucaugucaaacaacaggugauuugauugguuaaauaaauuuugcuuaaccaugcaaccaaaacaacaaaaaauaagguuguuaaaaaugguauuauagaaguguauuuacugacauggaaagauguucaugauauacugagaaaacuaauaaaauacacuugaauaaucaacaaagauauguaaaucggcauacagcguugaauaucacuuuauccaaaauacuuucucuaaccacucuauacuccuuauccuguuuucuuuuuuuaggcacuucucauuaccuaacauggacuuauuuauuuaucaucuucugcuauuuaaugagaauaugaaccuugucuauacuguucagugugauacuucccauaucuagaccaguuccugacacuuuauuggugaccaauacauauuuguuaagugaauugauggacagaauuaauacuuugguguauguauuuggaauaacauacaccaagguauuaauaauaaauuaauguauuuggaauauauaauaauaccuugguguauguauuuggaauaacauacaccaagguauuaauaauauuauacaccaagguauuaauaacaguggucucggcugggcccaguggcucaugccuguaaugccagcacuuugggaggcugaggugggcagauuacuugagcuuaggaguucgggaccagccuuggaaacauggcgaaaccucaacucuacaaaaauacaaaaauuagccaaguguggugguggugagcaccuguagucccagcuacuggggagccugaagugggaggaaugcuuggaccugagaguuggaggcugcagugagccaugacugugucacugcacucaacuuaggugacagagugagacccugucucaaaaaaaaaaaaaaaaaguaauaauaacaguugucucuagguagaugaaauuacaaguuuguaugugcuuuucugaaaugaacagaaagggaaagaaaaucucaaaccaacuauacauuuuaaagagagguaaagaaagaagaaauaccaaggacagguaggaaagaaaggcuguggacauaauauuccuuacugcugagaugaaaacugaauuguaacauauccguuaguuucagagaccaugaagacgcacccaaaucaagaugacagauuaucauuggguucguacaugaauagaaauccaauguauaagucaauuacaaaggaccagagcuuuuaaauucuucucccaucaaaggcccuaccuagacugaagacccagguauaaaagacuaggccuaccugguugagaaagaaaacucuccuaggaagacauggaaaaaaauagagcuugggugauaacacagaauauauucucuuuccuaccucucaauauuaacugaggauguacuaugugcuagacauauuguaugcaaugggaaacacaaagauaaaaaagauuccucuuuuauccucucgggccaggugggguggcucacaucuguaauacuagcacuuugggaggcugaggcgggaggaucaucacuugagccuaggaguucaacaccagccuggggacgggcgcaguggcucaugccuguaaucccagcacuuugggaggcgggggcagguggauuaccugaggucaggaguucgagaccagccuggccaacauggugaaaccgucucuacuaaaaauacaaaaauuagcugggugugguggcacacgccuguaacuccagcuacucaggaggcugagguaggagaauugcccagaagacagagguugcagugagcgaagaucacgccacacgccacagaauaagacucuguuucaaaaaaaaaaaaaaaaaaaaaaaaaaaaugcugggcagggugguucacgccuguaauccuagcccuuugggaggccggaucacgaggucaggaguuugagaccagccuggccaauauggugaaaccaugucucuacuaaaaauauaaaaauuagccgggcgugguggcacgugccuguaaucucagcuacucggcaggcugaggcagaagaauugcuugaaccugggaggcggagguugcaaugagccgagauugcgccacugcacuccagucugggugacagagcaagaacucugucucaaaagaccagccugggcaauauagcaagaccccaucuuuaaccaaaaaaaaaaaaaaaaaaaaagcagcucucauuuaguggagacagacguaagaagagucuuuaaauaagacaacgaaauaaauuuuacaaagaaacaaauuacagagugcuaaagaaggcugacuagaucuggguggaauucuggaaauucuucauggaagaggugguauccaaauugggcuuuaaugggugagugggguugggagaaagauuauuccaggcuaauaggauuauuuaugcaaaaccagagagguguaauaccagauauugcacauccggaaaauugcauuuugaggugacgcagcguaagauguaauauaauguuucuucagcaguauucauuacuaugugcugggcccugggcuauauauugggaaucauauugaacaaugacacauauaaagucccuguaacuuuugaaccuuaaaaucaaauuaggggaacacauuuaauuauaaaaucagaucugucauaaauguuaagaaggaaaauuacaagauauuaugggaguguauaucaggcaaauuuaacagucuagggaaucagagaaggaugucagggaaguaauuuaagauccaaucuaaaggaugaauuggaguuagaagaguagauaaggaaagaguucgauuugcaugguaaagaaagggaacagaaaaugugaggucacgagaggagaugauacauuugaggaaugaaaagguuaguaaugaaacuacagucagcaagaaggaaagaggcaugaaaugagguugaggagguaggcaagggauuaaguaucaugaucacuggcuauaugugcaaaaagaguuaauuaacacagcaacauaagcaaaaacugauguggcuuggacuugaaugucaauggagaugauaaggugcauggaaucgagauuuacuuuggagagggaccugacagaauuuguaauugauugcauauggagcaguuagggaaagcagagcacugagagugacuuuuaaguuguuggcaugaaaacugucggacaguaugccauucauugagaaugcauaacaauggagaaagaaaaaguuggaaggagguugagcacaaccauuaauuuaguuuaggacaugcucaauuucaagugccuaugagauaaugaaguggaaauggugaguuacguuguuagacacucagaagacucauuugacuagaacauaaaacuggcaauugucacauggcauuuuagcauaggacuggaugaaauggccuaggaagaaagagcaaauucuggcaaggacugagccccgagaaacucaaaaauuuaaagauuaugcaagagagacagcaaaggauacuaagcaggagcauccaauguacuacgaggaaaagaagugugacagaagccaagggaaaagaguauuuguaggagaaagugauucuuggccucaaaugcugcucauuugagaaguaaaauguauuuacugacuuuagcaacacaguagugaccuagacaugaacauaguugcuaaauaugaaccccccaaaaggguauauacaaguucugagaagaucagaagccagauaggaguggguuagggaguaaaugcuggaacaagaacauagaagguucugaauacugaggauuuaggauucuuugugggcaacaaggaacuaugcugaaauucugaagaggaguaccacacucugaucuauacuguaagaaaauaauuaacaagaguaagaacaguuugaaaaccuaaguuaagaaaaugguuagaaaaccauaggagucuaagggaaaaaaaagaugauagaaauggaaaaauugaguuguuaccuuguuggaggaggaguuugagaacgaugacacuuuuucugggcucuuagauuuuucugcuuucccaggcuucucuguaggcucucuacugucacuuaaagacuucugggauuuaucgaagauguuaauucccaagaucugagccacuuuguccaguucagauugcuucuuuucugccucuucugccucuugccguagcucugcaauguccuucauaauguuauccugaagccgacucaccuccaccaagagaggaucuuuguggccauccuucucccuucguuucuugcgcagcauuucuccugagcaaucaaaugucaacaaaaagaagcacagggaaaauaagacgagucauuucucauuuacaagcaauaauuugucagggcuuuaugguuacaaagucuuugcccacaaacguuucuaagaguggcuaggcgugguggcucaugccuguaauuccagcacuuugggagaccaaggcgggugacuacuugaguucaggugcucgagaccagccucacuaacauggugaaaccccgucucuacuaaaaauacaaaaaauuagccgggcaugggggugggcgccuguaauucuauuuacccgggaggcugaggcaggagaauugcuugaacucagggggcggagcuugcagugagccaagaucaugccauugcacucaagccugggugauagugagagacuccgucucaaaaaacaauuuuuuuuucuaagagcaagugagacucuccuuccacauggguugguguaagugaagcuucuaugaagguaaagaauggguuaugacauuaucuuuuguguaaagguuauuagcuaaggauuuauggacaggcuucaggggcuccaugaacucccauaacaguauauauaauuuugugugugucucucaaaaacauuaauaaguguuguaacuaugaauuuagcaguuguccucucuucagagggcugaagaauuauuuagaggguaauauauuugacuuuaucugaucuaaggacacuuuaacaacuucuucaaugaguuuuagguuuugccucugguuuaucuuuuuuuuuuuuuuuuuuugguagagaugggguuuugccaugucaccaggcuggucuugaacuccugagcucaaagugaucugccugcuucagccucugaaagugcugggauacaggugugagccaccacacccagcuggcuuuuuuaauguuaucuccuguuccaaacugcagauccucugguguuaauccucacaggauaaauaacucaauuucucaucccuaaacaguccaaacccagacagaagcaauuauaucuucucccacucucuguucuuucauacuaucaguauuuaggagccuuguuauguucuuuuccucacuguguaugugaauuccuaaaagcauaaagaaauggaauaaaaaggaaggcaucagggaacauuuuugugugugugugccaaauuuaaggaaagaccagacacugugguucaugccuguaaucccagugcuuugggaggcugagaugggaggaucauuugaguccagaaauucaaagcuacagugagcuaugacagcaccacugcccuccagccugaacaacagaaugagacccugucucuuaaaaaaaaagaaaaaaaggccgggugggguggcucacaccuauaaucccagcacuuugggaggucgaggcaggcggaucaccugaggucaggaguuagagaccaaccuggccaacagggugaaaccccgucucuacuaaaaauacaaaaauuagcugggcaugguggcacacgccuguaaucccagcuacuugggagguugaggcaggagaauuacuugcaccuggaagguggagguugcagugagcugagauugcaucacugcacucuagccugggcaacagagcgaggcuccaucucaaagaaagaaagaaaaagaagaaaaaaagaaaguacucaaaaacgauggagacauauugaaaggacacaggagcuaacucacagggggucccauuggccaaauuuggaacaauuugagcaugaaaauaaauaaugauaauaaaagauuauaacuuaucaaaugaagaauccaugaauucauacucauauaaaugaauaaacaaaugggagugaggguuaggaaguucccucuuacaguggaaagccaacuaauaaagcuagaaggaaugaggaaccuugaaaaaucacuauuugauaaccaucacaggccaggcacaguggcucaugccuguaauccuagcacuuugggaggcugcagagcucaggaguuuugagaccagccuuggcaacauggcaaaaccuugucucuagccaaaaaaaaaaauuagccaggcgugguggcucaugccuauggucucagcuacucaggaggaucaccugagccaggaagcgaggcugcagugagcugagaucaugccacugccacugcacuucagccugggugacacagcgagacccugucucaaaaaaaauuuuuaaauaacuauuaucauaauaacuggcucaggcaagacucaucaauggaugcuaaaaccagugggugaaagucugaggaguaacugaauauuuacauagucucaaaguaucuccucuauaagauucauauuaauuaaaaaggauaaaacaguaacuuuauaguggagaaaucuggcagacaccaccuuaaccaaauaauuaaaguuaacaucaccagcaaugggacaaaucaacaccugauacaaacucagcaucauuucugugauagucucgccaaaaaugaauaaccugaauuuaaucauaaggaaacagacaaaucaaaauuaagggauauucuacaaaauaugugaccucuuaucuuccagaauguuaauguuaugaaauacaaacacucagauuaaagaagaguacaggaacgugaaaacugaaugugauaaauaaucuugcacuuuguuuugcuauaaagggcauuaacgggacaaugugaaauaugaguaagaaugguagacuggauaauaguacuguaucacugcuaauauccuaauuuugauaaguguauuaaaguuauguaccuucuuuguuguuaggaaauacuuaaguauuuaggaguaaaggaacaucacaucuacaaguuacuuuaaaaaguucagaaaaggccagugcagugacucaugccuguaaucucagcacucugggaggccgaggaaggaggauugcuugaggccaggaguuugagaccagccuggacaaaaugaugaaaccccauugcuacuaaaauuacaaaaauuagccaggugugguggcacacaccuguaaucccagcuacuugggaggcugaggcuugagaaucacuugaauccagaaggcagagguugcagugagccaagacugcaccacugcacuccagccugggcaacagagcgaggcuccaucucaaaaaaaaaaaaaaguucaggaaaaauuacacacacacauacacacaaauugagagagagaaaaagauagagcaagcguauuaaaauguuaauaaucuggcagggugugggagcucacgccuguaauccuagcacuuugggaggcuaaggcggguggaucaccugaggugaggaguucgagaccaaacuggucaacauggugaaaccccaucucuacuacaaauacgaaaaaaauuagcugggcaugguggcaggugccuguaaucucagcuacuugggaggcugaggcaggagaaucacuugaacccgggggacagagguuguagugagccaaaaucacaccacuucacuccagccugggugaaagagcaaaacuucgucucaaaucaucaucaucaucaucaucaucaucaucaucaucaucaccaccaccaucaucugggagaagaguaccugagaauucuuugcacuauuauugcaacuuuuuuguaaguuuaauuacgucaaaaaaaaauuuuuaaugaaguuucagguuacugaaccugugugagaguaccaaauuugggucuccuacgcaaguuauuacaaaaaggcagucaugcaaagcagcugauaccuuguuguuuaugaagccgcucuaacucgguccuaagauaguacaucuucuucuggcgggcuucccggucauucuuuaguuuuucccucucuucaauaaccugcaaaauacaaagugguaagagaguccaucuccuccaacauucucuuuucuauuucucucuuccagaagccuucuuccuagacauuaucugaauguaaggauccaaaugccugcacacaggcucugaccuuacugucaaaguaauauuucguucuaaguuccagaauagaacuguccaucuuuucaaaaacuauacuguccagaaagguuguuuguuuguuuuuugcaggaaggaucuagggcacugauagcaacuauuagauagugguucuaaguuccaaagggaaccauagauaaaggaaccauauguguuauagguaagggacauauuucauguuguuuauuuucacugcuccuugcaaaccagggauaacccauaggcaguaugcccagaguagcauguuguuuaauccucacauuuucacuauuuuauagucagaaaacugaaguuguacaagauuaaguagaauacucaaagucacacauuaagaguagauuuacaauccagguauaucugcccuaaagcucaugaucuuucaacuauacuacuaccuaaugaaaaaaagcaaauauggcuugucuauacuauaccagcauauaauaggccuguaugugucuauaauagaccuauguauuaucagcgcccugacuuaaggacuagauuuauaaaaggaaaauaaagaggaaguguaugaccuccaaacacugucucuaaaguuuugucuacauugaaccuauucccuuucccaaaagacuucaguaaaacuaaagauugaaguucaggguauuuaaguccaauagaaacuuaagagaaguguuuuuugucuucccaauaauuggcuaaaacuuuuuaaccggaaaaaaaugagacuggcccucuaauuuuuuucuucagaacuuuuuuuuuuuuuuuugagauggaaucuugcucuguugcccaggcuggugugcaguggcaugaucucagcucacugcaaccuccaucuccuagguucaagcaauucuccugccacagccuccugaguagcugggacuacaggcgcgugccaccacacccggcuaauuuuuuguauuuuuaguagagacaggguuucaccguguuagccaggauggucuugaucuucugaccucgugauccacccgccucagccucccaaagugcugggauuacaggcaugagccaccacgcccagccaggucuuaacuuuuaugagcaaaccaaauuagacacauuacauuuuuauguuucuaaacaaagugaguugcuagguauaagcaccuuuacaauuaauaguauguauuaacucuuccacucaaaauucuucuauuauguauucccuaucuugauguaguuuucaccuacugcucuaaauuaucagaauuauuagaauuauuauaucuuuaccccagucacugcuuucuucccacaggcuggggacccaaugaaccuggauaauauaaaaaaugacuuuagaggccaggcacaguggcucaugccugugaucccagcacucugggagaggcuggcaggggaggaucacuugagcccaagaguucaagaucagccugggcaacagugagaagacuccaucucuauauaaaauauacguauacauacacacacauacacacacacacacacguaauuuuuuaaauaaauaacaugucaaaaauguuacuguuacuccuggacucuaagauaaaccagaacaagcaaaguuuauuucuugguuugcuucaauuaucaagcaacaacuaguuauuaacuuuaacucauaaucauuacaggguaagaauacagaauucacugggaucaaacagguuuacugauucuccuucaccacacccaauuuugguucccuacuccacuacgaaaucauauugaagacuucaaggcucccaguuccuaucuacaguguuugaagaccauuaacuuggauagaauuaaacuuaaaaaaggcugacaaucacaauaggacccaaggccagacuuuuguuuaguccuaaugauaaaacaugugugaaaaacagaggaacaauauacacuucuuaggaugaugacagcagccuccagacgacuucaagugaaagagccuuacaaauuuucagccccuucuaaaaaacauauacaaauuuauggcaaaacagaaaacucaggcacaggauacccaaagcuaauauucaccuuuugcuucugggaagcacgguucuucucaucagagaucuucucuggauuauaucuuaugagugauggaauggacaccuggacaggcacuugggccgcaggaauugagccucgcagagacucuuucugcuuaggcuuaucaggagucacaguggggaucacacgaagauugggacggcuacgaguagcuuguuugguuauuggcauuauccugugugguucagguacagggugguuugacgguugagaggugggauacaugggccaucuggaggcugcauaugccauguagugccuauaggcaucaaaagaggcagggggaauggcaggucccugguaguucggagguauccgagcugcagcaaacugagaggcccuuggcaugugaaacugagauaaagcagcaguguguggaagucuaauuggggcagauggggcugauggcaacaugcaccugacugcaacagaugacugaaacccacuaccaaccaccucugguccugaaauaugacccacuggauggucagacuuuaggaauggagggcuguuuuuugugagcagguaaggauccacaggagaagguggguguggaugggacaccucuggagaguggguauugcuaugaugugccucccugcucucuagucuguggggaucugaggaacgucgaucagcugagaagcaguggucaacugaggaacagcggucagcugagaagcgguggucaacugaggaacaguggucagcugaaaaguaucggucaacugaggaacggcggucagcugaggagcguaaugauggcuucuugccaugaagucguuccugggugcgugcagccaauugacuaaucucugcuacuccaauauccagcccuauugucuugagcaagucauggaucuucgcauauucuggauuggucucuucuagugauucuagcuuuacagcuggagcugaagacggcagggagcuugccuucugccucauaacuucacucucagagcucccaaggggcuuugguacggauucugccuuuaaauccucuucuucauccccauagagaaauuucuccucaucuucaaugucgggaaagcuacgucgccuuuuuuccuguguacugguagaaucagccaacaugcucagaaugcgggaaaaaccacugccauccuggcuagcucucucauggggcagcaggaagucugugugucgcucaggucccucagccuucaaauccaaauuauccuuguggcauagaaaacuuccaaauuuuucucugagaggacuguugucuuugggaaucccaggaaggggaccccauugguagagguugcccugagguuccuucaaggcagucucuaccauaguccccuuguuuucaaucucugaggcaaaagcagcaauagcaccacuuaguggaagggaugggugcccagaguagagagggugauccuggcuggagcugguacugcuggaaaaacucucaagcugcaaagacaaacacaacugauuuagucuuaugcagaaucucagaacauuaguaauugagauaaauacuuaaauacuuuggucuuccugaauuaacaggugagauacaaguauggauaaaagggaggaaaaguauccuuagccagauucaaaaugugaauccccuuaucuccagauguuucuacuguugaggagaaacaggaagugaggcaaacuggauggaauccucaccuuuaucuauuuguuaaaaggaauuugaauucaaaagaauuuuagagauccccuagcuuguuuucuuuucuauggauccccaaaagaaaaggaaaaaaaaagcugcuuuggcugaaguggggagaggaaacucuggaacgcuaacucaucagcauuccuuugcuugggaaccucuucagaagccuuuaucuccuaagaggacagcuaaaaacuaguggucuuuccacuaguggucugaccauccuuucacaggucagggaaaaauaucaaggcucagaauggugaggugacuugucuaaaaaucacaguaaguugguggcagaaguggguccaaaaucagaaucaucugauuucuaguccaguguccuacaacucauacaucuugucuucucucuaaagagagaugagaaaauugagaucaccuccuccccuugcccuucaagguucauuuccaacaaacccauacucaaagauugccaaaggauaauccaauuuaaguaaaaaaacuuacaguacucuccaaaauaucuauuuauuaauauaaagccuaauauacagcaauagaacccucuacugaugcauuaaaaggccuacaguuucguuuggagaguccuagaagguguagcucacaaugucgguccagcacauauuacaaagauaccauuaggaacauagcccacaggaaaguaagcaggcuuuaagauauuagggagacuagcaagaggcccuacaagaaaugcagcagagaccugcauggagggcuccauuauguccaccucaauccgcuucuucaaaauggauuucuugggcaucacagauacuuccucaggccgaugcaaagaauauccuggcuccgaugcuguuaggacaccugacaauccagggauggaacagccaguaccaccaccaucaacuccaaccagcuccugacucaagcuccuacuucgcuccuccucuuccucucgcuuucgucuggcaagauccaguucucgaaacucagggucgagaaaccuaggacuugggcuucuucuacgcugucgauaguugcgaguuccugauguaaaacuugggugauccccucccaugcuguuuaucuucacugugucaucauaacggggucuuuuggccucccggcuccuuucuucagaucguauggaguagccuuugaguuuuucucgauuccguucuguuccccgcaacagcucaucaugacaacugauauggggacuauaaucagaucgaugcaggaaaguuucuuuuguucgguaguccucaucaaguugucccaagaagggacugagaggcccuuccuccugggaaauauaucgcucaagaccccgagagcacugggagcuucgagugaagacagaaucaucagucaggucaucccugaggaaaaagagaagcaucauugaacaaauggacuuggaaagaauaagagcagacaaggcuaagagacugguguuugucaagggggcuauaaaaugcuuagggcaaaagacuauaaucaugaaguccaagaacauuuccucucccuuuccccaggggaacaagcagcuuuagccucuaaccaagagguaauauuaccaacauaucuagauagaucucuuggguaauuucuccgacuagacuuagggcaugcagaauaucauggaaguuacacaacuccacacaagcuaaauucuagcucuuugcuacugaaaguguagugcggacgaaacagcauuagcauuaccugggaacuuuuuagaaauauagcuucucaaagcuccaccccaagcagaucugaacuagaaucugcauuuuaacaagaucuccaggugauuugucuguacuuuaaaguuugagaaacaccaguccagaucaaugggauuuuuuuguuuuguuuugagauggagucucgcucugucacccaggcuggaaugcagugaugcaaucucggcucacugcaagcuccgccucucagguucacgccauucuccugccucagucucccgaguaacugggccuauaggcaccagccaucacacccggcuaauuuuuuuuuuuuuuuuuuucugauuuuuuaguagagacaggguuucaccauguuagccaggauggucuugaucuccugaccuagugaucagcccgccuuggccucccaaagugcugggauuacaggcaugagccaccgcgcccagccuguuuuguuuaagacagagucuugcucugucacccaggcuggagugcaguggcaugaucucggcugacugcaaccucuaccucccugguucaagugauucuugugccucaaccuccuuaaguagcugggauuacaggugugcaccaccaugcuggcugacuuuuugcauuuuuuuaguagagaugggguuucacauguuggccaggcuggucucgaacuccugaucucaggugaucugcccgccucagccucccaaacugcugggauuacaggcgugagccuccacacguggcucagauaaaugguuuuaaagcuguguuccagagguuguaaagagugcucaggagcuaccaaaagaaaggagguacuagaaaagcagaaccagcagggcucuugaccuucuaucccaguuaaaucacacuaauuccaacuuuaagucuguauauuaagguucuaauaauucaauugggaaaaaaaaguaucacuauaugguaacuuuuaaaaaaacuacugauuuaucuaauuagcaugauuuucucauaagauuuagaagguucuccaaugcuuugccuugaugguucacauauuaaaacccauaaagcucucucacagccuguuuugucacccucuuugccuucucuggauaucuacaagcacucugcuaaucuugggcuuagaaaagagaaagugaugguuugguucaccauauauuuuuauuucauuaaauacaaaggucucagaccuuuguggcaugagguaaaaauccaggaugggacagcuauucuuuuagcugagaauucuauaccacacccaauaaugcuaaccuucucaggggcuauggcuaugacacaaaacuaaaguuucugauuuaaaucacagauagaaauaaagauccucuagcacuuuauguaugaaaacuucuaaguacucugaauaaaaaauaaaaguucuuacaugucacucacauuccagagugaauuaucaucuagaggaugguaacuauuagugucuucuacaguuucuaguagcuacuuuuguugugaguuucuagaaaugacuuuuccuuaguuuuuuuaguaguugcuuuccuaucucugagacuaugccagcagaaucucaaaacauugccuuuucuuauucaccagccugccuuugaucaaaguuguagaccuaggaauaaauuuaugaaagguuaucaaggacaaacuuuauuuaccuucucuaacaagaaugccaccugugggaauccagguuucuguuacccaccuucuuccuaagaauuugggaaauuuugagguuucaaugcaguaugaaauaggaauaaaugggaauaaaccaaggaugauuucugaaaucaaacugagguaaaaauuuuucucuauaggucugucagccauaaacacaccuauuuccagagaggaauguucaugaguugagucacuccauugccaaaacaccaucuaccauacaaaaagucucugaccauauuaguauagggagaaaaaacauaggcuccaugaggaguggcaaguucauucacacucccacauucagcuccccaccagaacuauuacaugucaccaugaaacggcauacuagcccaaggucuaaaccaguacuaacuaucaagaagcuacaaaugagauggcucucaaaaagcuguaguccagacuuggaaucuccaguagagacagaaaaaaggcauaaaaacaguuuucuuaaaaaagcuaucacauacauauaggcagaaaucagguugcuuauuagaagcucauguccuccuuccccaggacuccaaaaggauaugagaagagaacuggcuguaguaagaacccuaaaaaggguacaaucuccuauacccugaaagaguccagcgauggauacucccggaaagccuugguuaaguucaacuguuuucuaaaauaaagucuaucuauuuaaaaaaacugauuguuggaguuagguaauaaggacaugggguuucacuguacuauucuacauuuuuguguuuacaaaucucuguuaaacaaguuuuuaaaaaauguauguauguccauauaaaaacuuuuauaccaauguucagagcagcauuaaucauaauugccaaaaagugaaaagaaucaaaauguuauccauucauucaccacugaugaauggauaaacaaaacaugguauauccauacaauaaaauauuaucagcaauaaaaaggaaugcuacaaacacggaugaaccuuaaaaaaaaauaugcuaagugaaagaagccagucacaaaagaccacauauuauaugauucuauuuauaugaaauguccagaacgggcaaaucuauagagacagaaaguagauuagugauugccuauggcuggggguaggguggagggaguaauggcuaaaggaacagagcuucuuucugguguaauaaaaauguucuaaaauugauuguagugagggaugcacaacucugaauaugcgaaaaaucacugaacuguacacuucaaaugggugaauuauauaguauacaaauuacaucucgauaaagcuguuaaaaauguauacauauuuuaaaagguccuucagagccuaaacucuccauucuuuucuguugaugagucccaaaaaugccccaagaaagcuguuugcuucuauucccuaaagaaaaucagagggaaaaaaaucccacuccuucaaucugucagaauaaggagaagaaauuaggcgauaagcugggcacaauggcucacaccuguaaucuuagcacuuggagaggccagggcagaaggauugcuuggggucaggagacuagccuggacaacacagauagauagaaacccaauuucuaaaaauuuauuuuuuaauucaccagguguggcagugcagcccauaguccuagcuacucuuuagacugagcugggaggaccacuugagcccaggaguuugagguuacagugaacuaugaucacgccacugcacuccaggcugggcaacagagcaagacauugucuuuuaaaaaguuaauaauuuuuuuuaaauaaauagcuccaugaauggaacauuaaaugugcaaauuacuuugaugaacaggagaaaucaaccuaacauccacaagucuuuagaagccaaguguuuuagaauuuuucacauuaccuuucauguucccuuuugaguagaauuacaguccuacauacagggcugcuaaggugaagacacuaaaacccaacuuggcuaucauccaaaccugauauaaaacuuaacagauucaauaaaggaagagaaagacuacuagagucucagaaaaaaaauaaacaaacaucuggccaggcaugguggcucaugccugcaaucccaucacuuugggaggcugaggcaggagggucacuugagcucaggaguuugaaaccagccuaggcaacacagugagaaccccaucucuacaaaaauuugaaaaauuagcugggcgucggguggugugugccuguauuccuagcuacuugggaggcugaggcaggagaaucacuugaacccaggaguuagaggcuacacuaagcuaugaucgugccacugcacuccagccugggugacaagagugagacccugucucuuaaaaauaaauuuaaaaggggccaggcgcgguggcucacaccuguaaucccagcacuuugggaggccaagguggacggaucacgaggucaguucgagaccagccuggccaaagaaaccgcaucucuacuaaaaauacaaaaaauuagccuggcaugguaguccgcaccuguaaucccagcuacucaggaggcugaggcaggagaauugcuagaaccugggaggcggagguugcagugagccgagauugcagcauugcacuccagccaggcaacagugcaagacucugucucaaaaaauaaauaaauaaaaauaaaaaaauaaaugaauuuuuaaaaaauaaacaucuacauacacgucuuuuuuuuuuuuuuuuuuuuuuugagacagagucuuguucugugcaguggcacaaucugggcucacugcaaacucugccucccagguucaagcuucuccugccucagccucuggaguagcuaagacuacaggcaugcgccaccacuggguaauuuuuguauuuuugguagagacaggaucucaucauguuggccaggauggucucgaacuccugaccucaagugauuggcccaccucagccucccaaagugcugggauuacagguaugagccacugcgccaggcccaaacaucuacauacaaaggauauaaauggccuguaucauugguugaagacuagacucacugucaggagacaaccugaguaugccaaugguccuguggccugguuuuaguggacaguaauuauccacacaaaccauacugaacaaaagggaaagaagagaaauguguagggggcaacaguauuuuuuaaauggccuuguaucuuuguuuagaaccuuaaucucacuuucucuaaaguagaccugugccucugaaacacaugauucuacaaagaagacugcugccccaaacuccuuaagaggaaaaauuuuaauuuuuguaauuuaaaaauauaauuaguucuaucugaagcacaugugcauaacaaaguuuaugcaaaggggaagugacauccuaggccuaagaagaacugcugaagcuaacucaaaaccucagcaaagaaugaagacaaucacacuauguaccaccuacccagacuaccuacucaauaauuuccccaaacagaagcagccagaagagcaagggcuauugccucaauuaagugauacagucacauaucuugaagcccuuuagaagcuucaauguuauaugacauaagacuauuuugccuugcuucuucucugagaaaacaccaaauggcagaugaugucgguggaggggguggggcgggggcagaggccccgggggcccugggaugggaaaccgugguggcuuccauggaggggcugggguugcagcuguggacagggcugaggccacggagcucguggaggcaaggccaaggauaaggaguggaugccugucaccaagcugggcugcuugguuaaggacauaaagaucaagucccuggagaacuaccucuucuuccugcccaucaaggaaucugagaucacugacuuuuuccugggggccucucucaaggaugagguguugaagauuaugccagugcagaagcagacccacacuggccaguugaaaagguucaaggcguuuguugccaucggggacuacaauggccacgucggucuggguguuaagugcuccaaggagguggccacugccaccugcggggccaucauccuggccaagcucuccauucucccugugcacagaggcuacugggggaacaagauccacaagccccacaccguuccuugcaaggugacaggcuacugcggcucugugcuggugcaccucaucccugcgcccaagggcacuggcaucgucucagcccgugcccaagaagcugcucaugauggcugguauugaugacugcuacaccucagccaggggcugcacugccacccugggcaacuucgccaaggccaccuuugaugccaucucuaagaccuacagcuaccugacccccgaccucuggaaggagacaggauucaccaagucucccuaucaggaauucacugaccaccucaucaagacacacaccagagucucugugcagaggacguaggcuccagcuguggcuacaacauaggguuuuuauacaagaaauauaaagugaauuaagccugaaaaaaaaaaaaaaaaaagacuguucugccuugcuucacugcauccacagccaauggaacuuuuagguauuaccaacggcaaaacugguccucagacuuccugcccagcucucccccacccgccuagcuaugcucugugcaacacggcaagcgacagucucaguuugaaauuacauuacauugauuuauugcuacugcuaaucauuugucaaaacucccaaugugcugggcagagaccauaacagucauggucucagcucugagaaagagugcuuuccugaacucccauccauacuuugacuuuugugaggugaaaaacaccuaaugugauuauuuacaaucuauauaugguuaaguuccuaguaccugaggucuauauccaacucucuugaguguaucuacccuuccucagcacucaauaguuguaaaauaauaacugaacuuaaacauuuuugaaggucucuagcuuucuauuaauacuuuaucuacuucacauacacacauauauuagacaugaacuuaccuaacccuuucugaaucuguuucagccuggauaaacuaaaaaauaacaccauuuuaaaaagacuucccauuuuguccagaacuuuucuuuggagaagggacugcucauaguuucacuguuuuagaaucuauaccaucucaacuguucuucauuugggggacucugauuauguccccucagccucuucuuucuagucagacucagaugaccuuuuuaaagucuuuuuuucuauacaauuuauucaacaacagagucuacacaucauuauacuccucccacuuagaaauucuaucccagcguuuuauuuuguacuggacauguggcauaggaaauaacuuuagagcuggcaccauccuuucaaauauaucauucggaaaacagcaacauuucugccuucaaguacuaguauaguaggcccugccuuaggugaugccuaccuguccaugucuuccagauuauccacuggugaccccagccgaucacuaagccgucgccguucuggugugcuaacacagaaguggucauugccaacagugauccuuaagcucuuuuccaaagagucagaacacagaccaggagagcgucucuacaaaaguaaaggauaauaugguuagucaauagggucaagacaucccuacauccaaaaacucuccucccuaguuacaaaguuagccaggcaugguggcucaugccuguauacccaacacuuugggaggcugagguguauaggcccaggcaagaaugugagaccagucugggcaacacagacuccaucucuauaaaaaaaaguuuaaaauuagccagguguggucccaacuacucagguggcugaggugggaggauagcuuaagcuugggaggucagggcugcagugagccaugacugcaccacagcacuucagccugggcaaugagcaggaccuugucucaaaaacaaaagacaacccugcaaaguugggguucaacaaggugagaaaugguuaugguaagacacuauaccaaaaauaaagcacuuuuuaaaaauuaucauuuucuuagagauauaagcccauaccucuaacucuccuaaacggugaccucucauucuuacugggcaugggaaaagagaagugaauaaagucccugcucucagaacccuacuucuaguguacauacuucuagugaaggagguaagccaaaaacaaguuuaaagaaaaaaaaaauucuucugguaagugcuauagucauuaaaacaugguaccauaaaaggaguuacuucagauaggaugguuagaaaagguuuuucucaggugauaaccugaggccugaagaaugaggugucagcuuugcaaagaacagguagaaagauguuucaggcaaagaaaagaaccaccucaguauagagcuugguauacuuuaaguaacagaaaagcggccgguguggcugcagcaaagugacagaagaggaaaagauaggcagaaagcacaguugggaaauuuggauuuuauucuuagugcaauuaacaguuauaggaggguuuuacacaggauagugacaucaucugacuacauuuuuccuccagaugcuugcacagcacacccucaccuccuucagaucuuuauucaaaaaucaccuucccaggaggccuucccugacuacucucaaaaauuuuaacuccccgggccaggcaugguagcuuaugccuguaagcccagcauuuugggaggcugaggcaggagaaucacuugaggccaggaguuugagaccagccugggcaacauagugaaaucccuccccacaccaaaacauuuuuuuaaaauaaaaucagcugggauguugguacgcaccuguagucccagcuacucaggaugcugaggugagaggaucgcuugagcgugggaguuugagacugcagugagcuaugaucacaccacuacacucaagcccgggugacagagcaacacuauauuacauacacacacacgcacacaaacuguaacucccuucucugcucuuaguccuuuuuuuuuuguuuuguuugagacuugcucugucguccccagccuggagugcaguggcacgaucucggcucacugcaagcuccgccucccagguucaugccauucuccugccucagccucccaaguagcugggacuacaggugcccgccaccaagcccgacuaauuauuguauuuuuaguagagacgguguuucaccguguuagccaacauggucucgaucuccugaccucgugauccgccugccucggccucccaaagugcugggauuacaggcgugagccaccgcgcccggcccuauuuuaguacuucuuaguccuucuuaguacuuaauuacauuuaacauaccaucgcauuucuaacuucaacuuauuauccaacucucccugcuagaauauuaacucuauaaggauaggaguuuuuuucugguuuguacuuuguuguauccccaggguaguccagaacaguccuaaugcaaaguagaugcucaauaaauacaugucaaauguauaaaaugagggcuuaaaaaucaauuugauuucuguguaaccuccagaacaaacuggaggguagcaagggcggaguguaaaggagccaaaugcaacaauccaugcaagagguaauagggcuuagaccagagugauggcaggaggauggcaguuuuggggauguauucuagagguaaagcuaacggguuagacagaugagguaaucugacaaauuagaugugggaagaagggagauaauggcuguuucugauguaagcaacggaugaugcuauuuacucagacagaaaagacuggagcaaauacauugcgcacuggagaagaaaaggagguuguguaaacaagcauucuguucuuccuuccucuguagugacugccacccacacuggcacugcucaacuggaaaucuuaacauagugacaaaucaauuuaaccaugaccaaaguacucacaguacuuacauacauguuagagagccacucaaaaaagcagaacuuuguuacuaaguuuaaaaaaagaggccgggcaugauggcaggcgccuauaaucccagcuacuugggaggcugaggcgggaggauugauugaaccccggaggcggagguuacagugagcugagaucaugccauugcacuccagccuggggaacagagugagacucuuucucaaauaauaauaauaauaaaaagauugaugaacuaaaaauaaaacaaauucccaaaaaccagacucuaccuagaggaucucuugggguggugguuaugguuaaaggucaacauuauuucuaaaacuaaacuuaaacucaugcuccguuccucuagcagugaaacauagagguucaaaucauggauuuggggaaccaggcggaucugaguugaagcacagcuccaccacuuagccgugucaccucagucgaguuacuugaaccucucuggguugguuccucggcuguacaacaaggaauaguauuaacugccucacuucaaagacuugugaggguuaaaauaaugugcaaagugaaaggcuaggcauaauuccugacauagaacucgauaagagguaguggcuauggcagugacugugguccugcacacuucauuccgaagcagcagcuccaauucauuuaagcuaacaguuuacacucuagacguaaagccugguaggguucaagcgucccuaacucgccacaaaaacggacauuucggcuuuuuccccuaagauccaggaaggcagcucagguguaaggggaugaaaaguacggaaccccgaggacacaucaacucuacaaaaaguaccaagacacacgguuuggacgaaaugccccucgccuuggcaaacuuuccacaccucacccggcaugagagaaacagccuauuccuaaggaacggagcgcgcacucccgacgagacgcccgugcgcucccgaguccguuauugugucaacgcucccgggucugacagaagccuccaggcucggcauccccgagggaguuggccggaggcuucgcgcuuaggacccuggucuggaggccccgggcguuucuggaaacgggaauuccgggggaggggacugggggauggagggaguccuggacgaggggugggauuacccggcugccgcugucgccuggauggucuccgcggccgucccgggcauagucggcgcgggacuccccccggcugcugccucugaagccggccgggcccggcgggaagagucgucggccccgcgguggcgacggggagccgcgacgggcccgaggcggggacggggagacgcgacgaccccguggcggggacggcgaggcccggcggccgcggugcccugagggcgagcggggucggcgagccgggguccgcgacgaggagccggagggcggaggcggcggugagcugcggcgagccgggccugaggaggagccagagcugcggccgcugcgcgggccgcccccgccgucgucuuuaggccggugggaagagacggaggagcgagcgcugcugcgguacaugguucuugcagcggcggccacggcgacagcucugacccgggggcgcccuagacgcaggcucggagcgcgccgccgcag

SEQ ID NO: 192701 - RNA, 10149 nt, Homo sapiens
cggagaaagccgcgaagacggccuuccccacaucuuccagcaccugcgcgccugaauccgucccacccaggcccagacgcaggcuucuucucgggucuugguccugcauccucucucucccagagccuccguuagggggugggaaaggacuuugccauaggucgcugaggccaccaucugcucucuuacuggccaagggcguaaaaagauagucuucccauuagcuagagagcaaaccccagaaagccuauuggcugcgccguccgcgggccuugguccgcuuugaaggcgggcugcggcugcgagaggagggcgggcgggaggcuagcuguugucgugguugcucggaggcacgugugcagucccggaagcggcgaggggaaacugcuccgcgcgcgccgcgggaggaggaaccgcccgguccuuuaggguccgggcccggccgggccauggauucaaugccugagcccgcgucccgcugucuucugcuucuucccuugcugcugcugcugcugcugcugcugccggccccggagcugggcccgagccaggccggagcugaggagaacgacuggguucgccugcccagcaaaugcgaaggugaggaggcggggcccguggggcguauccugccggaggggcuggcuccagcgguggugcuugcggagcagcgucggggguugcaagguuccgagcucugcagggugucuuccuuccuugaacaggcuugcgccgggacgcugcggcggacgagagaucuggucccgguaccccuggaguucacacauugguagaaacaagcaaugauaauucagaguaguagaugccaugauaggggagguacagagcuuccuuuugggggccggacgaggagcaucuggucuagccuggagugggggagggggugggcgaaggcugugugcagaggggagucaaagagggcuucauacaggaagcacgaagaggcauuaggaguuagccggaugaagagaaguggaaagagaggggcccacucaggaaacuacagaggcagaggccugccggcugagaagcuaagaacgaguuugaggaacugaaaagcuccagaugacucaucuugggggaaaaaaaccuaagacuuuccccuuuugcccucacugcaacccaaucuguguaguugucuguugcacccacuaacaacuccucgaaggcaggaauuuuugucuuagauacguauucacacagugucugguaggcacucaauaaauguuuugagaauacagaugauuaaaugggagacugugggugugugugaggaggaggaucuggaucugaggagcccuuugggggaacaauagagccuauggggaacuugaaagaagauuuuaggacuuuggagaaaaggugagucccaaagacauaggcguugaggaacuacagagagagagagagagggagcuaccagcgagccaggacuauaaaggaccuauuucuuuuuccucaacuccgucccuuaguuuucuccucagaccuuacagucaugccugccuuccuagccccguaaccccagggcccccagaaaguuggcugugaaucucucaucugaauugaaagccuacaucaggccagauguucccuaaacacuggaaaguggguuugggguaaguuucggacacauaauccuuccauuagagagauuaaaaggaugcuuuagagauaagccgacuucacugguagggcacccaguaugaguucaagccugugccuucccccguacauucuuuucuuuuuuuccuuuuuuuuuuuuaugagacugucuggcucuguugcccaggcuggagugcaguggcgagaucucggcuuauugcaaccucugccuccuagguucaaacgauuuuccugucucagccuccugaguagcugggauuacaggcgcaugccaccaugcccagcuaauuuuuguguuuuuaguagagaugggauuucaucauauuggucaggcuggucuugaacuccugaccucaagugauccaccugccuugggcucccacagugcugggcuuauaggcgugagccucugcuccuggccgcccuuucacuuuucgcucuuccucuaguccugauagcuuuuuuuuuuuuuuuugagauggaguuucgcucuuauugcccaggcuggaaugcaguggcgcgaucuuggcucaccgcaaccuccagugacccacccuccucggccuuacaaaguauugggauuacaggcaugagccaccgugccuggccuuuuuuuuuuuuuugagacggagucuugcucugcccagucuggagugcaguggugcgaccuugacucgcugcaaccuccgucccccagguucaaggauucuucuaccucagccucccgaguaggugggacuacaggugugugccaccacucccggcuauuuuuaguagagacggguuuucaccauguuggccaggcuggucuugaacuccugaacucgggugauccacccaccuuagccucccaaagugcugggauuacaggcgugagccacugcacccagcccagcuaacugauagccuuucagcguuucgcuuccucuucucuuucuuuucugucuuauuauuauuauuauuauuuuuuuuugagacggagucuugcucuguugcccaggcuggagugcaauggcacaaccucggcucacugcaaccucugccuccaggguucaagugauucuccugccucaaccuccugaauagcugggauuacaggcaccugccaucaugcccggguaauuuuuguauuuuuguagagacuggguuucaccauguuggccagguuggucuugaacuccugaccucaggugauccucccaccucagccuuccaaauugcugggauuacaggcaugagccuccgugcccagccuguauucugucuuauucugauaucaaagagcccauacucucccucuuauuauucucauagccuaaggagcucacauuuauucuccuuaggcaacauucacagacucacggaagcauagagaugcccaggaucucuauaucucuauaucuagagaucauucuagucuacccucauuugguaacugaugaagauuaauugaaaagggauuugcagucacaggauggcuuggcaaacuccaaccguuagguucaucuuaauaguauauuuguuuguauuauuauuacaccuuuguuauuaaaugcugacugugucuagcccaccaagccugccuccuggcucaguagccugaguggaacaggccucggcacagaggaaggagaaccugcccggaaaaaaagaguggguggaugucagugagggucuggugucugugccgugaaucuccugugagucugguucugggugggauccgcagaggaggucuugaagagguaauguuuggaagagcuggaaagcaaggcugugguugauggguaugagagagaaaggauguuccaaaccuccccuuuccccacuccuggggagggcgugggaggaggggcaaguggugcuagaaaaaugaugugccugcacagaguacaggacagaagaggggagggagcccagaugguccuggauggagagcuggggaggugagacauccccaguucauugcagacuugaagaucaccagcuuauuacuuggaauuuguauguguuucaaauucuccaagccauugauuaauuucaccaagcaggccuccaggggauguauuuauuuuugugguaaauugguauucuagcagacugugcugucaguguuaaaacugcugauggcauuuagccuucagacugguauuccauucagaggcaucagaagacggucucuaucaacaagauuuaucgagcguccagcauauaucaagucccaggcuaaggaaauacgaaaaaaucuaauacauaaugcacauuuuggggacccuuguggucuauguggagagacacaucaaaugacugaggguccuuagggagagcauggauccugcagaggcccagagugaaaucuagagcaauuggcauuagugcagaauggcuuccugggggagaggcuuauaaugcgaggugggcaggaugggcagagaagcccuuagaaggcauuaaguauuuuccuagggccucaggcacuucacacccucggugguagcacuguagcacucuauacagugguaguuauuugucuacaccuuuaucugcugcauuagacugaguaucuggaagggaggggaccuuguuuucaucucuguauccccaggcugacacguaggaguugccuaauaccuauuugaggaaggguaagaggaaaugaggaaauaaaugugcggagacaguaggaacaagagcucucuggagggcauggagcaaauuaacuugguagaaauagagcugauguuggaacacauaugaaaucaaguaaucuaacaaccauaaaagauguuuuggggacaauuaaggaaauuugaauauggacuacugggugauguuggaauuguuaauuuuccaaguaucauaauuguucuaugguuauguaggaggaggucuuuuuucucaggagauacaugaugauauauuuaucucaaaaggucauguuugccacuuacuuucaagaugguguagcaaaagaaauguauauauuguugagauauuauaauuauauauugaagagagaauguggcaaacuauuaacaacuguugaauacaaguggaagguauucauuguguucuuucagcuuuucuguauguaugcaauuuuagaaaguaaaaugauagacccuggcgugguggcucacgccuguaaucccagcacuuugugaggccgaggugggcggaucgcuugaggucaggaguucaagaccagccuacccaacaagaugaaaccugucucuacuaaaaauacagaauuagccgugcaugguggugcaugccuguaaucccagcuacuugggaggcugaggcaggagaaucgcuugaacccaggagcugagaucucaucauuguacucuagccugggcaacaagagcgaaacuccaucucaaaaaaaaaaaaggaauacgaagaacaauugcuuaagggcaggauuuacaguaaguacaugcucuuacacaagaaacaguagauaaaauagaaauccuagaggcauuccugaaacugggguuaaucagaagucaacauggcacauuagcauccaagauggaguugcuuuagccuccacagguucuaacuccuucccugccuugagugcugauuuugguccuccagucuaggaaaggaugcccaccuggaucuguuuugcugggagcuggccucccauuagacucaugugcacucagugggcugugcuaccucccucccccaguguguaaauauguugcuguggagcugaagucagccuuugaggaaaccggcaagaccaaggaggugauuggcacgggcuauggcauccuggaccagaaggccucuggagucaaauacaccaagucguaagugaauggggacucacuggccuggccugcguugcugcuggaggcuucagggguuuggaguucccuucuccuagcuaggcaaacccccuacaagggcaucauuuguaaccaagaccugaguuugcccacugauucuguccccagcuaauugggugacgugcauaaaucucuuaacuucuuuaugcuucagcagauuucucaucucuaaaagcaagacuguuggacuauaucauugauucucagacgcuuggauuucacagagcaaugcaaguuuuuuuuugcgacggaguuucacucuuguugcccaggcuggagugcaauggcaugaucuuugcucacugcaaccucugccucccggguucaagagauuuuccugccucagccucccaaguagcugggauuacaggcaugugccaucacgcccagcuaauuuucuguauuuuuuuaguagagauggaguuucaccauguugguuaggcuggucucgaacuccugaccugagaugauccgccugccucggccucccaaagugcugggauuacaggugugagccaccacacccggccacagugcaauuuuuuaaaacauuaguaacaggauuaccagcuuuuuauuuugcuagguacaaauauaguuuuuaaaaacccaauucugucagcugugaucauccuuucaaagagaaugauauuuuacuaucaaaauuuaauaauuuugcuuuaucaaaaaaucuaaauacugaaucauuuagcuuuauaaaaaauuccuucccuuagagcuguuaaaauuuugucucucuggucuguguuccagcauuucagaucccccagaccagaugaccuaucuuccuuccagcucugagucacuucccauuggugagaugugcagguguuggggcacagggcuggagggacagaccacuaacccacugcggcuaggaggggaacucaguuccucauccuccugucuuggcagggacuugcgguuaaucgaagucacugagaccauuugcaagaggcuccuggauuauagccugcacaaggagaggaccggcagcaaucgauuugccaagguuggauucgggauuguccuucauccgcucuggggucaggccugcauguaucuuagugugucugcuggugugagugugauuugaagaugaccaccugggaucuuccuucauugccucuucccauucuuugauugccguuugugcuccuccccucuugaguggccucauuuuucaggcacaugcaugagggucugggccuguucaugaggguccugcuucaaucucagacacaggcagaaaugcuccacaguugcugcccccgugggaaccuaaagacacuagaacggggagaacucagcaagauccacgaugugcagaaagguggggguuuaggcgaggugucagaggacaccucggugggagugacugcccagucccaucucuggguccacacagcaccucccacaaccccgcugggaugcccuugugauggcccauguacucaguauguguacgagugcuuuucucucuggagaaugagcugcuuacaacaaggcccauaguucuuacucucuacaucuucagugccuggcacaggguaagauaguugccacccacauuuuucuaccuaaguuuccuucuagcaaaggauaccauucauaaacuccugggauaccuaagggaauagucucaagcagcagaaauuuguaugaauuuugcacucaguaauaaaucuguguuugcuuuaauaaaaaguguuuaagaauuauuuuucauagcaggaaaaaaaugagaaacaaucuaacucuaccaauaggggauuaaauacguugauccagccguuugguggacuaguaugcggcuggaaacgaagcauggggaggcucuuuaggaacugaauucaauugauuuucaagguuuuuguguguuuguuuguuuuggagacagagucucacacucuguugcccaagcuggagcgcaguggugcgaucucaguucauugcaaccuccaccuuccagauugaagcuauucucccaccucagccuccugaguagcugggauuacaggcaccgaccaccacgcccgacuaauuuuuguguuuuuuaguagaaacgggguuucaccaugcuggccagggggucucgaacuccugaccucaggugaucagcccaccuuggccucucaaagugcugggauuacaggcaugagccacugcacccagcccuucaagguauaaguaaaaagggcaagugcaaaauaguguguaugcuauaccacugcuuguguaaaaaggcggggggaggauauauuuagauauugguauuuguaugaguuaucucugggaaaauagaggaaauggauaguauguuuucucuggggauaagaccuaggcagcuagcagagauaguuuuuacagaauaaagggucuaccugccucagcuaugccuuuuucccacugaggaaagacacaacccaggaagaacggaacagcaggucuggaugauaugggaguguuuccagccauagugaggggaaagagcuaagacaaaccuauuuccuggaaaagaagcauaaagccaaagggccugagggcagccgcaggucuuuuugaagcgaugaggugugcagaggcagaucaggggguauaugugcagggguugugggaagcaggccuaaaagagggaagaggaaggucaggucaaggaugaggccaggugcgguggcucacgccuguaaucucagcacuuugggaggcugaggugaguggaaaacuugaugcuaggaguucgagaccagccugaccaacaugacaaaaccccaacucuacaaaaauuagccggguaugguggcacgccuuuguagucccagcugcuugggaggcugaagcaggaaaaucgcuugaaccugggaggcagagguugcagugagcugagacgcuccaaccugggcgacagagugagacuccuucucaaaaaaaaaaggaugaggauccuuagagggcguugagcauuggucuuauagcuggguucuuagccaccacugggagacgagggugggagggagagaagggagcuccgccugccauaucuggucgcuucuuccagggcaugucagagaccuuugagacauuacacaaccugguacacaaaggggucaagguggugauggacauccccuaugagcuguggaacgagacuucugcagagguggcugaccucaagaagcagguacaggcccuucagcccuuggaaggguugcugugcccagugaggggcugguggggauugggucugcucugaggaaguccacccaggccgggguggcuuuggucaggucauuucaccucucuggccucaguuuccuuaggugaaccgcugccacugccuaccuugcaguggguugcgaggcuuagcugagcuccucuaggagcgagucaggugcuggggcuuugccaauaugagguauuaugauuaacagugugaugugcugguggaagaguuugaggaggugaucgaggacugguacaggaaccaccaggaggaagaccugacugaauuccucugcgccaaccacgugcugaagggaaaagacaccagugaguuuggggaagcaagggcaggcuggcucuggaugauuuguuugcucucccuugggggagguggguaggaggagaaacagagggcaccagagggcauuguaggaucucugcccuugaaaggcuugauuggcaagacauggugaaguaagagucacugaaaccaggugcagaaugaugggcagacaagucagaugcccccagaggggccugguggccacagcgagaggcaggaggcagggaggcugaugucaagcacagucccaguugcuacucccacggcucccugcucagugcuccuugcccagcaccccagcccugaggcacuucuguugagggucucucuccuccacacccuagguugccuggcagagcagugguccggcaagaagggagacacagcugcccugggagggaagaaguccaagaagaagagcagcagggccaaggcagcaggcggcaggaguagcagcagcaaacaaaggaaggagcuggguggccuugagggagaccccagccccgaggaggaugagggcauccagaaggcauccccucucacacacagccccccugaugagcucugagcccacccagcauccucuguccugagaccccugauuuugaagcugaggagucaggggcauggcucuggcaggccgggauggccccgcagccuucagccccuccuugccuuggcugugcccucuucugccaaggaaagacacaagccccaggaagaacucagagccgucauggguagcccacgccguccuuuccccuccccaaguguuucucuccugacccaggguucaggcaggccuugugguuucaggacugcaaggacuccagugugaacucaggaggggcaggugucagaacugggcaccaggacuggagcccccuccggagaccaaacucaccaucccucaguccuccccaacaggguacuaggacugcagcccccuguagcuccucucugcuuaccccuccuguggacaccuugcacucugccuggcccuucccagagcccaaagaguaaaaauguucugguucugauuucuga

SEQ ID NO: 192702 - RNA, 7061 nt, Homo sapiens
cgagauggagucucgcucugucgcccagcuggagugcacuggugcaaucuuggcucacugcaaucucugccuccuggguucaagcgauuuuccugccuuagccucucgaguagcugggacuacaggcacgcgccaccacacccagcucauuuuuguauuuuuaguagagacaggguuucaccauguuggccaggauggucucaaucuccugaccucauggucugcccgccuuggccucccaaagugcugggauuacaggcgugagccaccgcgcccggccagcaauacaguuuuuaguuacucgacaucuuuaagccuauaacucuuaggcuaugcauagccccauguccuaaucaggcauucacugaucccagcaggucuccaucuauuuguaccagccuccucuauuccucccaaucucaagguuacucuuaaauacuaguaaaugcaaaaagaacuuguaaaguggcaaggcauggccuaucaaaagucagcccaagggcaguuuucagcccugccucaccugggucuaguucagcugacggaugagcugauugaugcguucaccccgauagccaggugugcccaucuccuugaggaagcccacucuauuuuugguagcaugacgggccacugagagguggaaagggcacaagaaccaugagaucuccuggaaaugcuucccugggaaggcaauuucaugaaugaggucuuccaagcaaaugacgccaaacuucccuaagaaacacaaaagcacagauuccuuuauuuaacauguauccagcauauacuaagcuggccacucuggcagacucuuggggccccaagaagaauacaaccugaaucucacaucaaagcuucaaagacccuggcuuucugccccagcugaucccuaagcuguagcacucacccaggugcuccucaaucacuguauugucugucagagggauggucuuauucuugaccuuggcuuguccacguuucaaaaugaguucucggacagacuucagauuuggaaaucuauguaggaaaauaaagcacgguuuucaccagcaccuggcacacuacauaccaguccugcagccuggcugagagguuggagagguucucccacacacucacuucucccaacgagcaaguguucugcaaucacauuccagcugaaaugcuuggaaauacuccugauaaagaacugaagugaccccacuuacauaauuagaaauuuaaauuuauggauguaaauguucaccagggaaaauauugccaacaaaaacaaaacagaaaccauguccuagcuuaccuuaggggcuacgacucuggccuuaggugacccucuacucaagauggugcaagaguuggaaauaaaauccaaguuuuuguuggguuucaauguuugaggaauacuacucuuuuuuuuuuuuugagacggagucuugcucagucucccaggcuggagugcaguggcacgaucucgacucacugcaagcuccgccucccagguucaugccauucuccugccucagccucccaaguagcugggacuacaggugccaggcuaauuuuuuuuguauuuuuaguagagacgggguuucaccauguuagccaggauggucucgaucucccgaccucgugauccaccgugucuggccuuuuuuuuuuuuuuugagacagaguggauugcaguggcacaaucucagcucacugcaaccucugccucauggauucaagcgauucuccugccucagccucccaaguagcugggaauacaggcacacaucaccaugccuggcuaauuuuuuuuguauuuuaguagagacagggguuucaccauguuggccaggauggucucaaucuccugacccugugauccacuccugaccgugugauccacccgccucggccucccaaaguguugggauuacaggcaugagccaguguguccggccaggaauacuacucuuacacaugcacugccuuuagcucugcuuuaagacuuucaagaaccaagcuuuccuugacccagccuuagccuaugacugaaccagcccuacuaugguauuguucagaccccucccuacccugugucccaugguuauuacagcuacccacugauuucagguugacuguggucacagcaaaaugucccuucuacagcaacaugagcccuggaaagcaauacccggugcacccugacacacucaaauagaaaucuaaugugaauucacauggaaaaccuuacuuacccccaggucacauaagguuccacuauacgcagcauuuuuagauucuggggggugacuuuuacaaagacaccacuaaaaauuuucuuuaggcgaagucuugcaaugguucucugcaccaguaaacucacgccgucaauccugaaaugaacagcaacagaagucagacagacucccuccaguuuaugucaguccagcaagcacaacaugcgaggucacuacacuggguaaucuggaauaagacacagagacuaugccuuaaagagcucaguuuagugggaggcgguuaugaaaacagauccuuuucauaauguggagcagugccuggaaugcuauggaaauugaacuuguguguguuucagggguaggcggaguggugguauguaggucuacacauguccagcuaaggaagcuggaugugcuucuaugggcaguaaaagcuacugaagauuuuaagcagaagagaccagaccagauuucuuucugacaaucaccaagggcaguguaugggacagaucacaguaugacacuagaggcaaggaaauccaggaggaagguuaauacaauaguucaggaaaaauaugagcagugguagagggcuacaaaggacagagcucauaaacaugcaaaauccacagguuucugguuugggugauuggguaggggaaacagcaagaaguagaguuguacauggggugggcaggggguugggaaaguuccacuaaaugaggaaaaaugucuccccuucacugaauaugcuucauccacucagccuuguuucaguuccuagaaugaugccuugcuuucccuaccucaggacuucagcacguaugccugaaaaaucucccaacacuggugaacgccuuucacaucuuucaggucucagguugaaguuccugcuuuagagaggguguccucaaccccucucccuagugagcacuuuacccucauagcacuuauuuucaagccuaucugucuaaggucuuccaaauauugcagacuaaauugugcucaacccugacauccuagcacaauuugccugaguggcuuggggcauauuaucucccuagaaaggggucuaaagcuuaagcaacacuuugccccagccucaugcaauuagaaagacaccaguuccuuaccuuucgaugcguacaacaaaggccaaggaauguuuaucuggcaauuccaaggcaugagguuucacuucuagucgucugagacgcaccuugucacguuucugccgccaggaaucauguaggaaugauuccagucgcuuaaaccugagcccuuuuccuuucuucugcuacagagaagacagaccaucaucaucaucuugugccuccauacauuuuuacuuuuagaacaguaauucauaagugacaacugauauagcuuauuuccccguguuccacaaugcgaagcaaagcaacauucucuauuuucauauaaaggaaaaaugagaaaccaaaguaaagguggaguugaggaaacuugggaauuauugggaaaaauaacgaacaaaaaauuaguuuacauauuaaucaguguuuacuaacaaguuuccuuaaacuccacgccagcauuugccugcagguguuaaauauuugcuaaaugaagacauaaaccauauacacuuggugcucugcaucugugauucaaccaaccccagauggaaaauacuuuggaggagcacauacaguagcucacccuguagucccagcuacuuaggaggcugaggcgggagguucucuugaacccaggaauucaaggcugcaaugagcuaugauccugccacugcacucuagccuggguaacacaagaccucacuccuuguucuuuuuuuuuucugagauggggucucgcucugucgcccaggcuggagugcagugauaugaucucggcucacugcaaccucugccaccugaguucaagccauuuuccugccucagccucccaaguagcugggauuacaggcaugcgccaccacacccggcuaauuuuuguauuuuuaguagagacagggucaccuuguuggccagcuuggucucaaacuccugacuucaggagauccaccugccucagccucccaaagugcugggauaacaggcaugagcuaccacaccuggccaaagaccccacuuauuuuuuuuuuuuuuuuuuugagacaggguuuugcucugucacucaggcuggagugcaguggcacaaucucagcucacugcaaccuccgccucucggguucaagcaauucuccugccucagcccccugauuagcuaggauuacaggcgcaugccacagugcccgucuaauuuuuuguauuuuuaguagagaugggguuucaccauguuggccaggcuggucuugaacuccugaccucaaguaaucugcccgccucagccucccaaaguguugggauuacagaugugagcccagcugaccucacucuuaaaaaaaaaaaaaaaaaaaaauucaggggaaaaaaugaaaaauaaccguaaaaaguaauacaaauuuuuaaaauacauuauguacacuguauuagcuaucaguaauccaggccaggcaggguggcucaggccuguaaucccagcacuuuggaaggccggugggugaucacuugaggccgggaguuugagaccagcauggccaacaugucaaaacaucucuacuaaaaauacaaaaaucagccgguggccgggugggguggcugacaucaguaaucgcagcacuuugggaggccgaggugggcagaucacuugaguccaugaguuggacaccagccuggccaacauggugaaacccggucucuacuaaaaauacaaaaauuagcagggcaugguggcacauccuuguaaucccagcuacuugggaggcugaggcaggagaaucgcuugaacccgggaggcggcggagguugugguaagccaagaucgcaucacugcacuccagccugggugacagagugagucucugucucaaaaaacaaaacaaaauuaaauuaaguuaaaaaaaaaauuagccaggugugguggcgcaugcuuguaauccuagcuacuugguuggcugaggcacgagaauugcuugagcccaguaggcagagguugcagugagucgagauugugccacugcacuccacucuaggcaagagugagacucuugccucaaaauaaauaaauaaauaaauaaagcuauuaagcaauccagagaggauuuaaacuacauaggcggaaggaguauagauuauaugcaaauacuacaaccaguuauuuauuuauuuauuuauuuuuugagagagugucucgcucugucgcccaggcuggaguacaguggcacgaacuuggcucacugcaaccuccaccucccgaguucacgccauucuccugccucggccucccgaguagcugggacuacaggagccugccaccaugcccggcuaauuuuuuauauuuuuaguagagacgggguuucaccguguuagccaggauggucucgaucuccugaccucgugauacgcccgccucggccucccaaagugcagggauuacaggcgugagccaccgcgcccggccuacuacaaccauuuuauauaagggacuucagcagucugagauuuaggcaucugugggaguccuggaaccaaccccuuaaggacacugagagacaacuauaccuggucugucaaaccguuggggggagcucgucaauaccaaauguaguccaacacaugcgggauaaaacucaccaaauaaaaauucuaauuacuuucucuugguuccccaccauuaccuccuucuuugccaaaagugccugcuuugccuggguggcuuugagggcuugauaagccuuccucuuuuucaggagauuuucuggaaccaaagggauuuuucuuugccugaugcagaaaauugagaucagagauaacauuuagaaaagaacacuuggccgggcucgguggcucaagccuguaaucccagcacucugggaggccgagguggguggauuaccugaggucaggaguucgagaccagccugaccaacauggugaaacccccguuucuacuaaaaauaaaaaaucagcugggcgugguggcgcacgccuguaaucccagcuacucgggagacugaggcaggagaaucgcuugaacccgggaggcggagguugcaccgagccgagaucccgacacugcgcuccagccugggggacagagcaagacuccgucucaaaacaaaaacaacaacaaaaaagaaaacgaacauucaauggauuuccaaaccaauucaauauccugggcuuuagggaacauuacuguuuucaaguaucugaagaaagauuccccugaaaccugcgguuucugacuccaggccucauaaauccaucccuaauagucacucauccccaaagccucggaaaauaaugaauccuuuagccucuggguucguauaaguuaacaggguuuucacggccacaguucuucauaggcacuagcagcgacgaaucuaugggguuggggcgggggcaggccuaucugcagaguuaacacuugucgggcugggugaauucaacuguggcacuccagcccgcugccugaagucaauccucgccucuccagauaacccgaacuugaccgcgguccccucccuccuccgccacagcgcuacuccuccucacccccacccuuuguaaacuguggccuuuucuauuccuagagcccacaggaauccgccaccaaggcauaaacaccguggauggcaccggauacucaagaccccacuccagauauucaaagccccaaacacucacucuugcuccgccaucuuuc

SEQ ID NO: 192703 - RNA, 7061 nt, Homo sapiens
gaaagauggcggagcaagagugaguguuuggggcuuugaauaucuggaguggggucuugaguauccggugccauccacgguguuuaugccuugguggcggauuccugugggcucuaggaauagaaaaggccacaguuuacaaagggugggggugaggaggaguagcgcuguggcggaggagggaggggaccgcggucaaguucggguuaucuggagaggcgaggauugacuucaggcagcgggcuggagugccacaguugaauucacccagcccgacaaguguuaacucugcagauaggccugcccccgccccaaccccauagauucgucgcugcuagugccuaugaagaacuguggccgugaaaacccuguuaacuuauacgaacccagaggcuaaaggauucauuauuuuccgaggcuuuggggaugagugacuauuagggauggauuuaugaggccuggagucagaaaccgcagguuucaggggaaucuuucuucagauacuugaaaacaguaauguucccuaaagcccaggauauugaauugguuuggaaauccauugaauguucguuuucuuuuuuguuguuguuuuuguuuugagacggagucuugcucugucccccaggcuggagcgcagugucgggaucucggcucggugcaaccuccgccucccggguucaagcgauucuccugccucagucucccgaguagcugggauuacaggcgugcgccaccacgcccagcugauuuuuuauuuuuaguagaaacggggguuucaccauguuggucaggcuggucucgaacuccugaccucagguaauccacccaccucggccucccagagugcugggauuacaggcuugagccaccgagcccggccaaguguucuuuucuaaauguuaucucugaucucaauuuucugcaucaggcaaagaaaaaucccuuugguuccagaaaaucuccugaaaaagaggaaggcuuaucaagcccucaaagccacccaggcaaagcaggcacuuuuggcaaagaaggagguaaugguggggaaccaagagaaaguaauuagaauuuuuauuuggugaguuuuaucccgcauguguuggacuacauuugguauugacgagcuccccccaacgguuugacagaccagguauaguugucucucaguguccuuaagggguugguuccaggacucccacagaugccuaaaucucagacugcugaagucccuuauauaaaaugguuguaguaggccgggcgcgguggcucacgccuguaaucccugcacuuugggaggccgaggcgggcguaucacgaggucaggagaucgagaccauccuggcuaacacggugaaaccccgucucuacuaaaaauauaaaaaauuagccgggcaugguggcaggcuccuguagucccagcuacucgggaggccgaggcaggagaauggcgugaacucgggagguggagguugcagugagccaaguucgugccacuguacuccagccugggcgacagagcgagacacucucucaaaaaauaaauaaauaaauaaauaacugguuguaguauuugcauauaaucuauacuccuuccgccuauguaguuuaaauccucucuggauugcuuaauagcuuuauuuauuuauuuauuuauuuugaggcaagagucucacucuugccuagaguggagugcaguggcacaaucucgacucacugcaaccucugccuacugggcucaagcaauucucgugccucagccaaccaaguagcuaggauuacaagcaugcgccaccacaccuggcuaauuuuuuuuuuaacuuaauuuaauuuuguuuuguuuuuugagacagagacucacucugucacccaggcuggagugcagugaugcgaucuuggcuuaccacaaccuccgccgccucccggguucaagcgauucuccugccucagccucccaaguagcugggauuacaaggaugugccaccaugcccugcuaauuuuuguauuuuuaguagagaccggguuucaccauguuggccaggcugguguccaacucauggacucaagugaucugcccaccucggccucccaaagugcugcgauuacugaugucagccaccccacccggccaccggcugauuuuuguauuuuuaguagagauguuuugacauguuggccaugcuggucucaaacucccggccucaagugaucacccaccggccuuccaaagugcugggauuacaggccugagccacccugccuggccuggauuacugauagcuaauacaguguacauaauguauuuuaaaaauuuguauuacuuuuuacgguuauuuuucauuuuuuccccugaauuuuuuuuuuuuuuuuuuuuuaagagugaggucagcugggcucacaucuguaaucccaacacuuugggaggcugaggcgggcagauuacuugaggucaggaguucaagaccagccuggccaacauggugaaaccccaucucuacuaaaaauacaaaaaauuagacgggcacuguggcaugcgccuguaauccuagcuaaucagggggcugaggcaggagaauugcuugaacccgagaggcggagguugcagugagcugagauugugccacugcacuccagccugagugacagagcaaaacccugucucaaaaaaaaaaaaaaaaaaauaaguggggucuuuggccaggugugguagcucaugccuguuaucccagcacuuugggaggcugaggcagguggaucuccugaagucaggaguuugagaccaagcuggccaacaaggugacccugucucuacuaaaaauacaaaaauuagccgggugugguggcgcaugccuguaaucccagcuacuugggaggcugaggcaggaaaauggcuugaacucagguggcagagguugcagugagccgagaucauaucacugcacuccagccugggcgacagagcgagaccccaucucagaaaaaaaaaagaacaaggagugaggucuuguguuacccaggcuagagugcaguggcaggaucauagcucauugcagccuugaauuccuggguucaagagaaccucccgccucagccuccuaaguagcugggacuacagggugagcuacuguaugugcuccuccaaaguauuuuccaucugggguugguugaaucacagaugcagagcaccaaguguauaugguuuaugucuucauuuagcaaauauuuaacaccugcaggcaaaugcuggcguggaguuuaaggaaacuuguuaguaaacacugauuaauauguaaacuaauuuuuuguucguuauuuuucccaauaauucccaaguuuccucaacuccaccuuuacuuugguuucucauuuuuccuuuauaugaaaauagagaauguugcuuugcuucgcauuguggaacacggggaaauaagcuauaucaguugucacuuaugaauuacuguucuaaaaguaaaaauguauggaggcacaagaugaugaugauggucugucuucucuguagcagaagaaaggaaaagggcucagguuuaagcgacuggaaucauuccuacaugauuccuggcggcagaaacgugacaaggugcgucucagacgacuagaagugaaaccucaugccuuggaauugccagauaaacauuccuuggccuuuguuguacgcaucgaaagguaaggaacuggugucuuucuaauugcaugaggcuggggcaaaguguugcuuaagcuuuagaccccuuucuagggagauaauaugccccaagccacucaggcaaauugugcuaggaugucaggguugagcacaauuuagucugcaauauuuggaagaccuuagacagauaggcuugaaaauaagugcuaugaggguaaagugcucacuagggagagggguugaggacacccucucuaaagcaggaacuucaaccugagaccugaaagaugugaaaggcguucaccaguguugggagauuuuucaggcauacgugcugaaguccugagguagggaaagcaaggcaucauucuaggaacugaaacaaggcugaguggaugaagcauauucagugaaggggagacauuuuuccucauuuaguggaacuuucccaacccccugcccaccccauguacaacucuacuucuugcuguuuccccuacccaaucacccaaaccagaaaccuguggauuuugcauguuuaugagcucuguccuuuguagcccucuaccacugcucauauuuuuccugaacuauuguauuaaccuuccuccuggauuuccuugccucuagugucauacugugaucugucccauacacugcccuuggugauugucagaaagaaaucuggucuggucucuucugcuuaaaaucuucaguagcuuuuacugcccauagaagcacauccagcuuccuuagcuggacauguguagaccuacauaccaccacuccgccuaccccugaaacacacacaaguucaauuuccauagcauuccaggcacugcuccacauuaugaaaaggaucuguuuucauaaccgccucccacuaaacugagcucuuuaaggcauagucucugugucuuauuccagauuacccaguguagugaccucgcauguugugcuugcuggacugacauaaacuggagggagucugucugacuucuguugcuguucauuucaggauugacggcgugaguuuacuggugcagagaaccauugcaagacuucgccuaaagaaaauuuuuaguggugucuuuguaaaagucaccccccagaaucuaaaaaugcugcguauaguggaaccuuaugugaccuggggguaaguaagguuuuccaugugaauucacauuagauuucuauuugagugugucagggugcaccggguauugcuuuccagggcucauguugcuguagaagggacauuuugcugugaccacagucaaccugaaaucaguggguagcuguaauaaccaugggacacaggguagggaggggucugaacaauaccauaguagggcugguucagucauaggcuaaggcugggucaaggaaagcuugguucuugaaagucuuaaagcagagcuaaaggcagugcauguguaagaguaguauuccuggccggacacacuggcucaugccuguaaucccaacacuuugggaggccgaggcggguggaucacacggucaggaguggaucacagggucaggagauugagaccauccuggccaacauggugaaaccccugucucuacuaaaauacaaaaaaaauuagccaggcauggugaugugugccuguauucccagcuacuugggaggcugaggcaggagaaucgcuugaauccaugaggcagagguugcagugagcugagauugugccacugcaauccacucugucucaaaaaaaaaaaaaaaggccagacacgguggaucacgaggucgggagaucgagaccauccuggcuaacauggugaaaccccgucucuacuaaaaauacaaaaaaaauuagccuggcaccuguagucccagcuacuugggaggcugaggcaggagaauggcaugaaccugggaggcggagcuugcagugagucgagaucgugccacugcacuccagccugggagacugagcaagacuccgucucaaaaaaaaaaaaagaguaguauuccucaaacauugaaacccaacaaaaacuuggauuuuauuuccaacucuugcaccaucuugaguagagggucaccuaaggccagagucguagccccuaagguaagcuaggacaugguuucuguuuuguuuuuguuggcaauauuuucccuggugaacauuuacauccauaaauuuaaauuucuaauuauguaaguggggucacuucaguucuuuaucaggaguauuuccaagcauuucagcuggaaugugauugcagaacacuugcucguugggagaagugagugugugggagaaccucuccaaccucucagccaggcugcaggacugguauguagugugccaggugcuggugaaaaccgugcuuuauuuuccuacauagauuuccaaaucugaagucuguccgagaacucauuuugaaacguggacaagccaaggucaagaauaagaccaucccucugacagacaauacagugauugaggagcaccugggugagugcuacagcuuagggaucagcuggggcagaaagccagggucuuugaagcuuugaugugagauucagguuguauucuucuuggggccccaagagucugccagaguggccagcuuaguauaugcuggauacauguuaaauaaaggaaucugugcuuuuguguuucuuagggaaguuuggcgucauuugcuuggaagaccucauucaugaaauugccuucccagggaagcauuuccaggagaucucaugguucuugugcccuuuccaccucucaguggcccgucaugcuaccaaaaauagagugggcuuccucaaggagaugggcacaccuggcuaucggggugaacgcaucaaucagcucauccgucagcugaacuagacccaggugaggcagggcugaaaacugcccuugggcugacuuuugauaggccaugccuugccacuuuacaaguucuuuuugcauuuacuaguauuuaagaguaaccuugagauugggaggaauagaggaggcugguacaaauagauggagaccugcugggaucagugaaugccugauuaggacauggggcuaugcauagccuaagaguuauaggcuuaaagaugucgaguaacuaaaaacuguauugcuggccgggcgcgguggcucacgccuguaaucccagcacuuugggaggccaaggcgggcagaccaugaggucaggagauugagaccauccuggccaacauggugaaacccugucucuacuaaaaauacaaaaaugagcugggugugguggcgcgugccuguagucccagcuacucgagaggcuaaggcaggaaaaucgcuugaacccaggaggcagagauugcagugagccaagauugcaccagugcacuccagcugggcgacagagcgagacuccaucucg

SEQ ID NO: 192704 - RNA, 114373 nt, Homo sapiens
gcggaaaagaggccguggggggccucccagcgcuggcagacaccgugaggcuggcagccgccggcacgcacaccuaguccgcagucccgaggaacauguccgcagccagggcgcggagcagagucccgggcaggagaaccaagggagggcgugugcuguggcggcggcggcagcggcagcggagccgcuaguccccucccuccugggggagcagcugccgccgcugccgccgccgccaccaccaucagcgcgcggggcccggccagagcgagccgggcgagcggcgcgcuagggggagggcgggggcggggaggggggugggcgaagggggcgggagggcguggggggagggucucgcucucccgacuaccagagcccgagagggagacccuggcggcggcggcggcgccugacacucggcgccuccugccgugcuccggggcggcauguccgaggcuggcggggccgggccgggcggcugcggggcaggagccggggcaggggccgggcccggggcgcugcccccgcagccugcggcgcuuccgcccgcgcccccgcagggcucccccugcgccgcugccgccgggggcucgggcgccugcgguccggcgacggcaguggcugcagcgggcacggccgaaggaccgggaggcgguggcucggcccgaaucgccgugaagaaagcgcaacuacgcuccgcuccgcgggccaagaaacuggagaaacucggaguguacuccgccugcaagguacgcgcucgccgcucucggaccgcggaugggugcuaggggcccagcccgcgggaccccccucccccucccgcuuccaccuccgccucccgccuccugccucucgccucccgccuggggccgcugcaccgcggaagugcucuugucgcccgcgcccaauuagcuucuucuuggauaagaguccugcuggguuugaagaagggggaucacuaagacggagagcccuucauuccuuccgcuugaaaggaguagcuucggcauccgagcucccgggcuaccuugggguuuuguugcucuguaggagcucgcuggagucacuuucccgggaguggagcggugcucuccauguggcgggugacccaggggcaaggaaaaaucuuuugggggacugaguggucccuucugcaaucgaucccuuccugugucccacugggaggaacugggugcaaggaguggggguggagaagacucccggacuccuggcgcuuugggaaagcgaaggggaggaaagcgcggggugggaaggugggcagaguccgaggcgagggucuuguggugccuggcgcccucggcugggggcggaggcacugccgcgcgcggugacagcccugucauuauuguauuauuacuuguuuaguuaaaacgcugucccagcugcucgagguguaaacaggauuuggcaaagugacagcccagcgcggcgggcgcuacugcucaguuugaggacacccauuucuugcuacccacucuccaugccaguuuaggcacccugucaccuccagcugcagauccagauguggaggcuguguucccgaggugggaggauugcccgaggccgcggggcaggcuggcccugcgcugucagcagcggcuuuguuuugacagggugacagcugaggggggcggggacuuggccuugucagcuccugcggccuguggcugaggcagggaagagacacacucacacacacucacaccucccuguauucuuccugccugcuguaaagagggucaaguucccagauuccagauucccgauugucacaaccaagcugcagugaccacuucugaauuuugacauaacuauaauuuauucuacuagaacaucuagguuauacucuucuugguacuugcaggagcuucucagucacaauggaaugucuaugcuugcucuuuuuccacaccauaugcucagguuuauguuaagcaccucuguauccuacacugguucaauaaauauuuguugagugaauguaggaucuagcccagugcuccucaaacuuuaaugugcaugggaaucuccuggggaagcugguuaaaaugcugauuaugaaucagguggucugagguggaagcugagaguuugcauuucugacaaacucccaagugaugcuaugcuaguccacagaccacauuccaauucagaccuggacaauauauuauuuguccccuuugauuuuagcagaaaagacagaaacaaauaauaaugcuaugugguuauuucugaagaaggaaugcaaaaaagaugaaguggggagugugcuucuaagaaaggugcaagcccaggaguugaucaugaagggcauuagacgaaugagaacaggacaccgacuguaguaggcagaagggcgagcuauguacagaauuaagaacaaggucauggguacagggcauacugcuugggugaugacuacaccaaaaucucacaaaucaccauuaaagaacuuauguaaucaaacaccaccuguuccacaaaaaccuaugaaaaaaaagagcaaggucaauuacuugguggccuuggcguuucgcagccaaagugggcucaugcaggaacugucucaacucaguguuucuguucuggcuuuauuuuaaaauuuauuuauuggguucucaucaccagcaccucuuaaagacuuccugcugccugcuguagcuuuaauaucugaaaacuuuccugaaguuuugguuuugucuaaaaccaugagcauauguggccugcauugauauuuuugaucuuuucaaauuuccaugggugagauguagcaccacuuccaagugggauuugaguguuuccuggucacuuucaugacccaacaagagaaagagaaaauuuauuuuaacgucuuuuuuuuuuuuugagacagggucucacucugccacguaggcuggagugcaguggcaugaucguagcucacugcagacucaaccucccugggcucaggugauccuccuacaucagccucuugaguagcugggacuacaggcaugcgccaguacacuauuauuauuauuauuuguauucuuuguagagauaggguuucaccuuguugcccaggcuguucucaaacuccugagcccaagcaauuugcccgccuugcuucccaaagugcugagauuauaggcaugggccaccaugccuggcugaaaguguucauuuuuauguauccauucauucaguaaauauuuagaggguuaccaacugggugucaggcauugggcuaggugcugggccuaugacacacagaauuuguccuucaggaguuacuuauugugugugugcacaagugcauguguguguaugcauguguugggggccuagggaugagggcagugaaccaaaauuacagagaaguucagaaaaacuacuuucuuggaguaguugcggacccagagcaggacaguucauagacuggggcacugguagggugggauuggcuuccuggaggaagugucaguggcugcuaagaacucuuggcagggcagagugggguggggugaagcuucuuguaguggagaaacugaaagcaguuguggaagcuuggaggugggccaacugagccagaccuuuguugccuagggccaccggcuggggugcguggccaagagggcacugaggagugcaggaaucuuaaccuggagagugacauuaucucagauuugcuuuuuuuaaaaaaaaaaaaaauuuaacuggacuugauuggguacgagggaguguaagagagcaaaaucugugguucucucucagcuuguuucugcacuuaauaugagcaagcccaaaaggacagauugcucuaccuuugccacaggccccuuggcaaguuagauuagagagauuagagaaugaggagggaucuagaaagagauaagguaguucacuggggggcuuuugaaagaaaaacaggucccaggccugauauaaaucuggccuuuaaacuucacaaacgaaaccaaaaaagaagggagcuaagucagccagggugacgugccacaccccagagaauagaaaaagaaaaaaaaaaaagaaaaaagaaaagaaacaaacaaacuuguuucgcaggauccagaucuuugaacuguguccugguaaagguugcuucagagucauuuugguucuguguucauuaaaaauguagaucuaggccaggcgcaguggcucagaccuguaaucccagcacuuugggaggccgaggcgggaggaucacuugaguccaggaauuugaggccauccugggcaauauagugagacuucgucucuacaaaaaauaaaaaauuaaccaggcgugguggcagagguugcagugagcugugauugcaccgcuguacuccagccugggugacagagcaagauucucccuaaaaaaaaaaauaaauaaauaaauaaaauaaaguagaucugaccauguuauacccacacuucaggcccuuuaauuucucuuuauugugguccacaaggcccugcauggccuggcuacugcuaucuguggcuccuuaucgaggguucaggcacaugguuuccuuucaccuagucgggggugagguggggugaggggcuuugcacaugcuguucacugggacuggaagcucuucuuuccacauuuuaaaauuaacucccaacccuuccuauagaacucagauuccuugccuuuccuuuaccccccugagcagccuucccauuagaaauuauccaaauucaucuguacucuuccuggugcuuauauuaugauuuuuaugauuuguaugauuauuugaugugcauuuagaaucuuugaauagauucuuagccaugcgguuauugacuaagcgaaugaaccagagaagagaaaauggaagaaaugauuagcugugauguuagcaguuguggaauuuuaacuuaaucacuucuugacaacuaaguagagauuugucauauaggacaguucuaggugucccacagauauugauaggauuggguuauuuauuuauuuauuuuuuugagacagggucucgcucugucacccuggcaggaguacaguggcgugaucuuggcucacugcaaccuguaccucccaggcucaagugauccuuccaccuuagccuccugaguagcugagaccacaggcaugcaccaccauacuuggcuaauuuuuguauuuuuuuugguagagaugggguuucgccauguuugccaggcugguuuccaacuccugggcucaagcaaucugccugccuccaccucccaaagcgcugggauuacaggugugagccacugcaccuggccuauuuauuuauuuauuuauuuauuuauuuauuuauuuauuuauuuauuuuagagacagggucuugcucuguugcccaggaugggguacacuggcacgaucauagcucacugcagccuugaacuccuugacucaggugauccucccaccucagccucuuggguagcugggacuauaggccugcaccaccaugccugcuugggauuggguuuuuaauguuauaaaagaaaccccaagugaauguaugaguaggccaaauccaaaucuucuugaauuaaaguauaucaucuacuaacuucaaaagagaaacaaaacccauugacuaacccuuccuaaaggagcaggccauuuauauuaauacguaagaggaggcaauaggguauaguggcuaagaacaugggcuucagaguucaggcuaaucugaauucaaauuuugggauauccagcucugcaaccuuggauaaggauuucauuuaagccuuuauuucccugucuguaaaggaaugauguuacccgccucauggcauaacagugaggauuuaaaaugggcuguauuagacauccagcauggugucuugcccauggcaagcccucagaagguaggggagacgcuguuaacuugaaagucaaguaagagcaacagacucaguccugaauccaccccagcucugccacuugugugaucuuaggcacaggucacuuaguuuuucucugagccucaaugacugcauguauaaaguggugaucaugacuucaaccuuaaaguuaaaagaaaaaaguguccccagaauuccuagaacauaaagaugcuagguuaaugcuggcuaaauaaacggaauugccuggugcuuuacucguauaucagagucaguggccacaaagcauuuauggagaacccaguugcuuggguucucggcaaggugccacauuuaaggaguuucauggguacaggacuauaaaauuagucuuaauugaaaaaauaggcccagggcaugguggcuugugccuguaaucccagcaguuuggguggccaaggcagacggaucacuugagcucacgaguucgagaccagccugggcaacauggugaaacccugucucuacaaaaauuacgaaaauuagccgggcaugauggugcgugccuguagucccuagcuacucaggagguugaggugggaggauggcuugagccugggaggcagaaguuacagugagcugagaucaugccacugcacuagaccuugucucaaaauaauaauaauaaugauuuauaaucuagaaguagcacugguuguagaauauacagagagcagagguagaugugccaccacaaaacaaaaagcauccucuguuggcuaagggcugguggguggggcacuagaacaagccuuauaguuggagagcgcccccaacaccuuuguauuugucagucacucccccagagagcaaauugucuuuuucauuugucagcauuuagagcaguggcucucacccaggagcuauuuaaccucccaagggacauuugacaaugucuggagacauuuucaaucuuugcaguugggaggagggaaugcaacuggcaacuagugaguggaggccaguaauguugcuauacaucccacaaugcacaggacaacuccccccaacgaaugauuaucugguccaaaauauuaauagaauuaacagaaguugagaaagccuguuuuagacaaauaccuuugcagcacagaaagaaaaaacaucaaugguuuuuguuuugccccccccuuuuuuuuuucugaggcuuuuuugaggcagggucuuacucugcuucccaggcuggagugcagugggcucaggugguccucccacccuagucucccaaguagcugggaggcuacuuggccaggcgcacgucaccauggccggcuaauuuuuguauuuuuuauagagauguuucgccaaccuggguuucgccauguuuaacaggcuggucuugaacuccugggcucaagcaauuggccugccuuggccuuccaaagugcugggauuacaggcaugaaccaccacgccuagccuaaaccaaugcuuuuaauaugaauaugacuaacacuuaaaaucugaaaaaucucacuucgugaaucaugggcauauauuuuaaacagcuuuauugcgguauaauuuauagaucauaaaacuugcccacuguaacuaugcugcuuuugaguuaauguaugcaguugugcauccaucaccacaacccaguguuaugacuucuuccauccccgaaaguuuccucuugccgugaguaccuuuuuuuuuuuuuuuuuuugagacggagccucacucugucacccaggcuggaguggagugcaguggugugaucucaguuuacugcagccuccaccucccggguucaagcaauuugccugccucagccuccugaguagcugggauuacaggcaagugccaccaugcccuguuaaauuuuuuuguauuuuuaguagagacgggguuucaccauguuggccaggcuggucucaaacuccugaccucaagugaucugucugccugcgccuccugaagugcugggauuacaggcaugagccaccacacaaggcccaugaauaccuuuuuaaagugauauuuuguaucaaauugguuguugguuugcaaacagaaacuaaauuagaaauaucuuuuuggcaaggcuucagauaggcaauauugucacagcaaaguacaaagcauggagggagguggauaagauguuguuuuaaaagaucagucuuuagccacauaaguuuauugcauacaauuguauccuguggugacuucucuaaaaugcgguaagugucauaaagccaagcauacaaaggaaaaaauguuucauuuggcaggcacaauacaaaaagccugagagaaagauguccaaauuuaauucuguauccucagaaauuuucagggaagauggaaauucaagccugcaaagccuucagauugcaauuuguaguuuuauauaacugagaaaguguuuuacagggcaaaacagcaaaaucugcugaggacuguuuuguuuuaggaagugugugcuuggaaauagcgauuugugauauagcgcuguuuaagguuuuuguuuuguuuuguuuuuaaaaaucaucuggcagauuuaaacccaguugccucgguguuagccagauuuaauucugcgguuguuaaguaaauccauagggucugauccaucauggugacuauggagggugaaauauaaacuuuccuguaagaugccugggagcagucagcacaucugcuucucagaugaauacuccguguagugccaauaaaauuaggauuuucaaggcucaguggcuucugauuuaguuagucugucguuaagagaaaaguggcuauuuaggaaaaauugucaacaguuuccuacucuugcaugcugcuuuucugcuguggucaucugauucaaacggggaauuagaacaggcacauuggcuacucacacauggggagagaaggaggggaauccuugcuucuuucccucuaugcugggugccuuugggcagcgccccccuuuucuuuuuuuugagacggagucuugcucugucgccaggcuggagugcaguggcgugcacugcaaccuccaccucccagguugaagugauucuccugccucagccuuccgaguaguugagacuacaggcccccgccaccacgcccggcuaauuuuuguauuuuuaguagagacgggguuucaccauguugcccaagauggucucgauuucuugaccucgugauccgcccaccuuggccucucaaagugccgggauuacaggugugagccaccgcgccuggccgggcaucgccuuaacugccuaguuucaguuuccuccuuggugaaguaggaguccaggugccaccucauugacuuauugugaagauuaaauacuucaggauauaugaaaguucuuggaaccuaggcauuccacaaaugucuauuuaauuuuauuuguaaaaaacguuccauugguauuagcaguuuguguguuugccaaaguguuaugucucacgacauuugauucuucuacccggggaaaguggaagguaagggaguucauuuuacuagcagggaacugagacucaaagagguuaagugacuucuucaagcuacagugguuacucaugaaagcgucugcccaaguagauccucuuuccuaugcaccauuuugccuccucuuccaaaacuuucgcaugggguagagggggucgcuuuucuuccaaaugguuucuugagaggauuacauuuguuuuaggcauucugcugucguuugaaauuuauuguacuccaauugagagguauguucaaaggauuuucuaguccauugaaccugugcaggccauaaaguaaacaaaauaagcauucuuuauuacuggcccaggacagacauauacaugcucuugauuguuuuaaaguugacaaucaagacuggucacugugcuggcccaauagaauucucuguugaagaaagaugaaagagacaccuacucaggcuauagaaggugccaaaugugucagaaaguuaagaaauugacugucuugaaaguuuagaaguccagcugggcaccguggcucccccuuguaaucccagcauuuugggaggcugaggcaggcggaucgcuugagcucaggaguucgagaccagccugggcaacacggugagacccggucucuacuaaaaauacaaauauuagcagggcgugguggcuugcaccuauagucccagcuacucagaaggcugaggugggacgacugcuugagcccaggaggcagagauugcagugagcugagaucauaccacugcacucuagccugggcaauggagugagacccugucucaaaaaaaaaaaaaaaagauuuagaagucccccaaccaguuuauauaagacgguucacacaacaguaucucaacaugauaaaaaggagucauuaaaaaaaacuuuuaguugcauuacacauaaagggcucaaaucauguuuauagcgcaauuaauuuuuacauguguauacaucuaugcaacugccaccuagauaaagcuguaggacauuuucagcaucucagaggguucucuugugccuccuccccacuccugguaauccuuauucugacuucuauuaccagagauuaguuuugucuguucuuaaacuuuacauaaauugagucauaugguaugaauuauuugugucuggguucuuucacucaacauuaugucugucagaugcaucuauauuauugcauauagcaguaguuuguaaagacacauguuuuuaaauuaaaaaauuaaaacauugccagcaauuuucaggaggaagucauuggauguggacaaccucaugggaugaaucuuuuuuuuuuuuuuuugagacggagucucgcucugucacccagacuggagugcaguggcaugaucucggcucacugcaggaucugccuccuggggucaugccauucuaugggaugaaucuuuaacuaagcuuuugaaagaaaggaugggaauuugauagucauauuuggaagaacccaggagggcaggaauguggauaagaaaucaaggagguggccggguaugguggcucaugccuauaaucccagcacuuugagaggccgaggugggcagaucgcuugaggccaagaaaucaagaccagccuggccaacaugacaaaaccuuguuucuacuaaaauacaaaaauuagcugggcaugguggcacacaccuguagucccagcuucuugggaggcugaggcaugaggauggcuugaacccaggaggcagagguugcagugagccaagaucacaccacuguacuguagccugggugacagagcaauacucugucucaaaaaaaaaaaaaaacccaaacaaaaaaaacaaaucaaggagggguacuuggccaaguagauguagauaaggaauaugaaaggaagagagguagaaugauaaggaggugggugcaugugggcugaugaugucacugcugguaguaugucuagccugcauagcuccuucuccccuggaguccguauuggugaguccuuacugguaaauauucaugugaaauccuguugccacuugucccugguucuggaagaugacuagaguugcuauacguuguagucggugagccaugcagaaccauacauguugagagugauggcagcuuuccuaaaaggcuggcagagcccaguacauaaagcuccagugggcaaugccaccuuucuuaugugggccuaguugauagagauguuggaaagagaacauucaguccuguguucucuagaacuacuugcugaggccauuaaaugccacccucuccccaggaaugacagugagaagcaaagauuacucuacagcuccacaaagauuuuucauaacaacugucccugaaaaguaguauugaauauaugaugagcucguuauuuaauggcugauucauuugaaccauccacuuauaaauuagucuuuuccguaauugguauauuuaacaaaaugggaauuuacuuaaagauuguguguuugcacacaugggguguuauaucuauugccauuuauuuauucauuuaacauuaaauuccaugggcugcuuuggaagauuucugcucagguaccuccuguucaaacuucuuaagauaauuuaucaccuaguuauaauugaaauggaaucaagucuuuuauaauuuugaaucacauucaucucuagcaucuaauugugcaugugguuaccugcugcuuugcacacuuuucucugccauguaucucuguaucuuguucucaaagccucauuccagucuguucuuaaaugccagcuucucagagaagccuuccugacucuccggucuaaaguagcagcaccccaucuaucacucuauaaucuuaucuuguuuuguuuuccuuuacugcacuucuuaauauuuggaaauuauguuuuaaaaaaugauuuccuaucuguuuuccuuaugacaauagaagcuccaugaagcggagauuuggguucauggagcccauaaggccucagcccauaggagaaacagacaaguuguacuggggauuaaauuccauuaaauuuuccauuaaauucauaucucggguggaucauaccuugcacauaguaggcacuugauaaauauuuguugaauaaauugguaauuugauauucacaggcuuugugagauugguggaaaggaaacuguauuguaaagauggccaggcaugguggcucaugccuguaaucccagcacuuuaggaggcugaguuggugauccagccuaggcuacggagagagaccccaucucuuaaaaaaaagaaaaaaaaaaaagagagaaaaagaggccgggcacgguggcucaugccuguaaucccagcacuuuaggaggcugagguggucacaucaccugaggucgggaguuugagaccaggcuggccaacauggugaaaccccaugucuacuaaaaaaacaaaaagacgaaaauuagccaggugugguggcaggugccuguaaucccagcuauucgggaggcugaggcaggagaaucacuugaacccaggaggcggagguugcggugagcugagauugcgccacugcacuccagccugggcgacaagagcuagacuccgucuucaaaaaagaaagaugaggaaacuaaggugcagggagguuuaguagcuagcuuuguggucugcagcagggcagccuccagcuggagcuggaacaacacuuacucauaguuaaguguguuuccccuugguucauggcagacuugaugacaagcaacaguuaucuuauggccugaacgucuccuacaaaucaagcaaagaggaaucaccuauauuuuaauccucuccaaccacuguuuccucuucugcaaguuacaauuaaauucuuaaggccaggaauguggcucacgccuguaaucccaggugugggauccuacuuuuggguggccaaggugggcagauugcuugagcucaaggguuugagaccagccugggcaacauaaugagaccccaucucuauaaaaauacaaaaauuagcugggcaugguggcacaugucuguaguccuagcuacucaggaggcugaagcaggaggaucacuugaguccaggaggucgaggcuguggugagccgugagugugcugcugcacuguaguuugggugacagagugagacccugucucaaaaaacaagacaaaacaaaaaaacucaggaagguauaugaguguuaugagaucagugaguuaaaagcuacaaagugagacaaaguuuuagcauauauucuagaagucuguauuauauuaguaaacuuaaaaaucaauuguauaugaaggcauucuuuaaacuacuauuuauauuuuuuguuacuuuguggcccacuuuaaagucuacaauagacuuucuuuaauuguuccuuuaccauuuaggcuuauuuuuuauuuauuuuuauuuuauuuuauuuuuuugagauggagucucacucuguagcccaggcuggagugcaguggcaugaucucagcucaccgcgacuuccaucuccagguucaagugauucuccugccucagucucccaaguagcugagauuacaggcauguaccaccacaccgagcuaauuuuuguauuuuuaguagagauggggucucgccauguuggcaaggcuggucucaaacuccugaccucaagugauccauccuccucggccucccaaagugcugggauuacaggcaugagccauuguguccggcuuuagacuuauuuuuuuuuguuuuuguuuuuuguuuuuuuguuuuuuuuuugagacggugucucgcucugucaccuaggcugcagugcaguggcgcgaucuuggcucacugcaaucuccgccuccuggguucaagcaauucucugccucagccuccugaguagcugggauuacaggggucugccaccauacgcagcuaauuuuuguaucuuuaguagagacgggguuuuaccaucuuggccaggcuggucuugaauuccugaccucgugauccacccucaucggccuuccaaagugcugggauugauuacagaugugaaggagauggaugcauuuauuuuggaaaaaagugugaauaaugucucuaaugguccacuuggaacaauacaucaccuaauaucaggaggagguuuaggguaaucuugucaguaaccucagggcaaguuguaugggguugcuuccauuaaauuccaugccauccuaaucaguccccaugcguuguguacucuuggcuugugcagcuuuuugcgagguuugugugguaugcaggagguuccagaaguacaaggaugagaccugaguaauaucauagugauugaugguggcagugccaauuugcaucagcucugacaagcugguguugaaacuagauggcagaaugccaaagaugccaaggucagcauacuuugaaauaaugaagugagucauguaacccaggauuggcacauacucacaggacuaccugacucaucccaccucgaaaggaacacaucugugagcaccgguuaggggccuguggccacuucucugcuacaugugcaaaaggaagcaaaagccacaaggagcccuuuucuuguugaggagacagauauuaagugaaagaaaaauuaaaaugaauaaucaagcaugaagucaaugcagagagaaaccauugugagccagggggaggugaaagggugggagagagacccagcccagauagagggaacagaguaaaaccaagcagagaagcaaaacuguugugagccagacgugagaguaguuuagaacauggaccugggcaccagacugccuggguuugaacccugaugugugacuauggggagguuacuuaugcuuuacaagccucagauuucgcagcuguaauguggagacagugauauaugucaacuuuuuccguuuacucaacaaauuguuauuuaaugugccagguguugauuuagaugcuggugauacagugacagauggguccuuauucuugcagagcuugcuuucugguagcagaagcagacaauaagccagaaaauaacagaaagugguaagugccucgcagagaaugaaaacagagaauuaaaugagaaugccuggggaauuccucuagauacaugcccaggaaauccuucugcagaagggacacggaccgaggccugcaugauaagaagugaggaagagggugccgugcaaagacucuggggccagaaguggcuugucgugugugaggccugucaggagaccuguguggcuagauggagguggguggggugggggguaugaguguaggagauuagguggaagggauaaaugggggccagauugccaacauauaauuuuuacacagugaugucaagaucuuuaguucugauacguuucaacaaauacguaucaagacagaacuuuuccaucccccuagaaaauuucugccugcuccuugccauucaagucucucucccuuggaagcaagcacugaucugauuugugucacuuuaaguuaauuuagcuauuuuucauauaaauguuaccacauaguacauacuguucuuucacucaguauauuuuugagauuaauccgugguguuggaugcauugguaguuaauuucuauuuauugcugaggaguauucugcuguauggacguacuaguuuguuuaucuguugacuuguuauggacaucugggcuguuuccagugaauucaaauuagauuuccgguuugaagugaccccucuggcugcucugagaagaauaaaguauaugagagaaacaguagauaaagagggccaguuggaaguuauuauagucuagguaugaguagauggugucuugggcuaggguagcaggaauggaggggugagaauuaguuugggcuauauuguaaggguagaggcaacaggacuuaauuuguuacaagggagguggugaugaaaagacagaaaugaaggauaauguccagguuuuuggccugagcaacugaauggaugguaguuccauuuaccaagauagagaauaccauaggagaagcagguuuggguaagaauaaagaguucuuuguuggaggugauacauuagauaugucuguuaauagacaaaugcuauuuugaggauaaaaugaaauaauguauuuaguaacuugguauagaaucugggacauucugaaugccucauagaugucaguuacuguuacaauuaaaacaaugcuaaauaauaauuauuguuuuuaauaaagaggcuaaccaacuuggaggaaaagagaaauauggucaaagagaaacugggacauagggucugcuagguuaggaagaaaugaguugauagaaggucuugaauuucagguagaaaauuuuggacugaauccauuugauaauaguguccuugccuuuuaagaaggaggaggcacaagguauuuuagaaugccacagaggaguucuagguuuugauguuggcuucuuguucuuugccagcugagugaacucaggcaagccacaccccuucucuaagcauugaauuacuuguccuacaggguuguugggaggggaacauaacaugauuuggacugcaauugccuuggaaaguaguaaacacaaaugcuugacguucuuaaguggcauuuuagaguacagugaugugagcugguauuaggaggaagguugggagugggaauguauuggaagaggggaggaaguauuucuucuaguuggcugauaagggccugaacuggggcccuggcaaugagaauggagaagguauagaucugacagaguuugaaagaagaaucagguggccuggaugagggcauugagugcagauuaaccuuaggagcugggagaaggacagugccaacaaagggaauaggguaguugaaaagggaguauugggauggagggcaagccuuuuuguaaaacugacugggcagaaaugcuggauguaagcaguuagaaaugagggcuggaaguucugcuuuacagguugggcugguuauguggaugugagagucaucaucucagauaaugacugauaccaugagaacgugagcuguccaaggaaacaacguauaaggcacuacuuauuuugcucauccugguugauuuggugccaaaacaacaggcggaagggugaaaaauucuauuagucagcugguugucugaacugcucaauguuagccaagcaguuugacagaucuuuccacugugucgaagucugagcugacugcucuggcauuuugacagauaauuucugauaaauucuguguguguguauuaaauggaaagaaauugucuuggauuuagcauuccaggguacuaguuucuaggccccagugucacccaggaccuccugaggccuuuucagggguaaugcaugcuuagguuugcuccuggagaggucacucggauguaaugaagggucuggccaaccccuaggcuauuugguaacaacuggagccauuccagcaucuucagagagccugccaaggggguuccagaccuuucagucagcgggaccuaauuauaauauuuagcaaagggagggcaguuucuuauucaacuccagcauaaacacaaggauuucuuccagacagggaugucaugaagauuuucuguugauuugauuuuggaguaaccauggagagcauagaugagaagaauuugaaugagguguuuauuuauaccuggguuguuuugucuugggucauuuccucaugauaugcuuuccacucucuuucuguagccuugaccacucuuuaauauuuguuuuuuugauuccuuguggcuucacagaccaaaauggcacucauaaauuaagguauucagccaggugcgguggcucacgccuguaaucucagcacuuugggaggccacggcaggcagaucaccugaggucaggaguucaagaccagccuggccaacauggugaaaccccgucucuauuaaaaauacaaaaauuagcuggguguguuggugggcaauaaucucagcuacucgggaggcugaggcaggagaauugcuugaaccugggaggcggacauugcagugagccgagauugcgccacugcaccguagccugggcaacgagcgagacucugucucaaaaaaaaaaaaaaaaaaaaaagguuuucagagaugcuucugauagugaauuaccucacuaguuaucuuuucucucuuacaauucuauuucuaucucaaucccaggcaguuuuguucuccugagggaacccugauccccacccuguauacuuuccucuuuucacuugugucagauuuuuaaaguucccauaguuuaaaaaucccagcuugaagucauagcauuaugguaucuucugcuggccuuccauguacaacugugugaacuggaaggauugucacacaguggaggaagaaaaagggcuugugucccagggaaggauuacugaaccauuuaaucuguauaugaaaagcuaaaguuaauucagggagaagagaaagguguugcugaagucaaaccaucuuuaucucuucaaaucuuggcuacucaaagaguggucuucacccaggaacuuuuagaaauguagaaucucagguuccacccgacacccacugaaucuuaaucuucauuuugaugagaucuccaggugauuccugaguagauuggaguuugagaagcacuacuccuaauuacaucagcauaauucaaacugcucauuuccaaagagaaaacuucuggcaaucccagcugcuuacaguggacuccagguguuguuuuuuaaaaauauuauuaaaauaucuugcugggcauguggcucacaccuguaaucccagcacuuugggaggcugaggugggcagaucacuugaggucgggaguucgagaccagccuggccaacauggugaaaccccgucucuacuaaaaauacaaaaauuagccaggcgugguggcaugcgucuaguagucccagcuacucgggaggcugaggcaggagaaucgcuugaaccugggaggcggagguugcagugagcugagaucaucaugccacuguacuccagccugggcgacagagacucugucucaaaaaaaaaaaaaaaaaaaaaaaggccaggcguggugccucacgcuuguaaucccagcacuuugggaggccgaggcagguggaucacgaggucaggagaucgagaccacggugaaaccccaccucuacuacaaauacaaaaaauuagccaggugugguggcgggcgccuguagucccagcuacuugggaggcugaggcaggagaauggcgugaaccugggagguggagcuugcggugagccgagaucguaccacugcauuccagccugggcgacugagcgagacuccaucucaaaacaaaaacaaaaacaaaaaaaacuuuacugaguuaugauuuagguaccauaauauucucuaguuuuaaguguacaauucaaugauuuuuaagaaauugacaaguuguacaaucaucaccacaaucuaccuuuuagaagauuuccaucaccuccaaaggauccuuggguccauuuacaguuaacccuguuccuaccccccaccccagaugaccacuaaucuuucugucucuauaaauuugccuuuucuggauggucauguaaauggaaguauacaguauguggccuuuuaugaugggcuucuuaugccgaguguaauguguuugagauacauccauguuguagcauaugucagcacuucuuuaucuuucauugcaaguaauaauccguuauaugacuagaacacauuuugcuuaugcguuaacuaguugaugggcauuuagauuauuucugccuuuuggcuaucaugaauaauguugcugaggcaucugcaugcaagucuuaguauggauauauuucuguuucucuuggguagauacuuaguggauuugcugggucaugugguaaauuuauguuuaacuuuuugaaaaaauuguuguuucuuaaaaaacugugggcugggcaugguggcucacgccuguagucccaguacuuugggaggccaaggcgggcggaucaccugaggucgggagucugagaccaaccugaccaacagggagaaacccugucucuacuaaaaauacaaaauuagcugggcaugguggugcaugccuguaaucccagcuacuggggaggcugaggcaggagaaucucuuaaacccaggaggcggagguugcagugagcugagaucacgccauugcacuccagccugggcaacaagagagaaacucugucuaaaaacaaacaaacaaacacacaaacaacaaacugugguaaugcugggcaugguagcucauggccuguaaucuuaguacuuugggaggcugaggugggaagaucccuugaguccaggaguuugagaccagcgugaguaacauaguaagacccugucucuaccaaaaaauaaaaauaaaaaauaaaauaaaauaaauuauccagguguagagguacaugccugugguccugucuacucaggaggcugaaguuggaggauugcuugaacccaggagguugagguuguaauaaaccaugaucaugccacugcacuccugggcaacagagugagacccugucucaaaacaacaacaacaacaacaacaacaaaacugugguaaaauauagaugaucuaaaguuuaccaucugaacuauuuuuaagugucuaguucauugguauuaagaaauucacauuauugugcaaucaucaccaccauucauccacagaacacuuuucagcuugcaaaacugaaacucuguguucauuaaacaguaacucccucuuccuuccuccaaccccucggcaaccaccauuccuaucucuaugaauuuggcuaccauagacaccuuaucuaaguggaaucauacaguauuugucauuuugugacuauuuuacuuagcauaacauucucaaguuucauucagguuguggcaugugucagaguugccuuucuuuuuaagguuauauaauagcccuuugaauguauauacuacguuuuacuuauuuauucaucucuuaagggaugcugggguugcuuggaccuucuugcuguugugcuuaauaaugauacuaggacauggguguccaaauauuucuuugacuuccuacuuucaauucuuuuggguauauacccagaaguggaauugcugcgucauauaguaauuccauuucuaauauuuugaggaacugucauacuguuuuccauagcagccauaccauuuuacgucuucagcaggaauauucaagguuuccaguuucucuacauccucuccaacacuguuuucuguuucuuuuguaguagccaugcuaaugggagugaggugguauuucauuguaguuuuaauuuguauuuucauacguauauaugaaaaaauaauauauaugaaaaaauauauuauacauaaaaauauauaauuuauaauacauaaaauauauuauauauuauauauuauacauaaaguauauaauauauaauauacauaaaauauauauaauauacauaaaauauauaauauauuuguauaaaauauguauuauauauuauauauaaaauauguauuauauaucauauauaaaacauaauauauauuauauauaaaacauaauauauauuauauauaaaacauauaauauauaaaacauauaauauauauuauauauaaaacauaauauauauuauauauaaaacauauaauauauauuauauauaaaacauauaauauauauuauauauaaaacauauaauauauauuauauaaaacauauauauauaaaauauauaauauauaaaaauauauaauauauaauauauauaauauauaauauauaaaauauauauauuuuauauaaaauauauuauauauaaaaauauauauaaaauauauaauauauaaaauaugauauauaauauauaauauauaaaauauaauauauaauauauaaaauauaauauauauaaaauauuuauuauguauaaaauauaauauauaauauauuuuauauauaauuuauaauauauuauauauaacauaauaaauuauauauuauauauuauauauuauuauauauaauauauaauauauagaaauuauauauauuuuauuuuauauauauauauauuagagguaguuuugcucugucacccaggcuggagugcaguggcaugaucucggcucauuguaacgucugccuccuggguucaagcgauucucuugccucagcuucccgaguagcugggauuacaggcaugcgccgccacgcccagccaauuuuuguguuuuuaguagagacgggguuucgccuuguuugccagacuggucuugcauuccugagcucaggugauccaccugccucagccucucaaaguauugggauuacaggcgugagucaccgugccuggcccauuuucauaauuauuaaugauguugagcaucuuuucauguguuuauugaccauuuguauauuuucuuuggagaagugucugcucaaguccuuugcccauuguaaaauuucguuguuguuguuguuguugaguuguaggcauucuuuauauauuuuggauauuaaccuguuaucaaauauaugguuugcaaauauuuucucccauucucuggguugccuuuucacucuguuguguaugucuuuuggugcacagaaauuuaaaguuuuuccuaauuccaguuuaucuguuuuucuuuuguugccuguguuuuuguuauuuauuuuuagacaguaucuugcucuguuucccaggcuggaguacaguggcacagucauggcccauugcugccucgaauuccuaggcucaagggaucugccugccucagccuucugaguggcugugacugcaggcgugcaccacuauguccagcuaauuuuuaaaauuuuuguagagauggagucuuguuuguugcucaggcuggucuugaacuccugaccuucccagcgugcugggauuauacaccugagccaccacaccuggccgccugugcuuuugguauuauauccaagacaccauugccugaucuaguaucaugaagauuuuuucuguauuuucuuuuaagagauucuuucuuucuuucuuuuuuuuucuuuugagauggggucucgcccuguugcucaggcuggagugcaguggugcgaucucaccucacagcaacuucugaguaggccucuuuuuuuuuuuuuuuuuuuuuuuuuuuuuugagaugguugcucuguugcccaggcuggaauguaguggcacaaucucagcucacugcaaccucugccucccagguucaagcaauucuccugccucagccucccaaguagcugggauuacagacgugagccaccaugcccgguuaauuuuuguauuuuuaguagugacaggguuucaccauguuggccaggcuggucuugaacuccugaccucgugauccaacugcuucggccuccccaagugcugggauuacagacgugagccaccacgcccggccgagauucacaauuuuauguugaagucuuucaucuauuuugaguucauuuguguguguguuauuagcuaaggguccagcuucauucuugugcacacagauaccuaguuuuuccagcaccauuuauugaaaagacuguccuuucucuauugaauggucuuggcacacuugucaaaaucauuugaccauuaucugugaggguuuauuucugggcuaucuauucuguuccauuaguauauaagaagcuagcaaacuguuuuccaaggugguuguaccuuguuacaucccacaaacacuguaugaggauuccaauuuuucacaugccugauaauuuguuauugucagcuccuuuugaaaaaagaacuuauuuuguguuuaauugacaccuaauaauuauacauauugaugggggcauagugugguguuuugaaacauguauacauuguguaauggccaaaucaguguaauuagcauguucaucaccucaaucacuugucauuucuuugugaugagaacauucaaaauccucucuuguagcuauuuuguaauaugcaauauauuauuguuaacuauagucacucugcugugcgauagaacaccagaauuuacuccuccuaucuauauuugguuagagagaucuuauugggugagaaguuacgguuuugauccuugacauuuaaacauuaugacuuuguccagcauggagcagagagguagugaauaagagugaguccuuccucucucacaaccacagugccaguuaccugccuggacacauuuugugcaucugcaggguagaaugaguaaccccaggcaagucucuuaucaccuagagccucagcuuucucuuuuaauaauggcaauaauucauacuuuacuuacaucgagugagauaagaguacauguacauuuuuaauuuugggugcuaaauaaauguuggaucaguuauacugaauaaauuuuccaucaacguguucuugcugugggacauccuugacacuaauuuaaguuuuccaacaaaugcgacuuuccaauauuuuaagcaugacagaauuuugcuagacagcuggcugucuuucuccuguuccucuggaugccacucaaauaucuucacacccaucucacucauuaacacugcgugaacugugagcucuccaccccuugucugucuguaaucuggguugugacuacuuguuuauccaguuuaucuucuuucucaucauccauccugguuucugcauacuauaacaacaucgguugcauacuauugaccucuaacccuggauccuguugggaugaaaacauuaucccaguccuguugaaaguagugcaguggccuuuucuucuuucuugguucugcaaugucugcagagaugugcucuuggggggaugaagucaucuggguagcuuuccccucccugugcccagguugcuagcugcuacaguaauuggcuuggcagugcacucccuaaaagguuguccuucagcugguacuucauuaaagcugcaaggccaacucccuugggaguucccuuagacagcagcugucaugccuaauuaaggagagacaugggaaagguguuuugaaaggagaccucuuaucucgaagaacaguggccaggccugaacauuggaauggggagaugaaggccaaaguggagggcaugguagcagcagcucagaaaacuuggcagaaaaugcuuugcuggcagucaaggauaagagcauugacuguuuuuuaaaggacacaguauguccuuuuuagcaaaucaaguaacgagucccauauauauuaaaaauuuuguacacuuagguuguuaggugucccauggagcaugcacacaugcaagaaccaauuuucauauccugcaaaaaauacugaaacaaguaaggaaaacucaagggauucucauauauaucaauaggguauaacuuuaaagaguuaggaccacuuagggaugcugagacuauucuaugcuuaaacuguuaggguccauagugaagaccuggggcuuggggguggagucccuuuauagucuagugcaccaauauccaauaguaauauggaggccgcauguauuauuuaacauuuucuaguaguccuguguauuaguuucuuaggccugucauaacaaauaaccacaaaauauguggcuuaaaacaacaaauacaguuuuuuuuuuauucacaguuuuggaggcuagaagucugagaucaagaugucaucugggccacacuccuuuugaaggcuguagggaagaaucuuuccuugccucuuccuagcaucugguggugcuuggcaauccuuggcauucuuuggcuuauagugagacccuggucugucucauagugagauccagccucugcuucuaucuucacuuggccuucuuuacuguuugucugugucugucuccaaaucuccuucuucuuucucuuaggaaaacgccagucauugguuuuagggcuuaggauaauuucaucugcauguccuuaacugaucacaucugcaaugaaccuauuuccaaauauggccccauuuugagguuccaggggaacaugaacuuuauuuauuauuauuauuugagacagucucacucugucaccuagcuggagugcaguggugccaucucagcuuacugcaacuuuggccuccuggguucaagcaauucuccugccucagcuucccgaguagcugggauuacaggcaugugucacuaugccuggcuaauuuuuguguuuuuauuagagacaggguuucaccauguuggccaggcuggucucgaacuccugaccucaugugugauccucccaccucggcaucccaaagugcugggauuacaggcaugagccaccgcaccuggcugggacaugaacuuuagggcacacacuauuuaacccacugcaccgcauuaaaaaaaaaaaaucagaaaagccaaaaauuuaauuuuauuaauucuaauuuuuacuuuaacugaauauuucaaaauauuauuauaauauguaaucaauauaaaauaauucuuaaugugauauuuuaacauuuuuuaauacgaagucuuugaaauucaggguguauuuucaaacacucauaacacaucucaauuuuuauugccaauuuuuaaagacuccguauucgcuuguggcuggcugccacaucuuggacagcacaguuggagugcugcggggcugacaaaacuuuuaugcuucucaguguuucaccccauguugucucccucucuucauuccucuuaguuuucagggaauuuuaauuuguuugggaagucucagucauuaugaacaaaagaaauaaaaauauacuuuguacugggaucccaagacucaguggaggaaguaaaaucagccaguuuugaaagaaaagaucuuuauucaguuacauuuuuaagcaucaguguuuauuguaugguagaauucauuaagcacucuaucacaagugguuucaacacgugcgguuaauauucaagauguaacuuuuuuuuuuuauugaguaggggaaauauaagaccuuauuauuacagaucucccugccaugagauuugugacucacccauuuaugagcccccagugaacacagccauuauucucugucauguuaagacaagaaggggcauaaauaaacuuuuuuucugggcugacugaacuuagucuguugcaacaaugaaguuaagaucuauaucucuaaaacucuguguugucuucuccaagaauuuaaagcuuguuacuuguuagcaugcaucucagggcaaggcagaguuuuauaagcaagcccauaggaagaaaaguuuuagauccuugaauucuuucuuuauuuauuuuuuuauauuuuuuuaaacuucugagacagggucucacucugucacccaggcuggagugcaguggugcgaucuuggcucacugcaaccucugccucccagguucaagcgauucuccugccucagccucccaaguagcugggauuacaggugcccaccaccacaccuggcuaauuuuuguauuuuuaauagagauggggucuugccauguuggccaggcuggucucgaacuccugaccucaggugaucugccugccuuaaccucccaaaguucuaggauuaccugugccugucccgucuggcuuaauuucauuucuuuuuucuuucuuucuuuuuuuuuuguuuuugaggcaaggucuuacucugucacccaggcuggacugcaguggcgcaaucuuggcucacugcaaccucugccucccggguucaagcgauucugcugccucagccaucugaguagcugggauuacaggugugcaccaccaugccgacuaauuuuuguauuuuuaguagagaugggauuucaccauguuggccagguuggucucgaacuccugaccucaggugauccgccugccucggccucccaaagugcugcaauuauaggugugagccacugugcuugacccugucugguuuaauuucaacacgucuuuacccacugcgcuguagccacauuggccuuuacuuucuguugagcaagccaggcacucucuugccuuugcgcuagcuguguuucccuuauacuagauaccuaaugaccaacucccaccuuucuucaagucuuugcucuaaggucaucucaaaaaguccuaguuaaaauuauaccuuuuaucccacccucugcuaaguucccuguacucauccuuuuuucuuucuuuccauagcaccaucacauucuccaguauauucuauaauuuacucauuuguguuaaucuuguuuuccccauccccggcuaccccuaauguaaucuccaggagagcagaaucuuuguuucauagucaauaguaccuggcauguaguaggccucaauaaauauuguugaaagaaugagucagugugcauaacugcuuggcuugaaaugcuguucuccaaacucaagguguuuuugguuauuacuguuuuuuccuucuagguuuggccugccauauuuaauugcuuuguuggggccauuuagucauuuuucuuucucuaacuuaagguccuuugggaaagggcuguggaucagaccaacuauucagaaaagcuggaggcuuagggaguuccuggaaguagcuaugcggcaacuaagagagguuggcccacaauaagggugguuuccucugacucuacaaaaucuuagugauacuuuuguaggggaagaaagcuguuuucccuuuaccauuuuaggugcauugguuggggcccugucagucagacuaacagaauacauuaacaagagaaaaacaaaaacaaguuuauugacauauucauugcguaugaacaugagagcacccagugaagaguaacucaaggagguaguuagaacuugggcuuauaggcuaucucagcaaagacuaguaaauuuuuagagaagugagaagacaaaggaaaaggaccuugagcugcuagggacagcagauugugggaaggcaaguauguggggaaaccaaugguagaucagggcugguuuuagcaagguuuguuauguagauuccccugguacccuaucugggcugauaaaggucaagaguugucuccaagaucaacuucuguccuucuuguuagagagggaaguggggauaccuuuaagaauuuauguccugcuucuggggauauaggggagggcagagagcuuuucuuuuucuuuucuuuucuuuucuuuuuuuuuuuuuugagacagagucucacucugucgcucaggcuggagugcaauggcgcaaucucagcucacggcaaccucugccgcccggguucaagugauucuccugccucagccuccugaguaguugggauuacagguggcugccaccauacccggcuaauuuuuguauuuuuaguagagacgggguuucaccauucaagacuggccaggauggucuugaacuccugaccucaugauccacccgccuuggccucccaaagugcuggaauaacaggugugagccacugcgcccggccaagcuuuucuuguaucugcauuuuaauaacccuuaggccaaaguuguauauuucgguuugccauauucuccuauucacugucuucauuguaaauucucaugacaauuuccuucaagaacauggccucugagaucuuugcaaccucugaagagguggaugguucauuacagagaauuucaaggccagguucagccuggcaacagagaacucuggggguaagaguugggccuuccugaugccuagacaaaagacggucacuugagcuacucacugggggauguagcuauggggaugcugauguaggugcuucuccuggcccugccuucuccauccucauuaauacaaaaugggaaaagcagucagguuagguauuccagauucacauggcccacugaaaaggacucauucaaaggcagauuuuucuucuaccaugacccuucuuaccuugccaaucguuuauucucuuuucuuucuuucuuucuuuuuuuuuuuuuugagauggagucucgcucuguacccaggcuggagugcaguugugcaaucucggcucacugcaagcuucgccucccagguucacgccauucuccugccucagccuccugaguagcugggacuacaggcgccugccaccacgcccggcuaauuuuuuguauuuuuaguagagaugggguuucaccauguuagccaggguaaucucgaucuccugaccucgugauccgcccaccucggccucccaaagugcugggauuacaggcgugacccaccgugcccggccucucuuuucuuauacuguuacacauauauacacacuucagaaaugaucucuguccuggagaauuuuauguaugaggucaaagcagcagccacucugacaauuuucuucaaauuagacuuaugcugcuggucacgguggcgcacgccuguaauaccugcacuuugggaggccaaggugggcggaucaccugaggucaggaggucgagaccagccuuggcaacauggugaaacccugccuccacuaaaaauacaaaaauuagcugggugugguggugcaugccaguaaccccagcuacucaggaggcugaggcacaagaaucacuugaaccugagagguggaggaugcagugagacaagaucuugccacugcacuccagccugggcaacacagagagacucuguauauaaaaaaaaaaaaaccaaaaaguuuggauaacuguauuacaaaaguaaaaauaagucaauauuaauaauaucuuuucuuuaacccauauauccaaaauaauacauuuaaacauauaauuucaauauguaauauaaacauuguuaaugauguauuuuauauuuugcgcuagucuucuaaaucuguauauuuugcaacuacagugcacuuugauuugaacuagcuggauuucuagugcucaauagccacauguggccagaggcuaccguacuggauaguauauguagauggcucuacccuagagugacuucaucuguguuacauguuauucuaacaauguaucuucugguuucccagccacagcugacuugaagcaguaaauaaauggugagagugacagagugcuaagaauaguagagaaggggcagaagaauuauuuuuauaaguggcugaggucauucauugcaagcacaaaugaaagguaugaaccuuucauacguugagaccugcugaagcauacagugugguaccugguagaauaauugauaauuuuucaugcuugccuuccauuucauaggucagaucacuuaaagaaggcuacaucauguucacucuuggcuacaaacauagggaagugugaagaguauguggacaaaguuaaggaagcuuucuaucaaguguugcuaaaauaaugguguucuaguacaggaaaccugggaaauguacguguaaguagaaacccaggacuacaugaugaagcccucuucauuucuaaagcugggagcucacagaagucuuggaggagccugcaagugugccuucagcugggugugccccgucucaucuuccuaagauugcuaacuucuucgguucuauggguuucccuucugguccauggggcagagaugcagcuggugccuuggaaccugcaaggcucaaccuuagccuagaccuuagcuguguuugugggacaucaggagucuggcuuguggauuuggaauguccaucuuuugagauggacuuucuuggaacucaccacuucauggacacccacugggggcaaugguagcaaagugugugggucagcugcgugagcuguagcaugcagauuccagccagcagacaacaaaagaaaacaaaaagcaaagcacucaaaucaaauaccaccuuuggguuuucuguuuuucucuuguguauauggcagacgacaaagucaggggugaggggauagcugucauauaauuaguguacauuguucucauguaaaaccaucaguccacggcugccuguuaaauaauuuugucucuuucuuuauuccauuuuuaggccgaggagucuuguaaauguaauggcuggaaaaacccuaaccccucacccacuccccccagagccgaccugcagcaaauaauugucagucuaacagaauccugucggaguuguagccaugcccuaggugaguuccuaaaucuucaaggaaaguauaacgaguucauuguagcgugagacucuuaacuuacugaauucuguggguucaccaaauuugaaugcuguguaccucuguaugagagcaacaacaagagccucucuagucucacgaguuugcugggaagggcuucucgugagagacaaaugcugcacugugugcagugacuuugucccuucuuccuuucaagagcugaguuggacugggggauugccaaauaagaugaaacaugacaaucgagcuaguuagcaugaauaauguguaacauguccugauucauuuuggggguuggggccugagggucuuugaccucaggguugaaaccucaaccaacugguuuaaugauaauaaugaucauuuuuauuauuucuguugcccugaacuuucuggggugcuucauuuuaucuucauauuccuuaguuuuguguaucugauagcucuuucuucacugggcugcucuuuauuguguuuauugaauguuuacuggugguuucccuuucaacuuucuuaucugacccugcaaaauaaucauugucagugauggcucaguaggcucugcugcagucacucaaaaggccugugcuaguauguuguucuuuguccuaauacuaguuuuaugauuaaaauauuuaaaaaaaucauguguuguuugaguagauaaaaguugaggaauuaguuuuuccuagauacuaaaauuucaguccacgaagaaucuuagacuauucuuacuuuccugccuucaguuauacagucucccccaaaaugucaacaaggccaguuugcuguccgugacugcaaggacauagcacucacugggcagaacguucuugcuaagguaguugcucuuuccaccugaccauuauaagugggugacuucuuaugccaucauuucucuagagcuuccugcuuacaagaaauggugucgccuccaagguuagcaugguguuaggucgucugaaauuuuauuuuguacucagagaguauuucaauauuuacagagcauacaaguagauaaugugaucuucccaagaagucaucacauuggaauaaccuucugaaaauagaaauaguccugaucucacaaaagcaacacacuaauaauuucaucauuuuguugacuuaauugguaucucaaacaaugugagcucugaguuuugaagcacucaauacagagcaaaaauuucaaaaguuagagaacuguccuugauuauaauuuaccuuuuuaaaaaaauaaauaaauaaaacagaacgaaacaaaacaaucacuaacucugaauggagugaauggaguuuaggauugccucaggaaaugugacguaauaaaugucuggacucaagaaauccuuaagcccuaggcuugaaguguauuuguuauugauugggaaauccuauuauccuacaucaauuaacauuuaaaacaggaucuucuuucuuucuuagccgagcagauugucuccauucuaagcacguaaacacacaugaaugccugaaggcagagacagugcuucacaaaaaaagccaacuuuguuuccuuuuuuauuucuuaccaagcuuugaaaacaaaugcccucauucugcaauacauaaucaagaaugaagaaugaaaaaaaaaaucacauauccuuugaccuggcaaauccaugccagaaauuuaaucuguguguaaauuaagaugugcccucaaauuaaacuaaaaggacggugacaguguuuucuggccuuacuuacgauaguaaaaagcaugaaacaaccuaaauauuccaauguaggagaugauugugaagaaaucagguaauaaagcagcuugauaggagguuuuauaauuuaggacuaaauuauuggaucuaucagccugaguucaaauccuaacucuauaaccaguagcugugaguaugagcacauuacuuaaucugccuggaccucaguuuuuucaacucugaaauggguuaauacauaguaguauuuaccuugcaggaucauugugaggauuaaaugagauaagaaaaaaucuuagaauaguaccuggcauguaaauacaugauuauuggcugauguuguucguaguagugguacuauaacacuaucaggguucuuuuacuucacacagcagauauauacucugucuagcuuaaauaagaaaacaaugcauauaagaaggguacuaguagcuucuagaagcugaaaacaaugggaaaacagguuuugaucuuguuuggggaucucagcugcagaaguucacagagcuucuguucagucugcugccacugaaucauuuaggauucaacuccaacugccucugucccugugaguauugguucaggauuuaaauacccuguggaggagcuugugccuguuauguguuuaacucugaaguuuaccccaagggaacuaagaaguugguccuuucccaaauacaggaugcugacucagaaacagcauugauguuucaugaguaugaucccauuuuauuacuuuagaaaauauaauaccauaaggccgggcgugguggcucacgccuguaauuccagcacuuugggaggccgaggcuggcagaucacaaggucaggaguucgagaccagccuggccaacauggugaaaccccgucucuacuaaaaauacaaaaauuagcugggcaugguggcaagcaccuauaaucccagcuacucgggaggcugaggcaggagaauugcuugaaccuaggaggcggagguuguagugagccgagauugcaccacugcacuccagccugagcgauauugcgagacucugucucaaaaaaaaagaaaaaagaaaauauaauaguauaaaacuuuuuucuauuuuacucaacacagaacacuucugugaccagauguguggguuuuuuuuuucuucacucaccaagcaauucucccacucucugaacacuagcuggaggucccauaauucauuucgguucugacaugaccuacuuggagauagcaucacaucccacagguuaagggcacagucccacaauagugcucccacuucagaugccaauugcaagucccagguuaugaccuuugcuucugaccuaccggcuauaaaucaggguucccaucauaccccuuccuugguuucaauaauuugcuaggauggcuuacagaacucaaggaaacacuucaguuuacugguuuaauauaaaggauacacagacagccagaugaagggaugcacauugcaagguuuggggaaggggagugaagcuuccuugcccucuccaggugcacgaccccccaggcaccuccacauguucagcaaccuggaagcuugagccuguaaucccagcuacuugggagacugaggcaugagaaucgauuaaaccugggagcagaggcugcagugagccgagaucucaccacugcagccugggcgacagagcgagacucccaucucaaaaaaaaaaaaaaaaauuuuuuucauacggcuuuaucucuacacuuucccucccuuaccuuucuuguagauugaugggugggguugaagguuccaauccuuuaaucuucuaauaaccuggucucucuggugagcagcuucauccuggguuaucugugcacuaucuuaagucaccucauuagcauaaacucagguaugaucgaaaggggcucaugaugaacaauaaaagauacuccuccugcucaggaaaucccaaggguuuuaagagcuugugacaggaacugggacaaagaccaaguauauuucauacuauaccacaaacauguauuuuaauauauaugaucaggaaaaggucuggaaggauguauauugaguugcugacugauuuucucaggguacgggggguauagguauuuaaaaaauauuucccccuacuccuuccuuucuuccuuguuucuucucuauucuuuagucugcuuucuuaaaacugaaauuacugcacauuuucaaguggucuuggaauuauuguuggaaugccaguguuuauuuauuggucuuaguauaacagcucuagaaaaccuuuuucugagauuacucuuccuuccucccuccuuuccgugcuuuuugaaaaacuuuuuuucuuaauggaaaguuucaaacacccguaaaggcagaagggauaguugaaugaacugccuuggacucagcacccagcucuaaugauuauuuacauuugccaauuuuguuguaucuaacccccugcuuuuauuugccagaguauuuuagcaaguuuccuacauuuuuucuuaucuuauucaugcagauaucuucuuaauuguuaccgacaaaguacaaguuggggucuagggaauucuguuaggaauuacgcaagccugaauucucaaauacauuucaguugguauacauuguuguucuguuuucacauacaguagucaccauucugagcaugguugauuuacucaccaguaauuguacacacgaaaugaaauauucuugaauuugucagaacaaaacauacuggcuuauugauugagauaguaucaauucuauugauuaaauguuggguuucuuuugccucagccauauauguucuuuggagcugugguuuuguguagucuccugacaauuucuuucaucccagacaucuuuggucuaccauaauuuaauacuguucuguguuucauggacauaaaacacaggagugagauagucugaucaaguagaaagaacauucaguugggaacuaggaaguaauaauucuagccugucuggguauggugguuugugccuguaauggcagcuacucaggucgcugagaugggaggauccuuugagcccaggaguuugaggccaaagugagcugugauggggccacuguguguguagccugggagacagagcaaaaccccaccucuaacaaaacaaaaccaagaaaagaauucuagcuuggcccugcaguuuaccaaguuccuuaaccuuuuugcuguuuaguaucuccauccacagaaugaaaugguuggucuagaccuaugcuguacaauacgguagccacuggccacaugaaauguguuuacucugaauugagauauacuguaaguguaaaauacacacaguuuuugaagacaucauaagcaaaaacaaugcagaaugucucaguaauuauauuuuauauugauuauauguugaaaugauaauauuuugaauauguuggguuaauguauuauuaaaauuauuucuacuggaaaauuuaaaaaucacauuguauuucuauugaauugugcugguuuagaauauucuaguucauucucugaaauuauauuugggauuggcacaauaauauucaguuuacaaaaauuugacaaagggaucuaacaaagugcuuuaguuggucccagcauuucuccuuauuuuaguauuaauaaagauuuuucuuauuuugggacugcuauuuaaaaagcagcuugggucuugcaugguggcucacaccuguaauccuagcauuuugggaggcugaggcagguggauuguuugagcccaggaauucgagaccaucuugggcaacauggcgaaacuccaccucuacaaaaaauacaaaaaucagcuggugugguggcaugugccuuuuagucccagcuacucgggagacuaaggugggagggaggauggccugagccugggaggcagagguuucagugggccgagaucgcaccacuugcacuccagccuggguggcagagugaggcccugucucaaaaauaaauaaauaaauaaauaaauaaaaaggcagccuguuuuuacgagcaggaaaguaggaaacaaauccuugugaucaaaacauaauuggaauuucuauuguuauuuuggaguccauuguucugaacuguuucagaauagacugauuauuaaauuugucuaguaauaauauuuuaguuuagagguuuuuugauuauuuuucaguguugucaccuuuuucuuucucuucuguccaggcugaugugcaguggugcgaucucagcuuacugcaaccucccccucuugggcucaagcgauccuuucacuucagccucucgaguagcugggaccacagacaugcagcaacaugcccagcuaauuuuuuuuuuuuguaucuuugguagagacggauuuuguuauauugccugggcuggucucaaacuccugaggucaagcgaucugcccaccucggccucccgaagugcugggauuacagcuaccgcacccuucaucaucuuuuucugauauauguguauauauauguauauauauauguacacauucagcagugggaacugacuguuuuuugucacuauagauuccuugcuuuucugcuuguuuacaguagggaauuucuuuucuguuaacuuuuaaaauuuugaguuaggcagaccccucacccuacaaccagaauugauucaaagagacucccagagcuuuuuuuuuuuuuuugagaaggagucucacucuguugcccaggauggagugcaguggcgcgaucuccacgaucucagcucacugcaacuuccgccucccagguucaagcaauucuccugccucagcuucccagguagcugggauuacaggcuuauaccaccacacccagcuaauuuuuauaauuauuauuauuauuauuuuuuaguagagaguggauuuugccaaguuagccacgcuggucucaaacuccugaucucaggugauccacccgccucggccucucaaagugcugggauuacaggcaugagccaccacaccuggccucuuuuuuuuuuuuuuuuuuuugccacagagucuggcucugucacccaggcuggagugcaauggugcaaucucggcucacugcaacuucugccucccagguucaagcuauucuccugcuucagccucccaaguagcugggauuacaggcacccaccaccaugcccggcuaauuuuuguguuuuuaguagagacggguuuuaucauguugaccaagcuggucucaaacuccugaccucagguaaucugcccgcuucagccuccccaaaugcugggauuacaggcgugagccaccgcuucuggccugagacucccagagauuuuuaaggaaggucaagaguuagcuuuaacaaucacacuagagcuuacuucuugaguauuaugaagaaaauaccaguauuuuucucauggauauuucaaguauuuaaaucauuuaggcagaucauuugacucaacacauuuucuuugaucauacgacauuugcauagacuuguaccauauaauugcccccucaguucccauuuauacauguacugugcagaugccaaaggacguaaacauggggcccagcuagcacaaugacacagccuccugaauugagccagcauauuccucuuggcuggauguccacugcuggcuaaugcagccuuucagaugccgguuucagaguuuucaggagcugugggucgggcacagcaggaguuaaggggauaauacugguaauauuuucucugcucauuugguauaaguuaugucucccugacguccucuggucaugaaauccuguuugauacucccuucaaguuccugccucuagcacuggcugaauuuaggcuuuuccucauuauuccuugccugugucugcugcagcuucuggaguucuuauuuccauuccugcauaccuggcuuucccauaaagugaugauacaaugugaucccauucuccugcuuaaccccucugagcuucucauuauccucagagugaagggugaucuguaguugagcaagcagguucaguucauugaggccucuuuauuuucaaagcuuuucuccaauuaucuucauugcauuuuggccaucaggcugcuccauguucuccaaagguucuuugaacuuucucccaccucugccuuagaucuggaagcucacaccaccuucaaugccuuuccuucauuuucugccagggaauucugcuuauccuccaaggcuugacugcagaacucuguagagagaauaaaggccuucuuagagcucuguggcaauguuccuucuuauauaacuauaauuauauaccaaucuguacugaacugugauuaagaguugacuuuuucucuaguuuguaauauauuuaguucguugugcauaauugugcuuauucuuuuguugguaaauagucauugaauucaauaaugguaaaaugagggcugguugcauauauuugcagaggagcuuucaaaguuuauaaucuauaccugcuguguccaacacaguagccacuagccauguguggcuauugaacacuugcaauuucacuaguuugaauugugcuguaagcgugaaaugcacacagguuuugaagacuuaguacaagaagaggaauguaaauaguaacuuuuaauauugcauacguauugaaagaauaauacuuugguauauauuagguuaaauaaaauauauuauuuaaugaauuucaccugcuucuuuugucuuuuuaaacacagcuacuggaauacuuaaauuuacauauguggcuugcauuauauuucuacuggacugcucucaucuaaugggcucuuacucuuaggcuucucuuuuuuuucauuccagaucugagauuacagaaaaugaaaccacuuuuaaaugauaagccuuuugcacauuagucaauuugacagauuucauuguagucauuaauuuuaccucuucuagccucgaugccaaauucccaugaacaaaaaauguauuugagcagccuucaaauccuauuguguuauuugcuucugguccagaggagcagggacauguuagcugccugcccagcugcugccuguucacacugcagggcaugugaggacuggcugacugucuucacgagaagugcaggccaaugauacacggagccagagguuagugagggucacggcacacagugacagugugcuuccuguucucagcaagguugacagcugcaccgugauucuuggcagcagucacacggcgggucacucucuggcacccuggguguuugcaagucugacacagcacugagaggugccaagguauacccuucuggagugaucuaaagaaggcaaagccuccccucguccccucacuugcaccuucugucugcuuucuugugcccuucacacaaaguggacacugggggaacuguggcccaccaaaaggaauaaacuuugccacagcucaaggguuggucaaucuuggguaauuaguguauaucaaugcuuuguaucaggcucuuggaagacuauuuaaaguaaaagcaggauucuuuaaugaucaaauucagguggaggaaagauuguaaaaacacuuuuaauuugcaaauaauuaaaaauuuacauaaaagucaugagaauaauaacgaagaauaucccauaaauccuuucccuagauuuaccuauuaguaacauuuuauuuuauuugcugucauuggcucauauauauauauguauaaauguauauagagagucucauauauauauauauaugagucucuacguauaaauuuguuuuucuggaacuauaugagaauaaguuacuuauauaucauagcccuuccuccccuaaauauuucaauauacaguuccuaauaauaagguuuucuuuuuuugaaauggagacccacucuguugcucaggcuggagugcaauggugcagucuuggcuuacugcagccuccaccuccuggguucaaaugauucucaugccucagccucccaaguagcugggauuacagaugccugccaccaugcccagcuaauuuuuuuauuuuuaguagagaugggguuucaucauguuggccaggcuggucucgaacuacugaccucaaaugauccgcccuccucagccucccagaguguugggauuacaggcuugagccacugcacccggccacgguuuucucuuaauaaccucaguucaauuaccaacuuuaguaaauuuaacauuaauauaauaccuuuaucuaaucuacuguuuguauucuaauuuuaucuguugacccaaaaauguucuuuauaacauauuuuccuuuccauuaagccuccacucaagaaucacauaucuguuuaguugucaugucucuuuaguuuucuuuaaucuggaguuccucagcauuuuauuuuauuuguugacuuuuauaacauugacauuuugauggaggaauguuuuaaauuuuaaaaacaaacucuuuaaagagcuaggaaaaauacauuuuuuguuauuuuuuguuuauguaggaaaaaccuuugcaagcaaaaccuuaaagaacugccaacguagauauggcuuucuaaaaagauuaacauuuuucuacaaccaaaccaaauaaaccaaaaaucccuccccaccaaauacguaagcauuugcaaugaguauggcagacuaaagguaguacauaagguuuauucaaggugguaagaaaaagacuaacaucuuaaaaaccaagcaaaggaacucaaauuggcagguacacaggagaucaaauacaaacagccaguaguaugaaaaacaaacaacucccugggccuuccguugaaugcagaucaaaacaguagggggugcuuauuaauuuucaaaagauugguuaaauuaccgaggaugguucuccacuguaggcagagcacaggaaaaaggaauagucucucacuacugauacaguguacauugaugcacaucuugaugagggagguuaaauuagggagcgauacaucaaaguuuuacauagcagcgacuucauaucuugaguuuuguggcagguugacugcuauagauuugugcauuguaguuuauagauuuuuauuuuauuuuuuaguuuuuaauaauaugcuccuagacucauaaauaauagaggccuaucucuuuaagaaaacauacuuuuagauaauugaagggagccuauuugcaucaaaaagucuucuuaauaaaagguuaagagaaggguuucuuuuaauaaugaaugacucuuuuugguuuaauaugaauugauugucaguauaguaaauaguuuagcuuugcaguuagagugagguucaccuggguguugacauggguugggauuaauuaggagacugguaaaucuagagauaaguuaaacaagucuaauucuggucagcauccccaaagagccaggaguagucucuggaucugguagagaugggguuguuuaaggaaagugguauuuuaggaagacuacccuggcagcagagagaacagucuagggggcuauuuuauuauaguagguuugacauuccaauggaagaaagguaggauggggaaaugcagugucucugagagagaaugaggaagcucaguggagucugguggcugguaauguguggaagguaaaggacacuaaaggaaugaaugaugggcuuguuggcagaaacagggccagcaagagguagcugccauuuugaggagggccaugaggaguucagucuuugagucauuuuccgugaugguggugcaccuauuuuguugggauagggaggauggaaggugggguucggggaagauuggagcuggagaagagguuagcuggugauguguauuuguugagaacagaaaguucagcgcuacuuccucagagauugaguuaggugagagcugaaaaggauuuuuggucaaaagggaucuguaguuggccuccuuggagaggggcuacauuggagggucugagaaguuggcacauuuagacaacuacguauuuauauaguguagucauagcuguucuugucuggcuuucuuauuacagggaagcuucucuuugauaacaacuugucuggaccuuuuuccacccuucuccagcagacuguccacuccaucuacuuucauuugaucuuccuccaccucauuguuuauucuaggaagcuuaaccuuucucauacaauauucuccugcuucagugcucccccuaccacuccagaccugcguuuauuucauucucagaguaagagcuauccucuucugcuaugaaaguuacucacccuuuguacaggggagccucuuucuucucuucugggaaacuguugcugcuuuauuuacauuuucccccaucuccaucucccuauuccuuucuacuuuggguuucauacagagcucugaggagagaucacauauugcauuaugguaauaaauaaauaaauaauuaauaaaugcaaaaaaaaaucacaaaaccacaagcacauuucauuaugggcagagucagagggaaaugagccuccucagguuucacuuaagcauuuuaauuuuuaucaggcuacucuucaaaauaugcaaaaaguugguucuaaacagugguuuuaaagcugcagaaucccaacaagggaaugggauggguucuugagccuucuaaaaauagaagcuuucaccucuauuucauccagagcaacuccuucuaauucugauuaguaauuaauuuugguaaaguguuuuggggcuuugaaaaaguaagcuacuauuucaaaaguaaaucauggcauguacuuccaugaguuaaaccuacuauauguagcaccuuaauuagaugguuucauauuauggagcaucugaaggaauuuacuugauauuguauacugauugcuuucauagcuuaucacaaaaagagauuaaaaguuuguaagacaggccagaugcagaggcucacaccuguaauccuagcacuuugggaggccaaggugggaggauugcuugagcccagguguuugagacuagccugggcaacauagugagacuccaucucuaugucuauuaauuuaaaaaaaaaguuuauaagacaaaaauaguccuaaauaaaauuauuucuguaaauaacugacauaaaaauguugaccuaauugucugcagaaugaggccuguuucccaaaggcuucagauugaccucaaggaaaauuuugcagucuuaagaaaaagaugacccagcaaauguucuaccuaagaugaagucugauuuuggguaucuuuuagaaagugaugagguaacguauuguauagucaaacagcaaauaauauauuuaaacauuaauuuuuguguuuacacacacacauaauuuuucuuuuuucuuucuuucuuuuuuuuuuuuuuugcagggggcagagucuugcugucucccaggcuggagugcaguggugcaauuuuggcucacugcagccuccaccuccuggguucaagugauucucuugccucagccucccgagucgcugggacuacuggcaugcaccaccacacccggcuauuuuuuguguuuuuaguagagacaggguuuugccacacuagccaggcuggccucuaacuccugacuucaggugauccaccugccuuggccucccaaagugcugggauuacaggcaugagccacugcgcccugccuacauguaauuuuucuaugauguaaguuauuuauauacuuagaaacaauuuaauugauuauucuuuuucuauuugauaauguaauaauacaguguugacauuuuauucaauacugcugaagucagacagauuauaaagauuaauuccucucuucuuaccuuuuaaaaaugcuguuuugagcugggcaugguggcucacaccuguaaucccagcacuuugggaggccacaguggauggaucgcuugagcucagaaguucgagaccagccuggacaacauggugaaaccccaucucuacauaaaaauacaaaaacuagcugggcaugaugguaugcaccuguagucccagcuauuugggagacugaggugggaggauuaccugagcccagaaaagucgaggcugcagugagccauaauugugccacuacaauccagccugggugacagagugagacacugucucaaagaaaacaaaaacaaaaaggaagaaaaacaagcuguauuggagucugggcaugguggcuuacaccuguaauucuagcacuuugggaauccgagacgggaggaucacuugagcccaggaguucaagacuagccugggcaacauggugaaacuuugcgccaacggaaaauacaaaaaaauuagccaggcauggugguacacgccuauagucccagccacuuggaaggcugaggucagaggaucgcuuaagcucaggaggucaaggcugcagugagccaagaucgcaccauugcacuccagcuuggaugaccaagggagacccugucuugacacugccccaccccacaaaaaugcuguauuggggugcacacccaugcauauuccucaucauggguccaucacucugccuuucaauuacuuuucuguauuagaaaugaaagguggguggccucuaccucucuaauuuuaagcccuuuaaacugucuuccucuaggacauuuguguuauuuaaaaacaaauagauuuuuuuuuuuuuuugagauggagucucgcaggcuggagugcaguggugcaaucucagcucaccacaaccuccaccuccuggauucaagucauucuccugccucagccucccaaguagcuaggauuacaggcaugugcccccaugccuggauaauuuuuauauuuugaguagagaugggguuucaccauguuggccaggcugcuuuugaacuccugaccucgugauccaccugccuuggccuuccaaagugcugagauaacaggcgugagccacugcgccuggcugagauuuuuuaaaggauacaaaauuacugcuggauaggaagaaugaguucuaguguucuaugccacuguaagaugacugugguuaacaauaauaucuaguuucaaauagcuagauggaugauaccgaguguuuccaacacaaagaaaugauaaauauuugagaugauggauaugcuaauuacacugaucugaucacuguauauuaaauguaucaaaauauugcuggguaccucauaaauauguacaauuauauguuaauuaaaaugagaaaauaauuuauuuuuuucgguuuuauuaagguuuaauugacaaauaaaaauguauauauuuaucguguauaaugugauauuuugagauguauauauuauaaaaugauuaaaucaggcuaauuagcauaucuaucaccucacauacuuuuaauuuuuuguggugaaaauauuuaaaauugauucuguuagcaauuuucaauuauauaauuacaauguauuauuauuaaugauagucaccaugccacacaauugaucuccagaacuucuguguaaaugaaacuuuguacucugugaccagcaucucuacccguaccucacguuccaagucccuaauaaccaucauuuuacuuucugcuucugugauucugacuuuuuaagauucuacauacaaauaagaucaugcaguauuugucuuucugugccuggcuuauuucacuuagccuuaagacaggcucucacuuuguuguccaggccagaaugcagugguacaaucauaguucacuguagccucaaacuccugggcucaagggauccucuugccuuagguugcuaaguaacuagggcuacagaucugagccaccauaccuagcuaauuaaaaaaaaauuuuuuuuuguagagacagggucuugccaucuuaccaaggcuggucuugaacugggcucaagcaguccuccuacuucagccuuccaaagugcuaggauuacaggugugagccacugugccuggccauuuccuuaguuuuuaaggcugaauaguauuugauuguguucauauacuacauucucuuuauccauucauuuguugggguggacacuuagguaaauuccauauuuuggcuauugugaauaaugcugcagugaauaugggaaugcagaugucuuuuugacauacugauuuccuuuucuuuggauauauauccagaaguggaauugcugggucaggucauaugguaguucuguuuuggauuuuuugagacauauccauaugguuuaccauacuggcuguacuaauuuacauucccaccaacagugugcaaggguuccuuguccucacauucuugccaacacucaucuuucaucuuuuugauaauagcuauccugagcgugaagugauaucucauugugauuuuaauuugcauuucucugauuagugauguugaacauuuuuccauauaccuguuggccauuuguaugucuucuuuugagaaaugucuguucauauccuuugcacauuuuaaaauuggguuguuuucuuaccauugaguuguauaaguuccuuauauauuuuggauauuagcuucaucaaauguauggugugaaaauguucucuuccauuccauagguugucucuuuacucuguugauuguuucuuuuccuauauagaagcuuuuuaguuugaugcaauccaguuugucuauuuuuguuuuguugccugugcuuuuugaucauauucaaaaaaucuuugcgaagaccaaugucaagaagcuuuuuccuauguuuccuucuaguaguuuuacaguuucaggucuauauuuaagucuuuaguccauuuugaauagguuuuuguauaugguaugagauaagggucuaauuucauucuuuugcauguggauauccgguugucccaacagcauuuauugaagagacugucccuuccccuuggcaucuuuguugaaaaucaguugacuguaaauggauagauuucugggcugucuauucuguucaguuggucuauguauuuguuuuuuauguugguagcauuuuguuuugauugagauagcuuuguaguagauuuugaaaucaaguguagugugaugacucugccuuuguucuuuuugcucaagauugcuuuggcuauuuggagucuuauguaguucuguacagauuuuaagauuauuuuuucuauuucugugaaaaaugucauuggaauuuugauagggauugcauugaaucuguagaucacuuuggguaauauggacauuuuaacaguauuaauucuuccaaucugugaacauaaaagauaucuuaucacuuauucgugucuucuucacuuuuuuuuuuuuuuuuuuugagauggagucucaccuugucacccaaacuggagugcaauggcgcaaucucagcucacugcaaccucugccucccagguucaagugauucuucugccucagccuccugaguagcugagauuacaggcgugcgccaccaugcccggcuaauuuuuuuuaucuuuaguggagauggguuuucaccauauuagccaggcuggucucaagcuccugaccuugugauuugccugccucagccucccaaagugcugggacucccagugugagccacugcgccuggccuacuuucuuucaucaguguuuuauaguuugcaguguacauaucuuucaucuccuuggcuaaauuuauuccuagguauuugauuguuuuugaugcuguuauaaaugagauuguuuccuugauuuuuuguuuuguuuugauaguuuguuguuaguauacagaaacauggcugggcaugguuacucuugccuguaaucccaaugcuuuaggagguggaaggauugcuugagcccagaauuugagaagaacagcuuggacaacauagugagaagccaucucuauuaaaaaacaaacaaacaaaaaaacaaaacaagaaaaaaaaaaacgaaugguacugaucuuuguguguugauuuuguauccugcaacuuuacugaguuuguuuauuaguuuuaaaagcuuuuugguggugucuuuaggguuuucuguuuauaaaauuauguuaucugcagagacaauuuaacuucuucuuuucugauuuggauacuuucauuucuuuuucuuacuuaauugcuuuggcuaggacuuccaauacuacguugaaaagaaguggcaaggguggguauauuuuucuuguucuuaaucuuaaaggaaaagcuuucagcuucucaccauugagugugauguuaauuguggguuugucacauacggccuuuuuguguugagguacagcacauucccucuaugccuaauuuguugagaguuuuuaucaugaaaggauguugaauuuugucaaaugcuuuuucuguaucuuuagagauuaccauaugauuuuucuccuucauucuguuaauuugcuguaucaauuuauugcugaaccauccuugcaucccugggauuaauuccucuugcucguggugaaggauucuuuuaaucugcuguugaauucagauugcugguuuucuguuguguauuuuugcauccauguucaucagggauauuggccuguaauauucuuuucuuguaguuuccuugucuggcuuugguauuaguauaaugcugaccuuguaaagugaguuuggaaguaugcaucccucuucaguuuuuugaaguuuuuuuuuagaguuucacuuugucauaaaggcuggaguauaguggcacaagcaugggucacugcaaccucaaucuugugggguggguucaagcaauccuccaaccucagccuccugaguagcugggacuacaggcaugugacaccacaccugccuaauuuuuauuuauuuauuuuuauuuuuuguagaaacagggucucacuauguugugcaggcuugucuugaacuccuaggcuuaagcauuucuccuaccucagccuccugaagugcugggauuauaggcaugagccacugcacuugggcuuuuugaagaguuugagaauuaguauuaguucuuuuuaaaguguuugguagaauucagccuugaagccaucagguccugggcuuuuccaugauggaagauuuuuuauuuaauuacugauucagucuccuuacuuguuauuaguuuguucagauuuucuauauuuucaugauuuaguuuugguagguuguacauuuucaggaauuuacccauuucuuuuagauuauccaauuuauugacauaacuguucaucauaaucucuuauaauccuuuguauuucugugguaucaguuauaaugucuccuuuuucauuucuuauuuugagucuucucuuuuauuucuuuuguaguccagcuaaaaguuuguccauuuuuuuuaucuuuucaaagaaccaacuuuuaguuuuguugaucuuuucuauuguuuuucuuguuuccauuuauuucugcucugaucuuuuuuguuuacucuuucuacuaacuuuggacuuuaguucguucuucuuugucuaguucuuugagguguaacauuagguuguucauuugagaucuuuuuucuuuuuuaauauaggcauuuauugccauaagcuucuuucuuagaacugcuuuugcugcauuuuguaaguuuugguauauuguauuuccacuucuguuugucuuaagauauuuuuaaauuucccuuuuaaguucuucucugacccauugguuguucaggagaaugcuguuuaauuucaaccuauuuguaaauuuuccaaaauuccuccuguuaaugauuuauauagguugguccaaaauaauugcgguuuuugccauugaaaggaauggcaaaaaugcuauuauuuuugcaccaauccaauacuuuccuaccagugugguuggaauagacaguugguaugauuucagucuuuuaaaaguuguuaagacuuguuuuauggacuaucaucugaucuguccuagagaaaauuucaugugcacuugagaagaauguguauucuacucucauugaauggaauguucuguauaugucuguuagguccauuuucuuuaaaguauaguucaagcccagugcuuugucauugauuuucuguguaaaugauuuauccauuguugaaaguguaauauugaaguccccuacuauuauuguauuucauucaaucucuacuuucacauauuuauuuauuuauuuauuuauuuauuugagauggaguguugcucuguugccuaggcuggagugcaguggcaugaucuaggcucacugcagccuccaccucacagguucaagugauccucucccaucagccucucaaguagcugggauuacaagcaugugccgccacauccagcuuauuuuuugcauuuucaguagagacgagguuucaccauguuggccccacuggucucaaacuccugaccucacaugauccacccaccuuguccuccuaaagugcugggauuacaggcaugagccacugugcccagcucagauuuauuaauguuugcuuuauauuauauuauauauauauuuuauauauuuacagcaaacauuaggugcuguaacauuagguacauguguauuuacaguuguuauauccucuugaugaauugaucccuuuaucauuauauaaugcccuuuuuggucucuguaucguuuuuuguuguuguuguuguuuuugagauggagucucccucugucacuaggcuggagugcacuggugugaugucggcucacugcaaucuccgccuccuggguucaagcaauucuccugccucagccuccugaguagcuagaacuacaggcacgcaccaccaugcccagcuaauuuuuguauuuuuaguagagaugggguuucaccauauuggacaggcuggucucgaacuccugaccuugugauucgacugccucagccucccaaagugcugggauuacaggugugagccaccgugcccagccaguuuuucacauaaaguccauuuugucugauauaaacauagcugcuccugcuccuucaggauccccuaccccuugguguuuaauccucuuaacucucugaaaaugcauuuguuuagacauguuaguuugaguuccccaagaaacagacucugagacaaggauuugagugcaaguaguuuauuuggguugagaguaggagaguuaaaagugaaacacugaggaaaagguggccaauaaagagugaauuacuaagccagcucucacugugggcaauugguacucaauucugugcaggaauaauugggagcugguguagaacacuuaccucagaguuauuccaucugaagagugaggaaaugaguauuuauacccuaacuucuuuagucuuuggcuaagagcugcucuugaggguauauagguggcagaguagguuacagugauaagaaaagcccuuaggccaaauggagcugcugguaguuggaaaccaagaguugugguaaggaggggggauauauagguggauauuagcagcauccucuaucccaggcuucugacugagcauugugguucaauggugagcgcaucauggucuccagaguagacugaccuguguccagcaccuggcagauauuccucaauagccuuuaguuucaucucccuuuaaaagaacgaggaaaaaucuaucacuuuuuaaauacguauuuuaaucuuucuuuaaaaaucauuucaagcacuuuaaucuucaagcauuuuuaagccagcacacuuagagcuauaccuaagaggaucguucuugaggugccgccuccuguuauguggcaaacguaguaauagauguuggggauaacagaaauaaaagacaugauuccagcccagagaaguuccugggcuagugggugauuauuagaugguuuaucuagggauccuuuuucaagugaaaagggacuugaagugaaucauuuagucaacaaaaauauguuuguaggugcuuuagaauuugggucaaaccuuuuucaguuucaaacccuagcucugccuuguuggcugagugacauuugaugaaacaauauuuagucugucugagacuguauuaguucauuuucacacagcuauaaagaacuaccugaggcuggauaauuuauaaagaaaggagguuuaauugacucacaguucugcauggcuggggaggccucaggaaucuuacaaucaugguggaaggugaaggagaaggaaggcaagucuuacauggcagcaggagagagagagcgagcgagcgaggagggaccugccaaacacuuuuaaacaucagaucucaugagaacucacuaucaugagaacagcaugggggaaacugccuccaugauccaaucacuucccagcaggucccucccuugacauguggggauugcaauuugagaugauguuuggguggagacacagagccaaaccauaucagagccuuaguuuccucaauuguaaaaugcaauuacuaauaccgaccgcaugggauuggggauuaaauguaauaaccuuaaaagauggacuguauuugaguagaagagaucacaaagggaugagugaggagagagucaauggacaggucacaaaacuauaguaagacaacagaacaaagaugcaaaaguggguuugcagcuggaucacggaggauguugaaugucaagcuaaaauaggccguggggacuuugcagcagacagugagguuuuagugugucucaaucagaaaggcugaagaaaaaggccuucagucuuuacacugucaugauauucuuuggugaaugagcucuccacaggacuuagagcuauaccuuuagggagcuugguuuucugcaucucugaaccaccaacuuacaaguccugcauucaugacuaggaccauagagaacccucuugacaugguggagaauuugcuuauauggaaaccuaagaaguugacccuauuaggaccagucuugaugcuaccaguacugauucuuaaaauauacauuauuugcauacauuagccaccagcccauuuuuaacguuggguggggaggcuaaggcucaagaacaugguagucucuuaauuauagguagauuuugugagaagacuucaguccuacaggaguucagaaauuuucucuuauuaccagugaacuuaaaggauugaugguaagacugaugaaagaggaccuuccacuuaaaaauggggaauguuugguuuccaauugaggucuuacauauguuucuuugaucuuaucauaagcugcucauguuucccaccuggagaaugugucagaggaagaaaugaacagacuccugggaauaguauuggauguggaauaucucuuuaccuguguccacaaggaagaagaugcagauaccaaacaaguuuauuucuaucuauuuaaggugagauuuuaacauuuuaaaaacauuuucucucauuauucaaauguacccagucuccauaugccaggucguggcugugaaggcuuucagcuccugguacauuuugcccucagaguuugcugaacaauacguuucuucaugacugauucucuaaaauggcccaccauaguuugaacacaucauucucuuugaggcuuuuacacuuguaugcaaaguugaguaucuugguuugcauaugcaaauagauuuuuuccauccacccaacaaauauuuauugcacaucuguucugcauguggcacuaacguaggcaugagggauagaacaguggacaaaacagaguucuuccccucaugcaauauauauuucagcagaagagacagucaacaaguaaauaauaccuuugcagguggugauaaguguuggccgaagagaaacaaaguaggauaaguggaaucagaauggcagggaugguggcgaguuggggacaugccagcgaggaaggucaguuaggauagccucucugaggagauggaaguugagcagaaaccugagugggagauaggagccaucugugcaaagugcuaggggaagagacuccgaggcagagggaggaacggguauuuuaggccgugcacuaagagagcuugaagugaugucuguacagcaaggagggcagcgugguggagcccagcgagcagaggguugggugggaggagauguaguuggaggaguggcuguaaguccuaucucuaaugcuuuaagaggagaaaucaacauauuccaaauuuauuuugguaacuuagccacuguuaccuguuucucacugacaccagucaccgauuacugcugccauuccccguagcugccucuucacuaguucuaccucagcuccaugugggucacauccauucccuacuauagacauacaucuccucaagcuucugauuagagccaggacuaacgaugugggaaggaaacuggugguggaaauggauagcaaaacuucagguugccaaaaauagaucuauaaaggaggcugccagaaggaauaaccuuaaaaaaaaauaaaccugcuacugagggcauuguagauuauguuguauuguguaacccuuacaaggauguugaaagcaaaacaaaagcacucagagcuuauggguaggaaaaguuugccucuucuaauaagaagcacugugcuucauuuuauaauaacucuccuucaacucauuuauauuuauuuguacuucauuuuuauaugacaaaaacagcuaaauuuuccagugaguucccucuuuugcuuuggcugcuaggaaucuuagugcaaauuuuguacccaguuccuauagcucuuuucuuuucuuugucugaacuuauuugauucauaauuuugccuuucccccuuuuuauuaacuuuugucuuuuauuguacuaauggguuuuuuugggugguuaggagauaggagugggagguagaauuauauuuuuaaaauuugguagauauuaaauuuggggauauuaacuuuaaaaagaauaauaggaaagagagagagagagagagagagaaagagagugggggaagagagagaauaugaacagcuggauuccccacagccauuagcaggcacuggaccacuuuaggcauccaggugacaacuuguugacauggcugugagguuugagucauucagcucgaacccuggcagguucauaguguuuagagcuucuuuggaaaaagaucuuaguugaagaaaaacaaggucugccugacuacagcuauuauuugucuuggaacugugcucccuggcagcuccccacuacccuguuggaagugaagguggugucaagguuuccauccugucagccucuauuuaguuuauaaccaaccaaacaagccagaaagcauugcucugcuuuaaaguacaucuucucucucuuucuucccuccuucaucuuaaaauaacagugcaaauauauuugcuuguggaaacacaauccaaaauauucagcauucuccccaccuccugcaaaaaguauuauucuugggcaaauaaguuauaaauaaucuauuccuuagcuucugaaaggcaauuccuaaaaacaaaacaaaaauaaugauuaaaauuuuuuuuuaauuuuaacuuuuuugagacagaaucuuacucugucauccaggcuagagugaaguggugugaucucagcucacugcaaccuccaccaccugaguucaagugauucuccugccucagccuccugaguagcugggauuacaggugugugccgccaugcccggcuaauauuuguauuuuuaguagagaugggguuucacauugucggccacgcuugucuugaacuccuagccucaagugaucuccccccucggccuuccaaagugcugggauuacaggcaugagccacugcaucuggcccaugauuuuuuaaaaagaaaaaaagagaaaggcaguuccugugucucaugugucaauaauuaaaguaaaaauguguuacauauuuuaguagaauuaaaaaauuucagucuuagucugggcacgguggcucacaacuguaaucccagaacuuugggaggcugaggcaggcccauuaccugaggucagggguucaagaccagccuggcaaacauggugaaacucugucucuauaaaaauacaaaaauuagccaggugugguuguguguaccuguaaauuccagcuacuugagaggcugaggcaggagaauugcuugaguccgggaugcagagguugccaugagcugagaucaugccacugcacuccaaccuggccgacagagugagacaacgucccaaauuaaaaaaaaaaaaaagucagucuuagauguugaacauaaacccaauggaaagcugcguccuaaaguugaaguauaucuuagugcuuacaaauguggcgcuggagucuaacuaccuggguuuaaaacuuugcucuaucacuuacuaaaugugacuuugggcaaguuaaucugccuuguuaguaguagcaccuaccucaaaagguuguaaguauuaaaugagauaauauaugugaagaaccaugaagauugucuguugaaauuaaggaugcaaaugccugcugcuauuaagaacuuuuuuuuauaugcacacuuaucccagcuucaucaucuuauagauaaacugaaguucaacaucuccacaauccaucaguuuaccuccaaauugaaacccccaaaugggccaaguuccuaaauggucuuauuuuaacuggggaaaaaaaguaagcaaccagaauuauuuguauuuaauuuuuaugaccaaucuuuagauauucuuagaaacauauacaaugacuuaucuuuauugcuaauuugcuuuuauaaagaugggcauaauacuugaaaggaugaacagaugccccauacucauaauuuguauggcaccccuggaaggaguugagguccuuguaagacacaguucaguggugagacauggucaucuucaaucuuggugguucaucagguuccauuuaccccugagagaaugguuuccauguuuuguuucuacugaaaaggcaguaagcgagaaaggagggaaagauguuacuuaaauaaauguguggccauaucuaacugacccacauguaaaaguuacagaagauucaagcaaagaucgaagguaaagaauuucaauaucaaauuuauuuucugcguuguucuugguaaguggcucuguguucccuuuucuguuugcucuuugagagcuuuaaauuccaguggcaggaauuaagagcaguguuuuuguuuugugggcauugagaugccagaacaguuggccugcauucuacggauggaagggaaaugaaaaaaagacuguaacagugaaaguugcccauuuagagcucugcagacuuucuuccuaaagagccugugcccuagaugaugcguaugccgugcagcugcuguagacagcuccuguccccuggccucuuuugugcagaauagaucuuggucucucacgucuuuaaauaagauccucuagagcuucagcacaccuauaguggccuggaugggcaugugccaaguguguaggguugcauaccaggccucugggucaauggaaagccagaaacaguggggagaagagggaagugcaugggacgguggugucuguuggaccagcauggguggccuaggcugcccagaacaugaaagguguccauuucuucauaacucuggccguggacaugaaggccaauuuggguuaccugauaguugcccauuuuauugacuuaaggauuuguuuauauauaguuaagauaaauagaauaugguaacuuccuuuaaaggcuguguguguguguguaagagagagagagagagacagacagaaacagaagagagaggagagagagauagacauaccaauuaaguuuuucuuuuucuuuuuuuuaaugauuucuuugcagcucuugagaaagucuauuuuacaaagaggaaaaccugugguugaaggcucuuuggaaaagaaacccccauuugaaaaaccuagcauugaacagguaaaaagauuuuaaaagcccucuuuuuauuggcucaaggcugaagaaaucuuuuaauccuccuuuuauaucucuaucuacggcuucccuccuccauacccagguuagagauguuuaccagucuguggaaauuguccuggaggcuuuggaucagagguguauaccuaauuuaauacaugaucuagcuuuugccuuuuaggguuguuacauacucacaguuuacuguguguuuggggaagaaaaacauuaaguagaacauguaguuuguaagaagaacacaugaaaugugcuuuuucuuguuguuggugcuuuaaaaugaagucuuuguccauuugcuuggcacugucugagaaagccuauugaggugaggggauuuaguagcaaugugaaaaacauuguaagucaagcaaaaaaagcaaaaaagaaaugagauuuuguacccagaaauggacuuccugcuacauuaugauuccuggaaagaagccguuuuacucagggaaucuguuaaaauguaaagaguuuuucuguuagguguugucaguaucucucauuagcaucacuuuuuuagccuuugauuguuuggcuaaacaaaaacacucuggacugaauuuuuugaugagaaugacuacugaagucaugauaccagaauccuuaaaaauaaaugcauuuuuaucagucaguuuucaguaaauuuuauuuugccuccaaacucuauuaaauaagaauucauugcucuuuuauuugaaauuagaugagauggaaauauucuguagaaagauuaaauuaacaguuuuuuuaaaagcccauaauuuugaaugauauauauauuuugguaagcuuauugacuucaaacaaaugauaguaaagaguuuaaauuuuaguuguuuaguucagugguaggcaugauagcagguuuuugauuagcauuuuuguaauguaaaaacaauauuuaucuaagaacugcauuauaugugggcuacucugcugauaguaaagcaauaauuauucugcacaacagucauauuuucuuguuucagggguuuugaccuuuucaguccaugguuuugauuuucuccuuaaugcuucaggauuucagcaggcguagaaucacaacucacagccucucugucuugucacuuuucauccaccgugaucugaggcaagauucccucuggggauugcuauuuucuuuuagggaaaaggaagagauuuuugugaauagagaaaugucuguuauuuugcuaauaaccaccaaucaugcuggcuguguggguguucagaauuaguaugauugcauagcugcaugaagaaauugccuucccucuuuuuaagggugugaauaacuuugugcaguacaaauuuagucaccugccagcaaaagaaaggcaaacaauaguugaguuggcaaaaauguuccuaaaccgcaucaacuauuggcaucuggaggcaccaucucaacgaagacugcgaucucccaaugaugauauuucuggauacaaagagaacuacacaagguaaucagaugcaaguucuuuuccuuuggccccauaaagccuguuacagaccuaaaauuguacuugacucuauaaguauagggcugccuaguuaucauuaugacuccaucaauucagagauaaugucuuuauaauuuaacuugcaaacuccugcuuuucauugcuaucauaauauguugaggugugagggauguaaaucaucuauacccagugugauagccacuagcuauaugagcacuugaaaauguggcuaguuugaauugagauuucuaugauuguaccaaaaaggaguuuaaaauugcucauuaauacuuuuaaaauauugauuacauguagaaaugauaguacauuggauacauuggauuaaauaaaauauauugaaguuaauuuuaccuguuuuuaccauuccaguguggcuacuagaaaauuuaaaauccauauguggcuuguguuauuuaucuauugaauauaguugacuagauagcuacacuauaacucugaaauuaauuagagcccucacucaaaaaaugcaaugaccauauaaugaaguuaaagaauuuuuuuuaggcugggcaugguggcucacaccuguaauccuagcacuuugggagucuaaaguggguagaucacuugggucaggaguucaagaccagccuggccaauauggugaaaccccaucucuacuaaaaauacaaaaauuaacugggcauggugucacgugacuguaauccuggcuacuugggaggcugaggcaggagaaucacuugaacccuggaggcagaguuugcagugaacugagaucgugcacucugggcaacagagcaagacucugucucaaaaaaaaaauuuuuuuuaaaggaaagauuagcuuaguuccagaacugugauggaacugacaucauuauacauauuaucuuccagguuuuguccuuuuaaauaacauuuuacauuaguuauaaugaaagaaaauguagaauuuuguagccuuuaugucucuucacuuaauaucauaucaaacauuucacagguuacauuauaguccauugaguugauuuaccacaauuuaccuaaccauuucucuauugcuggacauucaaacucugcagauagucuuggauugaacauauauuuucuucuaaaguggaaauuuauuuuuauugcuuauuacuugcagaauaacagaauugguuuuacaaaucuuaaacuuguaccauacaaaauauaaggaccuacauuuauuuucaucugaaggacugugacuugggucauccauucuuuucaacuuuuuuauaacuuuucuauaacuuuucucuguuuauauuucagaggcacaucaagcuugcauuagggagcuuuagugccuacuuuuuuccugauuuaaagugggcaguaguaucuuuugauagccugucaagaccacuugugcccagguuauuuucuguaacagcagauaacauggaagaauuguauaauuuaaaauaagcuuuccucucugacauugaccuaguuucauguguaacacacccuuuuccucucuuucucuucacuuuugcaaauauaugcaauuucaguuauaaaguauuuucuccuuaauaauugauauuuauaggaauugcagauuucuucaaaauaaguuuuuaaauuauaucuucauuuccguaucuuucauuuuaggauuuuacauuaacaauaguucuguauuauugaaacucugcuauauuauugaaacucuuguuuauaauaagaguugagacgauaagucucucaaaaauauguauuuuuuaaucccgucugugaacaauugacaaagcugaauauuugucaaagccagggcccugaaugcauuugcgacuuuuagcagagaaaauaaucguuucaucaagaaaaaggagaauuaauugugaagcagcuugggagacauuaguauauuuuguuuuauuuuuauuuuuauuuuuuuuagagauggugucuuauucuguauccugggcuggagcgcaguggcaugaucauagcucacuguagccucaaccuccuagacucaagcaauucaucuaucucagccuccuuaguagcugggacuacaggcacaugccaccaugccuggcuauuuguuuauuuuuuauagagauggggucucgcuguguugcccaggcuggucucaaacuccugaccucaagcaauccucccaccuuggccucccaaagugcugagauuacaugugugagucacugugcccagcuaugauauuuuagaaaacagaagaaaaaugcaaggcagccuuugagaauuacuaagaaauugguggcacuuaugaauacuuaagaaguaguaaaaauggaaauugguuuggaugagugcuggguuugaaugguguggguccaucucucccuuuuuacaugagcuuuagaccagucucuggucuaaagagacuuuugguuucuuucucuguccaagugucaugacuuuugugaguauuccaugggugguuuguauguaguuucugacacacagagcaggugcugggaagaugcucaucaucauuuuccucccaugcacauuguucucuaaaacucagucacugccaauguggagcuuauuaagcuaaagccuuaaauguauaauugagugaguguguaauuauuugaauaucgcuuuagaaauuaagauagcagggaauagaaaaacagcaaaagaguccuuuauagcccagccuccugagccaacagcugaaggcaaaaaguggagucagacaaugggaaagagaaacuugcugagagaaacagaaaugaauaugcccuaaugaguucugaaacgugcugauuucuaggugaaauguagaccaauagccccuauuaauaauaaauaaggaaaugaagguagaugacaccaaccucccccacguccccaccaucacgucauguugaugaggaaagggaaguagagaggaacaaccugugaaaauuaggagaaucaauauucggaguaaaaccucacugccaugaccacauggggaauuaaaaaaaccacauaccaccacagcaugaugucucacugauacugaucuucucaaaaauggguaauauuacuggcugcaggcaccagcaggcuuuaucuugauguugcuguaagagaaccucaggaccuauaacgcugguucagcuuauaacuuacagcaguuacuguaaauauuagaacaaagaugugccgaaaauguuugcaguauaucagucugaaaaugaaguuaaacaggauucuuuguggaaaagacuggacuuagaaaaugauuguguucauuacagagcuaacuuguaaauauuuauuccauaaaaauuaaaagcagacugaacaguaguacugcuuaaauuacuucucuguucugaagaaaagaaaaauauaaguauucuuuuuuuguuguuuuuuuguuuuuuuuuuuuuugagauggagucucacucuguuguccaggcuggagugcaguggcgcgacucagcucacugcaaccuccaccuccugaguucaggcgauuuuccugccuuagccucccaaguagcuaggauuacaagugcgugccaccaugccuggcuaauuuuuguauuuuuaguaaagaugggguuucaccauguuggccaggcuagucucgaacuccugaccucaggugaucugccuaccucguccuccuaaagugcugggauuaaaggcgugagccaccuugcucaaccuaaauauuguuacauaaguguauguuaacuguaccuuauauauacucccaggagcaauugugguuauagaaaaaaaugugggcaaauauuuugaaguuccugaauuucaugauaguacacuauuuaauuccaugaagaaauaaccuaaaaagaaagugucacaggauuaugacuucuuaaaauacaacuguccaacagucugcugaaggaaagugcaaguaauuagucuuagauuuugaauuguguagaacuuuugaaaguuaaagcuuacccccacacuggggagauguuucauaagaauacagaguggcugugugcaguagcugaugccuguaaucccagcaacuuugggaggcugaggcgagaggaucgcuugagcccaggaguuugagcccagccugggcaacagaaugagacuucaucucuacaaaaauaaaaauaaaaaacuagcugggugugguggcaugugucugugguggcaugagccuguggucccagcgacucuggagguugaggugggaggauugcuugagcccgggaggucaaggcugcuuggagcuguccaugauccuaccacugcacuccggccugggugacagagcacgacccugucugaaaaaaaaaaaaaaaaaagaagaagaagaagaaaaagaauacauagcaaguuagcuagaacuaacuuguuuuugggaaacaguuuuauuuagccauucuucuaugauguacagccuauugccauguauacugagcauucauuauuagacauguaagucuagaacagauuuaucaggaagcauggaaagaacacuaggaaacaggagaucugacuucuagucuggacuuuaauuaaguaacugggccucagucccugugaacuagggcagaucaguuuauuccugaaaaccacaggauuuucaguucagcaagucaguagaaugacauggucuucuguguucacauuuuuaauuucuguucacagaaguuacaaaucaucaucaugaugugaaaaaucugggaguuauuugaacaguaagaaaauagcaugcaaauaccaucuuuauuagacauacaaaaaugaacgaacuaucauuuugcuucuuuuuaguagacccgaaaucagucauguagguaaaaucuuuucuacaguuacuucuuuggaggaauacaugugcucaugcacguccguuuccuucuuucugucucacugugugcaauaauaauaucaaucaauuuauuaaaacaacaccagaaguacacacacacacacacacacacacacauucugucucucucacacacacacacauugacucagccucauugucuuaaucuacagugaauuuaacagaguacaaaauaagauuaaucuuggaaguuaagaaaaagcugaaaaguauaaauugaggucuauaaaaugacuuugaggaaaugaaugaaagcccauuauuugaacauuuuuacuagcuaauaacaaucuaugcugucuucuacccugggaagauugaauaaccuguuaaagcacuuuuggauaacuuuuuaggauuuuaugauaauauuuauaaccuaucaucuuuguaucagaaauaaugucagucuuagagccuuagacguuugcagaucucuccucagauggaaaugcuguuuagacucuaaaucagcacuguccaguagauauauaauaugagccaaaaaugcaagccagauauauaauuaaaaauuuucuaguagcuacguauaaaaugaauagauauaagaaauuauucugaauuuuauguguauauauauauauauauguauauauauauauauauauauauauauauauauauauuuuuuuuuuuuuuuuuuuuuuuuuuuuuuuuuuugagacggagucuugcugugucucccaggcuggggugcaguggugcaaucuuggcucacugcaaccuccaccuccuggguucaagccauucccgucucugccucccgaguagcugggauuacaggcaugcgccaccacagcuggcucauuuuuguauuuuuaguagagacggcguuucaccauguuggccaggcugaucucgaacuccugaccuuaaguaaucugcccuccucggccucccaaagugcugggauuauaggcaugagccaccagaccuggccaauaauauauauauuuuuuacccaauauauaaaaaaugccauuucagcugggagcgguggcccacgccaguaauccuagcacuuugggaggccaaggcggauggaucacuugacgucaggaguucaagaccagccuggccaacauggugaaacccugucucuauuaaaaauacaaaaauuagccaggcaugguggcgggcaccuguaaucccagcuacuugggaggcuggggcaggagaguugcuugaauggggagguggaaguugcagugagucgagaucaugccauugcccuccagccuggggcacagagcaauacuaugucucaaaaaaaaaaaaaaaaccacaaaaacaaaaaacccacaaaaauauaauuucaccauguaaccauugugaaaaauuauuaaggauguauacuuacuuucuuaguacugaguccuucaaaccuccaaauccaguguuuauuuugcuuuuuccuuuuuuuuuuuuuuuuuuuugaguuggagucuugcuguguuucccaggcuggagugcagugguaugaucugagcucacugcaaccuucgccucccagguucaaacgauucuccugccucaggcugccaaguagcugggacuacaggcgccugccaccaugccuggcuaauguuuauauuuuuuaguagagaugggguuucaucauguuccccaggcuggucuugaauucuugaccuccgguaauccaccugccucaacuucccaaaguccugggauuacaggugugagccacugcacccggccaaauccaguguguauuuuucacacaucuuaauucaguagcuaaauuuuaaacaauuaaaacuaaauggaguccuacuagaacaaucaaguuguguuuaaugggaaaacauuuuacacuguuuccauuuaaaaguaaaauugaaauugauuaaauaaaauuaaaaguuaaacucagucauacuagccacauuucaagugcucaauaguuaccaauggcugguggcuacuguauuggauagcagagacauagaaucauccccaucaucagugaaagcuuuauuggacaauaaaucuuuaaaccuuucauugcagaagauuggacauauuuuguuauuuuuaaaauuuaggaucugcauaacaacauuuuagucagcaauggaccacauauaaugacaguaguccuuuaagauuaugccaaaauuuugcuguaccuuuccauguuuagguauauuuagauauacaaauacuuaccauuauguuacagucguuuguaguauucaguacaguaauaugcuguagagguuugcagccuaagagcaauagacuagaccauagagcaggggucccccaccccugggccaugguccaccauagguccguggcucauuaggaaccgggcugcacagcaggaagugaguggugggcgagugagcauuacagccugagcuccaccuccugucagaucagugguggcauuagauucucauaggagccugaacucuauugugaacugugcaugugagggaucuaagcuguacauucuuucugagagucuaaugcuugaugaucugagguggaacaguuucaucuggaaaccaucccuucuacccccagccauggaaaaauugucucucaugaaagcaaucccuggugccaaaaaaguuggggaccucugccauagagccuaggugccaaguguguaguagguucuaccaucuagguuuguguagguacacucuccaguguuugcacaaugauaaaaucaccugacucauuucucagaauguauucccguuguuaagcaagacaugaaagacaugaccauauuaauucuuacagauagucuugugauugccuaagucucacgaaauugaacuucugauuaugaagaucugugacuguuuaacucuaugguuucauuacuaguuauuugaucugacuuccccucagccccagauagauagauagauagauagauagauagauagauagauagcaugucagugucucauucugucacucugucacccaggcugcauugcaguggcacaaucauagcucacagcagccuagaacuccuagguucaagugauccuaccuccucagccucccaaguagcuaggaauauagguaugugccaauacaucuggcugauuuuuaaacuuuuuguagagaugggcgucuuacuauguugcccaggcuggucuugaacuccugggcucaagcgaucuuccugcuugggccuuccaaagcacugggaugacugguguaagccaccaugccaugccuagccagcccauucuuuuaacuuaauuaaguggccacagacuaacaucuagcaaacaauuggcuuugaaagcaaugaauuucuauaugaagcaccuuaugaauuacaaaauaaaugcacuuuauaauuuuuuucugcuaccaagaucacuguuucagacaaaagacaacauuaacacuuaagauacccauuucaguauuguaaacauaaacaacauuuggguguaaauuauuaaaggaaaaaaguugagagaagacauagaaauaguagcagaaauuuuagguuaauuuuuaauguaggcagaugaacuaacacuaaugaaagcuuuuucuccaaaggugaaccacugccacagccaccaccauuuccaccacuagcacacauacaggcaaaauauuuuauaaugcagaauaagauuuaaaaaaaaaagucaggagcaugaauaaauuaauauuauuccucucuucauuaaagggcucaaaguucauugggagcuuuuuguagcagcuugggcgcauuagaaagcugucucccauuugaaaggagaacaggaaagcacauagggaggagagguuugauuuuuggaaggcaguccuuuccuagaagaggaugauuugggucugcucugaaggaauaagaaucuguggaauaaugcuuuuugaccuuuuccucguuuggugccacccuccauggcuaccacuguuauauuuauguuuuuggguccugggaaauucacaucuucacuucugggagauaaaaaaaaaauaggguugucucaguuugguagcucaugccuguaaucacagcacuuugggaagccgagguggguggaucucuuuaguccaggaguucgagacaauccugggcaacauagugaaaccccgucuuuacaaaaaauaagaaaaaauuagccacaugugguggugcaugccuguggucccaguuguuuggcaggcugagguaggagggucacuugagcccaggagguagagguugcagugagccgagauuguaccacugcacuccagccuuggugacacagugagacccugucucaaaaaaaaaaaaaaaaaaagaaagaaaaagaaagaaaaagagguuuauuuuugaauagacuuuuacucuccacuguauguuggccgaaugcacuuucuaaauuagaugaccuguauugucaguguacccuagaacuguggucacaucucaagaaaaguccuggcuucccucuggucuggguccuccuccagcgucgugcagugaugcugaggugcauuuuugacuuugagucugagucguugaaaaauguaccuaggcgacaaaugguagaagcuuaauacuuccuacauuuuugacugaguuuuaaacaguccugaagaucauuaucuucccaccaaaccuccgauaagugcuguguaggcauuuuaaauaaaucuuacauuuuacucaaaggacuaggugguuaauucugauucuuucacaaaagggucuuccucagcuucuccuuuaauuuuuucuuuuaucuaaacuaccauuaaugugccaguaacuccaguuauacuaugcauuuuauauacaguauuucauuuaaugcucacaagaacccaaugaaguagguauuauuguuguccccauuuuacagguaaggaaggaaaggcuaaauagcguaaucaaauuuucaaaguuaugcagcuaguuaagugacacagcuggaauuugaucccaggggcuguuucauuccaggacucacuguaugaugcugcagaauaaggugauuuuaacagaauuagacacaaguggugauguaaggguaaucuaauugcauucccaaguuucacuagcuggcagggauauuguugcuuguuauugcaggccuaguuuuuuucugcuauaguuaauaguacgagauaaacauaauugaauauuucugaugaccuggggguuuaugggauauugauggugcuugacuucucuugucacagguggcuguguuacugcaacgugccacaguucugcgacagucuaccucgguacgaaaccacacagguguuugggagaacauugcuucgcucggucuucacuguuaugaggcgacaacuccuggaacaagcaagacaggaaaaagauaaacugccucuugaaaaacgaacucuaauccucacucauuucccaaaguaagggagaguuuuugcuggucuuuguuugaucccagagcuugagguugcuaaauacaaugccaaagccugcauaaauaacaagaucggaaaugacagaagaaacauuccaaggggaugggagaaaagacccucaguucccuuugugaaucuucuuggguauuuuccaguccauuuauuagccugacuuuggguugacugccgucauugcucccuuauccccuccucguccuaccugagucauugucucugacucacauagaauggggcagugcuuucuuuuguauauucagcggccaggaagcucuaggacgaugagggagaauguuuagguacauuuuccagccacucagaaauggugcaaaagagcucaaguggcuuuuuuuuuuuuuuccguucaauuucuccaacuuuuuccaagcacuggugaaccaucccugccucagcuauaguagacuugcccccacucuuuggaaacuagacugcaaaagcagggaugaagaggaauagagagcuccuucagcgugaugaaccucuauacuaaauuucuuguagaauaggcauacuuuggugcuccuugcuucuugcaccugucagagcuccaaggcauaaaugaucauuuaaauauuuuaaauggaaggaaaugcugcaaagcaauagaaaguugcagugcugcaccauuggccuuggaaaugcauuuuuaaugcuaaaaaccaaaaauuuaagcuaagcgguuggaugcuggugggauaggccaagggugcaguugaugacuucucauggagcaguaacagcgagaaaugaaugagacaguucauucugugauuaucauuccgccuagaucagcgcuuggucaggaagguaaaaggcguaauuugaaaaggcuggcuagguaugauauagccuuccuuccccaugccauucugaacugcugauguagagaauagaauuugagaggaaauauucuuugaucaaagauugaugaaacacuguuuuguuugagaaacuagauuuuuauuauucagauaguguuauuagauuauggaauuuuugucucagugaagauagaguuuuaauucauaacaauaaguuagguucaaaacaacaaaaauaaaaugguuuucugacagaaauugacugaagauuccuuggcaguuuaacccaaauccuaaaccuuagauagaugucauggguaauucugaugggcuuuggccaaacacccaauauuugcacauauauuucaacaaccugauugucaaauuuuucuuuagagaaccaguacaugagacuaagucaugacaugaacauuuuguuguccucuguggagggagauucugaagcacuuaaacugcaguuuggauguugcucccaaaauggguuaugaaauuagggcacacucauguauuucagugucuuuuaacugauguaagcuccuuuccuuagagauugaagcaguuuucuuacuuauguaucuauuacauuugccauauaagcagcauuuuauguuuucagguaauaguugucauucugucucugagucaagguacaaagaagacuccucccuucccaacaccuguuaugguauuuaaagagaaauuuuaguuacuuugcauaauaaauuuuuuucccauaacaaauucauuuugcuucuugcagguauuugcuaauuauaguguguuuuguucccucagcccauaguucuggcaugcuuaugcuaggagcuaaaacaucaaugcugccuucuuuucuucucuauuacuaauggugggguaaaacuaccacccacuucuccuuuuaaauccuuuucaccgaauaugacaacauuuaaggcuauuggggauuuauaccuacaguuuuggcagcagaaccacacauguugaagccugagguauuauuugagucuugggcacuguuucagagugagagcugggaccggcuucccagcacccagggaggucucugcaauucucagauguguuuucagggcuuacauucuuaucuuccuauucuucauaugugcugccuuuuuuuccacuuggcuuuaaugugugccucuuuccccauucaccuauuuacaaaguguuuuuguuuuuguuuuuaaguuguguaucuauauuucauucuaaaagugaagaaaauuugguucagggaaaaaaugaagaagaccacugauagcuucaccacucugaacuauuuuuagugcuuuuaguuauuucuguuuuucucccauuuauuggugaaaaaaauucaguaagccucagagggacuuagguaucuguauuucuuuucucuuuuuuucucuuuuaauuuuuuauucuuuuuaaaucaccugcccuauucugauaagcaucuguauuucuaauaagguuuccagaugauuucuauggguugccaaaacuugagauccauuuaguuuaaaguuagcauaguaauuaaucacugguuccaauccugauccugccauuuacuaguugugggaauuugaucuaaauauuucacuucucugugcccuaguuucuucaucugugaaauggguaugaauuuuaucucauagggucguuauaaagaucaagugaguuaauauacaucaaccacuuacaacacugccuaucauguaguaagagcuauauaugugcgugacaaauaaaaauagaauauauaacucauaggguugaugugaggauucaguaagaaguucuuagagcagugcaggcacaaagcaagcacucgauaaauauuaguaacuuuuaugaugguaaugacagugacagugcagcuauauggagggcugaaaucgugcucugagauucacugaggaagauuaaugcauuucuacugauguaauucauaugucuguauccugugcuguguuaagcuaugcagggucaaaagaguaaacauuuguauaaaugcauuucuguauuugaauauaccagggcugcccaacuaaaucauaauuugaguuguaauucuccauuauauuucugauugaagguuugagacgcugauguuaaggugauugucacagauaauuagggcuguuauccuuacaguaguuuuuuuuuaaucuuauugcuauuacucuugugucuagauuucuguccaugcuagaagaagaaguauauagucaaaacucucccaucugggaucaggauuuucucucagccucuuccagaaccagccagcuaggcauccaaacagguaaguuuccuuuuacaugaaucagagaacaaccagggaggccaaccugaaguguaaguugcaguucacugcaacuuauacuuagcucuauagucaaaugagcuuagcucuauagucaaaugcuggcuauuuucaaacccaauuauagucucagucgauggcuagauacaccuaggaaucaagucucagucugaccucuuaaucuaugaugucuguuuuauacaucaaguuaccaccagguauaaugguggauagugagugaaagcggcagucuugagucucaggaugugaacuacuucccuguggggcagggcauccuugcuauugcuuaaaucagccaguggcaucaguuggcauuuugugaggaaggaagacagaugccuucuggagucgcagugaucccagaaagaggaucugaauuccugccuuugacacuaggaagacuccauggagagguuuggcaagaaaugccaaagcaguuuauaucuggccauggggaaagacaggaugcaaaauuuugacgucaagaguuuuuuguagugcucuaggucaauguguauuaugggggcuugugaguauugccucuaaugccuccagcaaagaaaaaaugauuuauucuugcuuuaaaaacaaaauugaaguauaauuuauauauaguaaaauguacucuuuuuacuguacuguguuuugacaaacacauauacuugaguaaugaccacugccaucaaaauauagaacaguggccuccuuccagacagauugccuuguacuucucuauagugcauucauaguccuaccuccagcucugggaaccagugaucuguguuuuuguucuuacaguuuugccuuuuccagaaugucauaggaguggaaucauauaguagauagcuuuuugagacugauaacuuuaauucagcauaaugcauuugagaggugauuuuugaaaaagguuuucaucugaaccucaaguuuagguguaaauauaacuaaaucccuacaaaccaaaguacuagugaaugaggaauuuuauuugaaucauacucuuuuuguuugagcucauuaccaaaaacaugucaaaaacaucuuuguguccuuuuuuuuuuucuaaccugagaucguaauuucauguaucucugguccaaaaccuguagugcuuuggggccugucugugccuauuacauguuucuucuacaguugagcaguuagcauuuaguggacauguuuucugugguuacuggacauauccuuugcauugcucccucuguaccugugcuauucacuuuaccuuggauuugaucucaccuaacuuucaaauggcauuucuucugcaaacucuucccuaaguucucccauccccucuagcaaggacuggaucucuuuucuuccagacuuucauagagccuugaauauauccuauccaugguucucaaacauggcagcacaauggaaucacccauggaauuugaaaugcacuguauacuguuuucugagugccauuccaagagagugugagauuauuguccugggguguggccuggacauugggacuuuuaaaaagcuccccagguaauuuuaauaugcagcaacauuugagaaugacuguguuagacaauucucaccucauauuauccuagccccuuuuuuucuguaugucuuuucaucuccugugaaugcagcuuuuugauggucagagacccaguuuugucacaauaauugauacauuuauuaagugcucagcuaagaugcuuccuugguaucuaagccuuuucacaaacccugggaaguuggaauuaugaucuccuuuacauaguugaggaaauagaagcucagggaggagcaacaaauugcccaagauagaccuuguaagugauggaauuggguuucacauccguaucuaauuccuaaauauuacacuguauuaagagagccagaacucuaaccacuacaucacaccaucuuggugugugcugccaauauacagcauacacuuguggaaggaaugagugaagaacaguuuccucccucaggcagugggggaccaaaguuauucagcaggaucaacauaguucuccuguggugggucuguggagaggauuucugugugugaaaacuccccuugacccuuguuugcucaaaauucuccagucugcucaacuuccagccacauuguuaucugucauaguacaggauggagaaggaagagguuguugccugugacccuaugggaauuuuauucguuuuucuguggcuaagguugucaccaaguuaaguuggcguguacacuuuaguauuaccugaagccaucagaagugggcugucuucucuuguucuacuguaauugcaauguguucucuugggggaacagaagaguguaaucaucuacuuaauuagcaugucugcguaucgaugcaacugugauaaaugacauucauaaggaugaaccugaaauuuuacaagauacucagaugucuucugaaucaccagagcuuucucuuuguucagaaucacuccaguaugcuuugaaauucagaaggccuauauauugggagaaaaaaacauagagccuggcacuuuaguauauucugauuuuugacaaaccacuggcuauucaguuagaagugcuauggguugguaucucucuugcuugguuuacuuauuuuauugccuucuuggcugcugggaauguccuuguugacugaacuguggcuguguugaaacguagaugaacguucucucugacaauugucuguacugccaugcuguguccuguaugugaccaguguuauugagaaugucuguaccccuugucaccucucaccucaucagcuaccagucagcaacacagcuagcaaagcagcauccuacuuuguacaauggccuuuucuaaaauacaaaauagucccuuuuuguuuggaaauacugucaaacucacagaguuacaagaagaggacaaagaaauccuguauauuuucaguagaguuacaagaaggugacagagaaauccuguguauuuuauaugcuuuaccugguuauaaaccaauuguuaacauuuugccauccuugcuuuauuauuacccuuucucuaucccuucuuuuucucuuuaauucucuccacucuuccccuaaguuauuuacauguauauauaaaaaaaaauuuaggagaaaaaaauuaaauauauauaaaauauauuauauaguuuaaauuuauauauaauauacuauauauuuacauauguaaauauguaaauauauuuacauuuuuacaaaaauauguaaauauauuauuuauauauaaauaaauaauuauuuauauauagguauauauauuuucuccuaaauuuguguguguguguguguguguguguguguguauguguguguauauguauauauaaaacuuaggggaagaguagagagagagaaaaaaagagaaagagagcuauauaggccaggcgugguggcugacaccuguaaucccagcacuaugggaggcuuaggugggcggaucaccugaggucaggaguuugaguuugagaccagccugcucaacauggcaaaaccucaucucuacuaaaaauacaaaaaguagcugggaguuguggcaggcaccuguaaucucagcuacucgggaggcugaggcaggagaauagcuugaaccggggaggcagaggagguugcagugagccaagauugcaccacugcacuccagccugggcgacaaaagcgaaacuuugucucaaaaaaaaaaaaaaaaaaaaagagagagagcgaacuauauauauaauauauauauuuauacguuauauauaaauacaaauauauauuauauauauuuuuucuccuaaauuaguugaaaguuacaaacaucaugccccuuuaguaauuuugaugucucucauguauucucuaacauaaaaacuauaguuuucugucagcaaauguaacauugauauaguauaguuaccuaagcuauaugcugucuucuguuuuugccucuugucucaauaaugugguuuauugcaauuuuuccauugcaucaggaggcauaugauguuggcuugucccaucauuguugguauuaaguuugaucacaugguucuggugguggucaccagcuuucuccacugcaguauuaccaccuuuccuuuuuaaucaaaaaaauacuuuuguggggagauauuuugagacuguauaaauaucuugucuucaucaaaauuauacucacagguuuuagccuacacacaugaacuuccccaaaucaguuaucauaugguggcugccaaauagugauuuuuuuuuuuuuuuuuuacuaacuaccauaacuccguccuuauuucuuuguugguguucuugagcuuuucucaucuccacuaauuuauuuauguauucauuuauuauuuuaucaauauagacucagauauccuuauucuauuuaaugaguuauagucccugcugucuuuacuauuuugaugccuuguggcuuauguuuuaaagaugacuuauuuuguggcauugggcaggagugggguggucccaugugcacuucguuucuuguuaccuaagaaaggagucagucaucuaacaccuucuucuccuuuugccggggcaguuaucaauccaccuccuguggcugggacaauuucauacaauucaaccucaucuucccuugagcagccaaacgcagggagcagcaguccugccugcaaagccucuucuggacuugaggcaaacccagguaagcucuuaagaggggauaagagagggcugugacuugcuccaggagcuccauuaccugaggagugcaaaagguagacuugaaccaaguacagauugugcauguccaggauuuuaacagcuagaaauaacuuuguauuaggcuuuuggcuguacugguuaguuauugcuaucuuaaaacuguaauaacuuauugucauagcucacucauuugguguguugccugagaguuggcugauuucagcuagucucacucaaucuuggcugggcuugguugcaaguuacccauugauuauaaucucuguuuugggcuuggcuuggcuagagcacuuaagcugaagcaacucugcuucacauauuucucauaauuuuccugggacuauugggcuacccggaacauguccuucuugugaugagagagggcaggaagaaauacacagucucuugaagccuaggcuuggaacuuguaaaccaucacuucugccacauucuuuuuuuuuuuccuuuucuuuucuuuuuauuugagacagagucucacacugucacccuggcuggagugcaguggugugaucucagcucacugcaaccucugccuccuggguuuaagugacucuccugccucagucuccugaguagcugggauuacaggugcccaccaucaugcccugcuaauuuuuguauuuuugguggagauggguuuuugccauauuggucaggcuggucucaaacuccugaccucagguaaucuaccugucucggccucccaaagugcugggauuauaggugugagccaccauacccugcugacuucugccucauucugucguccaaagcaagucacguaguugaacucagaguugagagguggagaaguggaaaaagguagucuauuccuuucguaggaauaacugcaaagucacauagcaaagaguguagauaccaggaggguaaagaauuuggccauuaauguaaucuaccacaugggcaaaaauaucucuugagccuagaagcauuucacaguuagagaauguuuugaagguugcauuucuguccacagacuugacgucagacaaaucuuggaugugaccaaauuuuuaaauaaaagaaguaccaugaaagagggaaagaagaggaccuuauaauauaagaagugccauauauuuagcauaugccaccauucccuuucacuuccaagggagauaucacuaauucaugcagaaacucuuuaccagugagcuuggauucagccucagacuuuuuaaaaaaaaucauaaacaccauuagcagucuaacaagcagagggcauaucaaguacaaaccccagcuacgaaauaaauaguuuucagcauuacucuuagggaaucauggaauuugaggacuuauuggucagaugucugaaaauauuguuacuugucuccaaaaacaaacaacaaaaaauuguaaaaaaaagaacucgacaaaagugauuuaguaaauaauauguaauacuucuggaagaaucgucuacagucaaguuacuuuauacuguucugcuccuuuucaacuagagauagugagaaugcuauguggagaauguuauauugagauagcagugggauucacaugugaggaaauaaauuagaucuagacaucuuaaaaauucaaaaaauuuacuuguaaaaauaaauacauguuaugucuggaaaaaacuggaaaaaccaaacaugagaauagaaaggagaaaaaaacuaccaugcaaucucaugaggaaagcggaagaaaguucucucugccuuugcauggcucuccuauuguguggaauggugagauugcaucuacuugauaggcuagugguccugcucacuuugugaggcaucauuuuagggcaaaaaagcauuguaaaagauaaagugugucauuuuauaauagaaaauuaaauccauaaauuuguuuauuaaaaauaauuuaugguauauuucaaauauauagcuauauauacauaauauauaugcauacauacacauaugcauauguguguguguguguguguguguguguguguguguguguguguguguguguauagccaagcccagcacagagauuccaaucaguggguagacucaugaacaagccugccaagauugaaugagaugagcugaaaucagccacccaucaggaaacauacgaaaugaaugagcuaugauaguaaguuauuaugguuuaagacucauuugggguugguuuauuacauagcaauaacuaaccaauaaagcccaaagccuaaugcaaacugauuuccguacauauaugguggggugccggugggggcgggguggaauuaacaugacuacaaggagaaauaaucaaaucaaccaacgguugaggcuuuaaacaaacaacugaguaauucauaggucaaacagacaaaaauaucaguaaggcucuuacugauauccauacaacaugaucuguaagcugaagcuaauggaguuauagagaucaaaauaugaaaauacacauucuuuccaagaagacacugcacauuuacaaaagauuggucuuauuuuaggucauaagguaaaaauuucaauccauuuugacguuuuggugucauauggaccauguucucugaccuugaagagacuauauuagagaguacuaacaaacaauagcuagaaucaccccuuugcauuugcagaugaaggaacaugugccuuaauauuucauguaucuaguuaaaaaucaucauagaaaguagaaaauauucacaaugaauuggguuggcaguuauugugagcucacaauggcucucuuuccugucuuccuuugucaccccuuccccuggugguaaagauagaguugaccuccaugcccaucaaugcuguuagaaaauuaguuggcguguauuauuuguuuuguguuuagaaccacccauuguuugccuuuuauuuugaucaucauaggagaaaagaggaaaaugacugauucucauguucuggaggaggccaagaaaccccgaguuaugggggauauuccgauggaauuaaucaacgagguuaugucuaccaucacggacccugcagcaaugcuuggaccagaggucagcaggguaaaccugggcagccagcugguagaccucuucugcucuccuggccacuccagcugucagaaguggggaugcuaaugcugagaguuaacauguuaugcuacccugguuugcauuuaaccugguggucaguguggagagggcaggaacaacugaucaagagguaauuccccuugaugaauaucacaucacagguccacuuacuaauaaucucacaguugaaggcaucauucccagcuuuuuaucuugaaaaauuucaagcccucauaaauguugcagaaauucuguaauaaaaauccauagacucuuuacugagauucagcaguuaacauuaugccacauuugcuaccucucuuucucucugcgccuccccauaugcucuuuuucuuucucuccccacuccccaugaaccauuuggaaccauuucagaauuaaaaacacaugucauaauacuucaccccuaacuauuuuugcauguacuguaucucauaaggaagcuauucucuuacauaaccacaaugcagucauuacucuuagaaaauuuagccugguuacaauauuuucuaauacaggguuggugaauuacagccugcaagccaaaucugcuccacuggcuguuuuuuucaaauaaaguuuuauugaaacauauuguuugcagcugucuuugcauuacaacaguaaauuugaauaauugagacagggaauguguggcuugcaaaguaugaaauauuuauuaucuggcuuuucacugaaaaguuugcugaccucuggccuaauauaaaaccguauuuaaauuucccauauagccagaugaugucaguuauaaccuuuguuguuguugaaggaucaguuagggauugugcauugcauuuaauucuuaucucuucauuuguuuagucuccuuuaaaacaacuccccagccuuguuuuggucuuuugcagcacugccauuggugaagagucuuggucgcuaguuuuguauaaggucccucuuuuuggauuuguugauuguuuacuaaggauuagauucaaguaaggcauuuuugguaaaaaugcugcugucaucucauugccuugcaucugagggcaugcaaggcaaugacauuucuuaagacauaccugucuuaagacauuucugacagcuuccaggaaaugaagaaauggcuuggagauuauauuacaguguuaauuuucaauuugucauguuucuuuaaauauuuauuuuaugacauugaggauacuucagagaaccagaauguuguaauagaaaaaucucuuccuaaaauugaucuuuccauuuccuccuagauguccagucugugagggcuuaagacuauaguuuuuuagggauuuaguaacauuacagauuagcugaguuuagguuuuuuucagcuauaaaauggggauuuguacuagucuauugcauugcuacaaagaaauaccugagacuggguaauuuauuuuuuuaaaaaagagcuuuaauuggcucacaguuccacagacuguacaagaauggcaucagcaucugcucagcuucuggggaggccucagggaacuuauacucauggugcagggugaagugggagcaggcacaucacauggugagagagggaacaagagagugaggaggaggagccagaccccuuuaaaccaccaaaucucauaugaacuaacugagcaauaacucauucaucaacaaggggauggugcuaggccauucaugaggggucugcccugaugauccaacacuucccacuaggccccaccuccaacauuggagauugcauuucagcaugagauuuggaggggucacacauucaaacuacaucaggaugcagucacauguuugaaaauauuuuggauauauuaauauuuaguaguguacuagagcuggcuuguacuggaaugcacaagaaaauuguuaaauuuucaggaguuuugugagcugguuguuccauauguugguagcuugaaguugacuagcauggcaccugguuaccuggauagccaguucuggacuaaugagaugaagugucaccaguuagggccuuccuuccuugaagagcuguuuguggagcaucuacuugcaaaccacuaggcagauuaaauaagauggggagcauaagugcuggcacaugguugugcuuccagcuaugguugaguguaggucaacagauauucucuggaaagaaaacuguucuuuaaaaagagguguuaagaauauauacaugaggccgggcgcgguggcucagccuguaaucccagcacuuugggaggccgaggcgggcagaucacgaggucaggagaucgagaccaucuuggcuaacacggugaaaccccgucucuacuaaaaaauacaaaaaauuagcugggcgccguggcaggcuccagaggcugaggcaggagaauggcaugaacccgggaggcggagcuugcagugagcugagauagcgccacugcagucuggccugggcgaaagagcgagacuccgucucagaaaaaaaaaaaaaaaaaaagaauauauacaugagugcuacuauugggccuguaaugagaauuugaaucugucaucucaaggguccuuaaagcucagcuggagaggauuccuugaagccagagguuggcaaacuauaacccacaggccacauuuugucugcuuacuguauuuuuaaauaaaguuuuauuggaacaguacugcacccauucuuuaacauauugucuguggaugcuuuugcauuauagcagaagaaggaguaguugugacaaacaccuuauggcucacaacgucuaaaauauuuucuaucuggcccuucacagaaaacuuugcuggccccuaaucuacacugaauaucauccguguacacauauaauacuccaauuucucaaaaugcuuuaccugccuuuucugucuugucuucauaacuuguauguguaugugucucuguguguaugugugcacacauguguauuuaggacucugaaaauccacaaauguguaucuuauuagaacaaagaugagaagcuuggaugugucccauccccacugucuugagagaauagcucuguguaauuuuuuccugucucuugcaucucagaccaauuuucugucagcacacucggccagggaugaggcggcaagguuggaagagcgcagggguguaauugaauuucacgugguuggcaauucccucaaccagaaaccaaacaagaagauccugauguggcugguuggccuacagaacguuuucucccaccagcugccccgaaugccaaaagaauacaucacacggcucgucuuugacccguaagugguacuuucuguuccuucuuccuuauuuccuuuuuaaaugaaagaggaacugcuuagauagugaaagucagccauagucauccaccgaauacuacugcaccugucuugcuguggauacagagcuucaccaagcugauuuucaugucugaaagugcuaagaguaauuuucaacaauuuacaaauuuucuuguuaaugaugaugaaacuuuauauuuuacauugcugaugacucuccugugcuucauucuuuauagcagugagagaauguaacacuaagauguucugcuuucuucauaaucaaaauauugguuuugguaucuuaacuaggugccauuauugcccaggucugugggcaauuauugggauauaagacagguuaacuuugaaaauccauugcuuaaaaaaaaaaaacaaaaaacuaggccgggcaugguggcucaugccuguaaucccagcauuuugggaggcugaggugggaggaucaccugagguugagaguuugugaccagccugaccaacauggagaaaccccgucucuacuaaaaauacaaaauuagccaggccuggugacacaugccuguaaucacggcuacuugggaggcugaggcaggagaauugcuugaacccaggaggcggagguuguggugagccgagaccgugccauugcacuccagccugggcaacagagcgaaacuccauuucaaaaaaaaaaaaaaaaaaacccacgaaacccuaaagaacuaaacuucucuaauugaauuuauuuuaacauacauagcccaguagccuauggggacugugauccaugccugugacaauucagagugaugcuuuagacagagggaaggauuccauaaugcggaauuuugcaaauuguauauguaaauuuuaaauucuuuuucauaauguuucuguaauauuuuggaguaagacuuaacucuucagagacacauaccauguuuguccaugacuuccugcucucccugaccccuccuuggcacuggcugugccaguuccagagcaccucugcacauacucuguucucuauuuguaaaccucaggcacuucuuaggugacugguauuuuguucugaugggagugcugaugacaucuugugcaggcgaccuagcucuaaaaaguucagauaaaaggauggucuagcgagauaggggcuacaugaaggaaguuucuauagaaacuuaggacaugucccucuuucuuaguugguuaauaaggaacaccccaaaaaguauauuuauauaacuaggauagguaaaacuuugacauaaucuuauucuuucaggaaacacaaaacccuugcuuuaauuaaagauggccguguuauuggugguaucuguuuccguauguucccaucucaaggauucacagagauugucuucugugcuguaaccucaaaugagcaagucaagguaaggguaaacccaaggucuuagaagaagagcagaauguggggcuucucacuaaggccugcagagcuugggaagaucucucugugccauguccagagaagguucaaaguggaguuaaggacuuucugggaauaguccucucacuccaauggucuccaaccuuuuuggcaccagggacugguuucacggaagacaauuuuuccacgggucagauuagggcuaugauuuugggaugaaacuguuccagcucagaucaucaggcauuaguuagauucucauaaggagcaugcaaccuagaucccuugcacgcauaguucacaaugggguuugcacuccuaugagagucuagugccaccacugaucugacaggaggcagagcucaggcgguaaugcucacuugccugccacucaccucgugcugugcagcccggucccuaacaggccacggacugguaauggucuagggguuggggaccucugucucacugugaguguauguguaugugugugaggagaguaagugguuucaccuaccaacaaguaggguuguaccaaggcuuuguuggacuuuggggcgagguaccaggauacuguacaaguucaauauguaacucaaguguagucgauagcaaaugaagggauauuugaaaaauagaucucaguguucauuguuaauuuacacauacacgcaaacauguaaucacaauuagugacacugaacuacuggaaaggauaugguuaauguggauuagaaagaugauuuaggcagcuuacacuucagaaagauuucuuaugaccuugucccuaagggaaaacaaggacuaaggaaauucuuuaagggaagucaugaaauucuauaagggaagucauguaaauuuaugaauaaauuucagaaguuauuccuguaggguuuggcauguguuggagugucuuuuuguuuuguuuuguuuuuuuuuguugcuaauuuaucuucccaguugucuuuggcuuaggucccuuccuuuccaggaacuguguccauguuuuauugguauugcaguuggugucgcagucuggcgagaauaaaccagacucugaauugacagaaagagcucucaucuauaccuuguccuguucuacuuucuugcuuuuaagaaaagggaaccagaaaacauguccuuagaauguuauucauuuagggcugggcaguggcucacaccuguaauccuagcacuuugggaggccaagguggguggaucuccugagaucaggaguuugagaccagccugaccaaugugguaaaacccugucucuacuaaaaauacaaaauuagcuuggugugguggcacaugcccguagucccagcugcuugggaggcugaggcaggaaaauugcuugaacccgggaggcggagguugcagugagccaagaucacagcacugcacuccagccugggcaaugagagcgaaacuccaucucaaaaaaaaaaaaaaaaaaaaaagaauguuauucauuuaggauuuucauggguggacuaaagauuagcagcuccggaugauuaagauggcugcugagaaaaauuauuggaaggucuaaagcaauguguccaauagaaauauaaagcagccugcaaauaugagguuauaaaagcacacauauuaugugcuuuuaaauuuucuaguaguuauauguauauauuuuuaaaaaagcaaguggaauccagugagauuaauuuuggaaauuuauuuuacccauauauccaaaguauuaauauaacugcaacaggcauucaaugucacgaagaauuauggagaccuuuuacauuacauucuuuguucuguacugucuuuuuuuuuuuuuuuuugagacagguucacacucuguugcccaggcuggagugcaguggugugaucuuggcucacugcaaccaccgccucauggguucaagugauucucccaccucagccucaugcguagcugggaacuauaggcacaugccaccaugcccggccaauuuuuguauuuuuaguagagaugagguuucgccauguuggccaggcugguccugaacuccugaccucaggugaucugcccucccuggucuccccaagugcugagauuacaaacaugagcaaccacacccagccuuauacuaacucuuugaaaccaagcauguauuuuacauuuauaacacaucucaauuuagacaagcugccuuucaagugcuugauaggcacguguggccaguggcuccuguauuggacagugcuggucuaaguauuuuguugacuccuucagcuucaaagaagcaauaccauuuacagaaaccaaaaguaagucccugaaaggaaucauucucugcauuaggggcacagccugggcuauugguacuuuagcuuucauuaacagcuucacucucuggucacaguacccauuuuuuaaaauuauuauuauuauuauuauuauuuugagacagagucuugcucuuuugcucuggcuggaaugcagugaugugaucugcucacugcaaccuccgccuccuggguucaagugauucuuaugccacagccaccugaguagccgggauuacaggcgugagccaccacgcccggccucagcacgaauuauagcugcugcaauguauuuauucucacaaagcacaaguggagcuuuuugucuucgacuccuagcacuaagcaucaaagggcaaaugcaauucagcagucuuacauucaucauucugacuggggaaggugaagacccacauuugcuugaaacugaucucuggcucauuuucaaggaauucugacagugugucuuuagauggugcuguugcuguguuuaucauuauucuccgcuagccaaagugacaaauguccagauguuuccaaauguucaaaguuuaagaacuuacuuaaaggaaaauuuuauuuggcuuuucuuagggugaagaccuggaaaauaugcccuugguuuguaauuuuagaaaaagauggcguaauuuuuauuuucaaagauagcuauaccaaacaccuuguuuggaaaugcugauuaagguugaguuggacacuuuuagggauacuaaagggaaacugaagguauuuaauacgaauuggauacuuugucuuauuacuucccagaaaggcaauucccccccauaaccauguaauuuucuaaagacuugaaggaagguggccaagcaucacaaacucagaaggaagaacaagaaaagcaaucacuucuuguaagugacuugaaacuguaguuuuagaaaaugaagauaaugaagauuagucuuucaaaacaaaauagaauggaugaguuuagugugugugugugugugcgugcauguguguguuuuuuaaugguaagaacgugugugugugugcaugcgugcguguguguguguguucuaaugguaagaaccaaucuuuaguagaaguaagaaugugagaaacaguucuuccuuuaguuuccuggccuuuuuuuuuuuuuuuuuuuuuugagacggaguuuugcucuuguugcccaggcuggagugcaauggcgugaucucggcucacugcaaacuccgccuccuggguucuggugauucuccugccucagccucccgaguagcugggauuacaggugucagccaccaugcccggcuaauuuuuguauuuuuaacagaaaugguguuucaucacguuggccaggcuggucucaaacuccugaccucaggugaucgccugcuucggccucccaaagugcugggauuacaguugugagccacugugcccagccaauuuccugaucuuuuuacuguccugugucauuaaugauuaaugaacaacuuuugagacaucacacugcccaagauauuuacauuuucacuggcguauagucuaagauaaagauugcugagcucugccaacccagcaacacuagacaacauggaagcacuucuucaauauggaguaaaacugaaugggucccaguggcuauagcauauauuacugaagacagcaaauucauaagcagagguuuuauuuuuauuuuaauuuuuuaauuuuuugagaugggguuuugcucuguugcccaggcuggagugcaguggcaugaucacagcucccugcgucugcgaccuccugugcucagguaauccuccuaccucagcauucugaguaguugggaucacagaugugcaccaccaugccuggcuaauuuauuuuuuguagagauagggucucccuguguugcccaggcuggucuugaacuccuggucucaagagauccucccuccuuggccccccaaagugcugagauuauaggcgugagccauugugcccaaccauaaacagacguuuuaaguauuuauuuacuauauuaaaaaucuuggcuaaauggcacuuuaaaaucuguauauggucauuuuggagaaucaugcugauaaauuccugugaauucuuuaaauuagauuuuuauguggauuuauugugcugaaaacacaagauaacauaugagaauuuauuugaagcuccucuccugauuuuggaauauccuguaaucuaaaaacaauuugggccaggcgugguggcucacaccuguaaucccagcacuuugggaggcugaggcgggcggaucaccugagguugggaguuugagaccagccugaccaacauggugaaaccccaucucuaccaaaaauacaaaauuagcugggugugguggugcaugccuguaaucccagcuacucagaggcugaggcaggagaaucacuugaacccaggaaguggagguugcggugagccaagauugugcuauugcacuucagccugggcaacaagagugaaacuccaucucaaaagaaaaaaauauugaauuugauauuauauacagcuuuaaaauuauguagcuaauguuuauuuaccauaauagguauuuaaauaaacacugaaguuaccagauaguuagaaaaugauccuuuugauggcagguaaaaauaaagguguacaaacaaggggaaauaggucugggguuaaaaucuaaauaaacauuugcuuauaauagcuuuauguugucacugccucucuaaccaaggcaguacuuaaacuaccaugacugcuagucacaaauacuagcuagauacagaggaaguucaaguuaaaagacacagcccuuucucacaagcaacuuggaaucuggaaaagauuuuuggagagauggcaaauuuguggucacugaugaaaaauaucuuaugcagguuuugagaagcuauuuaccaaagaaccauuguuguucuugaguaaaauuaauuggauuauggaugaaggguacaaauuuauaguuucuauuaacuccuuacaagauggugcauacaacaaucucucuugcaucgacauccguguuaaagugaauuucauuagaagacacauuucuuacuaauuuuuagacauuacuuuuccugugcacaugcaauucacuccaacuggccaaccauuugcuuuccucuaguuaaaaaaauuuuuuuagaaauaauuuuuaauuauguaagacauauacaaaugcguuuucagauaaaacaaaaaucccauuuccccuucccacuaccauccugcuauuuuugucagcuugguacgcauccuuccagguacuuugguauugacacauauauuggaacuuacugaacuuacagguaagaggugacuguguguuuuguuguugcuuuuuucccauuuaaauaaauggaauucauauuguaugcauugcauuacuggaaaaaaacuuuacauuguccuagagaccuuucagcuuuagugcauauaugugauuguuuaaauuuguauuuagauaccuuaaauuaaaaugaauauuuacauccuugguuacucagguacucaguagcuacaugugacuaauauuaccauauuggauagcauagauaaagaacauuuccauaauugcaggaauuucuauuaaugcugauauauagcuacuuuauucuuuuuauacaguauuuuauaauauggaugcaccauaauuuauguaaucauuucucuauugaagacauauuugcuuauuucugguaauuuucuaucaucagcaauguucuguuuggaaauguuuccuuagacacugagaagcagaauuccuauaugaaugaauauggccggucuaaauuuaaaaaauuauuuccagauugucuucucagugggucucccaguuuacauuuuucaccagugguguuggagagaauaguucccccuaccauugcuggcacuggguacauaaacuguaaacguauuugcacgccgucaagugcaauauuucauuuuaugguagagcgcucugaucacuauugaggucgaacauaucucuuauauuuacugguaauauuuauucuuguucuagccuuugacaaauuuucuuuuauucuaucucuuuuuuguauugauucuauagaagauauuuauguauuuuugauauuaaaucuuuguaauauauguugcaacuacacccccccucacuugucauuugucuuuuguuuaugguaucuuugauuacuuauggugccuugaagacguuuuaaaauuugaaguauucuacuuaauaaucagucuuuuacuucaugcuuuugcauuuuauuuuuucuuuaagaagccuuuuuguaucccuaaguuauaugcccacuuuuccuauaucuuuuuauaauacuuuuguaaagguuuauuuuaccuuacauuuagauuucuaauccauuuccuucucuuguuuucaauuugacaagcucuuuuaaggccuagcuuaaacauuuccuuuuccucuauucgucuucucuuuaccaccuugauuauggucuuuuucacuaucguuuuguuuuguuguuuuuguuguuguuguuguuugagacggagucucgcucugucgccaggcuggagugcguuggcgcgaucucagcucagaucuuggcucacagcaaccuccgacucccugguucaugccguucuccugccucagccucccgaguagcugggauuacaggcacgugccaccacgcccagcuaauuuuuguauuuuuaguagagaugggguuucaccauguuguucaggauggucucgaucuccugaccucaugauccgcccaccucagccucccaaagugcugggauuauaggcgugagccacuaggauuauaggccaccgcgcccagcccacuauugaagauacaaauauaucacucuguacaaaugcugcauaacaggaauguaaugcaggccucaaaugcaagucacauaaguaauuucaaaauuuugaguagccauauuuaaaaaagugaaaagaaacaggugaaauuaauuuugacuuuuuuuuacuuaauaugucuaaaauuauugucauaucaacauguaauaaguauaaaauguuaguaaugagaauuuuuuuccuaguguguuuuuauacuucaggacauuucaaacuggacuagucucauaucaauugcucaguagccacaugaggcuagugucuacucuguugaauaguauaccucuauacacauguguuuauauguuuaucuuccccauuuuacuaucgucuccucaaggagagaaauaguucauuuguguuuuuauccaaguuuuauucaaacucucaguguucaguauugugauauguuugggaaaaguuaaaagcuaaaaugucuuugggugacaucaauggaagaauaauuugcagaagagggagaugaugauacuguucuguuuacuagacauaccguccccuuauuauuaugcuugguccuaggauccaugcuuuagaaaggcauuguuauauuagaaaaaacuccgaaaaaagugauuaguggccgggcgcgguggcucacgccuguaaucccagcacuuugggaggccgagacgggcagaucacaaggucaggagaucgagacuauccuggcuaacacagugaaaccccgucucuacuaaaaauacaaaaaauuagccaggugugguggcgggcaccuguagucccaguuauucgggaggcugaggcaggagaaugguauuaaccugggaggcagagcuugcagugacccgagaucgugccacugcacuccagccugggugacagagcaagacuccaucucaaaaaaaaaaaaauaaaaaccaaagugauuaguuugauaaggugucauucagucaugccauaugaggaaugacuauagccuugauggugcuuggcuugggacugggaaaguacggaugggcaugugugagagagcauaaucuucaaaggcuugaagggcuguuaaaagcaggaaugagucuuuguaacucuaggaguagaacuaaggucaauaaguagaaauaacaaugaccagaucuugggugaacguuaggaaggaauucccaacuauaugaugccugaaaaugaauuggucuaucucaccaccaaggaauuggccuacguuggcgguguucuagcagauugccuuuucaugauagauggcaaaagaccucuagccucauauggauuaggggguuagauagaaugacuuccaaagauccuucugaccuugagguacugugauuccaugagaucauaccugggaauauauuugaguucuuuagaaaaaugugccaccaaauugcagaaaauuuaugugaagauauuugggucuggacacuuggauuuacuuuuaucucucuuuaugagguuccaaaacaaucacauuagauuuacacguuuucuguaagcuuugucacugaaaaaacuugauauuauaaaaauauuucaaugacugaguuuauucaacauuguugacuaccuuuaguuacuuucuaaugucuucuggcugauucagagauucugggcuucucagaccuuacuuggaaaggucugauaagaccaaauuuaaaaugcuauguaugugaugauucaguucuuuagaaggguugccaguuugugguguacaguaaacacuuggauuacuaaauauucuagugaagauuagcacuuuucauuugcaucuuuuuuuuuucuucugagauucucaaauaccuuaaagauaagcagaaauucauaaucuacauucauucugaaaacuuuuauauuacuauucagcaagugaucuuuaagauugagcuaggaacuuguggcccugguguguuauuuucaaauaacuagaaacuuacauuuucaaaugaugauuuuuaucuuugaagcaaggauuuugauuuuguuuugguuuuauagcuuauuuucaaaguuaagaaacgcaagaaaggguguuaauauauuucauucaggaaagguccugguugguaaaauauguaaaaguacaaacuucugaauucaccaucauuuccugauggauuuguaaaaauuuuucuccccagucuaauguauuuguuuguauacuaacuuccacacagggcuauggaacacaccugaugaaucauuugaaagaauaucacauaaagcaugacauccugaacuuccucacauaugcagaugaauaugcaauuggauacuuuaagaaacagguugguuucucaccacgcaacacuguuuugucacuccuuuucuuaauauguucucagguagcguucuuccaaauaaguuucucccccaguguuuucuacuuauaagaacaggcauuuguuuuacaagccuuaugucaaaaauaagcuucagccuggauuagagagugucacuagcacauaguaaguauugaauaacuauuuguugagagaaugaaugaaugucaccugucagugagguauaauauugcauccuaacauucuaaaauaugguuucuaauaagaaauucccaguccuggaauuugguggguagcauucucugugaaugagaaaaacagauucaguuucuggaaggccuccauuuaugacagcagaaaggaaauccuggaguuuauaaaaaccugcaaacaguccugauucuacagcacauagugggcuaggagcuuggcugucaucuuugcaguuccuuccuuucuccguuccucccuuccuuuuuuuuuuuugagacagggucucacuuuggugccuaggcugagacugcaguggugcaaucucaguucacugcagccuugaccuccugggcucaggugauucucccaccucagccucccaaguagcugugacuacacccagcuaauuuuuuguauuuuuaguagagacaggguuuugucguguuacccaggcuggucucgagcuccuggacucaagcaauccacccaccucggccucccuaagugcugggauuauaggcgugagccaccucaccaggccucuguccuagcaguuucuuaucagaaguuuucagcucaggccaggugcaguggcuuaugccuguaauccuaguacuuugggaggccagggcaggaggauugcugugcucaggaguuugaaacagccugggcaacauagugagaacuugucucucuuuaaauaagucuuaaaauaaguuuucagcucagcuuuuugaggacuauucuuugacugcauauuauuuuuaauagugauuuauaauuccuaaacauuuucauuuacuuuucugacuauaaaaguaauguguaaucauuguagaaaauguaauaaagcaaaagaaggaaagaaaaauggcuuguaauucugucaccccaagaaauuuacuguuaaugcuuugauuuuuuuauuuuaaaauuuuuucuguuauuuuuccucucagcucauaccuaugcuguuaaugcuuugacauaaaucuuuuuaguauuuuuucuguguguauauaaacauaaaaguugguucauacuguguauauaauaauuuuggugguuuccuaggauuuuguuguagaaauagaaaauauuuaaccaauacauuuuugacuagguguuucuuguagguaaugugcauguguauggguguguguuuguguacauguuuugcccucauugaugguaauuugcuuagaauaaaucaagguuuuuguaauguguugcuaaauauuuuaaaaauuuccauuuuugucagcaguguauaagggggucaggaaaggaguugguaacugaaaaaaaauuuaccacuuuuccagauaauaaauuguguauguuugaauuuauuuaugugaaguuugauuuauuuuuccauguuuaucaauucuuuguauuuguuccuuuuuuggauugcuaauucauuuucuuuugucccuuuuucuauaaaaauguuuaguuguacauugauuugugagaacuauuaguauauaacuauauuaaccuuggauaauauuuguuucaacauugcuuauggcuuuuucuuuaaaucuucagaauguuaaagauguuauuacauaaaaucuauugacuuguuuugguuuggauuuuguuuguuuguuuguuuugagacagggucuuacacugucaccaaggcuggagugcuguggcaugaucauagcucacugcagccucaaccuccugggcucaggcgauccuccugccucagcuaccuguguaauugugaccucaggugcaugccaccaugcccagcaauuuuuuuuuuuuaaucauuuguagagauggugagggguugggagagaaucuugcuauguugccugggcuggucuugaacucuuggacucaagugauccuccugccucagucucccaaagugcugagauuauaggcaugagccacugcacccagccagacuucuuuuuuuuuaaaaauguguucuuauguaauuagaaagcuuuuugugcucugaagacagauaaauaaucuccuauuuauuaucuucucauuguuugagaugcauuuuaacuuuuaugguaaaacucacugagaacuuaauuggauuguuucacugaggucuugagcaucagcuuuccucagcuguaacuguagugcaaagcauaagaucucagcuaugguucuuaaaugacuugucuguaguccucuuugaggaugauggcaauaauuacuuggaaaauaaguuuuuguugaaagaugaggcagugaacugcuggcgauggugcugaaguucaagaaauuuucugcaaauaacugaaauagauacuuaaggcaaauuauguuuauauuauaaauauauuauuuauaauuuugaauauauacucugaagcagucuguuauuauggcuuaaaguguguaaaugaguauauuccaaagcauuaaugucauugaaacaaccacacauugugacugucuggaauuuuuuugccugcaaagaaaggauuucauuuccucagaaacauuaaguuucuaaucacuuuauuuuuuugaccaucuuuucuuugauaauuuagaucaauguuaguuauugauuugcugagaauccuggggacccccucaccacuuuuggagaaauuugcaacggucauauuuaauuauguaauucaguacaaaauuaaaccuaauuuuuacuuaacaccuguuucuguuuuaaacuuuuuaauauuucuugcauuuuauuagggccauuuaaaaaauguugucuugcuuccuauuuacacaguuagauuucugguguuuuugaacuucaugggugguuuuaagcuaauccucuucagaauaguacaaugagaacuucaaagaagcuugucuugauuccucacacagugccuggaacauaguuagcacucaguagauauuugguguaugguguucauaugaaugaauuuacuugcuuuucaggguuucuccaaagaaauuaaaauaccuaaaaccaaauauguuggcuauaucaaggauuaugaaggagccacuuuaaugggaugugagcuaaauccacggaucccguacacagaauuuucugucaucauuaaaaagcagaaggagguaagcaggugguugacucccuuaccuucuguacaggccagucuuagcugggguggguugcauuuccuugggugcugcguguauguguuuacuggauagcaaacucucgguuugcuguggguuaucuagauuucuucucucucucuuuuuugacacagagucucucugucaccuagacuggagugcaguggcacuaucucacuguaaccucugccuccugggcccaagcaauccucguaccucagccucccgaguagcuaagauuacaggugugugcuaccaugcccagccaauuuuucuuauuuuuaguggagacagcguuucaccauguuggccaggcuggucucgaacuccugaccucaagugauccaccugccucggccucccaaauuguugggauuacaggugugagccaucgcuccuggccauagauuucuuuaaagguauccuugaucuguuuccuuucucgguuaccauuucuacaagagucauuacuuuuuaaauuuguguaaaauacaaaauauguaaaauacaaaauauguaaaauauggugacauauuuuaacuucaccuucaagccauuuugcauucuggccucaauuauuguucccacucuuaucucuuuacuuucaucuccaaauacuccaagugcaucuauuuacuauucuccaaagugucuuuguccauuagccaccccguucacucagcacacacauaaaucaaaccguuucaggguguguuccaguuccucuucugaacuucucuagcaccaguuugauccaccuauuugaauuucaguuauucaucuuacauagacauuuaccuuacuguauauuaaucucugcuuuuacuuggcaaguucugaaggcuuauccuucuagguauuaagugauuuguuaucugguauugaggugacuuuuuuuaugcauaugaaugaaaagagaagcaguaaaagggaaagguugacagaguugaauacauaauaauuucaaauuuucuaaggcagaaaaaaaaaacacucaugaugaaaagaacagaacuggggaguacacaaaggccauuuauugaaagaaagaacuuuguguguuaaguccaggaucaccuccuggcugcucccaguuggguggaguuugcagcugugucaucccacgucaauuccacuugauacuucuguuauucguuuagugcacuuuucucuaacaaauagcuuaggaggacaucugucuuauacccaucuuuguuuucugguuucuacuaaccuccuuaaucccaguucuuaguuuuuuguuaggcauuaucuaccuaacagcccuaaagcuuuuuacacagugucuggugcauaguaguuacucauuaaguauuuuucuuuuacuuaaaguggcucagucuuguucuuguguuuccuggggaagugagcaaaggcuuuuuuuuuuuuuuggaaaauacaaacaacuuuuguugcuuuuuguucaaagaugucagccuaagagagaauuccaaguaggcacuuggaagaguuaauaaagcacagcgggcuccucucucucccugucucucugaagagcuggcuuuccucauuguucucucuggagcuuaaugagcaggucuggauucagcagcacaucguuccgcauuagaggcugcuggccaacuaaagccaucaccccgcugucagcugcucuuuccucauuccuccucccagcagcacuaauucauccccacgguguuagcugagagcaggauucccuuggcagagucugcaaauucacauuguacaugaucuguuggcccuucaaaccuacaggggaacgccagaagcgcagagcuauuuuagauggcuaacaaagcagucaacuuuuuagaagccaaggcucccuccccauucuuuuuucuccucuccucccccucugccuccagccuucccucacacauuccguugaaugggugauggagguuuggagaucuuaaccuaguuuuuaaaaaagcuaucugaagucacuucaauaaaaauauauuuggauucauguaguauuuuuuuccacagaauucaguugauuuuuuauaaguauuauuuguuccaacugugaaaaaccccucaaggaagguagggauucaugguggcagcaaagaaacagugaauauucugaggcauuuccuagccccuaaaaguauacaggagcagaauaaguuguaguugucauuaguagagagagagagagaaaacuaguauaguuggacagguggaccaagaguggagaguuaagugcuacuuugugaguguugacuccaagggaaagguaggaucuguaggggccucaugucaccugacagggcuuugugggacauuuguuuugaacugggcagccuggugaugaaaucugcauuagcagaggcucagaguccaauggaaacagauuugugggcacaugaacagguaggaccauuguuaugucggugaugaaggcacuauuugagaaagcgcgaauaggcuaugagcaagcauaauuggguaucuaugugccuguguguguguguguguguacguacauauaccuauguacauguauguguggauaggcugggugguggguggggggauaaguucuuaaaucuuaaucuacaugugacaauacaaggaauugggguuggagaagccaaaguaaggauggggagacucaaugcaauuuuuuuauaaggagacaugcaaagacugggugauguauuggagauggggaacuacuccacugaaauuuucugcuuugggagacccuaaaacugacagcaguagaucauaggacugagcuguggacuucaggagaagaagaugaggacauacuuucauuuggaaggcauugauuuuaucgucaugguagggaguugaagauauuuucuagggaggugaaguuaauacacuagaacacaaugaaaauaucuccuuucugagaugcaagucaaaaccacaaugugauacuaucucacaccagucagaauggcuauuauuaagaaguuaaaaaaauaacagauguuggcaaagcuguggagaaaagggaaugcuuauacacucuuggugggaaugcaaauuaguucagccccuguggaaagccguuuggagauuucucaaagaauuaaaaauagaauuaccauuccacacagaaauccuauuacugagcauauacccgaaggaaaauaaauuguucuuacaaaaagauacaugugcuuuuauguucauugcagcgcuauucacaauaacaaagacaugaaaucaauucaggugcccaucaaagguagauuggauaaagaaaauguaguacauauacaccauggaauauuaugcagccauaaaaaagaacaaaaucauguccuuugcaacaguguggguuuagcuggggccauuauccuaagcagauuaacacaggaacagaaaacaaaauacugcauguuuucuguuauaagugggagcugaacauuggggauauaugcucacaaagaugggaacaguagacacuggaguuuccaaaagaggcaagagagggagaggaguaaggguugaaaaacuaccugucagguacugugcucacuacuugggcagugagaucauuagaagcccaaaccucagcaucacacaguauacccauaauacccccuguaucuaaaaugaaaacaauaaauuaaaaaagaucucuucuccauacugauuacuagagguacagagagcuuaggacgccucccauucccauuaacagucacuucucaggagcccacaaucuuuaaggugcuacaugaggugaguggaagccaucuguaggucauugcauuugagagucccuuggugaagagaaggaaacuuucaaauugaaacagucuucagcauauucucugaaggugucgauuuaagagauugcccuugggauucuuuuuuuuuuuuuuuuuuuuuuuuuuuuuugagacagcgucucacucugucacccaggcuggagugcaguggcaugaucuuggcucacugcaagcucugccuccuggguucgcaccauucuccuuccucagccucccgaguagcugggacuacaggcacccgccaccaugcccagcuaauuuuuuguaauuuuuaguagagaagggguuucacuguguuagccaggauggucucgaucuccugaccucgugaucugcccaccucggccucccaaagugcugggauuacaggcgugagccaccaagcccagccagguuucuuuuuucuuuuuuuuuuuuaagauuuggacuuauaauaaauaaauggacuuaaaauaaauaaauggaaagcacccaucuagaucagccuugucaaaaguagcagucacuagccacauguggcuacugaggacuugauaugugguuagucaaaauuaaggcaugcuguaaguauaaaauccucugauuuucauuucuuucuuuuucuuuuuuuuuuuuuaagaggaagucucgcucugucacccagacuggagugcaauggcacaaccuugguucacugcaaccuccaccucccagguucaagcaauucuccugucccagccuccuguguaacugggauuacaggcgugcacuaccaugcccagcccauuuuuuguauuuuuaguagaaaugggguuucaccguguuggccaggcuggucucgagcuccucaccucaagugauccacccaccucggccucccaaagugcugggauuacaggugugagccacugcaccuggccaauccucugauuuucaagaguucauaugaauaaagcaauguaaaauaucuuacacuuuuuuccaauuguauguuacaaugacauuuuagauauaauggguuaaaugaaauacauuauuaaaaucaauuucaccuguuucuuuuugccuuuuaaaaaugcggcuaguagaaaaauuuaaauuacaugcguggcuuguauuaugucucuauuggacagcacugaucuagauuuacuaggaauauacuuuuacuagucccauucauuuuaugaaguuauuuguuuaacuguuaggauuacauauucaugcugcaguauuuaccagcuauauguuugaaaucaaucaggaaguagauuuuuuuguuuuccuuugugaaugcaauuagugauuucuauuguuuuguuucguuuuuccaaaauuucguuaugauauguuuaauuuccggaugggauuuuuuuaguuuuuuuuuuuuuuuuuuuuuuuuuauuaaagggauaaccucacugucuuggaaguaguuaccucagcauauuaauaauuauuuuacaaaacaaacaaaacaucucucaaaauuucucagucagugugauggcuuaugucaugguuguguugcuuuaauagaugauacuuuaaauugcauuauucuuuucuuucuucucaugacagccuacuauuauagagcugcuuuuuugaugcagccagaauagguuggagguccagccuugaaaaauuuaaauaguaaagcuuuaacaacuguaggcuuuugggacuuucuggggcccguuuaccugcuucucuaguccgaagggaacaguuccuaguuaugggaagugaagagguucugucacuugacugaguagugaaugcucagggcugcuuuccuguaauucuggcagagccuccucagagaagcagggcaaaauaauuggcucuuaugcuacagaugacaagugggcccuaggggcuguguguuuucucaauauuggcuuuucuggaugucagggacaaguaacucaaagauguuuuugugaaugucacuaaauagacaugguauaauauaaucuguucauuucuuacuuguuaaauagcauucaccccuuucucccaucuuauuucauaaaaaagacuguuuuguuaggaaaacauuucauuagguugacugacuugaacuguauccauagacuucuuucccuaaacacauuuccuuccugugcuuuacagauaauuaaaaaacugauugaaagaaaacaggcacaaauucgaaaaguuuacccuggacuuucauguuuuaaagauggaguucgacagauuccuauagaaagcauuccuggaauuaguacguauagaccuucuuuuaaaagcgaaauuuuuuaguaaugccgugguuuguguuugaaacaauuuccagaaugcaguaacuucgaaagcuuuauugcccugcccgucucuguguuaucucuagucuuuuaagaaggcagcaaauguuacccuuuuaugucuucccuaccacccaauacaaacaaaccaaagggagcuuagaugcccccuuguaauagcuguuaauauccaccacuuaaugagucugccauuuguagcacagugcgaauuauuacacauaugcaaccuugaaagcagggaauccuauuuuauaaauggggaaaucgaguuccaaagcaguuagaucauuuacuguuaaagggcacauagccaguaacggucagaauuagaagcagcccaguucugauggccgaacaccuuacuguuugcaccaugucucauugccaccaugguugcagccuccaagaucugugcuugacuagucuccccaaacuucuaaaaaauacuauuuguuaugugugguggaaaucauauaccuuguuucauauucccuauuuuacaguaguuuuccuaaggguucuugucuguauguuagaguugaguuguguuggguuaaaccauaccaaauaguuguuuuuauaggucaaaagccauugaauaucauuggcaauuuuguucaguucaaauccagguucuuuuuaguauauuuaagcuuuaauaaacaaaaucaaacaagcaaaaauuuuccagaaaaaauaagauguuauuuggacaagauauaucacuuuauuacaugugcccucuggcagaucuuacuuuuaugcuaaauccagaaauucuacuuccauguauuaucucuauuaaugacauaauagcaaccauaucauugaaugccuacuugugccacgcauuuaucuguuuuuguuuuuuuuuuuguacauuaacuacucucaacagggauaaaaccaccuaauuuuuaggguucuguuuuauagauugauaaacugagaggcaacuuacucuuauuuagggugaguuaccuuuuaaggaaagaacaggaaaucacauccagaucugucagacuccaggcuguuuucuaucugcuacacuaaacuuucuugcauuacaagcagggccuuagccaaauagaacagagaccaggacagaguuuguucugaccuaaaauaacagcuuaacucuuuuacagggugaucagcccaaaauuugacuuucaguuuaaaaaauacacaggcccacaguacuguacauauuuauuuuuuaugcucuccacugaaagguugguguuccugcuuuaaaacacuaacauauggggcagcguuguuagucuuggaaauguuuuauauuguuagugguauaaggaaguaacuaauugccauuaauuucagucgucucucagaaguagacuuuuauugucaugccuauaauuucuuguuuuugauaaguauuaacuauguuauucucuugaccaaaagcacuucucauucaguguuucacuuuguugacguauaggagagacaggcuggaaaccgaguggaaaagagaaaagguaaguaugacgggcaagaggauguuaauggaagugauuuuuuuuuuuccccaccaagcaacuuaaagaaaaacggcaaacuaauuguaaucacuaacacaacaguugguggguuuugaguuuccuaaaacauucuggaaugguuccaauuucagguuuuuguaagaaugagcugaauaguaaucagcuggcaauaggguaaaacucuaaucauugcuccuuguuucccuuuuuccuuucaaguaaagagcccagagacccugaccagcuuuacagcacgcucaagagcauccuccagcaggugaagguggguguccucuuuauucaccucaugcaaauauuuugaaaugauuucccacauggaauuuccauauuagauaccuuacuuuuuucuuuacccaagagccaucaaagcgcuuggcccuucauggaaccugugaagagaacagaagcuccaggauauuaugaaguuauaagguuccccauggguaauaccauuaacauuuucuaaguauagauuuaaaacucuggauggcggugugggggacaaaugguugcugagguugauuuguacuccucugcuuaggguaggaaguguaugacggguggugggauuccaugcaccguggcgggucagugauggcagagaaguggguggcuguguucauuagagacauucugcagcugucguuuagagcccacaugagcuuaacgacacuagacgcagaaaauccacgguaacugcagacagcacuagauuugaaagcuggcacuuuagauauaacuuugcuuauauucuaacucuuuggugcaaauagaaaaacaucagcuuauccucuugauaugcuuugcgucugucguaaauagguauuccuuugaauaauuauucaggauaauaaugaaagaaguuagauuaaaguacuugacugcuguacuuucagagggagaaauucuacuuaccacaauucuugauuuuccaugcccuugauggguacuguuaaugucacuguauauacucuuuauuuuacgcuuugucucauauccaaaaucaaacaaaaaaggaugucuucagaaauguagaauugugcaguuuggugcugugcccacaccacucuaaaauuaaugauuaauugaaucauuugaggucgcucaaauuaaacuaauuuggcauugugugggugacaaccaguugaaauguuuucuuuuuaucagcuauguggccauauuuuuggagagagccagagucuucugucucuuuucuaccuguaaucuauuccaggugcuaagaacugugaaaguccagcuuggguaauguagugagacccugucucuacaaaaaguaaaaaauuagccaggugcaguggcacacgccugaggccccagcuacuugggaggcugagguuggaggaucacuugagccugggaguuugaggcuguagugagcugugauugcaccacugcacuucagccugggcacuggagggagaccguaucucaaaaaaaaaaaaaaaaaaaaaaaaauuguggaaguguuaaaaaugugaaaaggaagagugaaagggacgcauuagcuccuugaaaacugaguuauuuacagguguuuucuauagcauuuaaauguuucacaugaauauuuuauauauuuguaguaaugauuucaguagccuacacccuuuaaagugaacacacaucuauaugcuuuucuuucucucuucucucugacuuaccacuauuuauuucaguacaagaaaauaaaggguaugguugacucagucuagaauucugaauggaaggcugauuugggaaucaauauuguccacuaugugcaaaauauguuaaaacucuuuguguccauuuccaaccauaaauuaacugauuuuugcauccucuuccucuggaccaucucagcuucuuuugggaaacccccaugggaagcugugugacuuuggggcccuuucagccccugugcacaugcacucugaugacgugcagcgauaggucuagcagaucucgucgaucauagccuacuugcagccugcuuucugaaaguguuuugcuuggucccacccgugaagguugugaacuucuccaguuggauaccaccuguaugcauagcugagucucacaaggggggaaacugaccuaauugagcaaggccagugaugggcugaaaugugugcuggacaaaguuaaagcuauaaaugguguucuucaguagggcaguauuuuuuuucuugguauuguucagaugcugaguaaaauauuuagucuuguccccaagauuaucuuguauuugaagacaagauugacaaaucaguaauuuuacauuuucccacgauuuccuuauuugauuuuucuaauaacauuacuuuucuuuccccauauucugaaaaacuguuucucucauauggaugggaucuaaccuguuuuacuuagggagucacacacuggacaucagcuguauagucuggcccaagcaugacuucuuguuacccauggauggcuaggcaggguuuugcugcuuacccagaauucccaaguuaaggggaaaggacaugaaaacugaauaauuuaauggugucucuauauuugguaccaccaauauuuagucaccuuuuuuaacccaccucauuuugucaauugaaaaaacucuacgaaggccagaggaagaagaaugcuaucuauagcuuuagaauagaaaggaaguauucagaauugguuauaguuauucagaaaaguccagacaccgccauaauucuugcuuuguuucugcugcauuuuaggcucucuccaucuuuucuuacccaucuccuaaaaaaguucgaaaagcuuuuggacaaacuucuuugugucgugucauccuuuuacucccccucccccuuuuugggggguacauguuucuuccuuuuaaaacauuauacauauuauauugggcagcauaucuuaagugguagacauuuagguggaaaagugaaaggaauguaaacaucuacuuuuacuuagggccaauuucauuguuuuuuucuucuuuaaaugagagaacauuuugaucuguucagucacacuuggaugggacauuuagugugagauuugaugagucuuuguguuucuuagcgcuuuuagauuuuuaucucucuccaaacuguuuuagagaagaaagaaaaguugaaaguugaauuuacagaugugaugacauacacucuaaccaagauaggcuuuauucaagagauaggcagaagcagcuuuuuuccauuucuucuuugaugcuuuugugguggauuuaggauauugaugcaaaugaauuccuucccauuuggggauauuguacguacauuuacuuaccuuauuaaaugaugaucccaauguauuugguuauagguuucuuucccccuggaaauuuuauaacauacuuauaauuugggauauugguagucagaagugggguuuuuuuuuucccauuugacuuauuuuuccacacauaguuaauacaauuauagcuuuuaacaauaaagccagacuucaagacaaccagggaaccauaaauagacaaauguuagcgucuauucuaaucugcauagaauuccuuaaauuaguccugacagugaggauugaagaaacccuacuuuaguuuuaucaguuuagauggaguacuguuuucaccuguaaaauacuacaauuuaaagcaaguagcuauauugggaaauauucuuugcaauagucucacaaggcuuacuugcuuuagaaaauagauuauuaaaugaaguuuguuauucuuauuucauugauggagcuugaagcaaauucauuugaaucauuuuacaugcaagggcacugguguguucacagauguauuuauuaucaguuucucuauaugacaccaaaacaacugugaguuuagugaaacaaaugcagucugauuguuuuaaguaauuaaaugauugaauacaaacguuccaccugcucuacuccauauagauagagccucuucuguauaauucugacugaauagcuaacaguagucaguucaucauacuuauuguugcuaaucuacuuagcuuccuugugcugaauaggggauugaaccagaugacuaauaauggucccuuuaaugcuaaaauggcugugauuuuacauuuuuaaaaaacccacaaaagaaugaacuuaagauuuaagaacuguuuuccuuggucauaagaauuucucuuaaauaaaagcauugggaugauaaaaauguaaucaaaccaacaacauagauuccuuucccagucccaguuuugucagcugguguuuaaagggagucaaagauugcuaauauuuuuuuuuccugugcagaucugaaaaccaugagugaacgccucaagaauagguacuacgugucuaagaaauuauucauggcagacuuacagcgagucuuuaccaauugcaaagaguacaaccccccugagagugaauacuacaaaugugccaauauccuggagaaauucuucuucaguaaaauuaaggaagcuggauuaauugacaagugauuuuuuuuccccucugcuucuuagaaacucaccaagcagugugccuaaagcaaggugguuuaguuuuuuacaaagaauuggacaugauguauugaagagacuuguaaauguaauaauuagcacuuuugaaaaaacaaaaaaccuccuuuuagcuuuucagauauguauuuaaauugaagucauaggacauuuuuauuuuauggaauagauuuuaaucuauuuacuacuauuaagguaaauuuucuauggcauguccauuagcuauuucaugauagaugauuagggguuuccucaaaaccugugugugaggaaauugcacacaguagcaaaauuuggggaaauccauaacauuuucagaccaugaaugaauguuuccauuuuuuucuaauggaaugugagaguuuacuuuuauuuuauucugaaggacuuuaaggaagggauacaugauuuuaaaaaagccuguaagaggugaaauaugugauguuugaagucucuuuauagacuuuuuauauauauuuuuuaaaacacucaucuagaugaggugcuuugagcaguucugaaaaaugcaguuccaggaaagcaacugcuuugguuccuaaggaagaaauucuaaauaaugcaaacuuuuaaaauaagcaucuagguuuuugauaauucugucuacuuacaacaaacuuguuaguacauaaccacuauuuuaauaauuauuuucucuacacaaauguguaauaucauauuugacuuugcuuaugcaggccauaaguuccaaaagauaauuucccugcccacaaaggcauaaacuugaaaacacaugagauugaaucaacaugcuuuaauaggaaaagauguauggucuauauauguaucaaucuggugaauccucguucuaauaaagguucuuuuucuuuucuaugauacacacagccacgcugauaauaugcaaaugaacauuuuccuuuaugucucuccagauaauguuuauugucugagguaaauuaaauucccaccaggguuugcugucaguauuuuaacacccacauuaguauaugcguccagggucauaacccccuaaaauccaucaugcaaccuuauuaaucugucuugggauuccaguuuagugcuuggauuuauuuccugauuacacuacauagaaaagugagacaucugccauucccaacucugggaaaaccaacuaauauacaaccauauaaaugaaggccaucuugauggucucaacacuaauuuuuaugaugcaaauuuauacacugauuuuuguaaaggacaaaguuuuaaaagcguauuuaacuugauguuuucuaucagcauaaauaaaauggucaugaauagucauuaaaaacaguugccagugauaaucugcaugaaggaaaaagaacccugcaaauggcuauugaguuggaaguauuguuuuugauauguaagagauauucagaaugcucacacugaaaaugccucaacuuuuuaaaguguaagaaaccaccaugaguggugucuagauuucuaaugaagaaucaugauacaguuuggauuaaguaucuuggacugguuuuaaacagugcuuuguaccggaucugcugaagcaucuguccagcugguauccugugaaaguuuguuauuuucugaguagacauucuuauagaguauugucuuuaaaaucagauugucucuucuauauugaaagcauuuuuauguuuucuaauuuaaaaauuaauauuuucuuauagauauugugcaauaaagcugaaguagaaugugugguuuuugcaaaugcuuuaacagcugauaaaaauuuuacauuuguaaaauuaauauauuguacugguacaaaauaguuuuaaauuauauuuuaaaaagcuuccaa

SEQ ID NO: 192705 - RNA, 7985 nt, Homo sapiens
ccgcagccaugaccccgcagcuucuccuggcccuuguccucugggccagcugcccgcccugcaguggaaggaaagguauguggggccccugggggacuggggggcccaggcagacggacaugacacgaggacuggccucggaucaugucuggggugggaaaucacauccucccgugcccaauggugggaugggguuacccucccauuguacagauggaggaacugaggcacagagaggcagagugccacauuggggguggaaggaugucaccuugugggugauagggacuggcagucacagcucagagguauccauagagcuacacagacauagcuacacagacaugcgaauuugagucacacucauuccuuugguuucuuuuugguuuuguuuuuugagacagagucucacucugucgcccaggcuggaguacaguggcaccaucucagcucacugaaaccuccaucuccuggguucaagcgagauucuccucccucagccucccgaguaguugggauuacaggugcccgccaccaugcccggcuacuuuuuauauuuuuaguagagauaggguuuuaccauguuggccaggguggucuugaacuccugaccucaggugauccacccaccucgggcucccaaagugcugggaugacagaugugagccaccgcgcccggccgacauucauucauuuugcacuagagaacaucuccauguccuugaagacaaaaugguuacagcagggcaugguggcucaugccuguaauuccagcacuuugggaggccagggcgugaggaucgugaggccaggaauucgagaccagccugggcaacauagugaaaccggaccccaccaaucuguacaaaaaauuaaaaaauuagcuagaugugguggcacgugccuguagucccagcuacuugggaggcugaggugggaggauaauuugagcccaggaauuggaggcugcagugagcuaugauugugccacugcauuccagccuaggugacagagugggauaccuugucucaaaauaauaauaauaauaauaauuuauaggcuggguuugguggcucacgccuguaauuccagcacuuugggaggccaaggcagguggaucaccugaggucaggaguuugagaccagccuggccaacauggugaaacucccucucuacuaaaaauacaaaaauuagccaagcguggcaguacaugccuguaaucccagcuacucgggaggcuaagaaucgcuugaacccgggaggcggggguggcagugagccgagaucucgccacugcacuccagccuaggcgacagagggagacucccucuuuaaaaaaaaaaaacaauuacaaaagagagaacacgguaaaaucucucucucuuacccgaguuccucucuguagaugcuuaaaccucagcuucccuaucuggaaaaugggcuaguaguccucaccuagauggauugcaguggggauaaaagaugacagaugacuuuuguccauguaccuauuuauuccgaaagccuuuauuaggcaccuaccauguaccuggugcuggcuggcaacguggcaggagcccagcgcacgggagggcuaugacaaucuggggguaaaccagaagcucacucuuucugucuuccuccagggcccccagcagcucugacacugccccgggugcaaugccgagccucucgguacccgaucgccguggauugcuccuggacccugccgccugcuccaaacuccaccagccccguguccuucauugccacguacaggucggagagccuggaagggggccucagggacacuggacuuccuggagagcccagaacucuggcccugagagcccuggggucaggaaaacuggagaccccgacauccugaaccccaggccuauggaauucuagggcggccccguccaauagaaauauacuuucugggccaggcacaguggugcaugccuguaaucccagcgcuuugggaggccgaggugggcagauugcuugaggucaggaguuugagaccagcuugggcaacguagugagacacugucucuacgaaaaauuuuaaaaauuggucaggugcaguggcucaugccuguaaucccagcuacuccggaggcugaggcaggagaauagcuugaacccaggaggcggagguugcagugagccaagauggcaccauugcacuccagccugggcaacagagcaagacuccaucucaaaaaaaaaaaaaaaaaacuacuuccuggguugggcacaguggcacaugccuguaaucccaguacuuugggaggcugaugugggaggaucacuugaggucaggaguuugaguccagcuugggcaaaauagugagacccugucucuaaaaacaauuuuuaaaauuagcugggcauggccaggcgcgguggcucacgccuguaaucccagcacuuugggaggccgaggugggcggaucacaaggucaggagauggagaccacccuggcgaacacggugaaacccugucuuuacuaaaaaugcaaaaauuugccaggugugauggcacgcgccuguagucccagcuacucgggaggcugaggcaggagaauugcuugacccaggagguggacguugcagugagccaauauugcaucgcugcacugcauccuggugauagagugagaccccgucucaaaaaaaaaaaaaaaaaaaaaaagaaaagaaaagaaaagaaaagaaaagaaaaaauuucgaaaaagaaaaaaaaauuagcugggcauguugguacuugccuguagucccagcuacucuggaggcugaggugggaggaucacuugagcccaggaguuugagaccagccugggcaacauagcaauauccugucuguacuuaaaaucaaaaaaauuagcuggauguaauggcacacaucuguagucccagguacuugggaggccgaggugggaggaucacuugagcccagaaguucaagaccagccugggcaacauacugagacccccccccaucuguagaaaaaaaauuuaaaauuagccaagaguggugaugcgugccuguagucccaaccgcucuggaggcugagacagggaagaucccuugagccaggaguucaaggcuauaaugagcuaggaucaugccacugcacuccagccugggcgccagagggagacccugucaugaaugaaugaaugaaugaagggaugaauuaaugaaugaaugaaggaaugaauuaaugaaugaaugaaggaaugaauuaaugaaugaaugaacggaugaaugaaugaaugaauggauggaugaaugaaugaaugcugacaucccagaaaccuuuagaaucccggacccuagcaucuagcuuggguuguaauccccgaccugaaccaucaggggcaccgugauguuggggcccaugcccugcccccgggggguggcacggccaccaccaggaccccaccccgggauccccauccgcugcccccuccuguuccugccucuccuuggggucccgggucaggcccggcaguaggaggugcugaggccacaggcacucccugaggcgcucagcgagccccacccugugcaggcucggcauggcugcccggggccacagcuggcccugccugcagcagacgccaacguccaccagcugcaccaucacggauguccagcuguucuccauggcucccuacgugcucaaugucaccgccguccaccccuggggcuccagcagcagcuucgugccuuucauaacagagcacaucagugagugggggcggcagugggggcgggggcggggcugccgucuccuuccagcuccccccaccccaccucccaccuguccuccaguccugcggcugcaccuucacacuuaagcaaaaaucugaccccuucuucccccuccucuaccaguacguggagcacccccaucauugacagcccaguccccuccauccugagcccuggccuccacagucuguccuucccacagcagccaccagagggcgccugagagcaccugagucagggcacgucccucugccuacagcccuccauggcucccaccugccuuggggucaaagcccaaguccuuccuacugcccaccaaacccuggacaaccugcccugucuccuccaugcccuccccuccucccugucucccccuugcucacucugcuguggccacaugugauuccuugauguucaacaugccaggaauaguucugccccagggccuuugcaugggcggugcccucuaccuggaacaccuucccccaaauguccccaugacuuauucccucaccuccuucgggucucugugcauacaucaccuccucaguaagaccucuccugaguagauuauuaaaaauugcaagcucuggcuaggcucaguggcucacacuuguaaucccagcacuuugggaggcugaggcaggccgaucaccugaggucaggaguuugagaccaguccuggccaacauggugaaacccugccucuacuaaaaauacaagaauuagcugggcauaguggcaggugccuguaaucccagcuacucagggggcugaggcacgagaaucacuugaacccaggagguggagguugccgugagcugagauugugccacugcauuccagccugggcgagagagcgagacucuaucucaaaaaacaaaacaaaacaaaacaaaaauugcggccacugccauuccugcacuccccagcuuucuucccuauucugugugaccuauggauuuguuuauuuccugucuucccccugauggauugugaguuccaugaggacagggguaggucaguuaaggucacuguuuuguccccucuguggcagccccaggcacacaguuucucaauaaauauuuguugguugagccaggcaugguggcucacaacuacucgggaggcugaggcaggagaaucgccugaaccugggaggcagagguuguagugagcugagaucacgccgcuguacuccagccugggugacagagugagacuccguuucaaaacaaacaaaauauauacauaauauguugguugaaugaaugagugaaugaaugaaugacuggacuuacuguccccugacccugcuuccugcuuguccgucagucaagcccgacccuccagaaggcgugcgccuaagcccccucgcugagcgccagcuacaggugcagugggagccucccggguccuggcccuucccagagaucuucucacugaaguacuggauccguuacaagcgucagggagcugcgcgcuuccaccgggugaggaggaugagggggaggcuggaaaggguggugccuggcagagggaaugguuuuuaccaagacuagcaggugugcugggcucuugcacauagcuugcgauuccgggugcauugaauaagagcaguccagcaaucugauuccuaggccucuaccgaaaaggauggaaagcagggacuugcacaagcugucgcacacccguuuuuguuguuauuguuuugagacagagucucgcucugucgcccaggcagugacacaaucucggcucacugcaaacuccgccucccagguucaagcgaugcuccugccucagccucuggaguagcugggauuacgggcacgugccacuaugcccggcuaauuuuuguauuuuuaguagagaugggguuucaucauguuggccaggcuggucucgaacuucugaucucaggugaucugccugccucggacucccaaagugcugggauuacaggcgugagccaccgaauuguucacuuuauugauugauugauugaaacaaggucuagcucugucacccaggcuggagugcaguggcgcgaucuuggcucgcugaaaccuccgccucccagguucaagugauucuccugccucagccuccugaauagcugggacuacaggcgcccaccacgcccggcuaauuucuguauuuucaguagagaugggauuuugccauguugcccaggcuggucucaaacuacggagcuuaggugauccaccugccugggccucccaaaguguugggacuacaggugugaggacuucaucuggccagaauuagccauuuuaaagugaacaauucuggcugggcaggguggcucacaccuguaaucccagcacuuugagaggccaaguugggaggauugcuugaguccaggaguuggagaccagccuggguaacauagugagacucccaucucuacaaaaaauuuaaacauuaguuggguguggugacacacaccuguacccccaguuacaagaggcugaggugggaggaucacuugggccuggaagauugaggcugcagugagccguguuggcaccacugccuuccagccuggguaacagagagagacucugucucccaacuuaaauaaauuaaauaaaauaaaaagcacgguuaggcuaggugcaguggcucaugccugaaaucccagcacuuuaggaggccaaggcaggcagaucacuugaggucaggugaaaccccaucucuauuaaaaauacaaaaauuggccuggcgcgguggcucaugccuguaaucccagcacuuugggaggcugaggcaggcagaucacgaggucaggaauucgagaacagccugaccaacauggugaaaucacagcucuacuaaaaauacaaaaauuagccgggugugguggcgggcgccuguaaucccagcuacucaggaggcugaggcaggagaauggcuugaacccgggagguggagguugcagugagcugagaucaugccacugcacuccagccugggugacagagugagacuccgucucaaaaacaaacaaacaaaaauuagccaggcaugguggcgggcgccuguaaucccagcuaucugggaggcugacgugagaggaugguuugagccuggaggcagagguugcaguaagccaagauugccccacugcacuccagccugggcaacagaguaagacugucucaaaaaaaaaaaaaaaaaaaaaaaaagcaugguuaauauagugggaccagggguaaagggagguaugggguccuaucccagagguccugguuuagucccagggaggagaaagaagaggauuauagggaucagggauguccugaugaacaaagacccuccugggugagacauccacaggggcuagugugguccaggaaggauucguaagagagguggcucugggggccacacagacagaggccgggauugggaggagcccaugaugcuauuugggguggggccgcacagcuggggccagaguccuggacuggagccugcagggggcagggaggacugcacgcuccguugugugguucugugcacaguggccccucuccaucuucugguucuagugaccugacgcucucucuucucucagguggggcccauugaagccacguccuucauccucagggcugugcggccccgagccagguacuacguccaaguggcggcucaggaccucacagacuacggggaacugagugacuggagucuccccgccacugccacaaugagccugggcaaguagcaagggcuucccgcugccuccagacagcaccuggguccucgccacccuaagccccgggacaccuguuggagggcggaugggaucugccuagccugggcuggaguccuugcuuugcugcugcugagcugccgggcaaccucagaugaccgacuuuucccuuugagccucaguuucucuagcugagaaauggagauguacuacucucuccuuuaccuuuaccuuuaccacagugcagggcugacugaacugucacugugagauauuuuuuauuguuuaauuagaaaagaauuguuguugggcugggcgcaguggaucgcaccuguaaucccagucacugggaagccgacgugggaggguagcuugaggccaggagcucgaaaccaguccgggccacacagcaagaccccaucucuaaaaaauuaauauaaauauaaaauaa

SEQ ID NO: 192706 - RNA, 12123 nt, Homo sapiens
aaacaauaacuuauuuauuuucuaggccaugggagggcuuugggauacgauucugggcccgaggacucaaaagggggccgagggucacugucagggggucugcgugaccacgggguacagcagagccagaugcucggcacccugcaccggcagugggcgugaacuguaguggaggacgagcucgggcacgcuggggaagggcccgcuguguuggcccagcaccaccugguucucacggguccgcgcgaacuucagaugcaggaagcccuggcugcuccugggcgaugagggagaaagggacuccugagcaucccggacccacccagaaaggcaccauccccaaagccaccucccacagugcccaggccaggugcucgugugucuccagucucugguaaacagcagugugguggcugguauacucgcucacaccuguaaucccagugauaugggaagcugaggcuguaggcuuacuccaggccaggcguuagagaccagccuggccaacagagugagaccccgucuccaccaaaaaacauuuaaaaauuaggcgggugcgguggcucacgccuguaaucccagcacuuugggaggccgagucaggcagaucacuugagguuacgaguuugagaccagccuggccaacauggugaaaccccaucuccacuaaaaauacaaaaauuagccgggcgugguggcgggugccuguggucccagcuacucaagaggcugaggcaugagaaucccuugaaccugggaggcagaggcugcagugagcugauauugugccacugcaccccagccugggugacagagugagacucugucucaaaauaauaauaauaaaaaaauaggcugggcgcgguggcucacgccuguaaucacagcacuuugggaggccaaggcaggcggaucacgaggucaggagauggagaccauccuggcuaacacggugaaaccccgugucuacuaaaaaauacaaaaaauuagcugggugugguggugggcgccuguagucccagcuacucgggaggcugaggcaggagaauggcgugaacccgggaggcggagcuugcagugagccgagaucgugccacuauacuccagccuaggcgacagagcgagacucugucucaaaaaauaaauaaauaaauaaauaaauaauaauaauaauaagaggccaggugcagugacccacaccugcaaucccagcacuuugggaggccgagucaggcggauugcuugaggccaggaguuugagaccagccuggccaacauggcgaaacccugucuguacuaagaauacaaaaauuagccgggcauggcggcucacaccuguaaucccagcacuuugggaggcugaggcgggcggaucacgaggucaggagaucgagaccauccuggcuaacacagugaaaccccgucucuacuaaaaauacaaaaaaauuagccgggcgugguggugggcgccuguagucccagcuacucgggaggcugaggcaggagaauggcgugaacccgggaggcagagcuugcagugagccgagaucgcgccacugcacuccagccugggugacagagcuagacuccgucucaaaaaaaaaaaaaaaaaaaaaaaaauuagcugggcacggugguaugcgccgaaagucuuccgucucccagguucaagcaauucuccugccucagccuccgagguagcuggaauuacagguaugcaccacuaugcccaacuaauauuuguauuuuuaggagagaagggguuucaccauguuggccaggcuggucucgaacuccugaccucaagugauccaccuuccucagccuuccaaagugcugggauuacagacgucagcugccgcgcucagccccaaucucgugcuuuuagaucuuccacucagacaccuagcagaaucuuaggagugguuuauaauuagacagacuuagaauuuuagggacggaagugcguacaaacagggucucaaccuaaaacgcuuacagguacacccugaaauuuuggcuucagauggacacaaauugauauaccuccauuuuuggacaaggggaguccagaggaaucuugugcaccuaguuccuugucuuacccaaggccuggaccuccucgaugccuuccacuccaucuucuuguauaccuccagcgauggugagcucauucucaauugcaaccagcuaauggccuccccagaacucccaccccuucuccuagaagucccacccacugaccuggaagcccuucccuauggcugcgggagccacacccuccccuucccucugaauuaacccaaaagggugacucacgcaauccugugacccuucgucccugugaggcugaguucucaccugagagacaaggagcaguccuggggguuggucucacugagccgcacuagguagcugccuuccuugcagagggacaggaggcucucugcauccgcccuguucagggggccaugaaaccaccuagcgaguauggacagaugucucaucaagggccauucccuucaaacacacucuggggcccuguaaucccagcacuuugggaggcugacgcgggcggauugccugaggucaggaguucgaaaccagucucccuaacauggugaaaccccguuucuacuaaaaauacaaaaaaaauuagccgggcgugguggcgggugccuguaaucccagcuacucaggaggcugagguagggaaauugcuugaaccagggagguggaaguugugagcugagauugcaccacugcacuccagccugggcaacagagugagacucugucucaaaacaaacgaacaaacaaacaaacaaacaaaaaaacacacucugggaucuguugggucacagcuggugcaugggcuuguggcaucugggcaaaugaagaaggacaauucccuuggaguuuucuuuuuucuuuuuuuuugagacagagucuugcucuguugccagguuggagugcaguggugcaaucuuggcucaccacaaccuccgccuccuggguucaagcgauucuccugccucagccuccagaguagcuggaacuacaggcgcauagcaccacacauggcuaauuuuugcauuuuuaguagagaugggguuucaccauguuggccaggcuggucucgaacuccuaaccucagguuaucugcccuccuuggccucccaaaguacugggauuacaggcuugagccaccaugcccggccaauacccuuggauuuuucaagaggagcccugguuaucguacacuugacauugaucuucacagccucccucauguccuugucaacuucaaccacuuucacaaaaguggugcuucaucuuguaccucacccaccugucccuuucuguuuuuuucuuuuucuuucuuuuuuuuugagacagagucucgcucugucacccaggcuggagugcaguggcacgaucucggcucacuguaagcuccgccuccccgguucacgccauucuccugccucagccucccaaguagcugggacuacaggcacccgccaccacgcccagcuaauuuuuugcauuuuucguaaagacuggguuucaccauguuagucaggcuggucucaaucucuaaccuugugauccgcccaccucggccucccaaagugcugggauuacaggcaugagccacugcgcccggcugccuggcuaauuuuuuucuauuuuuaguagagaugggguuucaccauguuggccuggcuggucucaaacucuugaccucagguuauccgcugcuucagccucccaaagugcugggauuacauccaugagccaccuuacccagccccuuucuuaauguuuuuuuguuuuauuuugagauggagucucacucugucgccaggcuggaguacaguggcgugaucucagcucacugcaaccuccaccucgcagguucaagagauucuccugccucagccucccgaguagcugggauuacaggcacgcaccaccauguccggcuaaugauggaguuucaccauguuggccaggauggucuugaucucuugaccucaugaucugcccaccccggccucccaaagugcugggauaacaggcgugagccaccgugccuggccuaauguuuugcuuuaaugugcucacaaagggguuugcaguagcaagcaagauaucaaagacagagaagcaccagagccuuugcuguuguucacaaugaaagaaaucugaaaagagaauaagcacauauggcgugccuguggucccauggagaggcugaggcuggaggaucgcuugaucccaggagugcagggguacagugagcugauugugccacugcacuucagccugggcaacagagugagacccugucucaaaagaaagaaagaaagagagaaagaaaggaaggaaggaaggaagguaggaaggaaggaaggaaggaaggaaggaaagaaaaaaagaaagaaagaaagaaagagagaaagaaagaaagaaagaaagaaagaaaagaaagaaagaaagaaagaaagaaagaaaaagaaagagcgggccaggugcgguggcucauggcugucaucccaacacuuugggaggccaaggcaagcacaucaccugaggucaggaguuugagaccagccuggcuaacauggugaaacucugucucuacuaaaaauacaaaaauuagccugguguggugccaggagccuguauucccagcuacuugggaggcugaggcaagagaauugcuugaaccagggaggcggagguugcagugagcugagauugugucauugcacuccagccugggcgacaagagcgaggcucugucaaaaaaaaaaaaaaaaaaaaagaaaggaaaagaaaagaaagagaagagaagagaaggaggaagggccgggcgggguggcucacaccuguaaucccagcacuuugggaggccgagguggauggaucaugaggucaggaguuccagaccagccuggccaacauacugaaacucugucucuacugaaaauacaaaaauuagcuaggcaugguggugcacgccuguagucccaccuacucuggaggcugaggcaugagaaucgcuugaaccugugagauggagguugcagugagccgaggucgcgucacugcacuccagccugggcgacacagcaagacucggggagggagggagggaggaagagaaagaaaaaaagagaacaaucuucacacccucggccucagaguuaaauagccaguucuguauugcccaccgaagagauuuuaggggugacugugacaacauggucuggauucuggggacuugggcacucccucaaggagcgcccaggcuggaaggacacagagucagcgucucccggcucacgugccaccccagcacggagcugugagcccaccaaaauccugcaucuccugguuccaucccaagaaccaagaacuggcugagaaugauuucugucucuuggcucugaggcuguaagccccacccaaguuaaggaaggaaauugccuuuucuguuugaaccugaggcucagagagguuaagugacuugccccaggcuacacagccaggagaggagagcaggaaugugaacccagaacuugauaccaaaggaaaagggaccccauaagauuguuuugugucuagcugggugccuggcacgcagcaggcucuggagcccguaaagauuagcugaagaaauaaguggaugaaugaaucgaaguucccccaguuccucuaaucugggaaacgaaaaaacuucugccugauacauuggagucuacagauacguucaacggggcucuuccaccuucagcuuccccacucacggcuguuucuccaggggcagggcuggguccacacgcuccgcaggcugggggcuucugggcggaggucuccggagcuccuuggcugagccuggaguccucucccacucuggacugucaaacugcacuggaaaggagauuuagagaggaaaggguuaaguccagccuaccuuggggggcggggcaggggcaagccaauggaaucucgguagaaaggcagggccagcuugggacaaccuaucacagcccaggggcugggcuuaaggcaggggcaggauuggccacaggugcaaccuuuuggccuuccuaagaaauaggugcggucauuuauaaaucugguggcaaggagcacaaggggcguggcuagacggggucgguucgaaguuuccaaagaggagcccuagucccuaaaccccuucugggguucagcccagacuguggccaaguccuaaaacuagaaaaucacccccaaucuacagacagguggacaaaggcacuaagcucuaaauacccucccagucauaaaacuuugggggcaaagucguguuugcacaacucuuccugguccaaauuuuauuuauuuuauuuuauguauuuguuuauuuagagacaaaguuuugcucucgcugcucaggcuggagugcaauggcacgaucuuggcucaccgcaaccuccgccuccagguucaagcaauucuccuaccucagccuccugaguagcugggauuaccggcaugcaccaccacgcccgacuaauuuugcauuuuuaguaagacgggguuucuccauguuggucaggcuggucucgaacuccugaccucaaacgauccacccgccucggccucucaaagugcugggauuacaggcgugagccaccgugcccggcaauuauuuuauuuuuuaaaacugauuuuaucauuaucucuuuuacagaagagaaaacuaagguucagaggcuucuccaagcucauccaauucagcuggaaauucaccuguaguuuacuagcagcuauuaagaaaugcugccccgggcgggggcgcgguggcuccugccuguaaucccagcacuuugggaggccgaggcggguggaucacgaggucagaagaucgagaccauccuggcugacauggugaaaccccgucucuacuaaaaauacaaaaaauuagccgggcgugguggcgggcgccuguagucccagcuacucgggaggcugaggcaggagaauggcgugaacccaggaggcgaagcuugcagugagccgagaucacgccacugcacuccagccugggcgacagagugagacuccgccuggaagaaaaacgaaagaaaaauaaaauaaaauaaaauaaaauaaagaaaugcugccccugccacccccacauccuauucuaaaagcaagccauauuccucuccccacaccacacugagcaggauaaguagguuccauuccacucuaaaaaguguuugcguuuccaaggaagaugcagguugucuuggaagaaagaauuuaggacuaucagucauucacacucuagugagaauuaacaaacuacaaaagugacaaguaauuggacucuacuuuguaaacugaaacaggagacaugaccagaugaggaaaugcagggauggggcauucagaugucagagugugggucugagaagcaccugcaaacgcccuggagauguggucuuucuuccacucccagggcugaucauacucaucugcuggccguucaucuuccuggggcauccggcucugccgaggcuucugcccagaaggggguccaucugcugucucuggguccuguuccucauaaggggugucauagagcugcaccccucugccgggaaguucuaggaggccagggacacuguucagcuccugcucccaucugggacccugucaccuucccccaagccgugccuacucaccacucaugacccauugggcaucguagggcuccauguacccaucauccgggggugcaggaugaggcugagcaucaaaggggucuaaauacucagugucggcuuccagcugcggagagaaggaaggggagaagacaaggacucagaggggcuucccugcuaauugacgcugcaccucuugccugcccacagggccaucugacaccucuccaagaguuuuuauuuuuuuauuauuuauuuauuuauuuuuauuuuuauuuuuugagauggagucucgcucugucacccaggcuggagugcaguggcgggaucugggcucacugcaagcucugccuccuggguucacgucauucuccugccucagccucccgaguagcugggacuacaggcgcccgccaccaugccuggcuaacuuuuuguagagaugggguuucaccguguuagccgggauggucucgaucuccugaccucgugaucugcccgccucgggcucccaacgugcugggauuacaggcgugagcaaccgcgcccagcugaguuuuauuuauuuauuuauuuugagauggagucuugcuccguugcccaggcuacagugcaguggugugaucucggcucacugcaaccuccgacucccgggaucaagcaauucuccugccucagucucuggaguagcuggaauuacuggugccggccaccaaaccuggcuaauuuuugcauuuuuaguagagacaggguuucaccauguuggccaggcuggucuucaacuccugaccucagaugauccgcccgcuucagccucucaaagugcugggauuacaggcaugagccacagugccuggccucuccaagaguucuuuuuggggguuggagagggagucuguuacccaaaagugcucgcagacagcggcuggcuucccacgucucccucugucuugaucccauuuccccagcacagacaccugccucccuccuucgcccacuucagugcuucuccgugcacuauugucaaggauuuaccuguguugauuuguaauaccaacauguaauaaguacaccauuccccuuuuccagacaaggaagccaaggcacagagacaguaaguguuuugcuuagggacacacagcugguaaguaagaggccgagucugaucccggcugacugguuuccucgagucccuggcucuucuuaccaacgucuuacuucuuauuuauuuauuuauugagacagagucucgcucuugucacccaggcuggagugcaguggcgcgauguuggcucacugcaaccuccaccuccuggguucaagcaauucuccugccucagccucaggaguagcugggauuauaggcgcacgccacaucgccugguuaauuuuugcauuuuugguagagaugggguuucacuguguuggccaggcuggucuggaacuccugaccucaggugauccaccugccuuggccucccaaagugcugggauuacaggugugaaccaccacacccagccuuuuuuuuuuuuuuuuuuuuuuuuuuugagacaggguguugcucugucacccagguuggagugcaguggcgcaaucaugacucacugcagcuuugaccuucuaggcucaagugauccuccugccucagccuccugaguagcugggacuauggugugcaccaccacaacuagcuaauguuuugauuuuuuuuuuguagagacaaggucucacucuguuagcccgggcuggucucgaacuccugggcucaagcaauccucccaccucgaccucccaaagugcuggaauuacaggcaugagcuacugcacccgguggccuggguucaaauccuaguaagcuagaaccccgugagaccuuagccaagucacuaccguucugcgagccucaguuucgcuucuguaaaacgggaacauagugguaggaagggcagcaucaccgggaggauauuuaggugcccagcaggggagcaacucacucagaucuauuuuaggaagaucccaccagguuccaagaggaaggggugcugaggggagggggcugggggacugcaggggaugaccauggaggaggaggaggacccggagaccaagcaggguggucagagaggcagaaggacaaccagcauuaugcauugaaaagggacagauauccaccgggcgcagugacucacaccuguaaucccagcacuucgggaggcagaggcgggaggaucaccugaggucaggaguuugaguccagccuggcuaacauggugaaaccagucucuacugaaaauacaaaaauuagccgggugugguggcacacaccuguaaucucagcuacuggagaggcugaggcaggagaaucgcuugaaccccaggagguggagguugcaaugagccgagaucccaccacugcacuccagccugggugacagggggagacugucucaaaauaaauaaauacauaaaaagaacagacuuccccaagcagguggaggucuggaggacugggaagggucugucuggugccccaguccccuccugugaucacacauaaaauaagcucuccacgauccagagagcccauccugagccuccccuccacccagucuccccaggccacccagccacgcaccuccuccccggggccgcccagaagggccuuggcucuggccauauccgcagccuccaccuugaugagccggugcuugggagaaccauacuuggcaucuccgggguucuuggaguccccagggcccgcgggguccggcuccaagcggcucuccgcguccucauagggguccucgaaguccagguucuucugcgcgcgguaggcccucaggaugucgcucucgguguaguccggggugggcggcugcggagggggccuccgacccccaaagcucagguagucccguagccacuuggccauuugggcgccugucaccccaaucgggccacugucagaggggcccccacaugcccuucuccgggccccuuuccccaaggaggaggaggagguggagaggaagggaagagcagggaaggaugagaaagaucaggugcgcccuuuggcggggcucuggauggauagagggaaggaaaaggugaacgagggggaggaaaaggaggcgacagaggagggaggaagagaagcccgccuuagcccagcuugggaagcaccgcgggggaaggggggaccucgcagggccccgaaccccgcgcgcugggggcuagggcgaggggcauccgcggaggcgcgcggaguuuccgcgggcagcgcgguucccuggagcgacacggccgcccgccgccuccaggaagcuccgggaucccuuccuggggucgggagauccgggccagcgccaccugcggacgcucccggccccucucccagcccggacgccuggguucucagcgcagcgggcgggcuccccaggggcgcgggcgccgcgcgcaaaguugggccgcggagacugugaccccggcgggacgcauccuuugucgcgcuccucucggcucagcggggagcccccagucccgcggcccccgccgccucgauccggccccagccacccgcacaaagggaaauaaaaaccuccuccaaucccccuucacgcuuucggagagacuuuccccgccgccgccgggaggugggacgcuggggaggggggcgcgcaggaggacgccccuguucccaccagccccgggccgcgucccgggcagcagcgucaaggcucccccaccuccccuccgccgcgucccccgccccuccccucccccugcgcuccccucggaggugacugagaccuucagcuguucuggggagggagggagccgcugcccgcggagggaaggggggcugggggcgggagucgccggggccgaggccgcggcagcuggacacugaccgggacgcccgagacuggccgcagcgagcgcggagcgcgggagguggggagcagcugggagugacacugcuggggaggggaggggagagggagaaggaggggagggggaaauugcccgggaaaugggggacugcacuugaccgccaaaaggggugaaauugaccagcagagggggugggaaugaccgccagugagggucgaaauggaaccgaugucuggcggugaaacggaccgggagaguggggaugugcaaauugguggagaggucacuggcugaaauugauauuggagcagcagaaggaagaggggggcaaaggaagggugggugcggaucgggcuuccccucccccaagagggcucugcucugugccccgcucccgccccagaggacuaauugcgggcagggggaggguugggggcagcuggcuuggggaagggagaugguaucugugccuggcgccuguccucugcaucuguccuuuug

SEQ ID NO: 192707 - RNA, 16560 nt, Homo sapiens
uggcuggcugcugcuuccguuucuuuauuaccugagcccauccggacccucaagacaacuggagcccacccugcccuggaaggcucagcuccccugcuugaggacgccgcacaccuguuccaggacgugacacaggcucugguccuugggcguccugcuggccaaggagaucugaaacgagggggcugggccucaggcugugcccggggguccuagccagcccugcgccucacaguccaccgugcaaguccagcauccugacugagccccccugagaccgaggcacagggcuggggucccgcagcacagccugcugcuuacccaguggggcaguauguaaccgagggccuggcucccaggggcagcggugcuguguggagggguggggcuuaugugcacacucccgauccugcccccacuucagccccucccugccugguuccagacacccauggggacaccacagccuccacagcuagccgagagcugagcagaaugagucccuuucuaugccagguggagggaaaccaggaaccacuacccuaagacacucagggguggccaggacccugggcccucugcaggggagccacucccaaaacccgcugccaggaccucauccggcacugccggagcuuaaagcuccacaguccaaucaaaucuggccugcacccugcugggguggccacggggugaccagggucaccagucugccagcugggcugucucaggccccugaggcccacggggcucauugcugccaccuuuuaggcugcccagggggccucuccuggggccccguuaggaggucugcggggacuuggggcucaccuuaagcuugucgagguaggugugcuccuggcuccaggguuccuggagccucacgaggucaggggaacccuuguagaacuccaccagcagcaucuacaggacagaggagcauggacucccaggcucccuccaagccugagguaccucagcgccucuccugggguuccagucucaggcagcccugagacaugaccccaucacuaacaaaccaaccacaaagagaucacgagugaccuuagccagagggcucaccuagcuuagguccaggagggcucucucgagggggaggcagcagcguugcccaaguggcugccacgagagguccaccuggaccugcacucaccgagcccaguucuccagaaccacgcgggccugacguggcccccugguucggccucauccccagcagugacaccugugaggucacagguuugacgaacuaguuuagguuuuguuggguuuuuuccuugagguagggucucacucuguggcccagacuggagcgcaguggcgugaucucggcucacuguaaccuccaccucccggguucaagagcuuguccugccucagccucccaaguagcuaggacuauaggcacccgccaccacuccuggcuagcuuuucuaucuugguagugacaggguuucgccauguuggccagacuagucucgaacuccugaccucaggugauccacccaccucagccucccaaagugcugggauuacaggcgugagccacuaugucugccuuaguuuaguguuuuaaaugcauguugaacacacaauuuuuaaguguucauccaguuaccacccaaagucccugggguuucucuacuggacagccuggcagaagaggccagugccuuagagaacagcagguggggaggugagggagggcagaaguuggagggacccuggcaagggccuggacucuguccugagugauggaagaagcccuaacccaggcccccaaggcgccaccagccauagcuucccaagcccaccggugggaagcagaccaacgcaucgugugcccagcugcgcacugccagccccugccugcccgccccgcagcgagcucaccaucucgugaaggaugucauuggucaggaagcuguccuggacguaggccaucuccacauccauggggaugccauagucacugggccuuugcuggcagggacacagaccagugagagaagccucaccagcccgcagcccauggcagcuggggacaauuggcagugcccgggcugggaacgggagagugcacaccccggcucagcucugcaccgggaucggcaccugguggugggaccagggaggcaguguagcauccuuacugugggagaggcccagaggagagccagggcccugaaaugacuucccagggcugaccucugacuucagggcaggauuggggaaugaagccaggcagggucaggaagggagcccucuuuguacugagcagccaaugacacaacggaggccccacgcccaggaccucaccaaaauaugggcagggcagcagucacguccccauuucauagauggagaaacuggggccccaacucuccaguggagccuggaaccaggggccccugccuagucgugacccaaaugccccagugcucccgggccccccaggcucucccaacagccccaccuaccucgggaggaggcaucacccagaaaggugagaucuuggacucggggccuggguugccagaauaguaaggggcuggcgggagagagggagagggguuggcccugggaggcucggcuggcccagcauccccccuccuugcuccccccacagccccaucccgcguacagcagagcagggcgaggcagggcuggaagccauugcuggagcccugcagccgcagcugguaguccaucugugcgucgauguccugcagagauggcagcgccgggcuguguggguggcugugguaccagcccaccagggacaggccccgcaggaacaggcucugguagaucuggggacagaggcgcagcucagcgggcacaggggccugaacggcucuagugagcuuauguggcuggccagcccugaacgaauuccugcuguguaucaggccuggggacacagugaugaccaagacaggcccugcccccaccgccacugaguccagugggagcuggagagacagccaacaaggaccucuuuuaauauaaaagaugcacccugccacaaagccaggacaccaaagucauuuuguucacugcuguagcccagcuuacagaauaauggucgccacacaguaagcacucaacaaacaguuaaaacuaggcugggagcaguggcucacgccuauaaucccagugcuuugggaggcugaggcaggcagaucacuugaggucacgaguucaagacuagccuggccaacauggagaaacccccuucucuacuaaaaauacaaaaauuagccaggugugguggcgugugucuguacucccaucuacuauggaggcugaggcaggaggauguugaaccugggcagcugaugcugcagugagccaugauuaugccacugcaguccagccugggcaacagagcaagaucgugucucaaagaaaaggaaaaaaaaaaaagaauagcaacuggcacuuaugaguaguguuuaauagaugaggccuggcacugagcauucaauauuagcagcccuucacuuuuuauguucuuagauauagggucuugcucugucacccaggcuggaacacaguggcgccaucucagcucacugaagccucaaccuccuggacucaauccauccuccugccucagccucucaaauagaugggacuacaggugcguaccaccaugucuggcuaauuuuuuuuaucuuuuguagagacggggucuugcuguggccccaggcugguguugaacuccagcaaaccuccugccucggccucccuaagugcugggauuccaggugugaacccccggugccuggaucugauggccuuucauugaagccgcucauuuuacagacaaggaaaccaaggcucugagaggggagggggcuggcgagguuucagcaccagggcuaggagauccaaaagcagugcucuuaggcugggcgcgguggcucacaccuguaaucccagcacuuugggaggcugacgcggguggaucacgaggucaggaguuugaaaccagccuggccaacauggugaaacccugucucaacuaaaaauacaaaaauuagcuggagaugguggcgcacaccuguaauccuagguauucaggaggcagaggcaggagaaucacuugaauccggaagguggagguugcagugagccaagaucgcgcccugcacuccauccugggcgacagagcgagaaugucucaagaaaaaaaaaaaaaaggccgggcgcaguggcucacaccuguaaucccagcacuuugggagaccgaggugggcagaucacgaggucaagagaucgagaccauccugaccaggcacgguggcucaccccuguaaucccaacacuuugggaggcugaggugggcggaucacgagguaaagagaucaagaccauccugaccaacauggugaaacccugucucuacuaaaaauacaaaaaauuagcugggcacgguggcucacgccuguaaucccagcacuuugggaggcugaggcgggcagaucacgaggucaggggaucgagaccauccuggcuaacgcggugaaaccccgucucuacuaaaaacacaaaaaauuagcugggcgugguggcaggcaccuguagucccagcuauucaggaggcugaggcaggagaauggcgugaacccgggaggcggagcuugcagggagcugagaucgcaccacugcacucuagccugggugacagagcgagacuccgucucaaaaaaaaaaaaaaaaagcaguguucuucacccuucaccauggggucccaagcacacagacgggcaugcucaccugcacgguugcugggugaugacacugccagccacugggcagucgccaggacagcuaugucccuucccaacccuccccagaaugccaccucccagguagccccucaccuccucuucgauggcagcugcagucucugcguccccgagccggcuccgacaagggaaggcucugagcaccgucagcacuguggggaggggcagcugugaccccgugaccccgguccuccaacgcccccgcccaccuggcccuggauacccacucuggcuguugacgucccagcggccccccagguaacccacgaccucacuccgugucaggugacuguggaaguccuggggaagggaggaacagcaaaagacuggcucaggcuguggcccugccccaacacuggagccagccugugcccucauucucuuugagacucagucuugcucugucgcccaggcuggagggcaguggcacgaucuuggcucaccgcaaccuccgccuccccaguucaagccauucuccugucucagccucucagguagcugggauuagaggcgugcaccaccaugcccagcuaauuuuuguauauuuaguagagacaggguuucaguguuacccaggcuugucucgaacuccugaguucaggugacccgcugccucagcuucccaaagugcugggauuauaggugugagccacugggccuggccacgcacccuccuucauacauuuauugagcacccacaguguaccaguagcaaacaaagcagacaaggccccagcucucauggagcugauacgcaggggagccccgcccgcugcccaccgacugggcuccggagccccuugccccuagacagggugggccacacaccagcaggaacagcacguugcuagaaacagccacguugaacggcuggaacuuguugauggcugcaaaggauguuacuuccaccaggguguggggguuccuguaggggccaggagggucgcacagucucaggaauccccaggcucuucccucgcccccacacugacucccccaaccccacagcucugaggaucugaggcucugucccaccccccaccccugcccuugcuaccccaagaccagcaagagauccaggugagcuggggcaggggcagaacuuggggugagucugaccuggccaagucgcggcugcccagcaugcaguagcggaccggaacccggaucuugcuguccacccgcuucccugggguuguggccucugggagagaaaaaggcagggucagucccuccccagcccaaguuagaacaaauuagguggccacugggugugguggugcaugccuauaaucccagugcugaagcaggaggaucgcuugagcaugggagguugaggcugcagggagcugugaucacaccacugcacuccagccugaguuacagagugagacucuuauuuacaaagaagaaauuuuuuuucacugggaagcugaggugagaggauugcucaaguccaggaguucaagaccagccugggcaagaugaugagaucucgucucugaaaaaaaauacaaaaauuagccgggugugguggugcacaccuguggucccaguuacucaagaggcugaggugagagcaucacuugaacccaggagguugaggcugcaguuagccaugauugcaccacuguacucugcccugggggacagagcaaaacccugucucaaaaaaacaaaaaaacagguacaguggcucacgccuguaaucccaacacuuugggaggccgaggcagguggaucaccugaggucaggaguucaagaccagccuggacaacauugugaaacuccaucucuacuaaaaauacaaaaguuagccaggcguggcggcuggcgccuauagucccagcuauuugggaggcugaggcaggagaaucgcuugaacccgggaggcagagguugcagugagccgagauugagccacugcauuccagccugggcgacagagggagacuccaucaccaaaaaauaaauaaauauauaaaauaaaauaaaauccagcauuugagcuuaagaagucaaggcagugaguaaaacugggcagugggacugucuucagcccaggccucguccggcuccagacuuagggcccagcugacucuccaugucuccaucuugggggcccuaggagaagaucaaggcccaaccucuccccagucuccuccccaacccgagcuguauccgccccuguccugccuccccuccccacgccucucacccgggugggcaggcucugaagggcucuuccccaguggucuccgacucuuguccucugcugagaccccugccagaacguccuccuccuccucuuccaucagcaacuccuccuccuccccuucacuggcugggcucugcagggguuaggggucagggacagcggugggacccucagcugggugcccccccgcucccugcuaaaucccaccccagcccuuuggccuaagccguaagugccauugccccacaugaccacuagagggagggagggagcagagaaggccuuaagcuaagaccucacauuuuuuuuuauuuauuuguaauuuauuuuuuauuuauuuauuuuugagacggagucucucucugucgcccagucuggagugcaguggugugauuucggcucacugcaacuucugccuccuggguucaagugacucuccugccucagccuccugaguagcugggguuacaggcaugcaccaccacauccagcuaauuuuguauucuuaguagagacgggauuucuccauguuggucaggcuggucucaaacucccgaccucaggugauccacccaccucggccucccaaagugcugggauuacaggcguaagccaccgcacccggcucaccucgcauuuuauaauacaagcccugcgcaaccuuuggugagcaccauugccauuuaugccuaggguuccauuauuggaacgcuaagcauaugggagcuauuuauauccuacugcucaaagucaucgccaaggucugauugcaaaaauucaaagaauugcaaccucaggcauaaauggguuuaaacucucugaacucuaucuauucuuuuaucuuuuuuuuuuucuuugagacacggucucacucugucacccaggcuggagcgcaguggcacgaucuuggcucacugcaaccucugccuuccggguucaagccauucucuugccucagccuccugaguagcugggaguacaguugcccaccaccaugccuggcuaauuuuugucuuuuuaguauagaugagguuuugccauguuggccaggcuggucucaaacuccugaccucaagugacccaccugccucagccucccaaaguguuggcauuacaggugugagccaccgugcccagccaacucuauucuuuuuuuuuuuuuuuuuuugagacagagucucacucugucgccgaggcuggagugcaguggcaugaucucggcucacuacaaccuccaccucccggguucaagugauuuuccugccucagccucccgaguagcugggauuauaggcaugugccaccacgcccagcuaauuuuuuguauuuuuaguagagaugggguuucaccguguuagccaggauggucucgaucgucugaccuugugauuugcccaucucggccacccaaagugcugggauuaaaggcgugagccaccgugcccggccgccaagucuauucuuaucuguaaaagggcacaaugaccuccaacuccacggggauggcaucagggugaaaugaaaucauacgcacaaagcauuuagcauacaccuagaugcuccguucauugagcgagccagcaccauacauagguggcuuucacgucuuucaguaaccuuuccucccagucgggcacaguggcccacgccugcaaucccagcacuuugggaggcugaggcgguggaccacuugaggucaggaguucgagaccagccuggccaacauggugaaaccccaucucuacuaaaaauacaaaaauuagccaggcaugguggcgaacaccugcaaucccagcuacucaggaggcugaggcaggaggaucacuugaacccgggaggcggagacugcagugaacugagaucacaccauuguacuacagccugggugacggagcgagacucugucuacaaaaauacaaauuaaaaauaaccucuccuccaguucuguccuaaacugcccuuguggaggugaccucucugggucacaucucacuuucuguccucgucaccuucucggcagcaucugacccagcacagccuccuaccuaccaggacacgguccucacacaacccccggaucccacgcucgccuggcucccucucaccuccccucucgcuguugcuggccccaggcuggguuuucaggccuccucccuccacaccccucccagguggccucauccccucucagggcuccaaauccugucuacaccugacacugcccacaguccugucuccagcccaagccucgcccggcuccagacucagggcccagcugccucucuaugucuccaugugggggacucacagggucacacucaacacagccaugcugggccccacugaacccccagaucugcccuucccacaucccccaauuuuggcagcucgauccacccacuugcucaggacuccagcaucugaucuaucagcaaaucuggcggauacacuuccaaaaauaccuggaaccugcccacuucuucccugcuccauggucggccugggccacuccaucaucccucaccuggaccagcucacucaccucugcccuggucccuggaucccacccuaacccccgacagucuaguccccacagcagccaccagagaacgccugugagcaccucagucagauccuguccuuccucugccugcaacacuccauggcucccaccuuccucccggucaaagcccaaguucuccccauaaccuacagagcccugcaugaccugcccuguccccuucccauccuccccaccuccuucucucucccuuacucacucggcuccagccacacaggcuccucgcuguuccuccaacacaccaggcacggucgugccccagggccuuugcagaggcuguuucucagaaguccucauggcacccucccucccuccccaccuucaguucuccguucaaaugucaccuucucagugaagcccccccaaccaccuucuucccccacaacucccacccaaaggcagggauuuuugacuuuuuuugcccucugcuuuauauucagugccuaaaacaggccuugcacacaguuggccacuaacugaauacauacugaaagaaugguuuccugugucaucuuagcuaggcaagagugccugguaauuuaauggaacacugaucuaggcauuacugcgauggcauuuguuacaugugauucauaucuacaguaaggugacuuucagaaaggacauugcucuugaccaggcuccauggcuggcucacgccugcaaucccagcacuuugggaggcagaggugggcggaucaccugaggucaggaguucaagacuagccuggccaacauggugaaaccccaucucuacuaaaaauacaaaaauuaacugggcaugguagugggcaucuguagucccagcuacucaggaggcugaggcaggagaaucgccugaacccaagaggcggagguugcagugagccaagaucacgccauugcgcuccagccugggcaacaagagcgacacuccaucucaaaaaaaaaaaauagacccacucacugagccacugaggacucggcagccucccguugagcacccucacuuccugacgcuccaucccucccacucgccuucucccgccaccacugcuuuccacaggcaguucccaccaaggcaaaggaaucgugacuggcugcgguggcucaugccuguaaucccugcacuuugggauaccgaagcgaguggaucacuugaggucaggaguucgagaccagccugaccaacauggugaaaccgcaucucuaauaaacaugcaaaaauacaaaaaucagcugagcuugguggcgcgcccuuguagucccagcuacucuggaggcugacgcagaagaauugcgugaacccgggaacgggagguugcagugagccaagaucacagcacugcacuccagccuggacaacagagcgagacuccaucucaaaaacagaauuauaucuuuuguccacuauccagaaccuccacucuuucaaccccucugcugaugcaaguaacagugaugaccugcuuccugcuggcacugaggacuguauccauauaagaauucaacagaggccgggcaugguggcucacgccuauaaucccagcacuuugggaggcugaggcagguagaucacgaggucaggaguucaagaccagccuggccaaaauggugaaaccccgucuccacuaaaaauaaaaaaauuagccaggccugguggugggcgccuauaauuccagcuacuuggaggcugagguaggagaauggcuugaauccgggaggcagaguuugcagugagccaagauugcaccacugcauuccagccugggcgacacagugagacuccaucucaaaaaaaaaaaagaauucaacagaaaaauggcaggaaaacgcuuacugcuguccugcaagagaucagugaugauuacgauaaaaagaaacuagugaagguguuuaagaagaaauuuaggccgggcgcgauggcucacgccuauaaucucagcacuuugggaggccgauggggguggaucacgaggucaggaguuugagaacagccggaccaacauggugaaaccccauuucuacuaaaaauacaaaaauuagccgggugugguggugugugccuguaaucccagcuacucaagaggcucaggcaggagaaucgcuugaaccugggaggcagagguugcagugagccuagauugugccacugagcuccagccugggcgacagagcgagacuccgucucaaaaaaaaaaaaaaaaaaaaaaaagaaauuugcaauuugccugccugcaaugauacuguaauugagcauccagaauauggauaagucagcugggcuugguggcucacgccuguaaucccagcauuuugggaggcggaggcgggcggaucaccugaugucaggaguucgagaccagccuggccaacguggugaaaccccgucucuacuaaaaauauaaaaauuagccgggugugguggugggcgccuguaaucccagcuacucgcgagacugaggcaggagaaucauuugaacccgggaggcagagguugcaaugagcagagaucguggcauugcauuccagccugggagacacagcgagagucugucucaaaaaaaaaaaacaaaaaaaaacacaauauggagaaguaauucagcuacagagugaccagugcaagaacauuugccaguuccuuguagacacuggacugacuaaggaggaucaugugaagggucaaggguuuuuuugccacugcgucgggcagguucauggguuuuaagugcuuguggcucacugaagcuuaagugaggauuuccuugcaaugaguagaauuuccuuucuguccuuugucacaaguuuaaaaaccucacagcuuguauaacguaaccauuuguggucugcuuuuaacauggacuaguguuaacuccuucaugcaauaaacuucguacauaaaaaaaaguuuaugaaaacauaucuacaggcagcugggcgcgguggcucacacuuguaaucccagcacuuugggaggccgagguggguggaucacgaggucaggagaucgagaucauccuggcuaacacggugaaaccccgucucuacuaaaaauacaaaaauuauccgggcgugguggugggugccuguagucccagcuacucgggaggcugaggcaggagaauggcaugaacccgggaggcagagcuugcagugagcugagaucgugccacuguacuccagccugggcgacagagcaagacuccgucuugaaaaaaaaaaaaaacauaucuacgaaaagaagaaaggacauuacucuugauacuacaggugggccucauccaaucaguugaaggcgauaacagcaaaaacagaaaaaaaaaaaagauucugccacaagacuacagcaucugcuccugccucaguuuccugccugcccuacagauuccacacaugggcacugguaccaucuccauuuugggguuuuguuguuguuguuuugaaauggagucucaaucuguugccaggcuggaaugcaguggugugaucucagcucacugcaaccuccgccuugcagguucaagugauucuccugccucagccucccgaguagcugggacuacaggcgugcaccaccacgccuggcuaauuuuugucuuuuuaguagagacgggguuucaccauguuggccaggcuggucuggaucucuugaccucgugaaccugccugcuucagccucccaaaaugcugggauuacaggcaugagccacugugccuggccuaccaucuccauuucacauaagaaaaaaaaaacggccagugcaguagcucacgcccgcaaucccaacacuuugggaaguccaggugggaggauugcuggaggccaggaguuugagaccagccuaggcaacauggugaaaccucaucucuucuaaaaauccaaaaauuagccgggugugguggcaugcgucuguaguccagcuacuagggaggcugaggugggaggaucgcuugaacccaggaggugaaggcuguagugagccaagaugggggcacugcacuccagccugggccacagagugagacccugucucaaaaaaaaagaaaaaaacuaaggcacacaaaggguccuuggucaaguucacccggcuggugaacacucagggaacaucuauuaucauagcauuugaaguucccccagugccccucuggucccugccaucauuuccagcccccucagccacccaugacaccagcaggucuuucuucuugucuacaugacuuugcguaugccauuccauccuucuagaaagcucuucccuucaacuugcucugacaaacuccugcucaucccucaaagcccaagcucccauguccccucucuccgccccagcccuggagggauggaggaggcaugucacgugguaagggcuccauccguguuuguauauauuacuaauaccuccuccggagagagcugugccaggcugggcaccccucauuccacagugaccugggcggcuuccuggaggaggcugcagcacguaccucaucagcagccguggcaggcgugugcagcuggugcagccggagccagguggccuuguacuuguccaguuucuggccuuuguacuugacagaggcccagccacagcccgacuucuuggcaggguucaccagcuucuugcaguggguggcccaggcgcugggugaguugaaggucugcccggucuccugccacaugauccuuccgucuggcugcaggucgcccaggaacuucuuccccugcagugacagucagcuggcugggcccaggaccaacacccaccaugcccucucucccgggggguccuccccagaccuacgcucccucaggcaugucuuuacagggcuuccaggaacaccucucaggccggcugcagggccuccucagugccugggaguccacacccacaaaccugaucagccugcaccaagcugccuggcagauaucugcaccccgcccaccaugaccaagaaaccccuaagaucggggauagggucugucugucuugaucacugcugugucuccaggaugcaacacucagcaguugcuccauucagaaacucccauucagaaggggaauaaugugcuaccauucacaaaucaaacaauaaugacaacaguaauaguaauaauacagggcugggugcagugguucacgccuguaaucccagcacuuugggaggcugaggcgggcggaucaccugaggucaggaguuugagaccagccuggccaacauggugaaaccccaucucuacuaaaaauauaaaaauuagccaggcgugguggcgggugccuguaaucccagcuacucaagaggcuaaggcaggagaauugcuugaaccgggaggcagagguugcagugagccgagaucaugcuacugcauuccagccugggcaacagcgcgagacucugucucaaaaaaaaaaaaaaaaaaaaaaaaaggccgggcaugguggcucacgccuauaaucccagcacuuugggagcugaggcaggcggaccacgaggucaggaguucaagaccagccuggccaauauagugaaaccccgucucuacuaaaacugcaaaaaaaaaaaauuagccaggcgugguggcgcauaccuguagucccagcuacucgggaggcugaggcagaaaaucgcuugaaccgggaggcagagguugcagugagccgagaucgagcaacugcauuccagccugggcaaaaaagcgagacucugucucaaaaaaaaaaaaaaaaaaaaaguacuaauaccuaccacagauaaagugcuuaccauguggcaggcgccugcugagggcuuuauucauuuaaccauccccuaauuuucccaugguggggaaauauuccauuucacggcugggaaaccacaggaaggccgggguguugcccaucugacccugcgcgggugguggcuccucucugagccucagcuucuccuuugugggaugggguguuugguaaucuacguccuccccaccagaaggacccaucugugccucagauuccucucuccacauggggcuugucccguaaaaagagcuccgggccucaguguccccuccacgggagcuccuccugcaggaaaggagcucugggccucaguuuccccuccccacacuggggcuuguccuaaagcaagggagcucuccaggccucagucucccuuccucacaccggggcucuuccugccgccaagggagcuccgggccucagucuccccucuucaugucggggcucuuccugcagccaagagagcuccgagccucaguuuccccuccucacacuggagcucuuccugcagucaacggagccccgggccucaguuuccccucgccacaccggggcucgucucucagcaagggagcuccgggccucaguguccccucccuacacugaagcuuguccugcagcaagggaacuccaggccucaguuuccccuuccugcccgagccgcgaugggacgagggaggcggggugcucaccagguaguagauggacagcaccccggcgccaggcuccagcagcgcgucuuugaggagcacccgcagugugaccgcgcgccuggugagcgcgcccccgggcccgccgcagccccccgccccggccccgccgccgccgccuccuccgcugacgcuacugccgccgccgccacugcguccaccgcccgcucccgcauucggccgcucaggguccucggccuccgcuucguccucguccuccuccggcgccuccucgcccgcaccgcccgccggggacagcggcuccggagcugcggacagcgagaggcugcagggaggccgcucgccccacggcucugcagccccgcgccccugcagccccgcgccccgcgccuccgccccgcugggcccgccguaccugccauggccgcgccuccccgcgcccggagcucuagacuccggcuucccggcacgucacgcggccccgccccg

SEQ ID NO: 192708 - RNA, 10293 nt, Homo sapiens
uauauucaaacaaccuguuuauuugggcuuaugauuuacuaacugcaggucuaugugcaggaaggccagcauccccuccugccguugucacccacauccacagagcagcccuagugccaggugcagccacugccacccacggcacacgggaacaggacccaugcugcaggccugcucuccugcccagggagaugccacgugugucuguccggcagcuucaugacacaguuaccaagcagcuagggagggcuuagauuuguugguguccccaggccucucccucgggggcuugggcgcauccccacagcccccaagggaugggggcucugccacggggcccaauuccacagcuccacggcuggcgccccucccgugcccauggggcagagccaaguauuuccagagguggcuuggaggcccugggguggcggggagaggaacagggagagcaugagacagacccacagggcugaggccaacccugcuuuuauuucacaagagcuucucgauggcugacaggagcucggguuucaggauggaguccggcucggcccccgcggccuugauguccuccagcacagccaugucccacgagaaggucaggagggcagagggcaccugcgguagggguaggccgucacucugagaccgagagucggcccuugccgcggcagggaacucagcgggcaaccugggcgcggggaugccccggccuggaagccaucucagcugguggaggcuguggcucgcacccaggccuccugcccucucccuccgggacuccaggaccuaagccuaaaccuacugcacuagcuaacgcacgucaccgcucccauuugauggggaaacugaggcguggaguaguuaugaacuugcucgaggcccugcugccaguaagugggaaagcaggauucaaacccagggaccugcccaggcccccugcucugagaacaaggaggcucccuccugggggugucugugccggucccaggagaaccugcagaggcaucgggucagcggugcuccugcgggccgacacucaccagcccgcacucguucaaggccagguucucguccucggacagcuucugcccucccgaggccagcagcucaaaaggcagccagucgcucugcagggccucccggacgaacccguacaccgcccccagccgcucccgagcguagaaagugccuggggagugggggagucagagcggguggggcccagggcccccuaccaacccgagccgcccuccacgggcaucguuggugcccacccugcaggaggcagccaucggggaggcgcacgcgcagcagcguguaguuguacuugcgcagcccccgcugcuccuccuucucccgcauggccuugguccgcagcacgcucagccgcuccaccgccucggaccugcacacgcgggccaggucacgagggcuggccgggguucuuccaccccgccccgccccacucugcuccgcggacgucaggcccaccugagccucugcucccgcuugaucuccucugcugugagguugaagaaguccccaggcaguucgaacugcgaggccaggggcgagggcuggaagacgcggcgcugccuguccagcuuggcgcgcacgggcuccgcagccagcagcuguuccuugugccucuccaggcucuggggcugggccaagguggucucgcucagcacguagaacuccucgggguccucuacagcguggcaggacaugggugucacugugcaauggagagacccccaagccgggcccuccugccccgaggccccucguccccauucccuacucagccaggcccuguccacuuacccugauccugggcgggaagcaacaccuucuggaacccaauggccucaaaaaacucgugggucccuuccaggcaguuaaugcgcuccuggggguggagaugggcgucacugggggccccuggcuuccuccauggccuggccacaccccacccaguccaggggcccggcucucgcuauugggagcagcugucgaccccuggauggggcccagcccugggggugccucagugcuggaugcaaaccugcuuuucuacggugggggcuguggagucuccaacagcucugcacagaggaaagagucacaaccaggcacgaagagugaggcugaggagccagacacugcuggggccugaugcgaggcuaacaccgcccaggaccccagucccugcccuuucccccagaagaaccagacaucugguuugcaugagaaaccuccccagagucgacauguucccaaacaagcccagcugaagaggaggaaaaggaugcaggugaggagaggcagaauuuguugauuuggggugaccggugcauaaaagucuugcucuccaucuuguccugcuaccuucuacuggccgaacccuucacugcuuguggcucaacucucgcuagcuccuccagggagcccaccgccuggugugggccaccaccggcuccugcaggccagcugcccccacccccagccugggccccgggggccagaaggcacgcccaccugaaacaccuuguucugcagcuugaucuuccgguacuucuccuccucggggugcagguggauguuguccagguaccugggguagguggagaaggugaguggggcacagcccaggcugcccacccggccccucugugccuccugcuccagguaacagcagcucagccacacuuggccucuagucagagggaagaagcggcccagugacgcgagggcagcagaccaucuccggguggaaggcacaccucggacaccccauggagcccaccccuggugccagcaggagccccacggaaccccucaccgucccaccagcccuggaagggcacaauuaaccacagcgguggggaagccacagugccggaagaguggagagccagagcugaagggccgcagugccagcagggggcuccugcggggugcucccucggcguuggcgggcagcguggaccuccaggccugcccccgauccugagacccggggaguggggugggacccugccuccuccacauguuccccaaggaagccagggugggaaaccccugauuccuucaacaccuucauuuugcacacggguaaacugaggcccaaggaggcccagcccuuugccugaggccucuggguggagcugccucacucucggccuaugcuccuucccaacccaccucagcagguaaugagggggccagagggggugacagccccagugggaggggugcugggaugagcuggaggggccaggcagggcaaaggggccacacgcucacuuggcaaugguguccacacccagcuucacccgguccuggucuuuguugaacguguagaucuucaugauggaggcggccacugggucgguggagaagugcugggaggagggaagcagggaaagccacucacugagagcccgggccgcacggcccuccgcugcccagguaacaggggcaggaaaaggaaggcagaacagcggcuuggagcggccccagcugugcgcucaucacagaaaggaaaagagagacccuccaagaccgcagcccugcccacgccccagggcagaggcgacgcagccaagacccagcagaacucaagucuccccuuccgccuucucaaggcuagauccaugggacuuggaagccagugugacgcgacagaacugugccucacacucuggcuuuagaacucgaccucagugcugagauccaucaaggccaccgccacuuacagaaccucccgccaccauggacgccccaucccuccugcucucgcagccccaugauggacguucuggaaccacucccgggccucauguuuacaaagagaccgagaggcccaucguccagggucacagggauggcagguggcagagaggacacaaaugagucugcaacccucaaugucugaaacucaauagcuggaagacggauacccccagccccugccccuccccgaggucccaccuauccaccuauguuaccgggggaggggagaagucauagcuggaacucuggggguuucccagaaccagcccugcugacugcgaacagcgucccagcauggagaggcugagaacaguacguacccuaagaccuggaaaagauuggggcacaaauccacgcucggcacagccaucacacacggccacacccagagagccacccauggccugggaagcagggcugccacccgcaccucccugggcugcccagacgagggcgggugaacagaagggcagcccagggccaugugucaggauucgggccaccugcccaggcagcccagagcuccacccaccaccccccacccucaacugcacagcagggucccucagcagcccccugcgucacacggaccaaugaccuacacacugagccggggcucaugccaacugaaaauugggacccggcccagucugccgguuuaguugcugagaugauguggggagcgggacagagcacguggaugcagagaggcagagcugccagaugggcauguccccaagacaacagcuuccuugggaucagagcgcccgggacagcacaccagccaagggaagcgugucagcuccaaaagcgggccucgggcguuuugggcgacuggcugccaggcuuaggucaggagcuggguacaugcacagacaagggacgaaggaacagcagccaggaagggguccaaauccauacaggaauguacuuugugagaaaggugggauuucacagcuguaagcaaaagacaggugcucucgacagguggggcugagaagaaagcugagccaagaucuaaaaaaaaaauuacaucagcuccaucccaccauguuacauaauaacaugcuccagcuggaucaaagcuucaaccauggaaacaagcaagcagucaaggagaagccagaagaaaagcucuggaggccgggcacgguggcucaugccuggaaucccagcacuuugggaggccgaggcggucggaucacgagauuaggagagcgagaccaucccggccaacauggugaaaccucaucucuaaaauacaaaaguuagcccgggugugguggcgugcaccuguagucccagcuacuugggaggcugaggcaggugaauugcuugaacccgggaagcagagguugcagugagcugagauugcaccacugcacuccagccuggugacagcaagacucugucucaaaaaaaaaaaaaaaaaaagcacuggagaggccacaaaagaauucucucagcauggaaauggggaaggcauuucuaagaaugaccccaaacccaaaagccaugaacuaaaacugacacauuuaauuauacagagaucaaaaaauccuacacagcaaagugaccauaagcagagccaacauagaagcaacuagagggaaacaugugcaacucauaucauaggcaaaagccuaaauugccuaauauguaaagagugcugccgggcacgguggcucccgccuguaaucccagcacuuugggaggccgaggcgggcggaucacgaggucaggagaucgagaccauccuggcuaacauggugaaaccccgucucuacuaaaaauacaaagaaucagcugggcgugguggcgguucgccuguggucccagcuacucgggaggcugaggcaggagaauggugugaaccucguaggcggagcuugcagugagcagagauggcgccacugcacuccagccugggcgacagagcgagacucugucucaaaaaaaaaaaaaaaaaaaaaaaaaaaagagugccuacaaaucacuaauaaaaagacaaacuaucuacuaaauaauguagaaaggacgcauucucauaugaaacauggccaauccaaaauaaggaaagugcaaauuaacucuauccugagauguuauuuucaccuaccaacaggcguaaagaucaaaguuuggugauuuacaguauggugagaggauggggacacgggugcuuuugcacacacugcuggagugggugugagucuggagagucuauggaacuauuacuauuuuguuuuguuuuguuuuuaagaugaaguuucgcucuugucacccaguguccacgcuggagcucaauggcgugaucugggcucacugcaaccuccaccucccagguucaagcgauucuccugccucagucuccugaguagcugggauuacaggcgccugucaccacgccuggcuaauuuuuguauauuuaguagauaggggguuucacuauguugaccaggcuggucuuggaacuucugaccucaggugauccaccugccucagccucccaaagcacuggaauuacaggcaagagccaccgcgcccagccacuuacuauuuucugagaaagggucucacuugucacccaggcuggugugcaguggcaugauuacagcucacugcagccucuaccucccaggcugaagcaauccucccaccucagccuucugaguagcagggacugcaggugcacgccaccaugcccagcuauuuuuuuuuguuuuuggcagagacaggguuuugccauguugcccaggcuaaagccgaaguuucugagaaccuauugaugguguuaagugaggacuugcuguauuggaaaaaaaugcuguggacguuuuuauuuuuugagauggaguuuugcucuuguugcccagguuggagugcaauggcgcuaucucggcucaccacaaccucugccuccuggauucaagcaauucucuugccucagccucccgaguagcugggauuacaggcaugugccaccaugccuggcuaauuuuguaggaaguucuuucuguauugaagcaaauaauacuuaaccuuuuaugaaaaacaaccaggccacgcgugguggcucacgucuguaauccuagcacuuugggaggcugaggcggguugaucacuugaggcaaaaguucgagaccagccuggccaacauggugaaaccccaucucuacuaaaaauacaaaaauuagccaggcaugguggcaggugccuguaaucccagcuacuugagaggcugaggcacgagaaucguuugaauccaggaggcggagguuguagugagccgagaaugcgccacugcacuccagccugggugucagagugagacuccaucucaaaaaaaaaaaaaaagacaccuaguugggagagaggagauacagaugcauacacaauggugugccuggauuugggguaucagaggaggggcuucacuacuagcaguggccucuggggacucugggagggaucuguaccaccugggcuuccgauggaggguggcucaggcacaggaagcuacagguuggggcaggagcacacagggugccacucaccaagagaauggccuccuugaugcaggcgucccgcugguccuuccucaggguggccccagugagcggacaggugaaguacacgccaggcacagccaggugggcagagccuuccucucugggcucagauaccuggggcggugaaagcguccaagucuggaccguggacagaggccaccccgacccucgccgagcaccacaguccugaguguggcccguagaaccagacaucuccagcccccaugcugucccuuccaccugguggccgugggagacacccuggccaagugaccggauccccgagucuuuucccugguaugucaaaugucccuguggggccugcucagaacuaaacgagguaaggaacggaaaguacggagcagcuucugacacgcaggaaacacccagcagauggcagcuggguuccugcugguccuguccccaagcuguugaggaaggagcucugugugggugucugcgggcacagugcgcuggacaaggcaugacuucugggccuccauuucuaggccaucucuaaggucccugcgugcuaaaauucacugaauccucgagggucaagcugcuuagaacuccuuucagcggagcucugaaggcccaccuccuagaggaaggccucccugauuccacccgucuccacagagccucuugaccuccaaggcaggcaggacugggcagugcuaggggacaggcucugaaaccacagacuggcucugguccugccuuugcugguccugggguguaggagagaggacagcugguuucaccucucucaaccccgguucucuuuuugaauaguggaaacuguaacugcaucugcccuuaagggguuaaggggagggagcgaugggcucguguaccugaggcccacuucuccaggccugagccggcauccucagcugccgagccccgaaggucccagacaacaccguguuccaccacaaccuguguccaccuugcaaggcaagguuuuccaacagcccuugagccccaagggcagaggccacaucucccccgugacacagucaagcuguccccaccccuuggcaugggacagugccaccaguggcuguucuuaccacguuggucccuggggccucggggcucccgcugacgguggcuucggcuugaaguuccuuucucacuggaaggcagcccaagaaagagaggcagagacgggauagugagcacgccgcuguccuggcccaagcccccucauucccggggugggccugggggccacgcacaccgccccagccugcuucugcuggaggucaggcuggagguccccugcaggacuugcugugcagccaccccucagccugagcaagcaccccacugccugggcagcccguuucugcuccaagucucugcucccacccccuccccaggaagcugcccuucccccagcaccugcccuugaugagccgcucccaagggugacccucacacccccacgguugcucaugugacuucugcauccagggccaggcaccagggccgagaaccucaaacagccccaaccugggcccgaggagggccauaucucacccugguuucggaugguguccugcgauguggggccccaggcccgggacugcuucugcuccagccgggcuagggcggcagcggcugccaucugugccucauuggugggucccuggcggggcggccugggggcuggcugguugggcuucucuuugugggccuuuucccugggaacagaccgagggagagugaguguauccucccgagguggccggcaaagcugacgugcagucacacagaggagcuucugccccuccccagcaccaucagccagacgugucccugccuaugugggccaggacaccugguucccaggggccaccugcagccaccagaugguucuacugcaggcggaagagccccuggaggaaggagaugcugguuccacucagcucugcaccaucgggcaaguccugcccccacuggcccucagcguccucaucuguaaaauggggugacagcaccccuccugaggugaaggcaccuugacauccucagugcuuuuuuucuuuuugagacagggucuugcucucucaccaaggcuggaguauaguggcacgaucauggcuuacugcaauccugagcucccaggcucaaggaauccucccgccucagccucccaagucgcugggacuuagaggcaagcaucaucaugccuggcuaauuuuucuaucgagacagggucucgcuauguagcucaggcuggucucgaacuuuugccucaaaugauccucccaccguggccucccaaacugcugggauuauaggcaugagccacagcacccagcccgcauccucaggaauugaggagacucaaggggugucacauccucccucccucccugccauaagacucuccacccucaggucacagcuucguuugcugagcaccuacugugugccaggacccugcugggagcuggucggcucgcuugguuuacuccuccuaacaagcugccagggaggccucaccaucccauuccuaaacccaagagggacaggaaguccgggcgaugugccccaugccacgccacccucguggcgggacccuggggagagcggacagcagaaccagccucgcccuggccacuccaugccaggccuagggcugugcaaguacgaagagcucauggacucguggcuccacccuguugagcccuacaccaaggagaguuccguaacccacguggcacagugaccuggcagagaagccucgcagagaagcccuuucucccaaccugcucggacgcgucugucucacccgucuccucucaggccccucccaugaacuuacgggcugugucaauuucugugccguaggucuauuaaaaccuucugggaggccaggcucucaguucaagcccuauacucc

SEQ ID NO: 192709 - RNA, 12859 nt, Homo sapiens
ggcggacgcuccacgugucccucgccgcgccccgucuacccgccccugcccugaggacccuaguccaacauggcggcgcccagcggaggguggaacggcgucggcgcgagcuugugggccgcgcugcuccuaggggccguggcgcugaggccggcggaggcgguguccgagcccacgacgguggcguuugacgugcggcccggcggcgucgugcauuccuucucccauaacgugggcccggggguacgugccaccgccgucccggauauuugagugcuggcaggcccggggagggggcgcggagcauugggggcggggcccgaggagggggcgcggaccgcggagguggguacugaagaaggggugcggauuguuagggucggaggcugaguggggggcgcgggaccgugaggccggggucaucacuggggcaggacugaacucauagggagcggggccuugugggccccggcggcguugagggggcgugaucaccugucaccugucgccugccuggaguguccaggcaccccugcccuccagacgcagagguggggaggggucagugaugggagcggcaggaggcuaaagggcaucugcccuccugggccugaaggaaaucagucgcugcagcuccgaagagggaggaagugcuccuuccuuccauugcacaagguccccccucaccgagggugugaggccgggcccucagcccuguacucagcuugucggcaaaguccuuuccccucucagccucccuuuccccgccuguaauaacaguaucuuuacuguuuuuugacuauuucuuuuuagacuugcgugcaguggcgggaucucggcucacugcauccuuagccuucuggguucaagcaauucuucugccucagccuccccaguaccugggauuacagacgugugccaccacacccggauaauuguuguuguuguuguuugagauggagccucacucugucgcccaggcuggagugcaguggcgcgaucuuggcucacugcaaccucugccucccagguucaugccauucuccugccgcagccucccaaguagcugggacuacuaaucuuuguauuuuuaguacagaugggauuucaccauguuagccaggcuggucuugaacuccugaccgcaggugacccgcccaccucggccucccaaagugaugggauuacaggcgugagccacugugccaggccaguuuguugacuacuuccuuauaguuaggugugaugccaaguccuuuauauguuaggcccaaguuacagaugagaaaaugcuucacauaaaaaagagaaacagagagaaacuagaggcucagaaaaguuuucacuuguccaggucccauggcaaaacccaucucuacaaaaauacgaaaaauuagccaggugugguagcaggugccuguaaucccaaguacucaggaggcugaggcaggagaaucguuugaacccgggaggcagaaguugcagugagcugagaucaucccacuucagccugggcgacagaacaagacucugcuucaaaaaaaaaaaaaaaaauuagucggguguggugguugcguaccuauugucucaguuacuugagaggcugaggcaagaggauuacucaaaccugggaguucgaggcugcagugagcugucauugugccccugcacuccagcuugggugacagcaagaccccgucucuuaaacaaaauaaaaauuuccuucuaccaaaccuuuuuuuuccuuccauucucuaggacaaauauacguguauguucacuuacgccucucaaggagggaccaaugaggugaguuguucaaaauucccucuagcuuacugugacaguauccauuguuguagggagauguucuguagcagacagcaggguugggucucaccuauaucaccuuacacucauugaaugacucuuccuaaaccaauaaaaagggagaguauuggcauuaaacagugacgacagauucugcuguuauuauucuacagagcaagcaaaugucuggacagaaggagggaggggagaugggagucugccauccccaugagcaucuguugggauguuguauuuuaugugcagugcaacaaguuaucacagcuuaggggcuuaaaacagcacccauuuauuaucucauagcuuuguaggucagaagucugggucagcucaguugugugcuucauaaaaccaaacucaagguauuuugggaggcugaggcgggcagaucaccugaggucaaaguucgagaccagccuggccaacauggcaaaaccucaucucuacuaaaaauacaaaaauuagcugggcaugguggcacaugccuguagucccagcuacucaggaggcugaggcaggagaaucacuugaacccaggagacggagguugcagugagccaagauugugccacugcacuccagccugggcaacagagcgagacucugucucaaaaaauaaauaauaaauaaauaaagguaucacaggcaaggcaugguggcucaugccccaucucuacagaaaauaaaaaaauuagcccagcgugguggcgugcaccugugguuccagcuacuugggagacugaggugggaggaucgcuugagcccaggaggucaaggcuguagugagccgugauugugcuacugggcaacagagcaagacccugucucaaaaaaaaaaaaagucucugggcugggagaagaauccucuccuucaagcucuuaguuggcagaauucaguuacuugugguucagggaccaaggucccgguuuccuugcuggcuguugucuccagcugguggcagaagagccaguaaagaugauuugggccaggcacaguggcucaugccuauaaucccagcacuuugggaggccaaggcuggcgaaucaccugaagucaggagcuccagaccagccuggccaacauggugaaaccccgucucuacuaaaacuacaaaaauuagccgggcgagccaggcgcacuggcucaugccuguaaucccagcacuuugggaggccgaggcggguggaucacaaggucaggagaucgagaccauccuggcuaacacggugaaaccccgucucuacuaaaaauacaaaaaauuagccggguguuuuggugggcaccuguagucccagcuacuggggaggcugaggcaggagaauggcgugaacccgggaggcggagcuugcagcgagccaagaucgcgccacugcacuccauccugggcgacagagcgagacucugucucaaaaaaaaaaaaaaaaaaaaaaaaagggugauuugaagcacauggacacauacgccacugcugcccuugagggaacugcagggcagggaauacacgcggccucuaggagcugagaacagccucuggcuggcagcaaggaaaugaagacuucagucccgcaaccaagaggaacugaaaucugccacaaccacaagagcuuggaagaggaccuugagcuaccaguaagagccuagcccggucaacaccuugagauggguuucgccauguuggccaggcugaucuugaacugcugaccucaaaugaucagccugccucggccucccaaagugcugggauuacaggugugagccaccggugcccggccuccuagagauuuuucuguauccuauguaaagcgcuucaguugcauggacguguggaguugacaaucccguacuaauggauugaggguuacuuccaacccaguccgugaauaaccuuggccaggguucauuguacaagugcaguuacaucugugggaaaaccacccagaagugggauucauggguccauuuucuuaaaaguaaaacugggcugggcgcgguggcucacgccuguaaucccagcacuuugagaggccaaggcagguggaucgccugagguugggaguuugagaccagccuugcuaagauggugaaaccccaucucuacugaaaauacaaaaguuagcagggcgugguggcacgcgccuguaaucccagcuacucaggaggcugaggcaggagaaucgcuugaacccacgaggcagagguugcagugagcugagaucgcaccacugcacuccagccugggugacagagcgagacuccaucucaaaaaaaaaaaaaaaaguaaaacuguauguuuugagaucaugguagauuuacauucacuuguaagaaauccuacagagagauccaaguaccguuuaaccagguuccccggugguaacaucgugcaagaggccagucauuuuagagauggggucucgcuauguugcccaggcuggucucgaacucuuggguucaagugaucaucccacguuggccucccaaagugcugggauuacaggcaugagccaccaugcccagccugcauuuuccauuuugcuuguaccuguugcagcuccaccgacaaccuggaauagucuugguuuucacacccauaugguguguuagcagacaggagggcuuuugcccuucugaccugggagaaaaagguaucucacgauaguucagcuuguguuuauuuauuuuucauaaaugauaugggacaucuuuuuuuuuuuuuuuuuuuuuuuuuuuuuuugagacagagucucgcucugucgcccaggcuggagugcaguggcgcgaucucagcucacugcaagcuccgccucccggguacacgccauucuccugccuuagccucccgaguagcugggacuacaggcgcccaccacugcgcucggcuaauuuuuuguauuuuuaguagagaugggguuucaucauguuagccaggauggucuugaucuccugaccucgugaucugccugccucggccucccaaagugcugggauuacaggcgugagccaccgcgcccggccuggacaucuauuuauauguuuaagaguuguucuuaggccuggcaugguggcuuauaucuguaaucucagcacuuugggaggccaaggugggaggauugcuugaggccaggagguugagaccagccugggcaauauggcaagacagugauucuacaaaacacaaaaauuagcuggguguggucccagcuacuugggaggcugaggugggaggaucgcuugagcccaggagguagagguugcagugaggcgagaucgugccacugcacgccagcccaggccacagagagagacuccaucucaaaaacaaacaaacaaacaaacaaacagcguuguuccuauuuccccauccgugggagccacuuugggguaguucucauuagaggcaccacuuuuaugggaaggauguggugcaggcaggcucccugaucacagaugacagcaaaccccaggccaccaggagggcggggcaggggauuuaguggccagccccugaaucgggagguacagaagagguggccugacuguagaaucagaggcacaccuagaagucuccgagagcagcuguguguccggggcugacccgcgcugucuucucuccccagcaauggcagaugagucuggggaccagcgaagaccaccagcacuucaccugcaccaucuggaggugagacucgggguggggauggcauuuccggcugccguuggccugcccuguggccucaggagcugcuuuggaaggcagggaacgagggcugcaccccuggaggggaagacagaccagcagggagacucaugcacgugcaggugggggguggcagggucgcuggggugggagugcuccccaaggaagugcacugaugcagagacugagaaggucugggggagacggggggagccugugcggggcaaggucccaggaaaaggagaagcagcucagagggugcggagcguggaccagggcccaggaaggccccaaggggcuccacccuccccuaagggugagacgaacucaccaaagggcuuuuuggcaauuuuuuuuuuuuuuuuuuugagauggagucuccaucuuuugcccgggcuguagugcaguggagcaaucuuggcucacugcagccuccgccuccuggguucaagcgauucuccucccucagccuccugaguagcugggauuacaggcgugugccaccaugccugacccuuuuuggcaauguuuaaaaacugagauaaaauuccauaaagcacagcauuuuaagcucacaauucagcugcauggaguacuuucucagaggugugcagccagaccucugcuuccagaacauuuucauccccugaaaauaaacucuguucccaucagagucauucuccuucccagcacauggcagccacgcaucccccuccugucucuguggaugggcguguccuggacauugcauagaaauggggucaaaccuucccuguguggccuuuggugucuggcgucucucacugaacgugacguccucaaggcucauccaugcugaggcccgugucagccucauuucuuuuccuggcugaguccuauuccagagggcucccugcaggaacauguggagcucagauccccccggcugaaggaggcaggcugaggcagggagccccuccaggcaccaaccaggauggagucggggguuggggguggggcgcagauugaagccugugcagaaugaggaugggguggguggagagggcacagauuggaggcuguguagaaugaggaugggguggguggggaggguagauuggaggcuuuguagaaugaggaugggguggguggggagagcacagauuggagacuguguagaaugaggacaggguggguggggaggguauacuggaggcuguagaaugaggaugagguggggaggguagauuggaggcuguagaaugaggaugggguggguggggaggguagauuggaggcuguguagaaugagggugggguggguggggaggauagauuggaggcuguguagaaugaggaugggguggguggagagugcacagguuggaggcuguagaaugaggaugggguggggaggguagauuggaggcuguguagaaugaggaugggguggguggagagggcacagauuggaggcuguguagaaugaggaugggguagguggggagaguagauuggaugcuguagaaugaggaugggguggaugggagcguagauuggaggcuguguagaaugaggaugggauggguggagagggcacagauuggaggcuguagaaugaggaugggguggguggggaggguagauuggaggcuguguagaaugaggacaggacggguggggaggguagauuggaggcuguguagaaugaggacaggacggguggggaggguagauuggaggcuguagaaugaggaugagguggguggggaauguagaucggaggcuguagaaugaggauggagugggguggggagaguagauuggaggcuguagaaugaggacggagugggaggggaaggcacagacuggaggcuguguaaaaugaggacagggaggaggggagggcacagauuggaggcuguggaaucagcuagcugggguaggaggaggaggaaggugcugggcagaguccugguggaacuggcggagcuggugcaggucugggcuggggacgagcuaggcagguggcaggugugggagucugugggguaguggcuguggagguuuggaugaugcuaucucccggggaaugugucccaccagaaggggccccagcuguuuccccucaggcaggucuuuaccagcauguucucugaaggaccagccugauggcucauagccuucuuggggugcagacaucugggaaucagacaaaagcugugcacucucuuccaccugcccgaacacacaugcaucuggguccacagccccuccccaagucuccccagacaccgcccgauucugccccugccgccauccucugucaggcucaugguuuaugggcuuaucccggcuccacucgccccacucauucucguaaccccacugccuagaucccagcucgaucugggcaaggucaugaagggaaggaagccgucaggccccccgguggggagggggucgggggcuucaggaaucuugucccuucuucccugauccuuggcccagaaugucucagcccaaacaguggguauuucuugagccuuuauuuugugcagacacuuuggagggagaaguccaagcuauagcuccaccacugcggucagguuaaagcacguugacaaaugggaggcagagaucagggaguggcgacguuuaacugaaggacagggugugauuugcugccucguguggguguugucccgccgugcccugcggggcgcuuuacaaacagcagguguuucuggggagauucucacccacuccauggaacuggcugcaucacaggcaggccaaggccccaggaggcaucaggagggucauugagaggagauaggccccaucagcccagagagacccugcagaggccgcccuguagucuuggggaagcccacggucgccaucgucugucugcaggccacugcccugcauggaccccugagugccagcuccccagagggcaucugggcaggugcaggucuggagcaguugggaugguggcugggcucaccuugagccugaauccuccuguccaacccccacaaaagcuccccaggggcaugcucagccccggagaccugccaccccaggccuccucaucucagacagugacuggacccucccugaccagggcuguuggcagugcuagggcuuaaagaagaaucuagggcucccuggauacccccgccccacccaugcacauagaaccccagccagggcuuccacagaaauggccccccugcugccccuccauccccaucacacucucuucacaccagagaugccaucauccccugcugucaccuuccgacaccuucugccacuccaguuccuuagaagccuccguuagcagccuucuagagaccugggcagaugauccuccccacuucuuaaguuaacuccuguacuuccuagucaaugcccucugagaagccuuuacuggccucucauugcccagccccagcccccgucguaguaccuggauugcugucagcaaccaagaagccaugugcagugaauggacaugggguccugucccagagcagcucccagcccacaggggagagaggcgugucuaugaaugagcuggaagaacauucuggcacaaaggggccaggcacaguggcucacaccucuaaucacagcccucugggaggcugaggcgaguggaucacuugaggucagggguucaggccaggcuggccaacauggugaaaccauguuuuuacuaaaaauaccaaaauuagucagauguggucgcgggugccuguacucccagcuacaagggaggcuaaggcaggagaaucacuuaaacccaggaggcagaggcugcagugagugagauugugccauugccauccagccugggcaacagagugagacucgucuccaaaaaaaaaaaaaaaaaaaaauucuggcacaaaagaaagagggucugcuguugagagggccccauccauccuucccagucagcaggugcucgugcucgggaauggcguccauguugagaagcaggcacgagaccugcugaccccagcccgagucccuggcggggcuccuuccagggcacacagacccagacccagcaggccuggccugacucccucgcccccucuuccucugcaggccccaggggaaguccuaucuguacuucacacaguucaaggcagaggugcggggcgcugagauugaguacgccauggccuacgugaguaucuuggaguggggcaggcuccggguguggcuucugugcacuggggcagcugugagauguccugccacaagagggcuccauggggacagggaggagaggggacagcgaauccugcagagguaggguguguaacuugcaggaaccuggcacacagacgcccccaggccaggggcacggggguuugguaaccuguugcugcuggcuucucuuguauaugccagaaaagacuucuccaggccaggcgcggcgguucacgccaguaaucccagcaauuugggaggcugaggcaggaggauugcuggaggccaggaauuugauuccagccuaggcaacauagcaagacccuauaucuaccaaaaguaaaaaaaaaauagccaggcguguuggcaugcacccauagucccaccuacucaggaggccgcagcaggaggaucacuugaguccaggacuuugaagcugcagugagcuaugauugcacugcugcauuccagccuggacaguagagugagguccuggcucaaaaacaaaaaagucuccucuccaucucuaguaaaaguagaaagcuuuagucugugcuucucuggaaagcaaacucaaucguuuuccuaaugaugagcauugaacuggcccugguaaaguuuccacucauucuuuuucagucuaaagccgcauuugaaagggaaagugaugucccucugaaaacugaggaauuugaagugaccaaaacagcagguacggaaagauggggaugggguagaggugacgccacccccauccaagggugggcaaucggggcaguuuggagaggggggucagccauagggguccuggagacuguagaccaggcauccacaaacugauucuauaaaggccaccucgucaauaucuucagcuuuguggcacuguggguucugucuagagcugugccauuguggcacaaagcugcugcagacaguauguccaugcguggguguggcugugugccacuagaacuuuaucuuagcugggcgcgguggcucaugccuguuaccgcagcugcucaggaggcuaaggugggaggaucauuggagcccaggaggucaagaccagccugggcaacauagcgagacccugucucuacaaaauuuuuuuaaaaaucaggcugggugcgguggcucacgccuguaaucccagcacuuugggaggacgaggcgggcggaacacuugaggucaggaguuccagaccagcuggccaacauaaugaaaccccaucucuacuaaaaaugcaaaaaauuagccaggcgugguggugcgcaccuguaaucccagcuauucaggagaauugcuggaaccugggagguggagguugcagugagcugagaucaugccacugcacucuagccuggaagacagcaagauucugucucaaaaagaaaaaaaauuagccgggcauggugguguguaccuguagucucagcuacuuaggaggcugaggugggaggauuauuugagcccaggaggucgaggcugcauugagcuaugaucgcaccacugcacuccagccugggcaucagaguaagacucugucucaaaaacaauaaacagggcugggcaugguggcucacaccuguaaucccagcacuuugggaggccaggaguuccagaccagccuagccaacauggugaaaccccuucucuacuaaaaauaccaaaauuagccaaggaugguggcacaugcuuguaaucccagcuacucaggaggcagagacaggagaaucucuugaacuuaggagcaggagguugcagugagucgagacugcaccacugcacuccagccuaggcaacagaggaagacucucaucucaaaaaaaauaauaaauuuuaaaaaauaaauaaaugaaauaaaacaaaguagaaaccaucagggcuuugagguugggacuguggcaugccgaggggaggcugcaggggucacugggaaacaucaggguccuucuucgguugccugagcagcaccgguguccucaagccacauucagcugcauggcgccaaugcuaagcagaaagaggaaucggaggcgccgagcuggggcaagggugggagccaagggaguggacacagcagguagggccgggagacuugggugaagcaguggaagccagaguucugacccugcuggagaagugucaugagggccucagacagguucacccacugagcaggaggucuugcagccugacccacccugcauccuguucaggccgggaucaucuccuuccugggcuucuucuggccccuuucugcaucucuucuugacaacauggcacaaaugaccaggguucuucccaccucaggucuuucuguggcuuccugcugccugccaucuauguuagccccaccgaccuuacccuccacaucacuguuuuccugucugucacccguaagacuuucagugccuggggccuuuucacaugggagucugcuuuggagacugcuccccuugccugcuuagcccccaccaugggccccaccccaaauccuccggacuucugagaauuuucaauguugagggcccaaccauguguuucuuucuugcaguggcucacaggcccggggcauucaaagcugagcuguccaagcuggugauuguggccaaggcaucgcgcacugagcugugaccagcagcccuguugcggguggcaccuucucaucuccggugaagcugaaggggccugugucccugaaagggccagcacaucacugguuuucuaggagggacucuuaaguuuucuaccugggcugacguugccuuguccggaggggcuugcaggguggcugaagcccuggggcagagaacagaggguccagggcccuccuggcucccaacagcuucucaguucccacuuccugcugagcucuucuggacucaggaucgcagauccggggcacaaagaggguggggaacaugggggcuaugcuggggaaagcagccaugcuccccccgaccuccagccgagcauccuucaugagccugcagaacugcuuuccuauguuuacccaggggaccuccuuucagaugaacugggaagagaugaaauguuuuuucauauuuaaauaaauaagaacauuaaaaagcaa

SEQ ID NO: 192710 - RNA, 15800 nt, Homo sapiens
gcgggguggagccagcgcccucagcgcgcuacgguccgcgggcaacuccgcagaagccccagcccccaggaccccaggacccaguggcgcagccggcagccccggaucccugguagguggggaaggggcgaggacgggccugagguggagaaggugucgggggugugggggguggcccugagcccgugccgcucgccagggcuccaggccaccuggccucccucuuagggccccggugcggaggagggggccuggcgccgcgcguugggagguugacguuccccucaaccuccagcuccccgcgcugguggcccagauccucccccacugucgggauccuccccagcacccuggcuuccuccccgacagccugaccccucccccaaaccccagauuccucccggacaccccagauuccuccccaacacccaggauuccuaccugaaaccccauauuccuucucaccccaaauuccugacacccaagcuuccuaccucacaccccauauuucucucaacgcccugaauuucucccugacacccaaggucccucccugauaccccaaauuccuccgugacacccaggaccccucucugacacccuggauucuuccccaacacccaggaucccucccgaauaccccagauuccucccagacaccccaaauuccucccugacaccccaaacucuucccugacacccaggaucccaaccucacacccuguaccaccacacaccuucuuccuuucucccccuccuaacgguuauccagccacaugggcuuccuuacuguuccuccagcucaccaggcgcaguccugccccagggccuuugggcagguggcuucaccuuccagaagcuuuccucccugaucuccacccagccuccucccucagcuccuuuaggucucagcucaauguuaccuccuguccccaaaggccucccuugaccaccgugguccccuguagccccuucccagccagucucucagagccacacagcccccggcucauggcuuucacguuacuuuucauucucugaaaugaucuuggguuauuuucucgcuuacuguuggucucccugaaccagacugggagcucugugaggguagaugugccugccuugauaugcaguggcacuuugaacaguuccuggaccuaguaggugcucaauaaaugcauauucgaugcaugaaaggcugcaugagagugugggaaggagagugggagaggugguuaaaacauuuaaaaaggacaaggugggaggaucacuugagcccaggaguucaagacaagccugggcagcauagcgagacuccaccucuacaaaaaaauucaaaaagaaaguuagccgggugcagugguuuaugccuguaaucccaacacuuugggaggcugaggcagguggauugcuugagcccaggauccuggguaacaugggugagacucugucucuaccaaaaauacaaaaauuagccagguguggugccgcacaccuguagucccagcuacucgggaggcugaggugggaggaucacuugaacccgggaguucaaggcugcagugagccgugaucccacuacugcacuccagccugggugacagagugagacccugucucuaaaaaaaaugaaauggggcugggcagguggcucacgccuguaaucccaggcagaucaccugaggucaggaguuugagaccagccugaccaacauggcgaaacccugucucuacuaaaaauacaaaaauuagcggggcgugguggugcaugccuguaaucccagccacucaggaggaugaggcaggagaaucacuugaacccaagaggcggagguugcagugagcccagaccacgccacugcacuccagccugggcgacacagcaagacucugugucaaaaaaaaaaaaaaaaaaaaaaagaaaugaaauuaaaaaucaaaaauuuuuuuaaaaaggaagaggaagagaaaaagucugccaauauuuauugucacacuaauauuauuauaucaagcucuugcuccuugcugggcacugaucuaaacuuuuuaaccauauuuucgcaugaaagcuucaaaacagacucccauucauccuaaguaccaguucauguggguguuauaaaugaggaagcugaggcugagaaacagaccacacaagccggcagguggcagagccagaacccuccuaccccauggguguuuuugucccgccaggcgccugcucuucagagugaggaguggacuuugucccagccauggacagugagaaaugaaacuugcugggucucgagaagguggagguggcagugggcaggggaggcgggcgggggaagcuggggcagucacugaaauagaguugaguucaggcccgggggggcagagagaaugagaagaaagaccacgugauuuuagagauuugccaggcauucagguggagaugguccugccuugaugauucuaagucuggcuggcuuugucguguuuucugcaaaacuccccugaguccuucuugcaaggagguuucagucuugcaugcuaauguuuguggggcaugcgugugccaggcacugcuuuaagaguccuauacaggccgggcgcaguggcucaugccuguaaucccagcacucugggaggccaaggcaggcggaucgauugaggucaggaguucgagaccagccuggccaacagccugaaacccugucucuacuaaaauuacaaaaacuagcagggcgugguggcuaacgccuguaaucccagaauuuuggaggccaaggcaggcggaucacgagaucaagagauugagaccauccuggccaacauggugaaaccccgucccuacuaaaaauacaaaaauuaccugggcaugguggcaugcaccuguagucccagcuacucgggagggugaggcaggagaauugcuugaacccaggagguggagguugcagugagccgagaucgcgccacugcacuccagccuggcgacagagggagauucggucucagaaaaaaaaaaaaaaaaagauuaucugggcgugguggcaggcuccuguaaucccagcuacucaggagagugaggcacaagaaucacuugagcccaggaugcggaggcuguagugagccuagaucgcaccacugcacuccagccugggcgacaaagugggacuccgucucaaaaaauauauauauguauauauauuuuacugacauguaggcugggugcaguggcucauaccuguaaucccagcacuuugggaggccaaggugggaggaucgcuugggcccaggaguuccagaccccgucccuacaaaacauuaauaauuagcugggcaugguggcaugugccuguagucccagcuacuugggaggcugagugggaggaucacuucuuaaucccaggagguugaggcugcagugagcuaugaucacaccacugcacuccagccuggguaacagagcaagauccugucaaaaaacaacaacacaggaggcugaggcaggagaacggugggaacccgggaggcagaacuuguagugagccgagaucgcgccacugcacuccagccugggagacagaccgagacuccgucucaaaaaaaauaaaaaaaacaaaaaagagugugaauucuaaguguuaaacucaaugaauuuucagcaugacgcccagccccacugcuacccugucccagcauggcccuucuccacacuuuaucaucuaugcccucuuaucagcuaaaaauuggaggguacgugccaauguauguuugcuuuuugcuugguaaguuauacacacaaccguucccaggaaacaccgggaggugggaagagcaguugauucguggaucaucgaacuuaacgggggguggggguauuggaccguauuccaaguaguugucuugaucauuucaaaaaguuuuggccgacuuguggucccaccugaauauaggaucuuuuuuuuuuuuuuuuugagauggagucucacucugucacccaggcuggagugcaguggcaccaacucggcucgcugcaagcuccgccucccagguucacaccauucuccugccucagccuuccgaguagcugggaguacaggugcccgccaccacaccuggcuaauuuuuuguauuuuuaguagagacgggguuucaccguguuagccagcacggucucgaucuccugaccucgugaucugcccgccucggccucccaaagugcugcugggauuacaggcgugagccaccgcgcccagcccauuuucauuuuuaucccauuuuauguagagcuuacaacagagauagaagcugggcaucuggccuuuuucuuuuuuuuuuuuuuuuuuuuuuuuuuuuuuuggagacagaguuucacucuuguagccuaggcuggagugcaauggcaugaucucagcucaccgcaaccuccgccucccggguucaaccuccaccucccggguucaagcgauucuccugccucagccucccgaauagcugggauuacaggcuugcgccaccaugcccggcuaauuuuuguauuuuuaguacagacgggguuucaccauguuggccaggcuagccucgaacuccucaccucaggcaauccacccgccucggccucucaaagugcugggauuacaggcgugagccacugcgcccggccgucuggccuuuuucuuauuguccgauugugccugcauuauuuuauuauuauuauuauuauuauuuccuaagauuauuaggaaaaaccuuuuauccuccacuucucuagaggaguacuuaggccauaugcuuauuuccugaacauuaguuuaauuaaaacuaggugaggcuguuucucaggccccauaaccagguccacauaagcuggagucuguguuaaaucugaaaauguuaaaaggagccaaaaagcucaguggauucuagaaccagacagccuggguuccaauccagcuguaucccuuaugagcugugugacucuggacuacuuacucaacuucucuguaccucuguuuccuugugucaaaaaggggccauacuccaauauuacuggacuguaguggagaugucuaaaacugugcuguccaacagaaauauaacaugaagcagccgcgaacaguggcucacgccuguaaucccagcacuuugggaggccgaggcuggcagaucacuugaggucaggaguucgagaccagccugggcaacauggugaaaccccgucucuacuaaaaauacaaaaauuagccggguaugauggcggaugccuguagucccagcuacccggaaggcugaggcaagagaaucgcuugaaccugggaggcagagguugcagugagucgagaucaugccauugcacucuagccuggaaaauggagcaagacuccaucuccaaaauauauaaauaaauaaauaaauauauauauauaucuccuaauaauacauuuuauuaauccaauauguaaaugcauuuaauaauauauuuuauuuaacucaauauacccaacaugguccaauauaauguuccauuacgaaugaggcaucuuccauaccuuuuuuauuuuguuguuuuugagacagcgucucacucuauugcccaggcuggagugcaguggcgcgaucuccggucacugcagccuugauucuccuggccucaggcgauccucugaccucagucuaccaaggagcuggggccacaggcaugcaccaccacacccagcuaauuauuuuuauuuuaauuuuauuuauuuauuuauuuguuuguuucuuuauuuugagauggaguuuugcucuuguugcccaggcuggagugcaauggugugaucuuggcuuacugcaaccucugccuccucgguucaagcgauucuccugucucagccucccgaguagcugggauuaccagcaccugccaccaugcccugcuaauauuuuuuauuuuuaguagagacaggguuucacuguguuggcuaggcuggucucgaacuucuaaacucaggugauccaccugccucagccucccaaagugcugggauuacaggcgugagccaccacacccggccuauuuuuauuuuuuguagagaugggucucacuguugcccaggcuggucucgaacucuugggcucaagagauccuccuaccucagcccccuaaaguacugggauuauaggcaugagccacugcacccugccuuaauuaauuaaaaauuagauaaaaugccggccgcgguggcucacgccuguaaucccaacacuuugggaggccaaggugggaggaucacuugagcccaggcaacauggggagacccagucucuacaaaaauacaaaaauuaacggguacauauccagguuuguuauauagcuaaauggcaugucacaggguuugguguacagauuauuccaucacacagguaauaacugucguaccugauagguaguuuuuuguuguuguuguuuuaagacagagucucgcucugucgcccaggguggagugcaguggcgccauuucaguucacugcaaccucugccgcccggguuccagcaauucuccucccucagccucccaagcagcugggauuacaggcgcacacugccacacccggcuaauuuuuuguauuuuaguagaaacgggguuuuaccauguugcgcaggcuggucucgaacuccugagcucaggcaauccacacaccucggccuuccaaagugcuaggauuacaggcgugagccaccgcucccgacccuccucucccuccuccucaccaccacccuuaagcaggcucuguuauuuuauuuuauuuuuuuuuggagacagagucuugcucugucacccaaguuggagugcaguggugugaucucugcucacuccagccucgacuucuuggguucaggugauucucccaccucagccucccuaguagcugggacuacaggcacccgccaccacacguggcuaauuuuucuauuuuuaguagagacgggauuucgccauguuggccaggauggucuugaacuccugaccugaggugauccaccugccucggccucccaaagugcugggauuacaggugugagccacugugccuggcccuguuguucccuucuuuguguccugcgguggcucacgccuguaaucccaacacuuugggaggccgaggcaggugggucaucugaggucagggguuccagaccagcccgaccaauaugaggcaaccccaucucuacuaaaaauacaaaaauuagccgggcauaguggugcgaaccuguaaucccagcuacucaggaggcugaggcaggagaaucucuucaacccaggaggcggagguugcagugagcugagauugcgucacugcacuccggccuggaugacagagcgagacucugucuccaaaaaaaaaaaaaaaaaaaaaauuggauaaaaguuaaaauucaagccaggcaugguggcucauaccuguaaucccagcacuuugggaggcugaggcaggcagauagcuugaggucaggaguucaagaccagccuggccaacauggcaaaacccugucucuacuaaaaauacaaaaauuagcugggcgugguggcaugugccugugaucccagcuacuggggaggcugaggcacgagaauaacuugaacccaggagagggggguggcagugagcuaagaucgcaccacugcacuccagcuugggcgacagagcaagacuucauccuaaaaaaaaaaaaaauuaaaauucagugucucuuuacuaccacagccacauuucaggugcccaguagacacagguagcugggggcugccauacuggacaacacagacagagaguguugaggcugaucuagacugcaaguaucugcaguguauuagcuacuguggcugugguaauaaagugccccagcccggauggcuuaagcaacagaaauuuauucucucacaguuauggaggcuggaaguccaagaucgagguguuguaggguugguucccucugaggacucuccuuagcuugcagacggccgccuucucccugggucuccucacaucaucuuccuucugugcaguuacgugucuguaucugaaugcccccugccuuuuccuuuuuugaugcagguucuugcucuguuacccaggcuggagugcaguggcgagaucuuagcuugcuugcugcagccucaaccucccaggcucaaccaauccucccaccucagccuccugaguagcugggauuucaggcgcaugccaccaugccuggcuaauuuuuuuuuuuuuuuuuuuuuaagacagagucuugcucugucacccaggcuggagugcaguggcgcuaucuuggcucaauguaagcuccgccucccagguucacgccauucuccugccucagccucccgaguagcugggacuacaggcgcccgccaccaugccuggauaauuuuugcauuuuuaguagagauggaguuucgccauguuagccaggcuggucucguacuccugaccuuaggugaucugcccaccucggccucccaaagugcugggauuacaggcgugagccacugcgccuggccaugccuggguaauuuuuguauauuuagugaagacgggauuucaccauguuggccaggcuggucucgagcucuugaucucaagugaucagcucaccuccaccucccaaauugcugggauuacaggcaugagccgucaggcccggccaaauaaaaauacuuucaacaucaaaaacaaacaaacaaaaacaccaaagccaaauacaaaccaaaaaaaggccuuuucucuaaauaaagucacauucugagcuacuggagguuggcacuucaacauaugauuuuggggagagacacgauugaacccauaauagccagucauaccccauacuaauuaaaaggcauuugguguuacaguuacaaacauuggcaucaaauggcugcucugucagucacuagcugugugaucuuggucauguuugccccucuguggaauggaaaauaaaaaaaaucacaugccugucucauaacccaggugucuacaagcuuuuucugucaagggucagagagugaauauuuuccacuuuguagaccccauggucucuguuguagcuacuccaucacucuagugggaaagcagccaucgauguguguaaaugagugaggaugucuguguugcaauaaaacuuuauuuauaaaagcaauuggcuggguguaguggcucacaccuauaaucccagcacuuugggaggccaaggugggcggaucacacaaggucaggaguucgagaccagccuggccaauauggugaaaccccgucucuauaaaaaguacaaaaauuagcugggcgugguggcgggugccuguggucccagcuacucgggaggcugaagcaggagaaucgcuugaaccugggagguggagguugcagugagccaagaucaugccacugcacugcagccugggcgacagagcgagacucugugucaaaacaagacaaaacuaaaaaacaauuggccggcacaguggcucacgcuuguaaucccagcacuuugggaggcagaggcaggcggaucaccugaggucgggaguucaagaccagccuggccaacacggagaaaccccgucucuacuaaaaauacaaaauuagccgggcaugguggcgcacgccuguaaucucagcuacucgggaggcugaagcaggagaauugcuugaauccgggagguggagguuacggugagcugagauugcaccauuguacuccagccugggcaacaagagugaaacucugucucaaaaaaaaaggcuggacgggguggcucaugccuguaaucccaacacuuugggaggccgagacaggcagaucaccugagguugggaguucaagaccagccugaccaacauggagaaaccccgucucuacuaaaaauacaaaauuaaccaggcaugguggugcaugccuguaaucccagcuacuugggaggaugaggcagaagaaucgcuagaacccgggaggcggagguugcggugagccgagaucgugccauugcacuccagccugggcaacaagagugagacucugucucaaaaaaaaaaaaaaaaaucgugggccauauuuuguggccccugucaaagggagaucugcacggugggaucaggacaggcuuaaccaaaaacaugaaggaggguaagggagugagccauagggauaucugggggguaacagagauauaggcagagggaacagccagugcaaagguccugaggcaggacugugcccaguuuaaagaacagauggggagcacaauauagcauguaguaagcccucaaauaagugguugcauguaaguguguguguguauccacacaugcccguuauauugucguauguaauauauaugaugcuuauauauuacauauaacuaacauaccauuagacagucaguugcuccagggaagaguccauugcuguuuuuccuugucugcauacugguguauucacuaguacccaauacauggcagaugcugaaaaaauuacuuuuuuuuuuuuuugagauggaguuucacucugucauccaggcuggaaugcaguggcgugaucucggcucacugcaaccuccgccucuuggguucaagugauucuccugccucagccucccaaguagcugggaguacaggugcccaacaccaugucuggcaauuuuuuuuuuuuuuuuuacuagagacgggaguuucaccguguugaccaggcugaucuugaacucaugaccucaaaugaucuguccgccuuagcuucccaaagugcuaggauuagcagcaugagccaccacaccuggcuaaaaauuacuucuuuuuguuuguuuuuugauggagucuuguucuuuugcccaggcuggagugcaguggcacgaucucggcucacugcaaccuccaccucccagguucaagcgauucuucugccucagccucccaaguagcugggauuacaagcacacgccaccaugcccggcuaaauuuuuuauuuuuuauuuuuuuuauuuuucuuuuaguagagacaggguuucaccauguuggccaggcuggucuugaacuccugaccuugugauccaccugccucagccucccaaagcacugggauuacaggcaugagccaccgcgcccggccaaaaaauuacuucuuaaaugaaugaaugaaugcuauguauguauccuucccugcagccucaacuuccuuggcucaagcaauccuccugccuuagccucccgaguagcugggaccacaggcacacaccaccaggccuggcuccaaacuuuuuuuuuuuuuuuuuuagauggagucucacucugucgcccaggcuggagugcaauggugcagucucgguucacugcaaccuccgccucccagguucaagcgauuuuccuaccucagccucccgaguagcugggauuacaggcgccugccaccaugcccagcuaauuuuuuguauuuuuaguagagacgggguuucaccauauuggccaggcuggucucgaccuccugaucucgugauuugcccgccucagccucccaaagugcugggauuauaggcgugagccacugcgccuggcccaaacuuuuuuuuaaacucacaaagucucuuaaaaauauuggaauugauugucaucccgagaagaaugagcggauuucuaaaaaucuagaucucuggcuucucuugaaaaaugaguggauguggugccuggcucccuugccauauucuguuaaugucauaguccaacgcugggacaguguuggaaggacugcucaagacugcaaauaccaggauguuggguccuugaggaccaucuagaaggcugacuauuuauuuauuuauugagacgggguuucgcucuuguugcccaggcuggagugcaauggugcgaucuuugcucacugcaaccucugccucccggauucaagcgauucuccugccucagccuccugaguagcugggacuacaggcgcggaccaccacacccggcuaauuuuuuuguauuuuuaguagagaugggguuucaccauguuggccaggcuggucuugaacuccugaccucaggugagccgcccuccuuggacucccaaagugcugggauuacaggugugagccaccgugcucagccgaggcuauuuagcaagcauguauugagcaccuacuggcuuucagucaucaagcucagaaguaucucuguguuaauccaacucaauuccccaaaacaagucuguaaguguaugccauuaggcacacagccuccacagccagacugccuggguugaaauccgucuucugccauccacugauagugugacuuugggcaagugacaucaccucugugugucuugcuuucuucaucuguaaauggggaaaauaguguaauaguguuuaccucucagguaacaccagguaagucucagaugacagcauuuuuuuuuuuuuuuugagacugggucucacucuguugcccaggcuggagugcagugguaccaucauagcucacugcagccucaaccuccugggcuuaagcgaucuucccaucucagccuccggaguagcuggaacaacaggcacgugccaccacgcccagcuacuuuuuuuguuuuuugagccggaguuucacucugcugcccaggcuggagugcaguggcaugaucuuggcucacugcagccaccaccuccuguguucaagcgauucuccugccucaguuucccaaguagcugggauuacaagaaugcaccaccacuccuggcuaauucuuuguauuuuuaguagaaacgggguuucaccauguuggccaggcuggucucgaacuccugaccucaggugauccccccgccucggccuccacaacugcugggauuacaggcuuaagcccccucacccagcccagcuaauuuuuaaacuuuuaguggagacggagucuggcuguguugcccaggcuggucucgaaguccugggcuuaagugauccuccugcuucagccucccaaagugcugagaucacaggccugagccaccacacuggccucauagcauuuugcagaggaagaaauggaaguugaaggaggcgacguguugccgaaggucaccuggcuaggucuggguggcaggcggggaaagcaggcgggggugugugggccgccuucccgugcugaccuuucuuggggguaaguguguuugcuucuccuguuuccuacagaucugcuugggcagcuccugcagaaccuggaacagugaauggguaggggacacugggcgugcagaaggcggggggcaguguggaacaugccuucaccaccuccagcuucugcugccggaggcugcacccaccugugcccauggccugcacaggcccaucacuuccuagcgccuucgacauucuaggugcagcaggccaggacaagcucuuguaucugaagcacaaacugaagaccccacgcccaggcugccaggggcaggaccuccugcaugccaugguucuccugaagcugggccaggaaacugaggccaggaucucucuagaggcauugaaggccgaugcgguggcccggcugguggcccgccagugggcuggcguggacagcaccgaggacccagaggagcccccagauguguccugggcuguggcccgcuuguaccaccugcuggcugaggagaagcugugccccgccucgcugcgggacguggccuaccaggaagccguccgcacccucagcuccagggacgaccaccggcugggggaacuucaggaugaggcccgaaaccggugugggugggacauugcuggggauccagggagcauccggacgcuccaguccaaucugggcugccucccaccauccucggcuuugcccucugggaccaggagccucccacgccccauugacgguguuucggacuggagccaagggugcucccugcgauccacuggcagcccugccucccuggccagcaacuuggaaaucagccaguccccuaccaugcccuuccucagccugcaccgcagcccacaugggcccagcaagcucugugacgacccccaggccagcuuggugcccgagccuguccccgguggcugccaggagccugaggagaugagcuggccgccaucgggggagauugccagcccaccagagcugccaagcagcccaccuccugggcuucccgaaguggccccagaugcaaccuccacuggccucccugauacccccgcagcuccagaaaccagcaccaacuacccaguggagugcaccgaggggucugcaggcccccagucucuccccuugccuauucuggagccggucaaaaaccccugcucugucaaagaccagacgccacuccaacuuucuguagaagauaccaccucuccaaauaccaagccgugcccaccuacucccaccaccccagaaacauccccuccuccuccuccuccuccuccuucaucuacuccuuguucagcucaccugacccccuccucccuguucccuuccucccuggaaucaucaucggaacagaaauucuauaacuuugugauccuccacgccagggcagacgaacacaucgcccugcggguucgggagaagcuggaggcccuuggcgugcccgacggggccaccuucugcgaggauuuccaggugccggggcgcggggagcugagcugccugcaggacgccauagaccacucagcuuucaucauccuacuucucaccuccaacuucgacugucgccugagccugcaccaggugaaccaagccaugaugagcaaccucacgcgacaggggucgccagacugugucauccccuuccugccccuggagagcuccccggcccagcucagcuccgacacggccagccugcucuccgggcuggugcggcuggacgaacacucccagaucuucgccaggaagguggccaacaccuucaagccccacaggcuucaggcccgaaaggccauguggaggaaggaacaggacacccgagcccugcgggaacagagccaacaccuggacggugagcggaugcaggcggcggcacugaacgcagccuacucagccuaccuccagagcuacuuguccuaccaggcacagauggagcagcuccagguggcuuuugggagccacaugucauuugggacuggggcgcccuauggggcucgaaugcccuuugggggccaggugccccugggagccccgccacccuuucccacuuggccggggugcccgcagccgccaccccugcacgcauggcaggcuggcacccccccaccgcccuccccacagccagcagccuuuccacagucacugcccuucccgcaguccccagccuucccuacggccucacccgcacccccucagagcccagggcugcaaccccucauuauccaccacgcacagaugguacagcuggggcugaacaaccacauguggaaccagagagggucccaggcgcccgaggacaagacgcaggaggcagaaugaccgcguguccuugccugaccaccuggggaacaccccuggacccaggcaucggccaggaccccauagagcaccccggucugcccugugcccuguggacaguggaagaugaggucaucugccacuuucaggacauuguccgggagcccuucauuuaggacaaaacgggcgcgaugaugcccuggcuuucaggguggucagaacuggauacgguguuuacaauuccaaucucucuauuucugggugaagggucuuggugguggggguauugcuacggucuuuuaauuauaauaaauauuuauugaaugcuuccgca

SEQ ID NO: 192711 - RNA, 29435 nt, Homo sapiens
uggcgcgggcaaucccucaaccugauugguccccucgcccgucacuccagugcgcccccaaccuaccacgcaguaaaagccacccccgccucggcccggacgguuuccaagcugguuuugaagucgcggcagcuguuccugggacguccgguugaccgcggugaguggcgggggcgucucaguugagcuggggggcgguguccauggaguccuggggcaccccaggggccggaggggucggggagggccuuucucggggugggauuugcuggacucugcggccuggggaggggucuucagcccaggcuggucaccccuccccccagaaaaauccaacuucugcaacgaagcucagacuuugaaacccucuucucacuuccugggacuuuugaggggcgaaagagccccguagaaggggugauauugaagggggugggcuaaauaccgccccccgcccaccagguuuucucuaaauuuugaacaguuugcuuuuggaaacgccauuugcaggcaaguuuccuccugcgggcagaaucuccgcccucccuucugggguuuucagagacaccccccgccaccgcaaagcccccuccccuacagaugguuuugccacggguggggguggggguugccccagcuccuggcgcccccaacugauucuggggaggucuugggcaaagccugcccacuucccucgggugggcguggcgacgagguggcuuaaaaguaggaaggccuauccguuaacugcuuugggguucuugucccggcuaggccuggcagugggaccuggggcccuuggaauuuuggaaguccagucuuagcaugcucugaaguugcuggauggcugggucuggccuggagcuccccuucuggagccagcggcaaggcaggucacugacccccagggguuucauaggguguugacaucugccauggccacccuugcuuaaaccaguuccaggaagucaugguggacagaggggacgggaggaagcugccugaguccuaagugggacuugagaaucggucgaggccaggaguuugaugccugccuaccuggcccccugcccaggugagcucaggcuccaaaggaggugaggagaagcacagauuuaggcaaugaucacugggagguagguaugucuucucaccugacuucccaguugggggacuuuuguaccuagcaggaagcugguuccuggcuggcuuuaccccuuuguccguggaagccagagugcggugagauaguuuauggagcacuuacuaugugccgggcacggaucugagcuuccccggagcagcgucuccuccaguccacagggacuccaggcucuugugaaacacuuauacacauuucacagauguggcaagcaagacuccuaggggaugcugccuucccaaacuccuauuccuagugaguugccaagcugggauuagaacccauucugggcugggcaggaugacucacgccuauaaucccagcacuuugggaggcugaggugggcggaucauuugaggucaggaguuggagaacagccuggccaacauggugaaaccccaccucuacuaaaaauauaaaaauuagccggacgugguggcgggcaccuguauucccagauacucuggaggcugaggcaggagaaucgcuugaaccugggagauggagguuacacugaacugagaucacgccacugcauuccagccugggcgacagagcaagacucugucucaaaaaaaaaaaaaggccgggcaugguggcucacgccuguaaucccagcauuuucggaggccgaggcgggcggaucaugaggucaggagaucgagacgauccuggcuaacauggugaaaucccaucucuacuaaaaauacaaacaauuagccaggcgugguggcgggcgccuguggucccagcuacucgggaggcugaggcaggagaauggcgugaaccggggaggcagagcuugcagugagcugagaucgcgccacugcacuccagcgugggcgacagggcgagacuccgucucaaaaaaaaaaacaaaaaaaaaaaaauggaaagaacccaaucuggacuccagaucuagugcuugcaaaacaucaucauuuugcuggguucugcuuaggggacaucgaagcaaggccaccaggagguggggccucauuccucugggaaaagaugcucagacucaaggccacagguucuuaggcucacaccagaauuccccaggaaagcagcccauaagacaggcaugaccuuuagccccauguuuuuuuuuuuuugaaacggagucucccucugucacccgggcuggagugcaguggugcgaucucgacucacugcaaccuccaccucccagguucaagcaauucuccugccucagccuccuguguagcugggacuacaggugucagccaaaauacacggcuaauuuuuguauuuuuaguagagaugggguuucaccauguuggucaggcuggucucaaacucccgaccuuaggugaucugcccgccucagccucccaaagugcugggauuacaggcgugagcuaccaugccuggcuuuuucuuuuuucuuugagauggagucuuccucugucacccaggcuggaguguaguggcgcagucuuggcuuacugcaaccuccgccucccagguugaagcaauuccccugccucagucucccaaguagcugggacuacaggcgcccgccaccacacccgcaccuaauuuuuguauuuuuaguagagacaguguuucaguauguuggccaggcugcucuugaacuccugaccucaugauccacccaccucagccucccagcgugcugggauuacaggugugagccaccaugcccgacccuuuagccucauauuacagguaagaugaccgaggccagaggaggggaaggcgccuugcuccagggagcauagcguagguggagcugggacuccuggcuucccccugagaaucucuucugaugauggugucccagcuucauuucacuaguccaggaaaagggaguuguggcuucaucccgcuuacauagacucaccuggggaaccccguccuccccacaccccugaccuggacuucauagcucugcggugcaggcaggcauguuaucucacuuuuuaaaaaaagccuaaauuuuggcugggugcgguggcucacagcuguaauccuagcaguuugggaggccaaggugggcagaucccuugagcucaggaguucaagaccaaccugggcaacauggcaaaaccccaucuacuaaaaaacaaacaaacaaaacaacaacaacaacaaaaaaaaaaacaaaccacggcugagugcagugacucauccuguaaucccagcacuuugggaggcugaggcggguggaucacgaggucagguguucaagaccagccugaccaacauagugaaaccccaucucuacuaaaaauacaaaaaauuagccagacguggugcacaccuguaaucccagcuacucaggaggcugaggcaggagaaucgcuugaacccagaaggcggagguuacagugagccgaaaucacgccacugcaccccagccuggaugacagagcaagacucccuguccaaaaaaaaaaaacaaaaccacacacacacacacacacacacacacacacacacacacacacacacacacacuagccaggugugguggugcgugccuguagucccagcuacuugcagggucaaggugggagaauugcuugagcguaggagacagagguugcagugagccaagaucgcaccacuacacugcagccugggcgacagagcggaaauccgucucaagaaagagaagaaaguuugcccuauuuaacacauuuuaucccuugacuagaucuuuguucaugucaugucaguuacauuuagucuuuuguuuguuuuguuuuguuuucuuuuuuuuuuuuuugagauggagucucgcucugucacccaggcuggagugcaguggugcaauaccaggucacugcaaccuccaccuccuggguucaagcgauucuccugccucagccuccugaguagcugggauaacuaaacauggaggcgugcaccaccacgccuggcuaauuuuuguauuuuuaguagagacgggguuuugccauguuggccaggcuggucuccaccuccugaccucaggugauccuccugccucggccucccaaagugcugggauuagaggugugacccaccacaucuggcccaugugaguuacauuuaaaucucuuuuuuuuuuuuuuuugagacagaguuucgcuccuguugcccaggcuggagugcagcggcgcgaucucggcucacugcaacuuccgcuucccggguucaaguaacucuccugccucagccuccugaauagcugggauuacaggcauucgccaccaugccuggcuaauuuuauauuuuuaguagagaugggguuucuccauguuggucaggcuggucucgaacuccugaccucaggugauccacccgccuuggccucccaaagugcugggauuacaggcgugagccaccgcacccggccuuuaaaucucauucuuuagccacugcauugggauacacuuauuuuuguuuuuguguuuugagacggagucucacucuguugcccaggcuggagugcaguggcgcgaucucaccucacugcaaccuccgccuccuggguucaagcgauucuccugccucagccuccugaguagcugggauuacaggcgcccaccaucaugccuggcuaauguuuguauuuuuaguagagacgggguuucacuauguuggccaggcuggacucgaacuccugaccucguguuccacccaccucggccucccaaagugcugggauuacaggcgugagccacugugucuggccacacuuguuguuuucuuauuccccuuuugcugggcauccagguuguuuccagugucauguuguggccaguaaguccacacagcucugcucauguggaaacacagguguggguucuuccccgaagugagguuucugggucaaggggaagauggcucuuggaacuugacagcuauuggcaaauuguccucuacagagguuuuaggucauaccuggcuugcuggaguacaggugagcccugaagggacuguucccaagccuugcuuccugacgugugucccagggaccagcugcaucaacacugccugggagccuuuuagaaaugcagggucagggccgggcaugguggcucacuccuguaaucccagaacuuugggaguccaaggcaagaggauuguuugagaccaggaauucgagaccagccugggcaacauagcaagauaccauuggccaggcacaauggcucacaccuauaaucccagcacuuugggaggccgaggcgggcggaucacgaggucaggagaucaagaccauccuggccaacauggugaaaacccguuucuacuaaaaaaauacaaaaaauuggccagguguaguggcacacgccuguagucccagcuacugggaaggcugaggcaggggaauugcuugaacgugggagguggagguuacagugagccgagaucgugccacugcacuccagccuggcgacagagcaagacucugucucaaaaaaaaaaaaaaaagauaacaucucuacccaaaaagaaaaaauuaaguaggcgugguggugugugccuauaguccuaguuacuugggaagcugaggcaggaggaucccuuaagcccaggaguuagaggcugcagugagcugugauuguaccacuguacuccagccugggugacagagcaagacccugucuuuaaugagaaaaaaaaaaaagaaaggaucaggugugguggcucacaccuguaaucccagcacuuugggaggccaagguggguggaacacaaggucaggaguucaagacuagccaggccaauauggugaaaccccgucucuacuaaaaauacaaaaauuagcugggcgugguggugggugccuguaauccagcuacucgggaggcuaaggcaggagaauugcuugaaaccaggaggcggagguugcagugagcccagguugccccacugcacuccauccugggcgacagagugagacugucuccaaagaaaauaaagaaaaaaaaaaagaaauagggggccaggugagccccaucccgaagcuuuagaaucagcacuugcuauugaacaaaguccagaggucacucuugugccugcuaaggacugaaagacacagcuguaagucaugggcaggugugaacccugucuuccagcugcagcgugggccuggacuuucuccuggaagguggggccaggcaggcuguaccugacuguuccucucuccucagcgucugcugcagagaccaugucugccgacggggcagaggcugauggcagcacccaggugacaguggaagaaccgguacagcaggugaggaagggccgggaccagggacugccccgacccugugauucccgugcaaggaggcuucccaccccagggugcccuggcagggagccagggaucugccggcagcucacggagccagagggauuuauuccucagugggguauggaccacucacugguguccccaguugggaggggggaaucucaaaggcccuuggagggccugagggagcaggguucugucugaaacuaccugcccuccccaaccccugagccaaaucauccucaccucugaaggcucucucagggacguccuaggaggccaguuucuauuccagaucucucauccucaggugauuuuauuuuauguauauauuuuugagauggaaccuugcugugucgcccagccuggagugcaguggugacaucuuggcucacugcaaccucugccuccuggguucaagcaauucuccugccucagccucccaaguagcugggguaacaggcaugugccaccacgcccggcuaauuuuuguauuuuuaguagagacggaguuucaccauguuggccaggcuagucucaaacuccugacccaaagugacccacccgccucggucucccaaagugcucggauuacaggcgugagccacugcuccuggccccaaaaauaauuaaaauuuaaaaaucaaguggugcgcuggcugugacccaugggcuguggucuacagcccccgguuuagacccuaacugccaugagaauggaacuguugucccuuaucaccaccuggcacaucgcugggauaaagugcaggcucauguaaauagccuguguucaaggaagcacgugggcugagugcgguggcucacgccuguaaucccagcacuuugggaggcugaggugggcgaaucacgaggucaggaguucaagaccagccuggccaacauggugaaaccccaucucuacuaaaaauacaaaaaaauuagcugggcgugguggcacccguaaucccagcuacucaggaggaugaggcaggagaaucguuugaaccugggagguggagguugcagugagcugagaucgcaucagugcacuccagcccgggcaacagugcaagacuccguuucaaaaauaaaauaaaaauaaaggaagcacguggcgaaaccccaagguuccuggcuugugcaacugccuggaugcaaaguguggguaaacugagccguuucacuggccaggaguaagagcaaaacugcagggcacccugaguuuccggcugagcuccccaucuucccccacccaguuugccugagccacuucucuccuguagcccagugugguggaccguguggccagcaugccucugaucagcuccaccugcgacaugguguccgcagccuaugccuccaccaaggagagcuacccgcacaucaagacugucugcgacgcagcagagaagggagugaggacccucacggcggcugcugucagcggggcucagccgauccucuccaagcuggagccccagagugggugaagucccagggggcacugaauuccccuccuggucauuucccuggguggggaguaggggggucuacccagcucuugguccugucccccugaaccauuacuaggugaccuuccagcagucacauuugcgucuuaauuguuguuggcaguugcaucagccagcgaauacgcccacagggggcuggacaaguuggaggagaaccuccccauccugcagcagcccacggagaagguaacgauguccguccucaggggcucugucgagacagggaccuaccuggguguggagugcgcuggucccagcuuaacuagacaagcuugauggcauccucccugcugccucuccugucgguucccauccccaccccgaauccacuccccacaggguagcuggaggaauaauugcaaagccagccagauuacaggcgccugcaaccaugcccaucuaguuuuuguauuuuuaguagagaugggguuucaccauguuggccgggcuggucucgaacuccugaccucaggugauccagcugccucagccucucaaagugcugggauuauaggaaugagccacggugcccagcccacuuguuuuuauaauaaaguuuuauuggcacacagccaugcccauuuauuuacauauugucuaugacugcuuucacccuacaauggcaagguugaguaguugugacagagacugugacccacaguacugaaaaucuuaguuacguggcccuuuacacagaauguugccaccuccauaacuuauuagucagaaaagguuggcggcaggaaagucaaaacaucaaaacaccauguuccuggccgggcgcgguggcucaugccuguaaucccagcacuuugggaggccaaggcgggaggaucaccugagguugggaguuugagaccagccugaccaacauggagaaaccccgucucuacuaaaaauacaaaauuuaucugggugugguagcgggugccuguaaucccagcuacucgggaggcugaggcaggagaauuucuugaacccuggaggcggagguugcagugauccgagaucaugccauugcacucuagccugggcagcaagagugaaacuccaucucaaaaaaaaaaaaaaaaaccaaaaaaacaccauauucuggccaggcgcgguggcucaugccuguaaucccaguacuuugggaggcugaggugggcggaucacaaggucaggagaucgagaccauccuggcaaacacagugaaaccccaucucuacuaaaacuacaaaaaaaaaaauuagcuuggcgugguggcgugugccuguaguccuaguuacucgggaggcugaggcaagagaaucacuugaacccaggagacggagguugcagugagcugagaucgcgccacuacacuccagccugggcgacagagcgagacucugucucaaaaacaacaaaacaaaaaaaacaccauguuccaaacuguguccugccccucagcagcuggguggcccucacacaaguuacuuugccucugugggccucacuuuuuuuuuuuuuuuuuuuuuuuugagacggggucuugcucuguugccaggcuggugugcaguggugcaaucucggcucacugcaaccuccaccuccggguuccagcgauucuccugccucaggcugcugaguagcugggguugcagacgucugccaccacgccuagcuaauuuuuguauuuuuaguagagacgggguuucaccaaguuggccaggauggucucaaucucuugaccucgugauccucccgccucggccucccaaagugcugggauuacaggcaugagccacugugcccggcccccucuuuuuuuuuuuaagauggaguuucgcucuuguugcccaggcuggagugcacuggugcaguuucagcucacugcaaccuccaccucccagguucaagcgauucucccgccucagccucccgaguggcugggauuacagacaugugccaccacaccuggccaauuuuuguauuuuuaguagagaugggguuuuaccauguuggucaggcuggucucgagcucccgaccucaggugauccaccugccuuggccucccaaaguguugggauuacagacaugagccaccaggcccagccugggucccacuuucuuuucuacagaauggcaaugcugaccugggguuaacaccugaaggcccagaacagcacauggcuuguagcaaauguuggcucuuaacauuaaaaaaaaaaauuuuuuuuuugagacagguucucacucugucacccaggguggggugcaguagugugaucauggcucaacugcagccuugaacuccugggcucaagugauccucccaucucagcuucccaaguagcugggaccacaggcaugcaccaccaugccuggcuauuuuuaauuuuuuguagagacgaguuuucaccauguugcccaggcuguucucagacuccugggcucaacagauccuccugccucagccuccugaguagcugggacuaggugcauccaccacgccuggcuaauuuuuguacuuuuugucaagacggagucucgccauauugcccaggccggucuccaacucuugggcucaagcaauccuccugccucagccccacaaagugcuagaauuauaggagugugccacugugcccuaccucaguuucccuuaaucaccgcuuuuuaaagacccugucucuaaauacagccacauucuuaccccuggggaucaggacuucaacauaagaauuugggguugagggggccauaauucaaccuauaacagccugggaugaaaaaaugaggcacagaccaggcgugguggcucacgccuuacucccagcacuuugggaggccgaagcgugcagaucacuugagaucaggaguacgagaccagccuggccaacauggugaaacccugugucuacuaaaaauucaaaaaucagccaggcgugauggugaguuccuauaaucucagcuacucgggaggcugaggcacgaguaucacuugaaccugggaggcaagagguugcagugagccgagaucgugccaccacgcuccagccugggcaacagagcaaggcucugucucaaaaaaaaaaaaaaaaacacccuccuucagauaagugugaggcuuaaucgguuauuguuugucuccccagcugggaccagggcacaggcugccugcuuuguggcuguguccagugcccagcaggcagccuggcacaggguagaugcuuauuuuuuuaguuuuuugagacagaguguugcucuuguugcccaggcuggagugcaauggugcgaucucggcucacugcaaccuccgccucucgggcucaagcgauucuccugccucagccucccgaguagcugggauuacaggcaugcaccaccaugccuggguaauuuuaucuuuuuaguagagaugggguuucuccauguuggucaggcuggucucgaacucccaaccucaggugaucugccugccucggccucccaaagugcugggauuacaggugugagccaccgcgcccugcagauagaugcuuauuaaguauucaggugcuccauguccgcuucagcccagugguuacagaagggccacccucggguaccaccugcuugugucugggucuguagcaucagaaauaggugaucccuggguuggaggcaggacaagccagccgcaucccagcauccuuggacuuucccugagaccaccugcagggacaggcagcuuauucauccacuugcuauugagugccuacuguaugccggggagcugugcugucccaucaugguuagacuuccucaccucccauuuaugcagaaauggccuuagcugggaaacagcagagcgguugucaacuugcauuuuuuuuuuuuuuuugagacaaggucuugcucuguagcccaagcuagagugcaguggcgugaucuuggcucacuacagccuugaccuccuagacuuaggcaauccucccagcucucagccuccugagaagcugggacuacaggugugcaccaccacaccugacuaauuuuuuaauuuuuuguaggaauggggucuugcuauauugcccaggcuggucucaaacucccaggcuagccaggcacgguggcucacgccuguaaucccagcacuuugggaggccgaggcgggcggaucacgagaucagaacaacagagcgagacuccaucucagaaacaaaacaaaaaacaaacuccugggcucaagcaauccuccugccugccuuggcuucccaaagugcugggauuauaguugugagccacuaugcccagccaugccuacaccuuaucagcaaaggccaauagugggcuuggcugaggggggauggaaacugcugagcuuacaggaagaugggaaacgucaaccaggagcccccgucucagggccaagcccuugcuucccuuucucucccacugauagcguaggaggccaacagucuuucuguuuauagaagggauaagcucagggugaauucuucaaggucacugaacagagcagcagcugggagcuuuuuuuuuuuuuuuuuuuuuuuuucagauggagucucguucuguugcccaggcuggaaugcaguggcgugaucucagcccacugcaaccucugccuccuggguucaagugauccuccugccucagccucccaaguagcugggauuauaggcgcccaucacuacgcccagcaaauuuuuguauuuuuaguagagaugggguuucaccauguuggccaggcuggucucgaacuccugaccucaggugauccagcugccuuggccucccaaagugcugggauuauaggcgugagucaccgugcccggccaauuuuuguauuuuuuguagaggugaggucuuacuauguugcccaggcuguucucacacuucugggcccaagcgauccucccaccucagccucccaaagugccgggaugacaggugugagccaccgugccuggccugcugugagcucuugacuuuuugagaggugcaaugcucucucaauucugggcccuaugaguuuuuucccccuuugugaagagguaacuuuccccagguucugggggacggugguguugucagagcuagauuuuaauccgggccagugugagaacgugcguguucacugaguaguggggcuguuagaaccugacucucaucgggggcguuggcucaugcuggcucacacagugaaaccccgucucuacuaaaaauacaaaaaauuagccggccguggcagugcacgccuguagucccagcugcuggggaggcugaggcaggagaaccgcuugaaccugggagguggagguugcggugagccgagauagugccacugcacuccagccugggugacaagagcaaaaacucuguaaaaaaaaacaaaaacaaaaacaaaaaacuugacucucacacccucuucccccacaaaaagaugaacucucaugaguacaagaggacugagucuucagggaagcaccaacuuggguaggaauggggcaggugugguuuucaacuuugcggagagcccucugcauagagaucugucuaaagacuuagcuucagcuggacacaguggcucaugucggucaucccagcacuuugggaggccaaagcaggaggacugcuugaggccaggaguucgaaaccagccugggcaacauggagaguccuugucucuacaaaaaauaaaaaaauaagccgggugugguggugcguaccuguagucucagcuacuugggaggcugaggugggaggaucgcuggagccgaagaggucaaggcuugaguaagcuaugauugcaccacugcacuccagccugagugacacagugagacccugucucaaaagaaaaaaaaaaaaaagacuuagauucgagaacagcagguauugacagaugagcgcucaccaugugcuggguggggcguagucaaaggauuccaugcaaagcuuuuuuuuguuuguuuguuuuuguuuuuuuuuggagacagagucucucucugucacccaggguggagugcaguggugcagucucggcucacugcaaacuccaccucccggguucaagggauucucccgccucagccucuugaguaguaaggauuacagacaugcaccacugcacccggcuaauuuuuuguauuuuuugucucuacaaaaaauaaaaaauaaggcugggcgcaguggcucaugcuuguaaucccagcacuuugggaggcccaggcaaguggauccccugaugucaggaguucaagaccagccuggccaacauggugaaacccgucucuacuaaaaauacaaaaaucggcucggcaugguggcaugugcuuguaaucccagcuacuugggaggcugaggcaggagaaucaccugaacccacguggcagagguugcagugaaucgagauugcaccauugcacucuagccugggcaacaagagugaaacuccgccucaaaaaaauuaauaaauaaauaaaaauaaaagauaaaaaauagccacgaguggugguacgugccuguggucacagcuacucgcuggggaagcugaggugggaggcucacuugagcccaggagguggaguuuguagugagccgagauugugccaccgcacuccaccugggugacagagggagacuccaucucaaaagaaaaaaaauuaaauugaaaaaaaaaaacaaaaaacaggcagagugcaguggcucaugccuguaauccuagcacuuugggaggcugaggugggcggaucacuaggucaggaguuugagaccagccugaccaacauggugaaaccccaucucuacuaaaaauacaaaauuagccuggcgugguggcgcaugccuguaaucccagcuacucgggaggcugaggcaggagaaucgcuugaacccaggaggcggagguuacagugagccgagaucacacaauugcacuccagccugggcaacgagagugaaacuccaucucaacaacagcaacaacaaaaaacaauuagccaggcaugguggcgggcaccuguaaucccagcugcuucggaggcugaggcaggagaacugcuugaacccgggagacagagguugcagugaucugagauggugucacugcacuccagccugggcaagagagcaagacccugucuccaaaaaaaaaaaagaaagaaagaaaugagguacagggagguagagugacuuuccugaagccacacagcugagaaguagcuagcuaggaacggagccuagguagucuggcugcagaguaugaggucaugcccacaacuccagacucagggucaccugggggauggcgcucccugccucagucucccuggaaguuggggugcaggggaggggugcccacauacagagggaagacggagaugcuggggucacccgggggauggcgcuccccgccucggucucccuggaaguuggggugcaggggaggggugcccagauauggagggaaggcagagaugcugaugcuguugcaucuccuagguccuggcggacaccaaggagcuugugucgucuaaggugucgggggcccaagagauggugucuagcgccaaggacacgguggccacccaauugucggaggcgguggacgcgacccgcggugcugugcagagcggcguggacaagacaaaguccguagugaccggcggcguccaaucggucaugggcucccgcuugggccagaugguguugaguggggucgacacggugcuggggaagucggaggagugggcggacaaccaccugccccuuacggaugccgaacuggguaaguguggccagcgggcugcucugggaccccuccccaggcccccugaccggaagccgcugucggccuccuggggucugugccgacacucacugccgccucgucccugccacuucucccgggcaucuuggaaucucaucacuaacgcaguccccucuguccugcucaccagcucccgcccucauccaccacagucuccuccccacagcagccaccagagggcgccugugaccaccugagucagaacccgucccucugcccacagcccuccauggaccccaccuccccuggggucaaagcccaaguccucgucacagcccacaagguccugcacaaccuccccuguccucuccccgcccuccuccucuucccccuucgccacuccgcuccugcauaaauacgugacuaaacuugagaucucacugaacugugacaacaaugcugguguucccgccaggccagacaucccacuccagucaucucggucacauauucgcacucccugcacuguuuauuugauauucuucuuuaauuaauuuauuuauuuauuuagagacagagucucgcccugucaccuaggcuggagugcaauggcgugaucucagcucacugcaaccucugccuccuggguucaagcgagucuccugccucauccuccugaguagcugggauuacaggcaccugccaccacacagcuaauuuuuuguauuuuuaguagaaacgggguuucacuauguuggccaggcuggucucgaacuccugaccuugugaucugcccaccucggccuccccaaguacugggauuacaggugugagccaccaugcccggcccuuuuuuauuuauuuguuuuagagauagagucucacucucuugcccaggcugaagugcaguggugcgaucauagcucaaugcagccuccaacuccuggguugaggcgagccucccaucucagccuccgaguagcugggacuacaagcacacaccaucacgcccaacuaauuuuucuuuauuuaauuuuugguaaagacggggucucccucugucaucccagcugauccagaacuccuuggcuggagugauccuacugcuuuagccccccaaagugcggggauugggauuuuugcaaauaaguagcuuaggauauaggcagggcgcgguggcucagccuguaaucccagcacuuuggugggccgaggugggcagaucaccugaagucaagaguuugagacaagccuggccaacauggugaaacccggucucuacuaaaaauacaaaaauuaggccgggcacggugggucacgccuguaaucccagcacuuugggaggccaaggccgggcggaucacagguucaggagaucgagaccauccuggcuaacacagugaaaccccaucucuacuaaaaaaaaaaaaaaaaaaaaaaaaaaaauuagccgggcgugguggcgggugccuguagucccagcuacucgggagacugaggcaggagaauggcaugaaccugggaggcggagcuugcagugagccgagaucaugccacuccacuccagccugggcaauagagcuagacgccgucucaaaaaaauaauaauaauaaaauaaacauuagccaggugcgguggcaggcgucuguaaucccagcuacuugggaggcagagguugcagugagccaagauugggccgcugcacuccagccugggcgacagagugagacuccaucucaaaaaaaaaaaagcauggguacaguaggagcaggauuaaauaaauacaugcagcugggcgcaguggcucauggcuguaaucccaguacuuugggaggcugaggcggguggagguugaggucgggaguucgagacaagccugaccaacauaaagaaacccuaucucuacuaaaaauacaaaauuagccaggcaugguggcgcaucccuguaaucccagcuaacucgggaggcugaggcaagagaauggcuugaaucugggaggcagagcuuguggugagccaagacugcgccauugcacuccagcccaggcaacaagagugaaacuccaucucaaaaaaaauaaaggccagguguggugacucaugccuguaaucccagcacuuucggaggcugaggcagcuggaucacauggucaggaguuugagaccagccuggccaacauggugaaaccccaucucuacuaaaaauacaaaaauuagccaagcaugguggcacauuccuguaaucccagcuacucaggaggcuaaggcaggagaaucacuugaacccgggaggcggagguugcagugagccgagaucaugccauugcacuccagccugggcaacagagugagacucugucucaaaaaaauaaauaaauaaauaaauaaguaaauaaauacaugcauauacacauaugaaccuacgaacaugggaugaggccaggcgugguggcucacaccugucaucccagcacuuuggugggaggauuaguuaagcccaguaguuccagaccagccuggacaacauagaccccaucucuacaaaaaauuuaaaaauuagcugggugugcuagugcacgccuguagucccaguugcuauuugggagcugagacaggaggaucacuugagccugggaguucaaggcuacagugagcuaugauugcaccgcugcacuccagccugggcaacagagcgagacuguacuucaaaauauaaaaaccgacaaaacaaacagaucuaaacauagaaaagguacaggaagccaggugcaauggcucacaccuguaaaccuagcacuuugggagucugaggcgagcagauugcuugaguccaggauuucaagaccagccugggcaacauagugagaccccauuccuacaaaaaguacaaaaauuagccaggugucuugccguagucccagcuuuauguagucccagcuacucgggaggccaagguugaaggauagcuugaagcugggagguugagccugcaguaagcugaggucgugccacuguacuccagccugggcaacagaccgagacccugucuaaaaaaaagaagaaaaaguacaggaaaaauacgguauauaugguauuauaaucuuaugggaccacuguaguauaugcaguccauuguuggcugaaaugucauuauucucuuuuuuuuuugagacggagucucacucucacccaggcuggagugcaguggugugaucuuggcucacugcagccuccaccucccggguucaagcgauucuccugccucagccuccuaaguagcugagauuacaggcuagugccaucacgccuggcuaauuuuuguauuuuuaguagagaugggguagugccauguuggccaggcuagucuugaacuccugaccucaagugaucugcccgccuuggccucccaaagggcuggcauuacuggcaugagccacugcacccggccuacgguauuauaaucuuaugggaccucuguaguauaugugauguauugcuggcuggaaugcuguuauucucugcaggacugcauaaugaacauucaggccuauauucacagguuguccaaggcaggucuggccugcaggccauagcuugagacccuccugcuagucuaaggucucugauuccugugagguuuaauuuuccuuauccccguuuugcagauagggaaaaccaaggcagaauccuuugcucccaggccuucgagguuuauaagaaguagaacuggguuauaaacuggacagcauggccaggugugguggcucacgccuauaaucacagcacuuuuggaggccaguucggaugaaucacuggagaucaggaguucgagaccagccuggccaacauggugaaaccccgucucuacuaaaaauacaaaaauuagcugggcaugguggcgggcgccuguaaucucaguuacucgggaggcugaggcaggauaaucacuugaacccgggaggcagagguugcagugagccgagaugacaccacugcacuccaaccugggcgacagagcgagacuccaucucuaaauaaauaaauaaauaaacuggacagugugauucuugggacugucugcaugggacgagcccagcuguguguucuggucuucacagagacccuucuccuuuuccuugcagcccgcaucgccacaucccuggauggcuuugacgucgcguccgugcagcagcagcggcaggaacagagcuacuucguacgucugggcucccugucggagaggcugcggcagcacgccuaugagcacucgcugggcaagcuucgagccaccaagcagagggcacaggaggcucugcugcagcugucgcagguccuaagccuggugagguuccagggggucggggcccugagccagcagccuucaccccgcagcagacacccacccagagcucaguggcuuauugcucaccccucugcaggcuggcagggccauucccgcuugcuccuggcacuguaucugguuguacacucauuugcucaggaugcugccacaaaccacacugucuggggccgggcacaguggcucacaccucuuugugugagucccucaagugcuuugggagcccaaggcaggaggaucgcaugaguccagggguuugagacccaccugggcaauauagcaagaccccaucucuacaaaaaauaauuuaaaacaauuagcuggcugugguggugcgugccuguaaucucagcuacuugggaggcugaggugggacgauugcuugagcccaggaguuggaggcugcagugagcuaugauugugccacugcacugcagccuagucaacagagcaagaccccaucucaaaaaaaaaaaaaaaaucguggccaggugcgguggcucaugccuguaaucccagcacuuugggaggcugaggcggguggaucacgaggucaggaguucaagaccagccuggccaacauggugaaaccccaucucuacuaaaaauacaaaaauuagccagguacaauggcaggcaccuguaaucccagcuacucaggaggcugaggcaggagaaucgcuugaacccgggcggcagagauugcagugagccgagaucaugcuacugcucuccagccugggugacaagagugagacuccaucucaaaaaaaaaaaaaaaaaauucguacugucugggaaauguaaacaacagauauuuauuuucucacauuucuggaggcuggaaguccaagaucagaguguccuucuggggccucucuccuugacucguagacagccaucuucucucuguguauucacguggucgucccuucccucuguguaugucuguguccuaaucucuuuuuuuucuuugaacggagucucgcucuguugcccaggcgggaguguaguggugcaaucucagaucacugcaaccuccacuucccggguucaagugauucuugggccuccacgucccgaguagcugggaucacaggcacuugccaccaugccuggcuaauuuuuguauuuuuaguagagaugggguuucacuauguuggccgggcuggucucaaacuccugaccucaagugauccacccaccucagccucccaaagugcugggauuacagacacgagccaccacgcacagcucuaaucuccuuauugaaggagaccagcccuuuauggauuggagcccacccuaauggauagcuucauuuaccuuuaugacgauuuuuuuuuuuuuuuuuccagagacaggggcucacucuguugcccaggcuggaguggaugaucauggcucacugcagccucuuaggugcacccaucuuggagcauaugucugccaucauuccucuuuauuuauuuuucuuuucuuuuuguggcgcgaucucagcucacugcaagcuccgccuccuggguucaugccauucuccugccucagccuucugguagcugggacuacaggcgccggccaccaugccuggcuaauuuucuuuucuauuuuuaguagagaugggguuucacaguguuagccaggauggucuugaucuccugaccucuugauccgcccgccucggccucccaaagugcuggaauuacaggcgugagccaccgcgcccggccuuuuuuuuuuuuuuuuugagacggagucucgcucugucacccaggcuggagugcaguggcaugcagucucugcucacugcaagcucugccuccuugguucacaccauucucuugccucagccucccgaguagcugggacuacaggcgcccaccaccacgcugggcuaauuuuuuguauuuuuaguagagaugggguuucaccguguuagccaggauggucucgaucuccucaccucgugauccacccgccucggccucccaaagugcugggauuacaggugugagccacugcgcucggccgacuauuuuucuuuucucuuaaacuuuauguaauauguagagaugagaugucacuguguugccuaugcuguucuggagcuacugagcucaacugauccaacccccuuggccucccaaagcgcugggauugcagaagucagccugcuucguuccuuuggaaggcugagucauauuucauuacaagcacuuuuuuuuguuuuuuguuuuuuguuguuuugagauagagucuggcucugucacccaggcuggagugcaguggcgcaaucucagcucacugcaaccuccgccucccagguucaagcgauucucgugccucagccuccugaguagcugggacuacagaugugcaccaccacaccuggcuaauuuuuguauuuuuaguagagacgggguuucaccauguugguuaggcuggucucgaacuccugaacucaggugauccacccaccucaaccucccaaagugcugggauuacaggugugagccaccaugcccagccuacaagcacuuuuuaagccuuugcugguuccaucugcucaugucccauuggccaaagccagccacguguccaggcucccuugcaagcgcaggagaaauugacacaaugggaagagcuacaggggaugugcagcccuucuuugcaccaaccacacagagccugaguaugucaaugauuaaaccaaaggccccagagcucaccguagccaggaaacccuuccucccucccucccuuucucuuuucuagacugucauguaagucagaugcuggaaggauuccuuggguuccuucuggaaucccgucucucccaggggagccuccuucccucacuucucucuccccugccccagauggaaacugucaagcaaggcguugaucagaagcugguggaaggccaggagaagcugcaccagauguggcucagcuggaaccagaagcagcuccagggccccgagaaggagccgcccaagccagagguacccaugaggggacugggggguggccuaggguacuuggagucccgaugccacucucuacaccucugcuucaugggccuaccugcuucgaaugauuucccuagccucaccugcuuuuggaagcuaaugacaccuccuucaggaagccugccuugauuucuccucuugggcaugcauagguauggcuucuguuuuuuguuuugagauggaguguugcucugucacccaggcuggaguacaauggcaugaucuuggcucacugcaaccuccaccuccuggguucgagugauucuccugccucagccucccuaguagcugggauuacaggcgcucaccaccacgccuggcuaauuuuuuuguauuuuuaguagagacaggguuucaccauguuggccaggcuggucuugaacuccugaccucaagugauccgcccugcccagccucccaaaguguugggauuacaagcgugagcuacugagcccggccccuagcagcaacuucugacuaguauucuccggcccccuccacucuaucucaagccuuggccucuuguguucucuaaugggucucgcugccugucccaccacccacuuaagcuccccaggggcaaaggaaguuugcagugagccgagaucgcaccacugcacuccagccugggcaacagaaggagauucugucucaaaaaacagaaaauguccugaaauuagaugaagguaguauuugcccaaccuugugaauguauuaaaaaccaaugaaucguacacuucaaagggcgaguuuuaggguguguggauuauauaucaauuuuugaaauaguuguuuauuuaucuuugagacagggucucacucuguugcccuggcuggagugcagugaugccaucacaggucacuguggccucgccauugcaggcucaggcaauccucucgccucagccucccaaguagcugggaacacaggcgugugccacgaugccuggcuaauuuuuuuuuuaauuuuuaguagagacaggaucucacuguguugcccaggcuggucuugagcuccuggugucaagcaauacucccacuucagccuuccaaagcacugggauuacaggcaugagccaccacacccgaccccagaucaauuauuuauuuauuuauuuauuuauuuauuuuuugagauggagucucgcucugucacccaggcuggagugcagugguguaaucucagcucacuaccagcucugccucccagguucacgccauucuccugccucagccucccgaguaucugggacuacaggcgcccgccaccaggcccagcuaauuuuuuuuguauuuuuaguagagacgcgauuucaccguguuacccgggauggucuugaucugcugaccuugugauccgcccgccucggccucccaaagugcugggauuacaggcgugagccaccgcacccugccuauuuauuuauuuauugcucuguugcccaggcuggagugcaguggcacaaucucagcucacugcaaccucugccuccuggguucaagugguucuccugucuccaccuccccaguagaugggauuacaggcaugcgucaccacgcccggcuaauuuuuguacuuuuuaguagacacgggguuucgccauguuggccaggcuggucucaaacuccugaccgcaggugauccgcccacaucggccucccaaagugcugguauuacaggcgugagccaccgugcccggacccagaucgauuuuuuaaaaacugaaaugagaucauaucaaaagcacauaguaagggcuacaaaagugacaugcauaaagauauggugaauaucucuauaaaugcaaauuguucgggaggcagaacuagaccaccugcugccuaaaacugucuccuguuuccccgacugcuaagcacagcagccagaaugacuuuucaaaugaaaaaaccagaucuuaucucucucacgugggcacucucccguaaucccucgcucaaguccagaguccuccagcugccagggcucugggcaaaacccuaccucccagugugugccuuuuuuuuuuuuuuuuuuuuuuuugagauagagucucacucugucacccuggcuggagugcaaugucaugaucucggcucacugcaaccucugccucccggguucaagcgauucuccugccucagccucccgaguagcugagacuacaggcaccugccaccacgcccagcuaauuugauuuauuuauuuauuuuugagacagagucucacuccgucacccaagcuggagugcaguggcgugaucuugacucacugcagccuccaccuccuggguucaagcaauuuuccugccucagucucccaaguagcugggauuacaggcgccugcaaccacacccagcuaauuuuuuuguauuuuuaguagagacaggguucugucauguuugccaggcuggucuagaacuccuaaccucaaguuauccacccgucuuggccccccaaagugcugggauuacaggccugacccacugcgcccggccuaauuuuuguauuuuuaguagagauggggucucaccauguuggccaggcuggucucgaacccugucugugcucaucucacucucuggccaaggaaauuuucaaggaccugauuucaacuauguucuccccggaugguuuacaacuucugccuagaaaguucuuccaggcugucccagccuggcuuccacuuuuuguuuuuuaacagcuuuuuuuuuucuuuuuuuuuuuuuuuuuuuuuugagauggagucucgcucugucgcccaggcuggagugcagugacgcgauuucggcucacugcaagcuccgccucccggauucacgccauucuccugccucagccuccuaaguaacuaggacuacaggcucccgccaccaugcccagcuaauuuuuuuguguuuuuuuaguagagaugggguuucaccauguuagccaggauggucccgaucguccugaccucaugauccacccuccucggccucccaaagugcuggggauuacaggggugagccaccgcacccagccuuuuuuuuuuuuuuaacaguuuuauugagaucucauuugcauaccauacaagucacgcauuuaaagcauacacaucgcugguucucagcauugugcaacuaucccuaucucaucucaugccccuaaaaagaaacccuuuucccaucagcagucacugccccauuuccuccuccucccaaccacguauccccuccugucucuggaugggccuguccuggacauuucauagaaaugggaucacacccuguuuggccuuuuguguccggcuucucgcgcugagcgugacguccuuagggcucacccaugcuguggccugggucagagccccaugacguuccauggcugagucacauucuguuguauggguggaucacauucuguucacccauuuaucaaccgaaggacacuugagucguuucuacuuuuugcugugccccugugugcaugucuuuguguguggacguauguuuccguuucucuugugcacacacccacaacuagaauugccgagucauaugaugauucuaugguuuaacauuuugaguaaccgcuagacuguuuuccaaaguaacuauaccaccagcaauacacgaggcuuccaauuucuccgccucuugacugacaguggguaucaucugauagccucugggguuuuuguuuguuuguuuguuuuugagacagagucucgcucuguugcccaggcuggagugcaauggcaugaucuuggcucacugcaaccuccgccuccugggugcaagcaguucuucugccucagcuuccuguguagcugggauuauaggcacaugccaccacacccggcuaauuuuguaucuuuaguagaaaugcggguuucgccauguuggucaggcugaacuccugaccucggugauccacgcaccuuggccucccaaagugcugggauuacaggcaugagccaccaugccaggccuccuuaugguuuugauuugcauuuccucaaugacuuauaaggucaaacagcuuuucaugugcucucccuauaucuucuuuggugauuugucuaugcccuuuaaagaauuugacuaguggccaaaugcaguggcucgugccuguaauuccagcauuuugggaggcugaagugggcaggucacuugggcccaggaguuuaagaccugggcaacuuagugagauccuggcucuacagaaaauuuuaaaaauguagcugggcgugguagugagugccuguagucaggcaggcugaaaugagaggauaacuugagcucaggaguuacaggcuguaguaagcuaugaucacgccacugcacuccagccugggcgacaaagugagauccuguuucuaauuaaaagaaaagagucugggcgcggugguucaugccuguaaucucaguacuuugggaggccaaggagggccgaucacuugagguagaguucaagaccagccuggccaacauggugaaaccccaucuguacuaaaaaugcaaaaguuagacgggcgugguggcacgcgccuguaguccuagcuauucgggaggcugagguaggagaaucgcuugaaccugggaggcggagguugcagugagccaaaaucaugccacugcacgccaaccugggcaacagagcaagacucuaucucaaaaaaaaaaaaaaaaaaaagggccgggcacgguggcucacgcuuguaaucccagcauuuugggaggccaaggcaggcggaucacgaggucaggagaucaagaccauccuggcuaacacggugaaaccccgucucuacuaaaaauacaaaaaauuagccuggcgugguggugggcgccuguagucccagcuacucgggaggcugaggcaggagaauggcgcgaaccugagaggcggagcuugcagugaguugagauugugccacugcacuccagccugggcgacagggcgagacuccgucucaaaaaaaaaaaaaaaaguuucgccuauggaaagcguuugccccaaggucagugguagaaccccucuuccccucuuucccuggcuucagcuccgaucgccuuuccugaaacaaaugguccugauugguguccccaucucccuucucagcaggucgagucccgggcgcucaccauguuccgggacauugcccagcaacugcaggccaccuguaccucccugggguccagcauucagggccuccccaccaaugugaaggaccaggugcagcaggcccgccgccagguggaggaccuccaggccacguuuuccagcauccacuccuuccaggaccuguccagcagcauucuggcccagagccgugagcgugucgccagcgcccgcgaggcccuggaccacaugguggaauauguggcccagaacacaccugucacguggcucgugggacccuuugccccuggaaucacugagaaagccccggaggagaagaaguagggggagaggagaggacucagcgggccccgucucuauaaugcagcugugcucuggaguccucaacccggggcucauuucaaacuuauuuucuagccacuccucccagcucuucugugcuguccacuugggaagcuaaggcucucaaaacgggcaucacccaguugacccaucucucagccucucugagcuuggaagaagccuguucugagccucacccuaucagucaguagagagagauguccagaaaaaauaucuuucaggaaaguucuccccugcagaauuuuuuuuccuuguuaaauaucaggaauauaggccgggugcgguggcucacaccuguaaucccagcacuuugggaggcugaggcgggcggaacaccugaggucagguguucgagaccagccaggccaacauggugaaaccccgucucuacuaaaaauacaaaaaaaaaugagccgggcaugguagcaggugucuguuaucccaguuaggaggcugaggcaagagaaucucuugaaccugagaggcggagguugcagugagccaagaucgcgccauugcacuccagccugggggacaagagugagacuuagucucaaaaaaaaaaaaaaagaaaaaaaaaucagggauauaguucauaucccacuucuuuguuuacaccgaugucccugaauaucagccuguagcuaauggacuugggauuucuggucuaagugggccuccuggggauggggugguacacugagcuucugagccucauuguagaguagaaagguacuggggccugugugguaagccuuguugaaaugcucugguauucaguauugccuuaauaaacuucacccacaacugcauacaggc

SEQ ID NO: 192712 - RNA, 52656 nt, Homo sapiens
aucagagcagcuggcagcgcggcgggcagcguuugccgagcgggcgcuccgggucgcacgcaaguccgcgcgggguccgggccacgcacgcgguuucaucgccauccccagccgggccacgcgcgcaggcagacaagcuguucgcggcgaccggagaggugagcgggcgggccgggucggggugccagcccgggccgggcgcacggggcucgggaacuuugcaaaacuuucccgcgcggccagcccgggcgcacgcaugucccgcacucugucccgggauccagggccuccccuuccaccuaacccucgggaaucguuccccggcacacauccggcuggagccgggaccagcgcugcguccccggagcccggcggggggucgagcgcgccgggugggggagggccuggcgagccgccggggaggaugucaggcuccgcgccugcgcgcggggcgccccgcgauucaauugucgcgcccgagcccgauuucgcgcgcccugaguuccccgggagcaucugggccaauggggagcgagcggggcggggcggccgggugcugcggagccaauaagaggcggcucaagugaaggggggcgggacuugacgagcgggggcccccucuguagucccggcggcgggggugggcgugggcucgcuggcgcgacccgcgcgggccagugggagugcgggagggacgccgaggguccaggguuuggaggggcgcgagcugccggggguuggaggucgaggugagucgcggggcgcgcgcgcucgcggguggccgggacggggcggccgguuaccauggccaccgcggggcgggcccggucgcgcacgcgcgcggggggggccggcaaggagggggggcgugggcaccgaggggucccgggguccgcggaucucgggugggguuuuucccucucaguggcacuugguugaguucccccgggacuucugaaguuccggcccgcgcuggacuucugggauucccucuuccguaaauaggaauccgaggaaugaaugaaucaaugaaugaaugaauaaacgaaccaacucggccacuuggcccgggccuccuuucuccucuggucguggggaaggagggauggguuggaccuucugcuuuucuuucaauucccucuuuucauucuccuuccuccucaaucuucaacacuuggcuagucguuaaugccuuaagugcuuaauuuguugugucugguccuggccagggucuggcuguacaggaggacuggaagggcauccugggaguuuccugguguccacaggccggacaaaagcaaccccgacuccuuagagcauggcauggcucagaggugcugguaaaacugauggggguuuuugcugucccuccccucagcgccgacaccauguggauccagguucggaccauggacgggaggcagacccacacgguggacucgcuguccaggcugaccaagguggaggagcugaggcggaagauccaggagcuguuccacguggagccaggccugcagaggcuguucuacaggggcaaacagguacacccgccgccagcaccuuuguucuaugccugguccaggccucgcgccucugcagccaccagccgauacuuucucccucccaccuccccccccaacaaccucguccggucccacuucaucucucccggaaggagaaguccacagaaaccucaaaugccugcgagaggaaggaacaaagggaggacucacagauugacacgcugggcuggcggcuggcccucgaaucuauagggucugggcuuuuaaacuucuuuuuucaaagcuccgccucaaaauaauggcuagagaaagaaguuuuggagguggccgauggaaggcugaggaauuuucgagaaagggcccaggaccaucugguagcuaggacggaggggaccagguuuucuuuuuuaaacauccaccaccaauugcucucagccuguaccgguuaagcaucagacccugcgaguguuuguuucuaaaaauuuggauuagcuuauucagagucuggagauggcgcuugcuaaucaggaauuuccgccacccugagccugcugugcugcggcugcugcugaccuggggcgugugguccccgagggguccaccgacccucgucucuuucucuguucugucuccagccccucguugcauuuaaaaugucccccuuugauuucauagcugccacguuuggggcgcucccuccauuggcaccuggggguggaggugcuacuuugguugguguuuuugugggggacugugggaccuacugggagugggguuucccggcaggaugagacagugugaucgaagguguaggucccaucugcuggaguugguuggaccguggggacgggcguagacuacuggaacuggauuaaaagucgucaguugagcugcguguaccccacuguguuguuguuggauuuugaaccggguacugcugccaucuggugucuagguuggaaaauaaacacugcgcccggccagggguuuuugggggcugggaggaucaugccugcucacuccagaugagaccugaugauuaauuucucuggcuugcaugccauaggagaccuucauuagcccucuucccguaagagacgugaugacuugagucuuaagaaucugaguuaacccgcccugccccgggaggaggcgaucuggagaacuuggggaguugacggugcaagccgcgugugugcagagaagaggcagggccgggcucgacagaggagcuccgccuggcgcucucuuccucccuccuccuaugaugcgugcucccuuuguggcauccaaacugauuuugauuugccacucagccuauugggucagcacagaaggcuucauuucacaaagaguuucugaagccugcaaggaccuucuaaguucacagcguaggucaguggcggguuggacucucaugcucccaaguucaggagaggagauaaugcugaguauccacucuaugccagccaccgagcuagcauuuuaacuuuugcauuucaaccaugcaggaaugggaaaacaccuagacacaccugccauguagauuucaccaucgguauucugacuuauuagguuuaucuugaagcgcucugucuuucucucugcccgccaauccaucuuuuugggaugcauuucaaaguaaguugcagacaccaguccaccuuucccuuauuacugcagcacaccgucaguaccuagagcucaguauuuguuuuugguucuguuuucauugauuuuuuuuguuguuguuccuauuugagacaggaucucacucugcccaggcuguguugcaguggcacgaucacagcucacuauagccucagcuuccugggcucaagcaauccuccagccucagccucccaaguagcuaggacuauaggcaugcaccaccaugccuggcuaguuuuuguaucuuuuguagagauggggucuuauuauauugcccaggguggucuccugggcucaagugacccuccugccuuggccucucaaaguuuugggguuacaggcgugagcuacagugccggaccuaaaagcuuugucuauagugaaacagauguuagacagacugaauaauuuugacaaaugucuacauccaugcaacccaaaaccccuaucuccccucauuuguaacauaauacuugagucauacaauagugucugucacauuucuaaguuuagugugacaaugacaggaacacguauguuaauuagacauguacauugugcuuuuuuuuuuuuuuuuuugagauggaguuucauucuuguugcccaggcuggagugcaguggcucgaucugggcucacugcaaccuucaucucccaaguucaagcgauccuccugccuuagccucccaaguagcugggauuacagucacccaccaccacgccugauuaauuuuuuguauuuuuaguagagacggaguuucaccauguuggccaggcuggucuugaacuccugaccucaggugauccaccuaccuccgucucccaaagugcugggauuacaggugugaaccacugcacccagccacguacauugugcuuuuaauugucaggauguccgcagugaugacaccuggcccuagccuugccggaacucacccggacugaacagggagcugggauuggaaccugggauuuugguuucugagacugggcucucaacacugaauuucgucucccaggucagcucugguaguuaugaaaagauucaguguuccuguguaaccuucauaaccgccucuuaguucccuuacccuguggcuguuucccaugcaguagcuuuuuuuuuuuuuuuuuuuuuuggagacaguuucgcucuuauugcccaagguggagugcaauugcgugaucucggcuuaccucaaccuccaccuccuggguuccagcgauucuucugccucagccucccgaguagcugggauuacaggugugcgccaccaugcgcagcuaauuuuuuuuguauuuuuaguagagaugggguuucuccauguuggucaggcuggucucgaacucccgaccucaggugauucacaccccccucccccaccuuggccucccaaagugcugggauuagaggugugaaccgucgcauccggcccccaugcaguagcuuuuaagagaucgugucguugcuucugucuuccgggccacagagaggugaugcaguuuccccacuugcauggcugggaaagugagcuggcagcagggagguuuggacaguggcgggaaggcgggacagaggcacacagcagcaccucccagagcgugaagucugcaggcacccaggcuaacgugauagaaagcaacacaguucccggugggcacaaaugggcaguuguccuuauagaauguucuagaguguucacagucuuuuuuuuucccuguuuaaagaaaccuggccuagcagcccaaggucugcagugaaguugauggagaccccagagcagaacagaguugggucugucucggaauauggaggaucucgugguggucucacuugggcugaauagggugacagugaugucacuugaugggcgggaacgcagggagcugaucgagggcagugacuuugggcagacggcccagccuaggcaacgggagaggcaucugcggcccccaccccucaaucuuuuuuuuuuuuuuggcugcacaucaaaauaacaauagcugucuuuugcggcaccuuuaaccugcucggguacaacgcucugcacuguacauaaucuuuucagcaucccuggcccgcgacucgccagcucccacaucaucuuauuuuagauagggcuaauacccaccacgcugcagcgcagugcgaauucaaugagguuguggauuugaagggcggagugagcccugugccaggcucacaaugaaagcgaaaucaaucucuuagcacagggccugucccgcucugcacuguggauguuuggggccaggucauccucuggcugggaccguccugggcacugcagggugcggagcagcgucccuggccuccacccacuccaugccagagcauccugcccuaccagucaugacaaccacaaauauucccagagacuuccaugccucaaaggcaggauuaaggucagucugaugccucaguugaaaugguggcccaggaauggccuugcaagagucacuugucacagugaugccucagguguccccacuggacggcccccuugcagagaccugcccuucugucugcgggagggaggguccccaccaccagcucccacccacugcggcaucccucccccaggauggcucccugguagagggcgcggccucuguuagggugacucaccacugcuguuguggccccgaagcagcuguagacaaucuguaaaccggugggcguggcuuuguuccaauaaaacuugauuuauaaaaacagguauggcggggcccaguggcucaugauuguaaucccggugcuuugggaggccaaggcaggcggaucaccugaggucaggaguucuagaacagcgugccaacauggugaaaccccgucucuacuaaaaauacaaaaauuagccagacgugguggcgcaugucuguaguuccacuuaggaggcugaggcaggagaaucgcuugaaccugggaggugggagguugcagugagcugagaucccaccacugcacuccagccugggcgacagagcaagacuccgucucaaaaaaaaagcaaaacaaaaaacaaaaccaaaacaaaagaggugcaggccagaauuguccccguggacauaguuggucaauuagauugcauacuuuaauccagccucaguuggugugucuggguuuucuggcuaggaagaaugcugcuguggaaugugcuggaacagauccuuacgugcgcuguguuggagucuuuccaggucagggguucucaaacggauuucaggacccuuuacaucauccagaaugauccaauagccccaggagccugugucuguguggauuaugucugccggcuguuaguguguuagaaguugaggccaggcaugguagcucacaccuguaaucccagcacuuugggaggcugaggcgaggaucgcuugagguugggaguuugagaccagccugggccauguagcaagaccccgucucuacaaaaaaugaaaauuagccgggcaugguggcgcaugccuguaguccuagcuacucgggaggccaaggugggaagaucacuugagccugaaagguugaggcugcagugaaccaagauuguaccacugcauuccagccugggagacagagcgagacuuugucucaaaaaaaaaaaaaaccaaauaaauugaaagcugagaaauucagagcacaagaagacaagcgcgcccccucuuuuagcugucaacauggcggagccgucccuggugacgcagccuccaaaggccucccugugcccuccugagaccgcaagagggaaaguggcagcgacagugaucguggugucuuuguggcgguuguguugaccucacugacccccgaagugccgcucuagggucuguccucagcggugacccggccgggucgaagggcagaguuccgcugucacuagcccuccacccguccugugugcugggaugcccucgcggcgccguccacgccaccgccgcccccucuuguggguucugucuccuccgugucuaggauccuccugcauccguuuuuccuuccucccuucucucccuccgucugucuugcccgcaccugagguugucgcagaggcgcugagacgggccagcaggagcuguggcugccccucaggaaggcagagcaguuucucacuuccuuccccccaggucccgucaggccccugcaggcacucucucuuccggcuggaggucccuccugaucgaggcuuacacggucuuugcugagcuccuaaacuucugguuucuaucccuaaaguuggagaaccacugcuccccaaacccgguggcauuaucugcccugcugugccgcuaggcaguguucggcacccugaaagagagccccugaauguggcacgagggguaggaagugggcagcucgguggggggggggggugcagugagcuuuuagucuuaaguuuucguuuuuuuuuuuuuuuuuuucuuuuuuauagagaugggaucucgcuuuuuucaccaggcuggucuugaaccccuggccucaagugauccucccaucuugacuucccaaaguacuggguuuacaggcaugagccaccacacucggcccuuugucuaaguuuucaaaaggaaucagcaaacuuaguuaucaaguuguauuuguauuuaucuggacacuuuuuuuucuuuucuuuuuuuugccuuuaagggagacaggguccacaaggccgggcgugguggcuuacgccuguaaucccagcacuuugggaggcugaggcaggcggaucacgaggucaagagaucgagaccaugcuggccaacauggugaaaccccaucuuuacuaaagauacaaaaauuagcuggggaugguggugcacgucuguagucccagcuacuugggaggcugacgcaggagaauugcuggaacccaggagguggagguugcagugagccgagaucacgccacugcacuccagcuuggcaacagagcgagacuccgucucaaaaaaaaaaaaaaaaaaaaaaaaagagacaaggucuugcugucguccaggcuggagugcagcggcgugaucauggcuuacugcaaccucuguuuuccaggcucaagcaauccuccuacuucagccuccugaguagcugggacuacaggugccugccaccacacccaauauuuaaauuuuuauuaauugaaaaaacuuuuuugcagagacagggucuugccugguaucaaacuccugggcucaagugauccuccugccucggccuucugaguaguugggacuacaagcaugagcuauugggccuggccuagcuuuuauacaaugcccauguuacaaaauuccaaauguccaaaaagcaaggagaauaucuuccacucugccuugaccuucaguuuccccccuguaguaaccugucugcuuccagaagugcuugaacaugugugcguuugcuauggguuuuuuuuuguuuguuuuguuuuguuuuugagauggagucucacucuguugcccaagcuggagugcaguggcgugaucuuggcucacugcaaccuccaccucccagguucaagugauucuccugccucagccucccaaguagcugggguuacaggugcacaccaccacguccggcuaauuuuuuuguauuuuuaguagagacgggguuucaccacguuggccagguuggucucaaacuccugaccucaggugauccacccaccuuggccucccaaaaugcugggauuacaaguaugagucacugugccuggccuguuuuuuuuuuuuugagacagagucuugcucugucgccaggcuggagugcguuggcuugaugucagcucaccgcaaccuccaccucccggguucaagcaauucugcgucagccucccgaguagcugggacuacaggcaugcaccaccaugcccggcuaauuuuguauuuuuaguagagacgagguuucuccauauuggucaggcuggucucuaacuccugaccuccaguuaucugccggccucagccucccaaagugcugggauuacaggcgugagcuacugugcccagcugguuuuuuuuuuuuuuuuuuuuuuuuagacaggcucuugcucuguugcccaggcuggaguacaguggcacgaucuuagcucacugcagccucgaauuccugagcucaagugauccuccugccucagccucgcaaguagcagggacuauaggcuguauacuacuauaccuggcugauuuuaaacauuuuuauagagauggguuccugccauguuacccaggcuggucuugaacuccuagccucaaaugauccuucugccucagcuucccaaggugcugggauuauagaccugagccacugcuccugaccucauuuuuuuuuuuuuuuuuuuugagacaguguaucagugucucccaggcuggagugcagcggcgcgaucucgacucacugcaaccccugccucuugggcucaagcaauccucccaccacagccuuccagguaguugggacuagagguaaauuuuauagugauggguuuugccauguugcccaggugaucuucaacuccuggacucaagugauccucccgucuuggccucccaaaucauaccugagauuacaggcaugagccacugcacacagccccauuuuaacuuuuuuuuuuuucugaggcagagucucgcucugucacccaggcuagagugcaguggcguggucuuggcucacugcaagcuccaccuccuggguucaugccauucuccugccucagccucccgaguagcugggacuacaggugcccgccaccucgcccagcuaauuuuuuguauuuuuaguagagauggaguuucacuguguuagccaggaugguuucgaucuccugaccucaugauccacccgccuccgccucccaaagugcugggauuacaggugugagccaccgcgccuagcccauuuuaucuuuucugauaaugauuuuccuuuugccaaaaacggcaaguggguuuuagauuaagucacuccuuuuaccaggcacaguaggagaccuugaguuagggcugagguggugucauuuaauagggacauucaacuucacuagguucaaugauaggagacuuuacaaauuuccauaaugguaaaucuucuuucauuuaaauuauuauuauuguuaauauuuuuuuuuuugagacagaguuuugcucuuguugcccaagcuggagugcaguggcgugaucucaacucacugcacccuccgccucccggguucaagcgauucuccugccucagccucccgaguagcugggauuacaggcacccaccaccacgccuggcuaauuuuguauuuuuaguagagacggaguuucuccauguuggucaggcuggucucgaacuccugaccucagcugauccguccgccuuggccucccaaggugcugggauuacgggcaugagccaucgcacccggccaaucauuuaaauuauuaaugaagaauaaaaagaggcugggcgcagcggcucaugcuuguaauuucagcacuucgggaggcugaggcaggcagaucaccugaggucgggaguuagagaucagccuggccaacauggugaaaccucgucucuaccaaagauacaaagauuagcuggguaugcuggcaugugccuguacucucagccauucgggaggcugaggcaggagaaucgcuugaacccgggagacggagguugcagugagcugagauugcgccacugcaguucagccugggugacagugagacuccgucucaaaaaaaagaaaaaaaaaaguaagucccacguagccaucacccucugcaguagucaucugcugugucugaucuuguucauuuugcucauuucuacccuacccacuuaccucuaccugacuggauuguuuaagagaugggaucuugcuguguugaucaggguggagcacaguggcuauucacagaugugaucauuuugcaugagaaccccaaacuccugggcuccccugacccuccagccucagucugccaagcagcugggacuacagaugugagccacuguacuggcuccuacuggaucauuuugaagugaguuacagaugccauaacuauaacacagacaucauagguacaggaauuucagugcaucuuccccaguggcucauggaucacacagauagaaaaucggucaggagggccacgcgcgguggcucacaccuguaaucccagcacuuugggaggccaaggcggguggaucacgaggucaagagaucgaaaccauccuggccaacauggugaaacccugucucuacuaaaaauacaaacauuagcugggcgugguggcaugcaccugcagucccagcuacucgggaggcugaggcaggagaaucgcuugaacccaggaggcggaggucacagugagucaagaucgugccacugcacuccagccuggugacagagggagacuccgucucaaaaaagaaaaaaaaagaaagaaaaucggccaggaugccgggcacgguggcucagcccuauaauuccagcacuucgggaggccaaggcggguggaucaacugagguggggauuucgagaccagccugaccaacauggagaaaccccaucucuacuaaaaauacaaaauuagccagguaugguggcgcaugucugucaucgcagcuacucgggaggcugaggcaggagaauugcuugaaccugggaggcggagguugcagugagccgagauuacaccacugcacuccagccugggcaacaagagugaaacuccguuucaaaaaacaaacgaaaaaggaaaguuggucaggaugcugggcacaguggcuggguccuguaaucccagcacuuugggaggcugagucagaaggaucaguugagcccaggaauuugagaccagcaugggcaacauggagaaacccugucuguacaaaaaauacaaaaaacuuucuggacgugauggcccaugccuguagucccaguuacuuggaggggccgaggcgggaggguugcuugagcccaggaggucgagguugcagugagccauggucgugccacugcccuccagccugggcaacagggagggagacccuguuuuaagaagaaaaagaaaauugauaaagauguagaugauuugaacaacacaaguaacaggguuaccguaaugacauggauggaaucugaacccagcaagagagaaaacacauucuucucaggccacgaggagugcuuagggaaacugaccacauacaaggcaagucuuaaaaacucgauuuuuauuuuuauuuguauuuacuuauuuuguuuauuuauuugagacagucucgcucugucgccuaggcuggagugcaauggugagauuucggcucacugccucccagguucaagcuauucuccugccuuagccuccugaguagcuggaauuacaggcgugcgccaccacacccagcuaauuuuuguauuuuuaguagagauggagucucaccauguuggccaggcuggucucgaacuccugaucucaagugaucugccugccucggccucccaaagugcugggauuacaggugugagccaccggaccugggcuuuuguuuuuuauguuuucauuuauuuauuuguuuuugagauggagucuugcucuguugcccggacuggagugcaguggugugaucucggcucacugcaaacucugccuccuggguucaagcaauucuugugccacagccuccccaguagcugggacuacaggcgcccaccaccacgcccggguaauuuuuuguguuuucaguagagaugggguuuugccauguuggccaggcuggucucgaacuccugaccucaggugauccauccgcccucggccuccccaagugcugggauuacaggcgugcaccaccgugccugacccuuuacaaauuuagaacaauuacugccuuacugaccauguuuucucucaccuguggggucagaacuuaacaauaacuaagcuuccuccuucgcgcuucggguugugcaagcuuccuccugccugcuuuggggccuuucugcaauguuccagaagcggcaucaggaggcugcccagccagcucgugaguuguguucuggagucagaguuuugugccagccugggccaggccccauccccacuucccgccccauuugccccugucuacaucauuguacugggagacacuuccugucccuccuacguagcccacgcuaagcagggugcuucuauccaccucaccuuuccgaugugggaagggccgaagucauggaggggcgacccgucaggcccagcaaggguggcacagauguugucccuaguaacagaugagaggggaugggcugggacugcaggccuggcuccccaagcugcuccugcgggucaggggcugcccauuagccuggccagggccccucauuggaucccuccuggccgcccagaccacagcccuugccccccugccuacccgccaccaguucucauuggcccugccucccugcuuaacucugccgccuuggcuuccccuccucggucugucuccuccccgacuuguccucugucugagucuggcaggacagaguccgaccgucuggcccccuccuggcuccgucugcuccuccugccgccuccugcugucgaggucacuugguucuuggccugucuggcccccagccacccugcuggcugccugcucuccaggcagccccucgcccagggcugcaccuccgaccuguccuccgucuuggguggggcugggacuguauuuuccauccucugcaguggucugguuucccucgugcgcugaggccccucugcuuggcugccccuggcugccccaugcagcugagccaugagcgcggccugugugccccucucccgcuggcuggagcucaggaugcucacgccgcucuggcagauaucgcugcugcaaacauaggaggagcagcugccccucugcgcacguggccuucggacacaugugagggccgcucuagcuugggugcucacugcgggugauuccacccuccaggggacacugggggaugucuggggacauucaugacucgggcgcuccuggcguggaguagguggaggccuggagugcugauuagcacccugcagggcccaggaaggccccaccccagagagugaucagaccccaaaugucagcuuuggcaagagcagugugccuggccacagaggugcuggcccggaugcagaugagugccccauccaucccucugagcgccguguggcuugucccaugcugcuuuuccugacccagugauauugggggcacuugacuucucucuuuuuaagacggagucucauucugucacccacgcuggagugcaguggcgagauccuggcucacugcaaccuccaccucccagguucaaaugauucuguugccuuagccucuugaguauuugggauuacaggcacuaaccaccaugccuggcuaauuuuuuaauuaauuuuuaauuuuuuuauuuuuuugagacggagucucgcucugucgcccaggcugcagugcaguggcgugaucucggcucacggcaagcuccgccccccggguucaugccauucuccugccucagccucccgaguagcugggacuacaggugcccgccaccacgccuggcuaauuuuuuguauuuuuaguagagaugggguuucgccguguuagccaggauggucuugaucuccugacuucaugauccacccgccucggccucccaaagugcugggauuauaggcgugagccaccgcacccggccaauuuuuguauuuuuaguggagacgggguuuggcaauguugcccaggcuggucucgaacuccuggccucaagugaucugcccaccucggccucccaaaaugcugggauuacagaguaagccacugugcccagccccuuuuuuagaaaaaauuaauaaacuuuauuuucuagagcaguucuagguucacagcaaaauugagcagaagguacggaguuccuauagacccccugccccaacaggcauagccgcccccacugucagccucccccacagagcggugcaucgguuacaguugauggcccgauggcccucuguggagucaucuucaucucugaguccacagucuacauacaccaaggcuugcccuugguguuaaguuuuuuuuuuuuuuuuuuugagacagugucucacuugucgcccaggcuggaauguaguggcgugaucucggcucacuguaaccucugccucccagguucaagcgauucuccugcuucagccuccugaguagcugggacuacaggcgcgugccaccacgccuggcuaauuuuuguauuuuuaguagagacgagguuucaccauguuggccaggcuggucucgaacuccugacuucaagugauccaccugccuuggccucccagaguguugagaugacgggcgugagccacugugccuggccugcuucauguuuuaaauaacggcuuuauuauaucccugcaguucacccaguuaaaguacacaguugagguauauucauaguuguguaaucaucacugcagucuauuuuagaacauuuugucaccuugaaaggaaacccugaacccugucccagcuacugcuuccuuuuucugcaucuccucccgcagccccuggcacccucaaauccccuuccugccucuguggcuuggccuguccuggaaauuucauagaaaugggaucaugcacugcguggccuuuugugucugguguuucucacugagugugauguccucaaggugcauccacacuguggccugggucacagccuugcuccuuuucauggcugagucguauuuuauuuugccuuauauuuuauuuauuuuauuuuauuucuuaagacagucuugcucuguugcccaggcuggagugcaauggcacaaucucugcuuacugcaaccuccgucucccagguucaagcaauucuccugccucagccucuggaguagcuaggauuacaggcacccgccaccacgcccaguuaaguuuuguaucuuuaguagagacgggguuucaccauguugaccaggguggucucaaacuccugacuucaggugaucugcccucguuggccucccaaagugcugggaugacaggcgugagccaccgcacgcggccugagucauauuuugacacauggauggauggccacauuguguugauccucucaccuguuuuuucuuuucuuucuuucuuuuuuucuuucuuuuugagacggaguuuugcucuuuuugcccaggcuggagugcaguggugcaaucucggcucacugcaacuucuaccucccagguucaagcaauuguccuuccucagccucccgaguagcugggauuacaggcaccugccacuaugcccggcuaauuuuguauuuuuaguagagacagguuucaccauguuggccaggcuggucuugaacuccugaccucgugaucugccugccucggccucccaaagugcugggauuacaggcgugagccaccgcacccagccucaauccccucaccuguugauggacaccuggguugcuuccacucucaggcuguugcgagugaugccgugugaaccugcguguacagguugacgugccucuuccucuccauccgugccaccucuccccaaagccagcugcucugugcuggagagcuggcccugagccuccuccuggcucccaggcagcgccuagcaugucagaggcacucacuucuagcugggagaacagaggggcugaagcggauauuggugggcccucgauguccacgguggguuucagagcagcccuugaaacccuuguagcuguagguggguguguacauauucaaacggguuuuucugaugcugguggaucgcuugcuugagccccggaguucaaaaccagcuugggcaaagcagcaagaccucaucucuaaaaaaaauuagcugggcaugggugaugugugccuguggucccagccacucaggagccugaggcaggaggauuacuugagcccaagguucgaugcugcagugagcuacgauugcaccacugcccuccauccuuggcaacagagugagauccuuucuaaaggaaaaaaaaaaaaaaguccgggugcaguggcucacgccuguaaucccggcacuuuggaagguugaggugggcggaucacgaggucaggagaucgagaccauucuggcuaacauggugaaaccccaccucuacuaaaaauacaaaaauuagccgggcuugguggcgggugccuguaauccccgcuacuugggaggcugaggcaggagaauggcgaaccugggaggcggagcuugcagugagccaagaucgugccacugcacuccagccugggcgacagagcaagauuccgccucaaaacaaaaaacaaaacaaaacaaaacaaaaaaaaacaggccggguacugugguucaugcuguaaucccagcucuuugggaggccgagguggguggaucccuucagcguaggaguucaaaaccagccuggccaacauggcgagacccugucucuacuaaaaauacaaaaauuagcugggugugauggcucaugccuauagucccaagcuacucaggaggcugaggcacaagaaucgcuugaaccugggagguggagauugcagugagcugagaucacaccccuacacuccacccugggcgacagagugagacuccaucucaaaaaaaaaaaaaaaaaaaaaaauuuuuuucuggaaaagaugagucagccuuuaucagguucuuagguuuauggugaacaaagaaagaaagccugcagagaagggccuuggccuucacugugacccccaugcuguuugcauuugaacagccgucaggccuuggauccccaaggggcgaaaggaggaagagcugacauucuauguaugucucucuccucccuuuuccuaaggucucucuccucccuuuuccuaaggaugcuccugaaccagggcauuucugccucuaggggacacauggugaugucugggggacaucgguuguugucaugacugguggaggccagggccgcugcagugccucugcagugcccagcacggccccacgguccagugcccagagggggagacccagcccaucccagaguggucagcccuaaugucagccaugcuuaggucgagaaaccuguauuaauuacauggaaaccaaccgaguccaauccugcucgcaccaggcacgggauaaacuccugacggggcagacguggaaaccagggggacccccagcuccugggauucaccuccucucucccuucccacucaguguguggauuuuaaugcgugcagccuccugggaccucaguagggcacagcaucaugggauaaggaguuucuugggggccuguggaauccuucaccagggggucucacccagggugacuucacacccccccaccccauaccguaugaugucuggggacauuuguggucgucacaacuacggggugcuccuggcauggaguagguggaggccagggacgcugcucagcacccugcagugcccaggauggcuccgccccagagaaugguccaggaccuggccccaaugucugcagugccgggggagaggaacuuguugccuugggggcaucuagauggcaaaucaucaggagggggggguccuagauggcaaaccaccgggagaggguccuuguuggguguugguggagugugaaggggcagcuucugacaaaaugccucggcuucuccagcccccagauacagcucaggugaugagcuccuccuugcauaccugcugagucaggugacccgaggggcaggcuguggagccaggccccagggguugagcgcaucaggauaaaagcgcacaaagggcggguggagcugagggucagaggaggugcccuggcaggcgagauuggcgcuggagccuuacccaggaagcucauaggaagcucauggaugcuggcaugugccucuugcuguucaggugggacagggucucucugucucgacacuggacagugggaccguccugggcacugcagggugccgagcagcguuccuggccuccacccacuccaugcuaggagcuucucccaguggcgacaaccacaaaugucccagacguggcccagcgucccccggggucugaaucauguuugguugagaagcagugacagaggugacacauguucacugucacaaaagcugccguaagcacgaaguauuaggaaaaacucccaagacccccaugugugcguggugccccgugaugauguuuugugcuucugggugcuuccugcaugcagugccaaaagcccucgcuagaggggccugagacccugagggaagggacuggggugccgcuugugagcgggacagcccccuggcauggcccagguaucauggcucuuuacucugaugcagauugccccccccccacaagggcugggacacaguguuugguucaucacuggugcccacagaugcccacuuggcauuugguggcuaaacagcgucugccucuggugucccugcagauggaggacggccauacccucuucgacuacgagguccgccugaaugacaccauccagcuccugguccgccagagccucgugcucccccacagcaccaaggagcgggacuccgagcucuccgacaccgacuccggcugcugccugggccagagugagucagacaaguccuccacccacggugaggcggccgccgagacugacagcaggccagccgaugaggacaugugggaugagacggaauuggggcuguacaaggugagccuccccuccgcagcugcucugggguuggacguucucccugccauucuggucuuugcauacccagggcucacaggaggggcuucccacgcgccucucuagcucuggcugggcagaaauggccaaggggugguuuccugcacguuccuugaggggaacaugguacccugggauuccuuuguggaccucuagagcagaguccuguucggggccugcaggugucuucuccgugaagcuugcaguggcugugacguuucugaacuugcugcuaccauguaagaucaggaaaugucacagaaagaucuggguuuccagcuuuuuuauuuuuuuauuuuuuuuuuggcagggucucacuuuguugcccagccuggggugcagccgugugaucacagcucacuguagccucgaacuccugggcucaagugauccucccaccucagccuccugaguagcugauguuauaggcaugugccaccacgcccagcuaauuuuauuuuauuuuauuacuuuuuuaauacauggucucauucugucgcccaggcuggaguacaguggugccaucucggcucauugcaaccuccaacuccuggguucaagcaauucucgugccucagccuccugaguagcugggauuacaggcaugugccaccacaccuggcuaauuuuuguauuuuuuguagagacgggauuucgccauguuggccaggcuagucuugaacuccuggccucaagugaucuucccgccgcagccucccaaagugcuggaauuauaggugugagccacugcacccagucuguuuuauuuuuuaguagacacagcgucuuaccauguugcccaggcuagucuugaauuccggggcucaagcgauccaccugccucggccucccaaagugcugguauuccaggcgugagccacgacgcccugccuggauuuccagcuucucuugacaaaugggcagcucuggucucucagggccucccagcagcuguggcugaagcagagccgcaggggccuuuguuaagacaguccaugcccccuggccccgcauccccgucaccccugccggggcugguuucucauggucagcgguucccagccagggaggagaaaccucgcugugggcauucgaguuugcgcccugguuccagagcaucccaguguccgagaaccaagguggucucccgucaguuuuccucaccccguugggaugccagacuucccucauuccucacaggucaaugaguacgucgaugcucgggacacgaacaugggggcgugguuugaggcgcagguggucagggugacgcggaaggcccccucccgggacgagcccugcagcuccacguccaggccggcgcuggaggaggacgucauuuaccacgugaaauacgacgagugagucauggcaggugggcgggccuggguauucaggcucugugacgcgcauccuuggcugcggguguucaggccagagcuuggcacugucucgagauggugaucaggaucuggggccccauccucgaauuccuaacagcauacgaggcugcccacuuggggacuagccuggggacccgaagccggcugcccccuccugugucuccgcggaggguucugcucgaucaguggcugaaacugccaccccaucaguuuuucuguuuuauuccaucuuccggguuugucaucucucccucauccccaccccuaacgucagucuccagucuuugcacaaguguuuacugggcacuuccuaccugccaaguucgggguccacacaccaguggacacagaugguggcugcgucuguccgugcugccaucgugagauuucacagacgguguggcuuaaacacggacauugguugacuugcucacugcaaccucugccuccuggauucaagcgauucuccugccucagccuccugaguagcugggacuacaggugcccgccaccacacccagcuaauguuuguauuuuuauuuuauuuuauuuuuauuuuauuuuuucgagacagagucuuacucugucacucaggcuagagugcaauggcguggucucagcucacugcaaccuccgccucccagguucaagcgauucuccugccucagccucccaaguagcugggauuacagguguguggccaccacgccuggcuaauuuuuguauuuucagaagagaugggguuucacuauguaggugaggcuggucucaaacuucugaccucguguuccgcccgccucagccucccagaguguugggauuacaggugugagccacugugcccagcuuauuuuauuuuuuugagacaguuucacucugucccccaggcuggagugcaauggugugaucuuggcucauugcacccuccaucucccggguucaaacgauucuccugccucagccucccaaguggcugggacuacaggcgugcaccacugcgcccagcuaauuuuuguuuuuguuuuguuuuugagacagaguuucacucuuguugcccaggcuggcgucaauggcgcgaucucggcucaccgcaaccucugccucccggguucaagcaauucugccucagccucccgaguagcugggauuacaggcaugcgccaccacgccuggcuaauuuuguauuuuuaguagagaugggguuucuccauguuggcuggucuccaacuuccgaccucagaugaucugccugccucagccucccaaagugcugggauuacaggcaugagccaccgugcccggccaugccuggcuaauuuuuguauuuuuaguagaggcaggguuucaccguguuggucaggcuggucuugaacuccugaccucaggugaucuucccgcuucggccucccaaagugcugggauuacaggcgugggccaccuugcccggccucuccucuuguucuaaagacaccaguccuguuggauuggggcccacccuacugcagugugaucucaucuuaauaugauuucaucugcaaagguucuaucuacaaagacccuguuuccaaaaacaauccuauucguggguacuggggaucagccuuugaacaucucuuuuugcaggggacacgggcaacccauaacaauuuuguaccuggaaugugccuuaauauaccuguguguucucaacaccagcauauaagccuguugggaggggccucugcacacugucgggaggggccgucccaccucggcucguuucccauugagggaaggaggcuuggucuuagcacggggucuaaggcccgggcuuuccucccagcuacccggagaacggcgugguccagaugaacuccagggacguccgagcgcgcgcccgcaccaucaucaaguggcaggaccuggaggugggccagguggucaugcucaacuacaaccccgacaaccccaaggagcggggcuucugguacgacgcggagaucuccaggaagcgcgagaccaggacggcgcgggaacucuacgccaacguggugcuggggugagccucgcguccuggggcgagcccuuccucucuccuuuccuccccucccggggcccccggacuggcuuugaagccguccagccagcgcugugugugcgaggcccuuagccuccggccuggccuuccugccuccccucuggggucuguuccugcucacugcugagcaucuuucuaagaccgaccaccuugugccccugagugccucugcccagggaacugucucugacccccaggcccugacaggcagaguugucaaacuuccuuuuucucaugguguuuuuuuuaucgcucuguugcccaggcuggagugcagugguucgaucucgguucacugcaagcucugccuccuggguucaugccauucuccugccucagccucccgaguagcugggacuacaggcgucuaccaccacaccuggcuaauuuuuuuguauuuuuaguagagacgggguuucaccguuaaccaggauggucucgaucuccugaccucgugaucugccugccucggccucccaaagugcugggauugcaggcagugagccaccgugccuggccucaagcuuucuuuuucucucuuguuuguuucaaauuuggugaauaggucccauucacagggucaaaauagaaagcacccaagaccacacaugaagguucucccuccucugccuggucacccaguuccccuuuuuggcgacaucacuguuaccaacuuuccagggacauucuguucauaaacauacacgccaaaccacaccgcuuaggaguuggcaaacugcaguccacaggccugcugugguccgcugccggcuuugacuaauaguuuuauugggacguggucacacccauuuuuaucuuauuaccugugguugcuuuuguguuauaagagcagaguuguguaguugcaacagagacuaugcggccuacaaagcugaaaauccuuccuauuuggccauuugcagaaucauuuugcaaagccuguucuuucucccuugccucuuugugugugugugugcgugugugugugugugugugugugugauaaaauguauguaacagaaaauuuaccuuuuuuuuuuuuuuaaaagacagagucucccucugucgcccaggcugggguauaguggcaugaucuuggcucacugcagccuccgccuuccagguucaggugauucuccugccucagccucccaaguaguugggauuacaggcgcccgccaccacgucuggcuaauuuuuguauauauauauauauuuaguagagucuggguuucaccauguuggccaggcuggucucgaacuccugaccucaagugauucgcccgccucagccucccacagugcugggauuacaggcaugagccacugcgcccggccaaaaauuuaccauuggaaccauguuuaagcgcacaguucgguggcauuaaacgcauuuacguuguuacgcaaccaucuccagcacuuuguccucuucccaaacugaaacucugacuccaugaaacacucacucccuagccccugacaccucugcauccuacuuuccaucucugugaaucugacaacucgggggaccuccuaggaaugggaucacacaggauuuguccuuugcaucuguucacugacgucacugagugugauguccuugaggugcaucaggcuguagccuggucggaauuucccuccuuuuuguggccgagugauaguacgugacguguugucuauaaacacgagcaucuuggcaacggcguuccaaguacagguacagcaagcacgcagagguccugggcugggacauuuauggugcaucuguggcccgguagggaggucagugagcugcgggugauggaggggaguggcuggggcugugggagccuccucacugagucugggccuuaagcgcguggcucgggugugguguggaauuggucuuuauucucugcuaggcgcauuucugaaucugagauuuucugagaaacuaucuggauuguuauauggaaucugauuuuuaaaugcuggugacuaacuuuuuuuuuuugagacagagucuugcucugucacccaggcuggaaugcaguggcaggaucucugcuuacugcaaccuccaccucccggguucaagggauccuccugccucacccuccugaguagcugggacuauaggugcccaccaccagcuaauuuuuguauuuuuaguggagacagaguuucaccaugcugcccaggcuggucuugaacuccugaccucaggcgauccacccaccucagccccucaaagugcugggauuacaggcgugagccaccgcacccagccuaucugguuuuauaaagggcaguuccccugcacacacucccuugccugccgcuguguaagaugugccugugcucguucaccuuccaccaugauugugaggccuccccagccaugcggaacugugaguccauuaaaccucuuuccuuucuaaauuacccagucuuuauuauuuaguaugucuuuauuagcaacaugagaacagacucauacaaccccuuccaagcucuugugguggcugauauaauccacuacuuugcgguugaaggaugggggcuucauuuuuuuuuuuuuaacuugguucuuggaggccgccugcaguucccagggcccaccugcaguuccuugccccaugggcuucucugauguggcuacugaugucaagcuagcaagggaggucuucagcuagucggcuaguaagauauagagcaucgugugaugugucaucgucccaggagugacaguccgucagcucugcuguauuuuauggguuagguuuaagugacagcccuguccauacuuuuauggggagaaacgccuacaaaugcgugguugccaggagguggggguuguggggccaccuuaggcuccauccgcaccaguuauacaccagcugcugcccguuuacccugagacagauaaccugcccagccagcacccacgggcuuccuccaccucagucccuccccuagcagaagaaaacugcauuucugcacauugacugucacaaggcaggggugucaccaggcagggaaacgaagauaccuggccgaccacaccuugggguguuuggguucuucgauucauucaugcuugugucccgagcccucuggggaugcaggaggcacagcgggaaagggaacaggugcucgguccaggcggccuuggggcagacacugucccuugccagccccaugggagcuuccagggaugcagugagagggucacgcugagccgaguugugccucgcaaugaguuugugaugugugcccaucguuagcaccuucgacuucuaucaucugcugagucaggcaucauacaagaugagacagagaaacgcgauugcagucccugucuuaggaggcacccagccuggugugggagacagaucugcagaugacagaccagggagaugcgugcucugagacaacacgcgaggauggguggcagagauggccgaguggacucugggauugggaggcucagauagguggcugagccccagguccugcucugggcagugcuaggagcuaccagccuuugccagggcugacuucuaaaugcaagcccucuacacuggugucucugcaguguggggggucaauucauucaucauucauuuucauuaaauuuuaccuugcauuguagauucacaugcaguuauaauguagagauggcuaggcgcaguggcucaggccuguugucccagcacuuugggaggcugaggugggaggaucgcuugagccugggagguugaggcugcagugagccgugaucacaccacugcccuccagccuaggcaacagcaagagagucugcaaaaaaaaaaaaaaagugaaaagaaaaaaaaacaggcuguguacccuuuauucaguuucccccagugguaacaacuuauauuaauaaacuauacuguguuaucacaacuggaauauugacauugauacagucaaaagugaguuuccuccucacaaaauccuucucguuaccccuuuuauagccaaacccaccuccccauccccaccuggucccugacccccggcaagcaauaauuuuuuuuuuuguuggagacggagucucgcucucuuuuguucuccauucauacaauuuuguaauuucaaggauuuuacaauuucaacuuuguaauaaggauucccguuauauaaauggaaucacacaguauguaaccuuuugggauugauucuuuuuuucccgacucuccauaauuacagauuaauugaaguuaccgcauaucaguagcucauuccuuuucaucccugaguaguauucugugguauagaugggccacuuuuuuuuuuuuuuuuuuuuaacgacccauuggauaucugagcugcuuccaggauuuuuugcuguuuaagauuuguuuauuuuuuugagacacagucuugcucuguuucccaggcuggagugcggugaugugaucuuggcucacugcaaccuccgccuccuggauucaaacgauucuccugccucagccucuggaguagcugggauuacaggugcguaugccagcacacccagcuuauuuuuguauuuuuaguagaggugggguuucuccauguuggccaggcugaucuugaacuccugaccucaggugauccgcccgccuuggccucccaaaguguuaggauuauaggcgugagccacuucgcccggccaguuuaggauuuauuugaguaaguuaauaagaaacaguggucugcaauucucuuguuuuguauggucuuuguugguuggucaauaccagccuuauaaugugagcugggaaauguuuauuccuuuuucuguuuucuggaagagauuguguaaaauuuacguuaauucuucuuuaaagguuugauagaauucuuuaacgagaccauaggcugggugcaguggccgaugccuguaauuucagcacuuggagaggcggaggugggcggaucacuugagguuaggaguuugagaacagccuggucaacauggugugaaauccccgucucuacuaaaaauacaaaaauuagcugggcuugguggugugcaccugcagccccagcuacuugggaggcugaggcaggagaaucguuugaaccugggagguggagguugcagugagcuaugaucaugccauugcacuccagccuggaugacagagcaagauuccgucucgguggggugggggaggaagggaagcuuuacugaggccauggagaucuggagaugucuucuggaggagcuuuuaugaauugaauuucuucuaugcuuaugugacugucuggacuaucuguuucaucauguuugagcugacauacuuucuggguuuuggggaauuagccgguuucucugagcauaaagucauuuguauuauuuccuuauucucugaugccugaaggaucuagugagaucccuguuuuauucuugguguugguaauuuauguuuucuuuuuauuuuugucagucuuuaccaauuuuauuuuugaggaucuuagaccuuucccucccuucucauuuauuuguacagcaagaauaagacaguuuuuuuuuguuuguuuguuuguuuugagacaaggucucacucugucacccaugcuggagugcaguggcgugaucucagcucacugcaacccccagauccuggcuucaagcgauccugaccucaggugauccacucgucucggccucucaaagugcugggacuacaggcaugagccacugcaccuggcauaagaguuuuguuuuggucagguuuuuuuuuuuuuuuuuuuuuuuuuuuuuuugagauaaggucuugcucuguugcccaggcuggagugcaauggcaagcucucaguucacuguagccccaaccuccugggcucaagcaauccuccaaccucagccucccacguagcugggaccauaggcgugcaccaccaugccugacuaauuuuuuuuuuuguuuuuugaugagacaaagucucgcucugucacccaugguggagugcaguggcacgaucuugguucccugcaaccuccaccucccggguucaagcgauucuccugcuuuagccucccgaguagcugggauuacaggcgugcuccacugcaccuggcucauuuuuuuuuguauuuucaguagagacaggguuucaccauguuggccaggcuggucuugaacuccugaccuuagauaauccacccgccucagccucccaaagugcuaggauuacaggcaugagccacugcacccggccauuuuuuuuuuuuuuuuuuuuuuaauuuucgguagcaaugggggucuggcuagauuggucucgaacuuuugaguucaagugauacuccugccucagccucccaaaaggugcugggauuauagguaugagccacuauacccagucuuagaauauguuuuucuuucuuuuuuuuugagacggagucuugcuguuugcugucucaccuaggcuagagugcaguggugcaaucauagcucacugcagccuugaacuccugggcugaagcaauucuccugccuuagccuccuuuuccuuaacacuuaauuuguugaggaauccuggucauuugucccaggaguuccaaauggcucuauccagacuguagagaugaccaggagaugucacuugcugugugcgucugugcuaccugugagcugguaggucaguguguucccacacugucccauagccaagagccaccugugcugugcuugaaauguggccaggaggaacuggaauguacugugaguguaaaauacacaugggugccaggcgcaguggcucaugccuguaaucccaguacuuuggggggccgaggugggcggaucacaaggucaggagaucgagaccauccuggcaaacacggugaaaccccgucucuacuaaaaauacaaaaaauuagccaggcgugguggcgggugccuauagugccagcuacucaggaggcugaggcaggagaguggcgugaacccgggagguggagcuugcagugagccgagaucgugccacugcacuccagccugggcgacagagcgagacugucucaaaaaaaaaaaaaaaaacacaugggcuuucagagaccugguacaaaagaagaauguaaaguagcucauuaauaacuuuuucauauucauuccauguugaaauaaucuuuugucuacacuggguucuauggaacauauuccaauuacuuccaccuauguuuaccucucaaacgugcuuauuaggaaauuuagaauuacauacacagcguguguucaagugcuguuucccucggacguugcugauggggaugucggauuauugaucucgggggaucaguuucacucacaggaguucuuguauuuugauguaggccauuggaucaagcguugccuuuaugauuuuuuuuuuuuuuuuuuuuuuuugagauggagucuugcucugucgcccaugcuggagugcaguggcgugaucaucucagcuccacaaccuccauuucccagguucaagcgauucuccugccucagccucccgaguagcugggauuacaggcacgggccaccaugcccagcuaauucuuguauucuuaguagagacgggguuucacuauguuggccaugcuagucucgaaguccugacccucgugauccacccaccuuggccucccaaagugcuggaauuacagaugugagccacggugcccaacuugauuuauuuauauauuuuuuugaugagauggagucucacucugucgcccaggcuggagugcaguggcacgaucuuggcucacuucagcgucugccuccuggguucaagcaauucuccugccucagccuccuggguagcugggauuacaggugcgcgcuaccaugcccagcuaauuuuugcauuuuuaguagagacaggguuuuaccauguuggccaggcuggucucgaacuccugaccucagaugaucggccugccucggucucccaaaguguuggaauuacaggucugagcuaccaugcccggccaaccuuuaugagucuugcuugucgguucuuguggauuuggugcuccuuagccaaagguucaaacucauucuucccagggcauccugcaaugaaacucugguuucuguguuuuguuuuuuuuuuuuuuuuuuuuuuugagacugagucuugcccugucgcccaggcuggagugcaguggcgcgaucuuggcucacugcaaccucugccucccggguucaagugauucuucugccucagccucccgaguagcugggauuacaugcgcgcuucuccaagcucagcuaauuuuuguauuuucaguggaggcggggguucaccauguuggccaggcuggucucgaacuccugaccucggccucccaguguugguauuacaggcgugagccacugcgcccuguuccguuucauguugcuucugugagugcagcuuugauugcuagggggcguagcugagcuguugccccaggcaucccgagaacccgugguguucaagugcugugaguagauuuaggggccucggcaggccagaauguuccagcguccucguuccuugcagggaugauucucugaacgacugucggaucaucuucguggacgaagucuucaagauugagcggccgggugaagggagccccaugguugacaaccccaugagacgugaguucugagccagccuuuccccaucuuccgcggugggcacggggcgggggcucuugucccgucucuggcuuggccgggccccgccggagcugacccugccgccccgugcccagggaagagcgggccguccugcaagcacugcaaggacgacgugaacagacucugccgggucugcgccugccaccugugcgggggccggcaggaccccgacaagcagcucaugugcgaugagugcgacauggccuuccacaucuacugccuggacccgccccucagcaguguucccagcgaggacgaguggugagugcggcccugcccgccgcggggagaccagagcgcccccuacaaauccccagaggggcacugaggagauacaggagaggggcaggcgcgggggcucacgccugcaaucccagugcuuugggaggccgaggcgggaggaucacuugagcucaggaguucaagagcagccugggcaacacaagaccagccugggggacguagagacucuguuucuuuuuuuguuuguuuuuuugagacggagucuuuuuucuuuucuuuuucuuuucuuuuuuuuuugcggcggagucucgcugucucccaggcuggagugcaguggcgcgaucucagcucacugcaagcuccgccucucggguucacgccauucuccugccucagccucccgaguagcugggacuacaggcgcccgccuccacgccuggcuaauuuuuuguauuuuuaguagagaugggguuucaccuuguuagccaggauguucuugauccccugaccucgugauccguccguuucggccucccaaagugcugggauuauaggcgugagccaccucgcccagccuugagacggagucuaauggcacgaucuuggcucacugcaaccucugccucccggguucaagcaauucucgugccucagccucccgaguagcugggauuacaggugccugccaccacauccggcuaauuuuuguauuuuuaguagagacgggguuucaccaucuuggccaggcuggucucuuaacuccugaccuuaagugaucugccugccucagccuuccaaagugcugggauuacaggugugagccaccaugccuggccuggagaccccauuucuacaaaaaauguaagaaaauuagcugggcgugguggugcucgccuguggucccagccacuugggaggccgagguaagaggaucggaucgcuggagcccaggaggucgagggugcagugaacugugaucgcgccacuguacuccagccugggugauggaagugagacccuauuucuuuagaaaaguaaaaaugaggucaggugcaguggcucaugccuguaaucccaggacuuugggaggcuaagguggguggaucacgaggucaggaaauugaggccagccuggccaagauggugaaaccccgucucuacuaaaaauacaaaaaaguuagccaggcguggugccacgcgccuguaaucccagcuacucgggaggcugagguaggagaaucgcuugaaccugggaggcggagguugccgugaacugagaucgcgccacugcacucaagccuggcgacagagugagacuaagucucaaaaacaaaaaaaaaggggggguggugaggaaaucuucccauguugcuugagugggugagaccugcggccagccagggaacagagugcagggggcuucacagcuucugugagaggagguuucguagccacuguguuccuggcgcacauaaugacaauugcggauguggauggggagguugugaugugcuaggcucgggucugaggaccugccuguggucauuccuccagcacagaaguggguguuguuguugcccugcccccccuccccacaucguagagauggggaaacugaguccacggcagugagaaggcacucauggaaucugcacguguauuucccacaucccacauugcguucacucucacuguugcaagauccguggaauucuccguggaaggccaacagagaaccugcuuucuuuuuuuuuugagauagagucuugcucuguccuccaggcuggagugcaguggugcaaccucggcucacugcaaccucugccuccugguuucaagcgauucuccugccucagccucccaaguagcugggauuacaggugcccaccaccaugcccggcuaauuuuuguauuuuuaguagagaugggguuucaccguguuggccaggcuggucuugaacuccugaccucaggugaucugcccgccucggccucccaaagugcugggauuacaggcgugagccacugugccuggcuuaguucgaaugaauuuaaauguaaacagccucgugugccaagcggccugcaauguggacagggcaggaugguaguggugccaggcggggagagccauguccguggugugugggcagagggcacauguuggcugagacaucugccaggcuaggcgugggcagugacaaucccgaccucgcagguacugcccugagugccggaaugaugccagcgaggugguacuggcgggagagcggcugagagagagcaagaagaaggcgaagauggccucggccacaucguccucacagcgggacuggggcaaggugaggcggguccuucccacgugcccguggccccuccccgccugccagggcucacgcuguuguucuuugugucugugccugggacagggcauggccugugugggccgcaccaaggaauguaccaucgucccguccaaccacuacggacccaucccggggauccccgugggcaccauguggcgguuccgaguccagguaccugcagcgucccggggcuccaggggccacgcgggcucauccugcuuuucugggggcaguuucuccuggcuuuggccagccaggggucagggugguuaccaguggugccucggcuagccgaggagggguguggaaagccugcagguuuggguuuacuccuuauuuuaccagggaccugcaaugaauccuugggggugggggcugcugcucugcucagagacacguaaggucauucccaaagcuccugucccagggaagggguggcaucugcuaagagggaccugucucagcgcugguugugaucuaucauuggggcagccccugccugugacuggguguugacagugcugggcgcugucagcugugggcugugugucacggcagacgagacacuuuggcacuagugacauuggagccagaugguucucuggggcggggccauccugggcacugcagggugcugagcagcaucucuggcccccacccacuccauguccucccaagucaugacaaccagaaacgucugcagacaugaguguccccuuggaggcaggauugccccugggugagaugcacugagcuggguggacaagcugggccucaucauggaguucauggggccaggcgugcagggcuaggagcuccuggggcagcgcuguaucccuagugcucagcggccagccggggccccaugcucaggccagggccucucaaggcauuuuguggagugaguggcaggcugcaccucaaccggccuaaugaaggccggcuuuuauaucauaaccucauuuagaacucagucacccccacuuuuauuuuuuuugagacggagucuugcucuguugcccaggcuggagugcaguggugcggucuuggcucacugcaaccucccucuccuggguucaagcgauucuccugccucagccuccccaauagcugggaucacagggacaugccaccacgcccagcuaauuuuuguauuuuugguagagaugggguuucaccuuguuggccaggcuggucuugaacuccugaccucaagugauccacccaccucggcccccgaaagugcugggauuacaggugugagccaccgugccuggccgucaccccccauuuucuagaggccgaagaggagcaucggagaucagcagugaggaugccccgugcacgcuugauggggcuggaauucacgccagcugguuuuuuuuuuuuuuuuuccauggugcagcucaacuccggccgucucuagccgagcagcacacguaguaggugacucgcaggccugaggaguuugguguaaaagugaggccgcuggcugcucgggguagggaggaggagggcgguggagcuucucugcagcagucauugcagaggacaccauguauaucuugguggcauccucaggucagcgagucggguguccaucggccccacguggcuggcauacacggccggagcaacgacggagcguacucccuaguccuggcggggggcuaugaggaugauguggugagugugugugugggaggggugggggaggguugcucuaguuuuuuggauggugguaaaauacauagaacaaaauuucccauccuagccguuuuuaaaugcuugguucccgguggcgugaaguauauucccauugcuaugcaaccaucaccaccaccaucuccagaacuuucucaucuucccaaacugaaacguugucuccacgaagcacucacuccccacccccucccagucccuggcaccgcccaaccugguuccugccucugugacucugacgacucuggagaccuccugggaguggaaucgcacggccugcguccuugcaugccuggcuccucucacugagcccgacguccuugcuuuguccauguugucgcauguguccggauuccccuuuuguucacggcugaguccuauucugccgugcggagggaccaugcuguguugaucugucuguccgugggcacugggguuccuuccccuuucgacugcugugaauagaucugcuacgaacacggcuguacaaguaucuccagcccccguuuuccauucuuuuggguguauauccagaaguggaauucaagacuccugugauaauuccauguugaguguuguuuuuuuuuuuucuuuuuuuugagaccgagucucauucuggcuggagugcaguggugugaucacagcucacuacagccacuaccuccugggcucuagugauccucccaugucagccucccaagaagcugggacuacaggcaggcacugccacgccaaacuaauuuuuguauuuuuuuguggugaugggguuucgccauguugcccaggcugaucucgaacuccugggcuuaagcgauccucccgcugcagccucccaaagugcugggauuacgggugugagccaccaugcccagcccucuguuuaaguuucuugaggacgcaccacacuguuuguauagucgcuuugccauucuguagucccaccaacaguuuacaaagggcuccaauuuccccacauucucaccaacgcuuguuauuuucuguuucuuugaaaguagccauccuggggaguuugcuuucaaugcagucucuuuuuuuuuuuuugccucugcagaggguucacccagccuucuugucuguuucaggaccaugggaauuuuuucacauacacggguagugguggucgagaucuuuccggcaacaagaggaccgcggaacagucuugugaucagaaacucaccaacaccaacagguuuguggaaucagccuucuuauuuccuugcugaugcauaucugccgagucuugguucuguuuugggccucauguccagcaagugauagucucauuaggagcgugguagaacauagcgaagccuggcauuugguuccucccucugucucccaaagugcugggauuacaggcgugagccacugcgccuggucugguuccucccguaugugugccacauaccgugagccauucagauggaugaaagcaaacuucccuauaaaaggccagauaauagauaucuuuuuuuuuuuuuuuuuuuuuuuuuuuuugggcagagucucgcucuguugcccaggcuagagugcaguggugcacucucugcucacugcaaccucugccuccugggcucaagcgauucucaugccucagccuccugaguagcugggauuacaggugcuugccaccucgccuggcuaauuuuuguauuuuuaguagagaugggguuuugccauguuggccaggcuggucucgaacuccugaccucaggugaucuucccuccucggccucccaauauugguauuacaggcaugagccacugcgccuggcugauaguagguaucuuaaugcugggccugguggcucacgccuguaauucucgcgcuucaggaggccgaggcucgaggauaccuugaguucaggaguucaagaccagccugggcaagguagugagacaacccaucuacaaaaaguaaaaauaaaaaaauuagcuggguguguuagcaugugccuauagucacagcuagucaggaggcugaggcaggaggaucacuugagcccaggagguugaggccgcagugggcugagauugcaccacugcacuccagcuugagcaacagacugagaucuugucaaaaaaaaaaaaaaaaaaaccccuccaaaauagauugcuucagcuaugcaggucacacagucuauucagagaaccucuucagcucuugugucguagcacaaaaucagccauagaccauauguaagugagugagcauggcuguguuucagugaauuuuauuugcaaaaguaugugauaggccagaauuugcuuggccccugauuacaggaugggggcggacuuuuccagcauaaaaaccaucauaaagcccaaaggaaaagacagauuugauuaucuaaacauuauaaauauauuacauaaauaaauccuauaaauuaaaaggcagaugacuaggaggaguucuugacaugacacaugaugauagugucuuuaucauauaaagagcuguugcaaaucaacaagaaacucauagaagagcugggugcgguggcucacgccuguaaucccagcacuuugagaggccgagguaggugguggaucaccugaggucaggaguucaagacuagccuggccaacauggugaaacccugucucuacuaaaaauacaaaaauuagcugggugugguggcaggcaccuguaaucccagcuacuugggaggcugaggcagaauugcuugaacccaggaggcggaggaugcagugagccgaaaucaugccauugcacucuugcacucuagccuggguaacaggagugagacucuaucucaagaaagaaagaaacucguagaagaaagcaaagaggccaggcgugguggcucacgccuguaaucccagcacuuugggaggcugaggugggcggaucacgaugucaggagaucgaaaccauccuggcuaacauggugaaaccccaucucuacuaagaauacaaaaaaaaaaaaaaaaaaaaagccugguauggugacaagugccuauagucccagcuacucgggaggcugaggcaggagaaugucaugaaccugggaggcggagcuugcagugagccaagauugcuccacugcacuccagccugggugacagagcaaaaaaaaaaaaagagaauauggaaauaaugcacaaaagaagugcaaaguuguaaucaaauacaaacugaggcuguggugagauacuauuuguuuccccuauaaaguuggccaaaaauucuaaaauguugacauaggucagggguaaaauagcauuccacuguugguagaaauacaaauuggaaccaucuuucuggaaaucucuucugccuguuuguaugaagagcuuuauaaaugaucuauucuugucacucuaacuccgcuuugaaaaaugucuuuaggagaccucuggcuagguaaaaauguaagauguaauguuuuucauaccauuaucuaaaacaauuggcacauagacacacacacacacacacacacacacacacacucucacaaagucaguaacuaaguaccuaaaaaagacaugggccauggguggugugucacaugccugucguuccaguacuuugggaggcugaggugggaggauugcuugaggcuaggaguuugagaccuacuugugcaacauaaaauuaugaaaaauuaaaauuacaaaaaagaauuucaaaaaaguuagcugguuauggucgugugggccuauagucccagcuugggagccggaggugggaggauggcuugagcccaggaggcugcagugaguaaggcgugaucaugccauugcauuccagccugggugacagagugagacacccuuucucuuuuuguuuguuuuuuuuuuauaugugugugugcuuuguuuuguuuuuuuugaggcagggucucccucucuuguccaggguggagugcagcagugugaucguagcucauuguagccuccaccuccuugggcuccacugauccucccaccucagccuccagaguagcugggacuauaggugcauguuaccacgccuggcuauuuuuuuuuuuuuuuguggagaugggguuuugccacguuggccaggcuggucuugaacuccugggcucaggcaauccuccugccuuggccucccagaguacugggauuagaggcgugagccacggcaccuagcaacccugucucaaauaaauaguaggcuggguguggccuauuuuauaaauuauacauauauaacuuugaaauauuaaauuuuuuuuuuuuuuugagacagaaccucacucugucacccaggcuggagugcaguggcauaaucucggcucacugcaaccucugccucccagacucaagcgauucuccugccucagccuccugaguagcuggaauuacaggcacgcgccaccacgcccggcuaacuuuugcauuuuuagcagagacgggguuucaccauguuggccaggcuggucucgaacuccugacuucaggcgaucugccuacuucagccucccaaagugcugggauuacaggccugagccaccacucccggcuccuguguuuccuuuuuugggggguacauccucaccuauaaugcgugggguccugacucucccugcagggcgcuggcucucaacugcuuugcucccaucaaugaccaagaaggggccgaggccaaggacuggcggucggggaagccggucaggguggugcgcaaugucaaggguggcaagaauagcaaguacgcccccgcugagggcaaccgcuacgauggcaucuacaaggugagugccccuugaggaggccgggggcucuguccccgccggggcugccucugauggagcugacgcugaugcccgcucucugcagguugugaaauacuggcccgagaaggggaaguccggguuucucguguggcgcuaccuucugcggagggacgaugaugagccuggcccuuggacgaaggaggggaaggaccggaucaagaagcuggggcugaccaugcaggugugucugggaugggggauggcacuuugggaggccaaggcggauggaucacuuacguuaggaguucaagaccagccuggccaacauggugaaaccucaucucuacuaaaaauacaaaaauuagcuggguaugguggcgggugccuguaaucccagcuacugagguggcugaggcaggagaauugcuugaacccagaagguggagguuauaaugagcugagauugcgccacugcacugcagccugggugacagaaugagaguccaucucaaaacaggagcacugccgggcuccaugacggcucugacacuucccgccugggcaccauguguccugcuuggaggcugucauccuugaaggucauugugggucacagaaugggcccugccugggcuuguggugcucauguucuggaccgcgcugaacacuccaggaggccucccgucucgggcccaugcuucccugguuucucucugauccagaauaauuuccagggccccagcugauggcaccccccuagcugucccauauaaauccuccagccagggggugaugggaacgcgcagaugacauuugcuucuccgccugccgcaucucagaguugaaaaccagacuugcuugucuucguucuguugguaaagggaucgcugcagaccagucaggcaucuggugucuucuguuuucacuucuuggcucaucacaaaaaaaaaaaaaaaaaagcagaaacaaaccaaccaaauugguggauuccagagagaucuggacggaaaaauggggaagaugaauauccccgagccaucucucaccucccuguggcgaugggaacugccgagaacuuacucaacaagcggcgcagcauuucagcaccaguuaggauguggucuguccauugcagggagaagcuuuacagcagacgaaucgugagacuauuuaaggaaucuuaauugcugucgagagccugauguccucuacccgagggggucacucagguugucuuuugaauggauuuguacgguggggaauuucagaagcugaggaaguagagagaaaaauaguaaugggagagacagccucagcuucuguugggaguaggauuuuuuuuguuuguuuguuuugagauggagucuugcucugucgcccaggcuggagugcaguggugggaucucggcucucugcaaccucugccucccagguucaagccauacuccugccucagccuccugaguagcugggauuacaggugcccaccaccacgccuggcucaguuuuuguauuuuuaguagagacgggguuucaccauguuggucaggcuggucuugaacuccugaccucaggugauccacccgccucugccucccaaagugcugggauuacaggcguaagccaccgcucccagccuuuuuuuuuuuuuuuuuuuggagacagagucucacucugucgcccaggcuggagugcaggcaugaucucggcucauugcaaccuccaccucccaggcucaagcgacucucucaucucagccuccugcauagcugggaucacagguguguaccaccaugcccagcuauuuuuguauuucuaguagagacgggguuucgccauguuggccaggcuggugaccucaggugauccaccugcuuccaccucccaaagugcugggauuacaggugugagccgcugacccuggccaggauuuuuuuuuuuuuuaugacucucaucuccauuguaacauaaagaaugugaaaggagcucaaagauuuccugagacacuggagagucagacgugacuuauagguaccuucgaaauggagcgaugaugcccugugaggacagagagggcccgaguccucagaaucaccagaguuuggccagcuaaggcccuggggucagguguucguaagugaaguuucuggggaaacagucaugcucauucacugaaguagccugcucucagcgcuugcaguccagacccauaaggcuugaaaacauucacccuagggucccuggaagcaaaaguuugccugcccucauggaaaucguaaagacaacgagaucuuauuggugggaugugaugcugaacacgucacccgcguucgcucacauuaaaugcgcuuaccccgacccugccagguggagcuuggccgauuaucuccucuuagucuccucuuguucguagugaagcuuugcgauuagacaggauuagccauuggucgaggcuccacaguuaacgaagagcugaaugcacaggcgucccccccuuaccagggggacacuucgaagguccucagcacaugcuugaaaccagagaguaccaaaccguugauguauaauuuuuuuuccauacguuuggacuggugauuaaguuuaaucuauaaauuaggcacaguaugagauucacaaccucucuuucgcaucuuaggcuucucuuuagcauuuccaaauugucagcaucccuacucuugcacuuuggggccauuauuuuuauuuuugagaccaggucucgcucuguuguccaggcuggaguguaguggugugaucauagcucacuacagccucaaacuccugggcucaagugauucuccugccucaggcuccuaaguagcugggacuacagaugcacaccaccaggcucggcuaauuuuuuaaauuuuuuuguagagaggggaucuugcuauguugcccaggcuggucucaaacuccugggcucaagcgaucccccugccuuggcuucccaaaguguugggcuuauuuaauaaaaauuagaauguuuaauauuaauauuuuauauuuagccuguaaucccagcauuuuggaugacugaggcagguggaucacuugaggucaggaguucaagaccagccuggccaacauggugaagccccaucucuacuaaaaauacaaaaauuagcugggugugguggcgggcaccuguaaucccagcuacucgggaggcugaggcaggagaaucgagaagcuggacaaagggaagguucacaucccugugggacgaugcaauguuucaucaugcagugugcgugaugugagguggcuguaaagggggaggaaggggccccgagccgagggaugcagcgccucuagacguuggacacuuagaacagugugcaguuuacaacuuaggaauuguuucuagaauauuucauguaacauuuucaguugacuuugggucacugaaaccucagcaaaacuagauaagggaggacuacccugugcucuucagggggauugggggucaggugugucuggaaacccagaccuggcaaggaggcuggaagagcgggcucugcauagcgugugggccccaagccugacucacggcugucccucuuccuccugaaguauccagaaggcuaccuggaagcccuggccaaccgagagcgagagaaggagaacagcaagagggaggaggaggagcagcaggaggggggcuucgcgucccccaggacgggcaagggcaaguggaagcggaagucggcaggugagaaucucguggguguggggugagcgucuugugugugggggagcaggugggcaucucgcgggugugggguugaggucguguggacgugggagccgguggcugucucuccggcagcucgggccacgcgccccucccucacgcgccccacccucuuccaggagguggcccgagcagggcggguccccgcgccggacauccaagaaaaccaagguggagcccuacagucucacggcccagcagagcagccucaucagagaggacaagagcaacgccaagcuguggaaugagguccuggcgucacucaaggaccggccggcgagcggcagcccgguaggcucgcacggcucacucgucgcccugauuugcguugacugcgguaaaauguguggggcuuguuucccauguuccccauuuucaaguguacagcucagucgcacugaguacauucuugugguugugcaaccaucaccaccaucaccaccuccagaacuuuauccucuccccagacugaaacccuggcccugaaacugucacucccacccccucccaagccuuggcacucgcuccccagccccggcaacugcuccccagccccugcacccgcuccccagcuccggcacccccugccauccuaccuucugucucugucucccggggcuguugcaaagugaccccaagccuaggagugcaaagcgacucacaucucacagcucuggggcugggagcccgacaugggccuugcugggcuaaagucagggcagggauagggcugggcccuccugggggcuccaggggagaaccagauuucugccuuucccaaggucuagaggcacuguaucccucggcucggggccccuuccucccccuuuacagccacagcgcaucuucuuccagucucugagucucacucucccgcccucucucgggaggaccucggggugacaucaggccccccgccucacccaggaugcuuucccagcuccagguccuucacucagucccaccugccauuucuccucugcuguggauggugacgucucaggauggugcaggucucaggauucagcuguggccgaggccaucucaguggucccucucuucccauuuccuucaggccacauucuucccagggcuuucuccccagcucccacccuacgcuggggcagccccuugccccuagaccuucacuugugucucuuugguccccgcacuuagcuccaagcaggaggaggugucuuucgagucauccgaggcugggcuccugguggcccguguacucaguaugcauugugucaguggacaccaugccucuaaauuuuuuuggugacaggagcucacccugucacccaggcuggagugcgguggcauggacaaaggucacugccuccuugaacucccaacucccaggccacgccuauguuuuuaauuuauuuuguuuauuuuuauuauuuuuuuuugagauggaguuuugcucucguugcccgggcuggagugugcaauggcaugaucuuggaucacugcaaccuccaccuuccagguucaagugagucuccugucucagccucccaaguaccugggauuacaggcacccaccacgccuggcuaaucuuguauuuuuaguagggaugggauuucaccguguuggucaggcuggucucgaacuccugaccuuaggugaucugcucaccucagccucccaaaguacugggauuacaggcgugagccaccaugcccggccuauuuuuuaauuuuuuguagagaugggggucucacuguauugccgggcuggucuugaacaccuggcucaagcgauccucuugucuuggccuuccaaaguucugggaugacaggcgugagcugccgcucccagccaggaaccucuccuaaagcccugucuugacucagugcagggugugcuugguggugccagcuggucauaucuggguccugcccagcaucauugaggcuggcgcccuuguacuggcuccgccucauccuccccaccuugccacuugggguguuggggacuucaggugaggcucaugccuguugggccucuguuuuucucagaacggggacgaucauggcccccgccuccuggagugaaggcuggggacagaauuagaggacccagguacaugcucagcaggaagccacugaucugugggagcccuggucccggugucuuugccggccucacacccgcuucccucuaguuccaguuguuccugaguaaaguggaggagacguuccaguguaucugcugucaggagcugguguuccggcccaucacgaccgugugccagcacaacgugugcaaggugaguagagauggccgcgggagccggguggaagguucuggaaggaugaccugaccucccguucccacaugccugccacuacagacagaggcuuguuggcuuugcuccgcucacucugcagcuuuucucggggcccuguugacugcuuucugggcagccuguauuaccacggaggccuauaacauucucccccaaguccuguauggucaaggggccagggugggagaggaugggccacagucuuggccuaaggucuggagaggaggugcacauccccuaggggucaggaaagaaggcuucuuggaggaggugguguuaccaggcagcaucccuuguaccugggacagcaggugaagaagccugggugggaagucagcagcuggggccugcaguggcucugggcacuggggugguggccugccaugggcuuuaaacucaggacaaguggucagucguaggagggacacaagaucccagcugaugguuuuuuuuuuuuuuuuuuuuuuuuuuucugagacagagucucgcucuguugcccaugcuggagugcaguggcgcagucuccacucacugcaagcucugccucccggguucacgccauucucccaccucagccucccgaguagcugggacuacaggcgcccgccaccgugcccggcuaauuuuuuguauuuuuaguagagaugggguuucaccguguuagccaggaugguuucgaucuccugaccuugucauccacccgccuuggccucccaaagugcugggauuacagguguaagccaccgcgcccaccccgcagcugaugguuuucaaaccgauugguuuggggccaggacagggucucuuccccccugugcugugggccuuggggcuggaucauugucugggguggggccguccugggcacugcagggugcugagcagcauccccggcccccacccacuccaugccaggagcucccugccuagucgagacaaucacagacauccccagacaccuuccaguguccccugggggcagaacugcccaggugggcagugugggucugggugaugguuucucugcugcaaccucuggccagagccggcagucccgguggacagguguggaagggacugacccugccaccccacggaucuccccaggcuucugaguugcuggcgguuuuccuuccaacugcagucccgcaguccucucagccaugggccacacccccgggucucagaccccguguuuguuuucaugccaggaggcagcucagggaaggucaggagaugggguguucccagucaugcccauggcaucucugccuccucgggccccaccugccucgcccuguggccugagucccuucagcugugugggccucccugagugcccugagugagguggcagaaggggugagaggccauggugucuuuggggcuggugguccgggucuggccaucugucaccucucaggcgugcaggcacuaaucccuccaagccucaguuggccacagugagaaggggccugguaacacuguccuggaugccagguuguugugaaggucccggcuuagccucuggcaggaaggaggugcucaggaggugggcacaggcagagggcuggcuguggggggcuauuggaagagggaggccugggagccccguggcgguaggaaggacuguggggacauuggaaaccaucuguccugugcaucggugugaaggcgcggaagcgcugaggaugugaaggaaggggcuaaccagcaucacgguguccccacaaucuguccuuguugcucuguuccaacuugggaagcucagcaucggagggguucugggaaacaggcugugaccuuccaccuugaucuuuuuaaauuauaaacuugaggccagccgugguggcuaaugccuguaaucccagcacuuggggaggcugaggugggaggaucacuugaggucaggaguuugagaccagcccgggcaacauggugaaaccccaucucuacuaaaaauuaaaacaaaauuagcugggugaggugacaggugcuacucaggagacugaggugguagaaucgcuugaaccugggagguacagguugcggugagcugagaucgcgccauuguacuccagccugggcgucagagcaagauucugucucaaaaaaaaaaaaaaaaaauugaaaaaaacauucagagacagcaucucacucugucgcccaggcuggagugcaguggugccaucauagcucaucgcagccuugaacuccucgcggggcuaaagagauccuccugccuuagccuccugaguagcuggggcuacaggcauacaccaccauggccaacaugaugaaacccugucucuacuaaaaauacaaaaauuagccaggugugcuggugggcgccuguaaucccagcuacucaggaggcugagacacgagaaucccuugaacccgggagguggagguugcagugagccaagaucacgccacugcacuccagccugggcgacagagcgagacucuaucuuaaaaaaaaacaacaaaaacaaaagccacaggcugccuggggcaggugacugugcuguggucaccaggccucucccccauguggucaccgcccucgcccagcugugugacgacaugcugcagacaugugcccccugcguaggcaucugugcaccuguguacggcgugucacuccucccuggcgugcagccagcccgguggcaucuucccuguuugucugcuugggaaguggagacuccaggccucucagcucugucuucuccuggcuuucuuccccaggcacgacuugguugauugagcuugaaguuaggaaucugaauccaccagacuugguuccuuccuccuuuuccccuuucuucucauugacguguauguuuauuuuuuauuuuuuucgagacaaggucuugcuuugucgcucaggcuggagugcaauggcgugaucauggcucacugcagccucagccugccucccuggguucaggugauccucccacuucagccuccggaguagccacgcccggcuaauuuuuuuguuuuuguuuuuucuuugagacgcagagucuugcccugucacccaggcuggagugcaauggcgugaucucagcucacugcaaccuccgccucccggguucaagccauucucuugccuuagccucccagguagcugggauuacaggcaugugccuggcuaauuuuuguauuuuuaguagagacaggguuucaccauguuggccaggcuggucuugaacuccugaccucaagugaucugccccccucggccucccagagugcugggauuacaggcaugagccacgaugcuuggccugauguguguguuuauuaagcaucuacuguauacacugugcuugguguugagagagaacacagccucaaagcucagggagcaucugcccuguuguagauaagauaagcacauuaauaauauauaacacggcuccacagguggaaggagaggugccgucuugaaggcagauggggugaggggaugggacugccucuagggaggugucagggaaggccccauaagggaggugacuugagcugagcugugagugaugagagccgggggaccgagcuguuaagcugcaugaccugccagggacaaaagccuggaggccgggugagcuuggaaucuuugagggccccuaggggggccaggcuggugaugggcagcagguggaaagugagacugaaggucagaggggccucuggaccuggugagacuguccccacaguccugggagagguggccaggagcaaaccugaugguguggauggcacuucucacgcgccugcugugucuuacaggacugccuggacagauccuuucgggcacagguguucagcugcccugccugccgcuacgaccugggccgcagcuaugccaugcaggugaaccagccucugcagaccguccucaaccagcucuuccccggcuacggcaauggccggugaucuccaagcacuucucgacaggcguuuugcugaaaacgugucggagggcucguucaucggcacugauuuuguucuuagugggcuuaacuuaaacagguaguguuuccuccguucccuaaaaagguuugucuuccuuuuuuuuuuuauuuuuauuuuucaaaucuauacauuuucaggaauuuauguauucuggcuaaaaguuggacuucucaguauuguguuuaguucuuugaaaacauaaaagccugcaauuucucgacaaaacaacacaagauuuuuuaaagauggaaucagaaacuacgugguguggaggcuguugauguuucuggugucaaguucucagaaguugcugccaccaacucuuuaagaaggcgacaggaucaguccuucucucggguucuggcccccaaggucagagcaagcaucuuccugacagcauuuugucaucuaaaguccagugacaugguuccccgugguggcccguggcagcccguggcauggcguggcucagcugucuguugaaguuguugcaaggaaaagaggaaacaucucgggccuaguucaaaccuuugccucaaagccaucccccaccagacugcuuagcgucugagauccgcgugaaaaguccucugcccacgagagcagggaguuggggccacgcagaaauggccucaaggggacucugcuccacguggggccaggcgugugacugacgcuguccgacgaaggcggccacggacggacgccagcacacgaagucacgugcaagugccuuugauucguuccuucuuucuaaagacgacagucuuuguuguuagcacugaauuauugaaaaugucaaccagauucuagaaacugcggucauccaguucuuccugacaccggaugggugcuugggaaccguuugagccuuauagaucauuuacauucaauuuuuuuaacucagcaagugagaacuuacaagaggguuuuuuuaaaauuuuuuuuucucuuaaugaacacauuuucuaaaugaauuuuuuuuguaguuacuguauauguaccaagaaagauauaacguuaggguuugguuguuuuuguuuuuguauuuuuuuucuuuugaaaggguuuguuaauuuuucuaauuuuaccaaaguuugcagccuauaccucaauaaaacagggauauuuuaaaucacauaccugcagacaaacuggagcaauguuauuuuuaaaggguuuuuuucaccuccuuauucuuagauuauuaauguauuagggaagaaugagacaauuuuguguaggcuuuuucuaaaguccaguacuuuguccagauuuuagauucucagaauaaauguuuuucacagauaga

SEQ ID NO: 192713 - RNA, 184485 nt, Homo sapiens
agggcucggucgccagcaaccgagcggggcccggcccgagcggggccugggggugcgacgccgagggcgggggagagcgcgccgcugcucccggaccgggccgcgcacgccgccucaggugagcccacggggaggccgcccggccguguccgagcgcggaccccgccgccauggccgcccccgcgucgcggcucggggcugcgggcgcgcccgggacucgaggcccaggccucgggcgcggccugcucgggccgggccucgcgcuuuguccgggccggcggggcgguuggggcguuaaccgcccggcccgggggcgcccgcugguuuucgggcgggggcggcggggccggacaauggcggggcgcgcccaggggcgggagcgggggccccuucccgggccgggggcgcgcgggggcugggcacagacggccccggcgccccgcacaaaagaugacagcguggguggccccggccgggcccuuuuaucacccgggacaagccucggccuauuauuauuauuauuuuugaaagaaagcaagaaaaaggaaaaagaccccagccccuggguaacccccgccugcguuucuggcccuuugggcgccaggggggcuaaggggaagccccccagcuggacacccagggaugcccccuaaaugccuaucauugcuccugcacugcccccaccuccggucaaccugcuaugccuugguagcuuccaaacuugccccccuguacguacccgaaacccccaccccgccauaagcauaugcaaucuggauuuuagaaaaaaaucaucuugcuaugcaacggcagccuccacgagucucuccgucccucccccuuccagccugaucgccaucucgaacgaagccccugcucuagagaaaugaauugaggaguugcuuccgccgagaccccuuuucugugucccccguggacaucccccugggagcuggggacggacucgcucugaaaucugcuugaccuggggucugccagggcccaggucugcgcucagugguggccaugacaaucaggcaggacgggggacucuguccaccugggcacgguggaagguuuuaaggggcauguuuuccgccccugggggcaguggaggcauggacugcuuuugggugcaucccaucuguuugcuugggggaggaugcuucuguuuuaauaauuuaccagcacccugugaggaaguguuccccgaguugugaaacuagugagaaggugguucagcuccguggagccuagugauccugucauaugugaagagcgucuuuuuccauguguuucuggcuggggcguguauucagcaaguuccuuugggucccaccgggugccugcacugucuugggaucucuggauacuggacugaauucaagggaucggugcccugccccaguccucugccucaauggccauuuaucagaauguccccgggcuggagaaugcuccuaaaaacagcaccaguccuaaagcaggcucauuagacgacuccuaugggcuuuuaucacugccguuaugggagcuaaugacuccccuaauucuccaauaauagcuuccuuaugagccaccaggaggguuugucaacacacggggucagccuucuccugcagccccugcugaagcagugggcauccucucuccgcuuugcaguuuauguuuugaaacccugaaggucggagcguaaagccgugguagagucaacuucugucugagccgaggauuucugggacuugccagccucgucuccgugugucugauuggacaccuggcagguccgggcgcucccccuccuugagccggcgacaccaggacgggucagacuguccuggccuagaggaggucaccgcuggggaggaaaaggggguaacggagauucugccgcacagacgggugucuguguacaggcuguuuugguggaagcgucuacugugucaggagcugcgggugccugcgugugcacguguguguuuaguugcugagaccugaaauauauaugucuuaguaacaauccguuugcucgcauuuucuaacccuuuccucuuuggggagggggcugcuaacaagauguuaacugcuggcgcuuaaagguauagcugaucagccaccgcacagcaccccgccuggccuuuguuguacuuuucugucucguggaagagacccuuccucagccuccugcccugucuucagucccugucccguccugcaggagcccucugggguggccaggggccguccucuguguccuucucucccaccugaccacucugccuguacuuuaauuccuaauuucucugucuccucugcugguuuccugcccguuuguccuaugccccacccacucccugaugagccggggaggagccucagcucuggggaagccaucuguccucgguuccaucugacaccuguggggacgugccuuggggucaugcguucaccuggucuggggcugcuagguuuccagugccgagugccaugccgggacagguugggaggagucccuggcuccuguggguuuagaguguagugggggaaagggugagcuggcugcccagggccuggucacagcuggaaugguggugugcaguccgcugcccucgggcccagcucagggagcaggcaggaggaggcgaggcuguugagggccugaggugcauuuguagguggcuuuguucccuggaucggggagcggaauuggggguucagagcugggugaccuugacccagucacuugcucagugacaaagcagaucgggggcacuaaaucuuucggagcccacugggcaggaggggacggagagcagaugaacagggugggggcucggggcggggggagcuccgcaggccugcacuggucaccgccaugacagaucggccguccucauccacagccucacccuaggcuccuggcucagcuccagggaccugccaugaggcagcucgauggggucuucagaugccacagcccucccccuuccugccccaggggucucuguuccuggcuuaggaugccggacagaagagcaggggcccagccugggcuccguucucaucugguggucuugacgacgucucuggaucucugcccucugucccaugccccacacaggcuucagaguuggagagaccuggauucagaucccuccucugaggcagucacuuccccucucugggccuugcuuucuucucuguaaaauggguguaaugggaacaccucccucccaggugguugugaggaucaaagcggguaaaaggcgcugaagcuugcagggugccaggagcucugaguucggagccgguuuauuacacagcaaggcccucugcccugucagggucuccccaccucugcccuauccacguucugggcugggacauucuguggcggggcuguccugggcaccguagggugagugugaacaauaucccugaccaccacccaccagaugcuaguagcacccuguccccuaagcgguagcaaccaaaaauguccccugggaagcacugucaaccccgcagugagaaccuuggacuuggccuucagcccugcaguagcucauggugugcugugaccgugaugggccucagcucccuuucuuuccuccccacucacccuuuagcagugagugacuccuauuugcaaacugugucccggacacacuccucaccugguuguucagguucuccgugacuguccuucugcccuuccaggguggcagcuuccaccugagaggacaggagcccccacgggguccccugcacgcccugcaaugaggggcagcccggcaucuguggggucuucugggcugcucucuggccucugagcuccgggucuuccugggcugcucuuuggccucugagcuuuggcagguccuugcccaggcuugcuuggcugcccccagggguggcacuuccacacccucccagucaccauagcccugaccugucgauuugccagacaguuuucuuuaaguccauuuaaaaaugacucaccucuuugaucuuggccucuuccugaacaguaauguccccagaguuguggaacguuaaugugcuaguugcacauacuuuuauuuauuuauuuugagacagaaucucacucugucacccaggcuggaguacaguggcuagaucucagcucacugcaaccuccgccucccggguucaagugauucucuggccucagccucccgaguagcugggauuacaggugcccgccaccacacccugcuaacuuuuguauuuuuaguagacacgggguuucaccauguugaccaggcuggucucaaacuccugaccucaagugauccgccugccucggccucccaaagugcugggauuacaggcaugagccacuaugcucggccaaguugcacauacuuuuacuaauucgcguucaaaugagcuuaaccacuauauuaaaaaaaagaaaauuuguaucuucccaaauacugaggggggaguggauugacgaauugauguuucuugguuuuuggacaaauuaauuuucaagcucacucccugcgugacuggccuguucuaggaugcuggacuugguuagaucuggguccgucuauucccuccugcucccuugaggagcucggaaaauggccuucccuguuggggcggggaacaugggaagucucuaccuccugcuuaguuuugcugugaaccuaaaacugcucucugaaacaaagcauauuaaaaaaaaaaaaaaaaaaaaacuggcugggugcgguggcucaugccuguaaucccagcacuuugggaggcugaggcgggcggaucaccugaggucaggaguucgagaacagccuggccaacauggugaaaccucgucucuucuaaaaauaaaaaaauuaacugggcguggcggugcacaccuguagucccagcuacuugggagacugagacaggagaauugcaccgagauccugccacugcacuccagccugggugacagggcaagacuccgucucaaaaaaauaaauaaguggccgggcgcaguggcucacgccuguaaagccagcacuuugggagccaaggcgggcagaucacaaggucaggagaucgagaccauccuggcuaacaccgugaaaccccgucucuacuaaaaaugcaaaaaaaauuacccgggcauggugguggccggugccuguagucccagcuacucgggaggcugaggcaggagaauggugugaacccgagaggcggagcuugcagugaguugagaucgcgccacuguacuccagccugggcgacagagcgagacuccaucucaaaaauaaauaaauaaguaaguaaguaaguaaauaaauacauaaaauaaaaaacuggccaggugugguggcucacgccuguaaucccagcacuuugagaggccgaggcgggaggaucaccugaggucaggaguuugagaccagccuggccaacauagugaaaucccaucucuacaaaaauacaaaaaucagccgggcaugguggugggcgccuguagucccagcuacucgggaugugggggcacgagaaucucuggaaccugggaggcagaggcugcagugagccaagaucacaccacugcacuccagucugggagacagagcgagacucugucuccaaaaaaaaaaaaaagaagguagucaaaggaguaaaaaccaaaacaaacaaacaaacaaaagauuuuccccugcucagaaccuuccggugacuuccuguugcccuugggaaaaauucugggcccuuucgcguggccccuucgcucugucaucuguggccuuguccuuccuuccuuuccucccuuucuuccuccugcaccugcuccuuuccuggcacagccgccuucccugcccgcccuucccugccgcaggaccugugcacuugcugugcccgcugccugguucucuuuccacccagccggcuccuuaucacucuagucacuucccuucccuacuucuccuccuuugcaugucacacgaucagagcuggguauuagucuguuuguguaucuguuugucucaucuacuagggcaggggcuuuuucuggaagggccggagaauaaauauuuuuggcuuuguaagccagaggucaucucuguccagaccacucugcuuugccguuguagcaagaaagcucccgugggcgagugugccuguguuucaguaaaacuuuauuuauggacacaaacgugaauuccgugcaauuuuuacauuauaagacauuuuucuucuuuugcuuuuuuuuuccuccaacgacuaaaaaaugucaaaaccauucuuagacugcaggcuguacaaaaacagguggcgggcaggauugaaccuguggguuguaguuugcaaauaccuggcuagggugugagggccacacuacggaaagcuauggaaaccaugucagccucacgaccccuagaauguacggcagcuccuuagacgugguggguguugaguggacauuccuuguugagugaaugaauuuuuuuuuuuuuuuuugagacagaguuuugcucuguggcccaggcuggggcgcagugggcugaucucggcucacugcaaccuccaccucccggauucaagcgauucuccuacuucagccucuugaguagcugggauuacaggugcaugccaccacgcucgacuaauuuuuguauuuuuaguagagaugggauugcgccauguuggccaggcuggucuccaacuccugaccucagggcauccgccugucuuggccucccaaagugcugggauuacaggcgugacccaccgugcccagccugagugugaauuuguaucuuccuaacuucaaagcauuuagagucauauucuagccuuaaaaaaaaaauggggcauggccgggugcgguggcucacgccuguaaucccagcacuuugagaggccgaggcggguggaucaccugaggucaggaguucgagaccauccugaccaauauggagaaauccugucucuacuaaaaauacaaaauuaguugggcguggugguguaugccuguaaucccagcuuguugggaggcugaggcaggagaaucgcuugaacccuggaggcagggguugcagugagcugagaucacgucacugcacuccagccugggcgacaagagggaaacucagucucaaaaaaaaaaaaaaaaaaggucaugggucauuucaaggauccuuaaaacugcaggaaugugagaaaaugcgaugcugacauccacccagacagccucaccauaaaggagggaaaaaacagcuacaaacaguguagguggggggaacgcuucgcuguuugagacgccagacucucuugcucugggauucacgcggcugccuuucuguuacagcucaccaagcgucagaagcacgucgagccguguacucggcccaaggaguucagugugaccuggcaggaacugaggguuuguuuaaaaggaagacagcauugcacaauuucacaaggcuuuuguuuuguaagcaucggaacucuccucguuaccagugcuagcgcccccgaugggaggggcaggggagucgcagauggugguuucugcugucccugagcacagaaagccucaugagggagguggcuuauccagugcagagcucagcuuuguagagugaguggacaagugcccgucgguggccaucgugcggucaguagccgagugggggacugugcccggccacacuuccuuugucucacucuucuccuggcugacaggcauuuucugagccaaguaggucuuuggcaucuuagauuugggccugucccaggaacguucugacuugucaagaaaucguaccguuaauuuacggucaugcuuucuuuccuugauugaaauaaacaaucuggagaggcuugcucagaauuucuuggcuuucaaaaguugccugucuuuuuuucuuuuucuuuuucuuuucuguuuuuuuuuuauuuuugcuugcccccucucucucccugcuucucuggcucuuccucccuucccucuuucuuuucuuucuuuauccaccucagugaucucagcaaacacgaggggauggaugacaaguuugcguccagccaucuccgcccugcuggcaggcugugccucuuuggcgguggccgagcgcgaaguugcucuguggcucuggacugggaucguguuuguucaauggacaaaggcugagaaucccgaggccgacugcccaguggcugcugcaccucaagaccccgagggcucucaggugcacagugacagucacucacgcagaccuggccccguuugcugguaggcgcgaccaccguuguguuuuucagacaagccugggugacuugcugugaaaacgucagcugagggcacgguggcaggauuucccccugcauagaccucccgucagcauucauagcuggacccaagugcuggcaccuuccgagccgccggcaguggcggugggccuguuugcguuuuugcggcugcccuagucuccagggagagagcguggagacagacgauuuguaugagauuagccggccguggauucagaaucgcucuuugugugaugggucccagggguuccuuuugaccacagagccagccugaaacuacccacgggugcuguggaccccuugaucauggcgggauggaaaugggcugugcccucagccgggacucaggacugcagcaugucugggcagcagccuggaagcuggccagccucggcgcccuuggggacagcccuugacacucuggcucggugcccugagugagggggcgccacccugggcucccugggaugcgagcaggacccaagccaggcugcuggaccgggacagucgcgucauguugcuguuguccccuuccugcagcaucuccauacucuccuaaaaucccaucugucagacaguguuggcuguaggcagagcgggccuccugucuugcagucgggccgcguggaucugauugucuugcucaggagagagagaagauugccgucccuagcaugcacuugagucaagccucuggaauuucaacuccugcucccugcucuauuccaacugcuucccccaggaaggggggacgaggcggaggaagucguucucuugacaccccuagaacauaaggcaucuuggccaggcacaguggcucacgccugucaucccagcacuuugggaggcugaggaggguggaucaccuggggucaggaguucaagaccagccuggccaacguggugaaaccccaucucuacuaaaaaugcaaaacuuagccgggcgcgguggcacgugccuguaaucccagcuacucgggaggcugagggaggagaaucgcuugaaccugggagguggagguugcagugagcugagaucacgccacugcacuccagccugcacaauggagugagacucugucucaaaaaaaaaaaaaaaaaaaaaaaaaaaaaaagaacauaaggcaucucauguuacugucugucugggcuggaauugguggaagccacagaauuuuuuuggccccucuagccacggguguccugcguaccccaaaggcagagcagagccugcuucucagcuagagccugaagggcagcugccguucaucaaaacagcuccugugcaauucugugccugucgcuggcucaggggcgcgggaggagggaugggcugcagcgagcggguguggucaggcccaggcuggugcguggucacugggagcucgggcagcauggcugucacuguagccacacccugggucccucugaguggguuugcauuguccagcuccgcgugagaguugucaaguucaugcgugccuggucaggggcgcaggguggccagaugaccagugucuccugcccgcagggccucuugguggaaggagauggagaauaacugccaagagggguagaaaccaagccuggaggccggauggcuguaacccagcacugugggaggcugaggugggaggaucgguggaggccaggaguucaagaccagcaagggcaacauggcaagaccccaucucuacaaaaacuagaaaaaauuugccagaugugguggcuaugucuguagucccagcuacucgggaggcugaggcgggaggauugcuugagcccaggaguuugagccuacagugagccaugauuacaccacugcacuccagccugggcaacagagcaagaccaugucucaaaaaaaccccaaaaaaccaagcccagggaagcacagggcagugcagugcgccgggaggcuucccauaggaacugcuguuugcgcagagccuuguccauugugggaacugucacagaugacugugagcuugagagcagaggaaguagcgagaggaacuuggggguguggccugggagaucugagaggggauggggucagggugaagcccaccuggcaugcuggaggcagcugggcacccaggcucuggggugucucuggagguguuacccgaaccagugugaucauggggacaugaggcagcaggcagccccguccucgaggagcucagagucuaguuggcaagucuagaagccauuccugucaccagggagggccaccucacaguugcccaacuauuggcgucagugugcuggccagguucugaauuuucuaggacagccucccuuagaaaugauccugccauuuuaaaaaauauauauuuuuauggagcuaucauucacauacuaugaaauucaucuucuuaaaguauacaauucaggcugggcacagcggcucaugccugcaauccuagcacuuugggaggcugaggugggcagaucacuugaggucaggaguuugagaccagccugggcaaaauggugaaaccccaucucuacuaacaauacaaaagaauuagccaggcauaguggugcacgccuguagucccagcuacuugggaggcuggggcaugagaaucgcuugaacccaggaggcggaggcugcagugagcugagaucaugccacugcacuccagccugggugacagagcaagaccuuuucucaaaaaaaaaaagauacaauuuagugguuuuuaguacauugacacaguugugcaaccgucaccacuaucaaauguuagaaccuuucuauuauuacacaaaggcacucugccuccaccaguggucacuauccauccccucccccaucugcugguacccacacaucucuuuccugucucuggauuggccuguccugaacauuucauagagauggagucacacacuguguggccuguugugucuggcuucucucagugggcgugauauucucaagguguauccacgcauggcaugugucagagccuugucccuuuucuuucuuuuuuuuuuuuuuuuuuuugagauggagucuuacucugccacccaggcuggagugcaguggcaugaucucagcucaccucaaccuccgccuccuggguucaagugauucuccugccucagccuccugaguagcugggauuacaggcaccugccaccacacccggcuaauuuuuguauuuuuaguagagaugggguuucaccauguuacauggccaggcuggucucgaacuccuggccucaagucaucugccugccucggccucccaaagugcugggaugacaggcgugagccaccgcgcccggcccacuuugucucuuuaccuggcugcauccuauuccccugugcgggggguguccuguuuuguuuuccauucaucucagugggcauuuaaguuguucucauuuuuucagccccauccucuccccagucuguggcagagcucagggauuccugugcugcaccaugcagaauacaggccgagauggccccggggcagacacagcauagaaaccauuuguggggcuggggugggcggggucagcuuggcggaugcugggcugcggcuaggcuuugaggugcaguggcccggcgggccugcaggggugcagagguacccugugaggccacagggucuaggcuccaggucauuaguggcgaguccgcgccacgggccucuucucucagccugagcuggcgugccucagccaguggggcccuggcagggaccucucugugcagccacagggccccugugucuccgcuccauggggcagcguggccccagcugaccacagcucugacuugcccuuugcuguguccuguaaggucaccccuggugagcaggaccccugaguccaccacaccagggcccgacggcuguccugucccccucguccuguuuuuggugucaccccgcugucugguuagcugugccggccucccugaggggcuugugagaagaugccagggccuuucuuccccagagcugcucccgcgaauccagccugggguuggagagcacgcugcucccugggucacuucccuuuccugguccggggccuggucccagcccugacaggguugugagccuuaggagguggccaucagguucuaaaugugccccuggggcccagcagccuccaccuggacguccccccaggagguuaaaggggugagugggagccccccccaccacgccgggccccuugggagugcagguggguucuccaggggagcaggugacacugccaggcaccggcggugcuguacagucagcccagugccaagccccaccucuucccaccugcucugcagugcucucccuguggggacagugaugugccuggggacugucaccugcucuccccugacagaggauguggguuaccuggggugccccaucaguaccccaggggcugcugaugaacaugggaagaccccauggcagggggcggucacguaacuaaacacuaccaagugucauguggugaagguggaccccugccucacaccauggccagaagccaaccccacauguagcagagaugagaacauguuacuaaaacgauuacaaaaccucuagaagagccaggugcaguggcucaugccugucaucccagcacuuugggaggcugaggugggcagaucaccugaggucaggaguuugagaccagccuggccaacauggcaaaaccccgucucuacuaaaaaauacacaaaauuagccugguguguuggugcaggccuguaaucccagcuacuuggaggcugaggcaggagaaucgcuugaaccugggagauggaggcugcagugagccaagauugcaccacuguacuccagccugggcagcacagugagauucugucuccaaaaaaaaaaaaagccagacgcaguggcacaugccuguaaucccagcuacucaggaggcugagguauaagaaucucuugaaccugagaggcggagguugcagugagccaagaucgcaccacugcgcuccagccugggugacaagagcaagacuccgucucaaaaaaaaaaaaaaaaaaagccucuagaagaaaaccuggauguauauguaaaauguuguauuuccuuuuuuuaaaaaaauuuaaaauuauuuuuauuucuauguuuuuaauggcuugucuguauaaccaaaagugauguucucucucucucucucucucuuucucucuuucuuuuuuuguggcggagucucacugugucaaccaggcuggagugcaguggcgagaucucggcucacugcaaccuccaccucccggguucaagcgauucuccugucucagccuccugaguagcugggacuacaggcgcgugccaccacacccagcuaauuuuuguauuuuuaguagagacagaguuucacuguguuggccaggcuggucucaaacuccugaccucgugaucugccugccuuggccucugaaaaugcugggaugacaggugugagucacugcaccuggccuaaaagugauguauguuuuaaggcagcgcuguccagugaggaugcagaacaagcccgugugucugaauuuucugguagcugaguuaaaaggugaagagaaaugggggaaauuaauuauuacaguguauuguauugaacccaguauacccccaguuuuaucauuucagcauguaaucaucaucuucaaaacuguuggugagauguuucacacugcuuuuucuuuucuuuuuuuuuuuuuuuugggugcugucuuugacauucauuguguauuuccccugagagcuggcccuacgugguugaucauuuggggagggcccuggccccggaugcacugagcgugaugccagccuggugcuauagaugggguccuggugcuuaguggaccagggcccacgcuccuuccucccacccucccaauccugcccccgccuaucccaggcaggacuuauggcucugauggugucuggcuggagagaugagacacaccugacauucaccagcaauggcaggacacgcugcgacaggugcggcugaagaagagcuaggcugucuggcggugguccuggccuaucuucccagugggcucucgcccacagucucucgccuuugccagggagcacugaaccguggacugguccugggggccaagggguccuggcggcccagccugggcagcgccucuggcaucgcagcugguggggaggcgcagggcugguggggcuuaggaggcgcuuggcacugaggagguguuuccgggaagagaauggcaggaaguuggaaugcuucuuuggcuguaggaaagcccagaagagagacuuguggaucagcaccgcccaggaauaacauccuauagccacaggcggcuucaaagggcuugagcuaucagggcaggauugcgggaggauucgcagcagggaggauggacacccggagaccugcuacccaugcacguagccugcugggcucagauccaccucuccugggucugugucuuuauuuccaaaguggggguggcucugcaggucccgcuucaaggcugggugagguuaacugaauuaccacgcgaaaagcccuuggugaaguaguucucaccccaggggcaauucugucucuuaagggacaccuggccacagcuggggacauuugugauggucaggauuuaggagugcuccuggcgugggguggguggagggcaaggacacugcucagcacccugcagugccccgggcggccucaucccagggaaggcuccaggccagcauccaccgagcggaggcugaggccccaauccagaguggcgcuggccagguugggccccgggaggucacaggaaugauuuuucucugggcuuguuucugcucuugacugugaauagaggugcugcacuagaaguuucuaaaaucuuuuuccauuccaagacagcuuaggguuuaugcugcucuucguguuugugcuggaaaggaaguuaaggagccguggaagugaucauaaagcaacuugaaaauaauaguuuuugcggccucuuuauuauaauggggcagccagguggguuggccgggguuuuaugggccaggaagcaggcguggggguuucugggggaagcuggacccgaggcagcguugaccccaagaccaggacuccgcgucucuccuguuccggccuguuccguacgccucgucagguuuucugcuccggugaacuuggaguguguuggggacugacagauccagagaacaugccccucugcugcaugaugccgcuggggcccucgggagggcuuggggugugucugugggucuugcaaacacucuccucuuggugagaaggaucugguugcauuuugugcccuugggcuguccccuggcucggacagaggugucccugcuguaacccccacuucgcaggguaccagaugccacugcccaggaguuacuaauguaccugggggucuggcaccugcuccgugaaacccgaggucucccuguacuaauuaauuuggccuuuagccaaagggagggcugcagccuucgggaucugcugggucacaguggguguuacccuaacaaguuuccuagagggauguucauuagaaaaauaauuuauuuuaugguauaaaaauuagcaaugacaggcugggcacgguggcucccgccuguaauccuagcacuuugggaggccaaggcgggcagaucaccuugaggucaggaguuugagaccagccuggccaacauggugaaaccccuucucuacuaaaaauccaaaaauuagcccagcaugguggugcacgcccgcagucccagcuacucgggaggcugaggcaggagaaucucuugagccugugaaguggagguugcagugagccgagaucgcgccauugcgcuccagccugggcaacagagcgagacuccgucucuuaaaaaaaaaaaucagcaaugacagugaaguggaaacaaaacaauacaagcugccgucaucuccagugagcuuccgaggucucugcuccauccauguggauguuugggaggggcccuccgugggcuccaggcggcugguuuagaggugguagaauguucuagcucugugaggcugggauucccaaguggagaccugugaugcugcugggugacaggcagaggauccugcugugcaggcuggggcugccaugggaggcuuggagcccgaggguggugaggauggaauuaagggaucuggccccgcgugcugugccgggugagaggcgggugugagcauggcaggaggcuuugggggccgaaugugcaguggaagccuggauggugagcggaugagcuggugcuggaacccagacccgccuucacugcccccagcguugggccaggaccgcucauccugugggcggaugguuuugcucugagccucagcaccgguuccaggagcgcagccugggagcgcggauugggacugucugucucuggccaaggcugugugugucucaggaagccuccccggcgcccagcccuccaccucuguguguucugcaccggccgucucccgguuuuucccucgcugucugggccugaaacagcccagaagagaaaucggaucucuucucagccugagcuucucuuuuagccugagcugaaagagaucaucuugggaaggagcuccccagcccggcuuggauugguccccucucuggugccccgggggaguagugauggauucaggacuugguccuggucugaccugccgugggggcugugaugggguccugaugugccccgugugccauggcgcucgccaagggccagcaugucugcggccucacaggggcuucacgagccacauucggggcagcgcuugguuuggagucuagagccagagccuggcgugggacccgagcucgugaacucugucagugccacugacuuggggcagugucuccgugugccucccuguggggcgauggcggaguaaacgggugauggccacugagcgcuggccguggggacucuugguccuggcugccaaguagaagcuucaggggugcucuucacagucagcugacucugcugucccugauagcagaagacagcgaaggcaccugcccccugccauggcaggucggcgggcacagaggagggcucgggaggcuguguccuccagcgucuccauguuuacugugccaggccaggugcugaggggccggcgaggaagacgugaggacuggagagagccuggauuagggcccucgaggggcggcgcugcuuuagccgggggaacagggagggccucucccagcaggugacauucagucagagaccucugagcgacucacaccugcccaccuuugcaggauuugggacaagagugcuccaaagaagugcaggcagcacgugcggaggccccaaggcggaacgaggcgcagcucacugagcuggcaggagcagagaggacugcaggggcacagaggccggagcagcagugccugcugccuagucagccgugagggcaaaggcuggaggcacugcugucagagguuuaugccuuuuuuuauuuuuauuuuauuuuauuuuuuuuuuugugagacggagucuugcucugucgccuaggcuggagcguaguggcacaaucucucggcucacugcaaccucugccuacuggguucaagcgauucuccugccucagccuccugaguagcugggaucacaggcgcccgccacuacgccuggcuaauuuuuauauuuuuaguagagaugggguuucgccauguugcccagucuggucucaaacuccugaccucaggugaucugcucuccucggccuuguaagaguuaaagaaagaggaaagaaacacaaaaugcagcuggcaguuaaaggcaaguuuucuuuaguuaaaaccugagaggcgcucuuggccgauugcggucaggagcgcuuucucuuauagacuaagaguauauauugguuuuagggugaaggggcuuaucacaagcuuggaacguuucuguguguggagaaguuuauggcagggcuggaaucugucugggaggaggggagguuaucuuggggcagacaucuucccggccggagggggguuaucucggggcuggcaugucucugguuggggaggaguuugcgauguuucuggcuggagaugcuauuugugguuuauggucaugcugaucuuagcuguuaggcugauacccuuuggauuuagcggucuuuuauuaaggugaacuuuuagaaugaggggcuuguccgggauggcaaugcuucugcugucaggccucccaaagugcugggaugaugggcgugagccacugcgcccggccaguauauguguuuuaaagaccucucugguggcugucaggagugaaagcaggggaccugucgggaaacuccaggcgucgcccaggugauucauggcaauggcucaggagaagggggucugggcuggggcugcggccuggacuggggguggcuuuuggagguagacaggauaggccuggcugguggguugaauguggaguggggagaucacugcuacucccagggugcagcagcugguuucacgcccccagcucggccacuuccugcacagcgauguggucuugggccugagaacgugggaauaacaaacucaguuucucccaggcugucagagcagucacagaucccuuccagcacacgcgagcaaagcggugcaggggcaggagcuggggcccuccguucaguucacuccuaccugggggcugcaucgggcaggacaggcugcgggcuccuccccacguaccuaaccccacggcccaugccagucacaagccccaggcuguguccugagcuucugcuggacgcgcuggaaaccagccuucucaugaacccuucuuuuuuuuucuuuuuugagacggagucuuguuguguuucccaggcuggagugcaguggugcgaucuaggcucacugcaagcuccgccuccuggguucacgccauucuccugccucagccuccggaguagcugggacuacaggugcccgccaccacgcccggcuaauuuuuuguauuuuuaguagagacgggguuucaccauguuagccaggauggucucaaucuccugaccucgugauccacccgccucggcuucccaaagugcugggauuacaggcaugagccaccgugcccggccucaugaacccuucuuugagcuuaauuugcuaaugcaccucucaaaacucaggggagcuguuacuuacguuuaccagcuuauuagaaaggauuuuacaaaggaggcagaugaagacauguguagggugagggaugugggaaggggcacagaggguuccgugcucuccccgggcugugacgucuccaggaaccuccacgcauucaucuguggggaagcuuccaucccaguccuccggguuuuaccucagcuuccucgcagaggcuugggugaccucacugcauuggccugggugaucaagucagccuucagccacaugccccuccccucccguccagccugggucuuuucagugagcagcccuauucccucagcucccgaggggcugccaagcccuuagucaccucauuagcacacuggagaauuccgaggaucugggggagucguaggccaggaaacaggacaaaauguauuucacagucucacugggccggucccuugccuccgcuuccuugucugugaugagaggacgggaggguggcugucuggacagugcugaagugguagaggugagucgcugccguggagggcuuggcagggugcucugugaagggcccuguggccugggguggaagccgcuugcagagugcugguucuuugccuaaggaugguggggcaggggggccguguucacacgugcuguuggcugugucugccagucuuccuuucuuuuuucuguuucuguuucuuuuucuuuguuuuuuuuuguuuguuuguuuguuuugagacagagucuugcucugucgcccaggcuggagugcaguggcacgaucuuggcucacuguaaccuccgucucccagguucaagcgauucuccugccucagccucccccaguagcugggauuacaggcaugcaccaccacgcccagcuaauuuuuuuguauuauuaguagagacaggguuuuaccauguuggccaggcuagucuugaacuccugaccucaggugauccgccugccucagccucccaaagugcucggauuacaggcaugagccaccaugcccagucuucuucuucuucuucuucuuuuuuuuuugugagauggaguuucacuuuguuguccaggcuggagugcaagggcacgauuuuggcucacugcaaccucugccuucuggguucaagcgauucuccugccucagccuccuaaguagcugugauuacaggcaugcgccacugugcccggcuaauuuuugcauuuuuaguagagauaggguuucaccuuguucaccaggcuggucuugaacuccugacuucaggugauccacucgccucggccucuccgagugcugggauuauaggcgugagccacggugucugacucagucuuccuuuucaugucaucccuuguuaauuuccuuuagaaacaguuugggccaggugcaguggguggcuuaugccugucauccaagcgcuuuggggggcugaggugggaggaucacuugaggccaggaguucaagaccaggcugggcaacauaaugagacccagucucuacaaaaaaauuaaaagcuuagcugagcauggagguggcaccuguaaucccagcuacuugggaggcugaggcagaaggaucgcuugaacccaggagguugaggcugcagugagccacgauugcaccagugugcuccagccugggcaaaagagugagacccuguccccgccccacaaaaagagggucagaaccuugguguuagagcaguucacuuccacccaaaaacagggacuuagaaagggagacacuuguguggagcccgaggcagacaugcccugacuuagcagugcagguuucuguacuggaaugagggccuggggcagguggccucuggcaggaugcaucuguuaccugagucugaaggcagcguggcgaggagaugggagggcugugccugggauccuggggccguggagagcucaucuagaggucaugaguauugggcaaagcucacaugccguguuuuaauacugucauuauggaaguuggccuggggguaauccagugucucuuuuagaucuguguuguacaaacacugaacuaguucuggucgccucuccggccuuuguuuuggggagaauauucgaugagauggcccguaauucuaacacugugcauuuugaaggauauuuauaaacccggauggauaaggcccuucuuagugcuauucuuguguugguucccuuuauuauuuuuuuuaaaaaacuuuauuaugggccggguaugauggcucacgccuauaaucccagcacuuugggagucugaggugggcggaccaccugagaucaggaguucgagaccagccugaccaauauggugaaaccucgucuuuacuaaaaauacaaaaauuagcugggcgugauggcgggcgccuguagucccagcuacuagggaggggacaggagaauugcuugaacccaggaggcggaggaugcagugagcugagauugugccgcugcacuccugccugggcgacagagugagacucggucucaaaaaauaguaaagcaaaaaauaaaaauaaaaacacuguuauggagaauuugacuacacagaaagguagacaacauggaauaacgagccccccaggccccucacccagccccaaaaccaucaacccauggcaacccccccugcccuacccccaucuguggugaaauagcccucauauuauuuuuguuaacuuuuaauuuuuaaagaauuacagaggcugggugugguggcucacaccugucauccaggcacuuugggaggcagaggugggaggaucacuugaguccaguaguucgagaccagccugggcaacacagugagacccugucgcuacaaaagcaaaaauaagaaugaauuauagacugccaagguguugcaaaaauaauaaagagauuucccuaggcuucacccugcugucuccagugguaacauuuuacauaacuuuagugucccguuaaaacuaggaaauugacacaggacacuguggcuucagaccuuccucaggcguccucaguguuagcacuggcucauucuuuugguagagucuuugcgacauucuguuaccugcacagauuccaggaaccaccauugcaaucaagauacagaacuguucugucaacacaaaggaacgcucugcuucucccuucugucacccccaggcccuggcgacggcugaggaucucugcaucucuguaaccuugcccuuuugagaauguuauguagauggaaucacagcguauuuaaccucuugggauuggguuuuuucgcuugcaaucugucgaaguuguuguguguaucaguaguuacuuucuuuuauuacucaguaguucuccauacggguguuguuuucucauucugcuuauuucugugagacggguggcagugguaaggucccaucuuucauucccgauuuuagcaauuugaguucuccagagauggaggacaagauccaagguugccagggccugggggcgacagaguggaagcagagugaguuccuuuguguugacggaacagcccuguaucugauugcaguggcgguuccaggaaucugugcagauaacaaaaugucacgaagacauuuaccuucgacaguuuuacuggucuuuucaagggaccgacuuuugguuucauuggcugucucuauuuuguuuauuuuugcucguuaucuuuguuacguacugugcuccaucugccuuaguuuccgugugcucuucuuuuuccagugucuuaagggagaugcuuaaauuaauauuugagaucuuccucuuuuuaaaaacuguauaggcaauuauaaauuucccucuaaguacugcuuuagcugcaaccuguacuuuuuuuuuuuccuugcgauaggaucuugcucuguugcccagacuggagugcaguggugcagucacaaaucacugcagccuugaccucccgagcucaagcaauccucccaccucagcccaccaaguagcugggaccagaggcaugugcuacuaucccuggcuaauuuaaaaaauaauuuuguggagaggaggucucacuauauuuccccaggcuggucucguacuccuggguucaagcauuccucucaccuuggccucccaaagugcugggauuacaggcaugagccacugugucuggccauccuauaaguuuuacuuuguugugaguucauuuucauucaccucaaaauauuuucuaauauuuucuuccuguucaacccugugauuauuuaggaguauguugguuaauuuccauguacuugugaauccccaaauuacuuucuguuguugauuucuaauuuccauugugguuggagaacuuacuuuggaugaucugaauucuuuucaauuuaaugaggcuuguuuuauggacuaacauaugguuuauccuggagaauguuccauauguacugagaagagaauauguucuauagauucuuuuggcuuauagugcucaagucucucucuuuguugcucuucugcuaguuguguuaucuuuuauugaaagugaggguaugagccgggcaugggggcucaugccuguaaucucagcacuuugggaggccgaggugaguggaucaccugaggucagcaguuugagaccagccuggccaacaaggcaaaacccugucucuacuaaaaacacaaaaauuagccgagugugguggcgcaugccuguauuccagcuacucgggaggcugaggcaccagaaucgcuugaacccgggaggcagagguugcagugagcugagaucaccccacuacccuccagccugggcgacagagugagacuccaucucaagggaaaaaaaaaaaagaaagugaagguauugacaucuccagcuauuguugaauuacuucuccuuuuauuucugucauuuuuugcuucauguauuuuggggcucuguuauuagaugcauauauguuuauaauugcuguaucuugcuaauggauucaccuuuuuaucauuauaaaaugucccucuuuaucucuaguaacuuuuuuguuuguuuuuuuuuugagauggagucuugcacuuuugcccagucuggagugcaguguugcgaucauggcucauugcagccucagccuccugggcucaaguaauccuccugccucagcauccuaaguagcugggacuacagguguguguugccacgccuggcuaauuuuuuugaauuuuaacagaggugaggucuuacuauguugcccaggcuggugucaaacuccugaacucaagugauccucccaccuuggccuccugaagugcuuggauuacaggcaugagucauuauaccacaccuggcacauuuuuuuuuaagucuauuuugucugauguuaguguagccacuccagcuuucuuaugguuccuguuugcauguuacacguuuaauuuuuauauuuucagccuguuuuuuuuuuuuuuuuuuuuuuguuauuguuguuuugucuuuuuugagacaggguuucgaccucccggcaugcaccaccauaccuggcuaauuuuuguguuuuuucuguagagacggguuuugccacauugccuaagcugaucucgaacuccugggcucaagcaguuugccugccuaggccucccgaaguguugggauuacaggugugagccacugugcccagccuauuuucagccuguucguaucuuugaaucuaaagaguguccccuggcugggcgcaguggcucacgccuguaaucucagcacuuugggaggccgaggcggguggaucaccugagguugggaguuugagaccaggcugaccaacauggagaaaccuugucucuacuaaaaauacacaugcgugguggcgcaugccuguagucccagcuacucaggaggcugaggcaggagaaucgcuugaacccgggagguggagauugcagugagccaagaucaugccauugcacuccagccugggcaacaagagugaaacucugucucucaaaaaaaaaaaaaaaaaaaaaaaaaaguguccccugaagacaguauauaguauaguauauaguuggaucuuguuuuuuaaauccagucugacaauuucugucuuuugauuggauguuuaauccauucauauuuaaugccguuauugauauaguuggauuuguaccugccauuucccuuuuuguuuucuauuuuguuccuuuauuccuucuuugauguuuucuuuugcauuaagugaauauuuucuaguguaauauuuuaauucuuuucaugauuguuagcacuauauuuuuggaaguauuuucuuaguaguugcugucggucuuauaggcaucuuaacuucucagaaucgacuucagauccccaauaucauuugaagcaaggcugugcuuacuccuuuugaacugugcuuagcaaucaggauuucacuuaaucaguucaauggcuuggguuuucaaggaugcugauguguuuguuugccugaauggugccucuucuuuugcucauuccuccucacauucagugaaaugaacacaucaaagcccucuuaggaccugugaucaucaaaaccauuuggagaccccacugucucgggagcagggcuugggaaggacaccagcuccccugucaucccucuccuuguguuucuggcuucuuuucaucucccuugcaccacugaaacugaugaguuuguagcccuguuccugacacaagacuccaaaucugugucagugggucucacccacuuggaggcaggucuuuuuuuuuugagauggauucuuacucugggcaacagagcaagaauccuggguucaagcgauucuccugccucagccuccugaguagcugggauuacaggcacccgccaccacauccagcuaauuuuuguguuuuuaguagagacggaguuucuccauguuggccaggcuggucucgaacuccugaccucaaccgaucugccuaccuuggccucccaaagugcuaggauuacaggcaugauccucugugccuggccgaggcuuggcauuuuuaauuugaauugguagagagugggugccaucaucguuuugaugaucauucaaccccaggaauaugcaucccuuuccugagaggcacucucauccucuacgcagagcagccagugagcugcuggagggaccuugggucccagcacaguaucccaggcuggcucccuuuaaauacucguuguuuuuauaaaagggauauguaaguaugguuggcgugugaacuacaaaugucccugcauccugcgacccugaaauggccugucuugguguuggcgcuccuggucgccgcggugucacgcguagaucuuugcuucucaguggcucugcaguccuuuauuuugguacagauauguguaauuuacuuacccauucuccuacuaaugagcacuuacuuuucucucucucuuucuuucuuuuuagacagugucucgcucugucgcccaggcuggccugcaguggugugaucucagcucaccgcagccuccuccucccaguucaagugauucuccugccucagacuccugaguagcugggauuacaggcaugugccacgacgccuggcuaauuuuuguauuuuugguagagaugggguuucuccauguuggccaggcuggucucaaacuccugaccucaggugaucagccuaccucagccucccaaagcguugggauuauaggcgugagcuacugcaccgaacuacuuuuuucucuuuuaaacaaugcugcuggccacauccuugcugccagcccuucuaggugggguugcucagagugugugugccuguuuuauuuuuauguuuuugagagggggaccugcucugucauccaggcuggagugcaguggcaugaucacagcuccuugcagccucagcccccugggcucaagcgaucucuugccucagccucccaaguugcuggggccacaugugugcacuaccacaucuggcuaauuuuuuuuuuuuuuuaguagugacgcggucucgccauguuguccaggcuggaguuuauuuugaagcguguugcucagcuguccccugagguggucugaauuugugccccugcacagucauugugggacagucauuguguuggggacagcucuggucucugccccuccuuauaaccugucuccucgugcugguucuuguuugaguugccaguucauagccuuugccugcuuguugauuugguauguuuuuuuucuugacuuaaaaacaaaaaaacaaacccaaagcuucucaaauucggcacucuugcuaucuugagcuggguccuucucugggguggggcuguccugggcccugcagggugcugagcagcagcccuggccuccacccacugcaugccaggagcacccccuagucgugacaaccacagacagccccagaccucccaguguucccugugggcacagcugcaugguugggcagugugggucugggugaguggguucuuugcaucccuggccuccacccccuccacgccagcaccacccucagucgugacagccauaaaugucccuagacaucggaaggcauccucugggggcacgaucagccuugguggagaaccccuguuuuggaauaacccuuucuguacccgggcuauuaccacccuauuguguuaccuuuuuucucaguuccucacuuaucuuuaguuuuauuuuuggugcguuguuacauaggauguuuucaaguugccugauguguccuucccuuuagggcuuccgaguuugugucccacuuagagagguuucccccgcccuaggaguccaggagcgucggccccuggcuuccacuguguccuucugugguucaugaggaccugccaucugggggcggcgaggugggcugggcuuuguguuuccaacauguccaccccagccggcugggccugcguacccaguggguggcgcucaggucugcagcugccuccuuggcuccccgguuguuagcugugugaucuaggguaggccacuuccugccugugccucaguuuccucuccugggaaaugggcuggaauagcugucccugccuccuccgguuggugggcuggucagccaugccaggcacucagagucaucccugccuccucgaguuggugggcuggucagccaugccaggcacucagagucaugccugcaugggggcuccaggaccucgucaucagccucuucauccuuacugucuggucuguuccaaaggccgcaggccccagaaagacggugacacuccaggagguugcuagaccuggcgggccccagggccaggagugaggggcggacgugccacucugcacugcugucccucuccacccaggccuuggggcucccagacaaccaugaaauuacaaggcagguuuguagaugcauagauuauuuaguuaaugauuaugguuuuaaaugguuaauuauggaacaucagauaccuauaaauaagugugaaacauggacugguccucuugugucugccagggguugccuccugacugggugggagccugcuugggggcccaagucugcuggcauccccgcucuguguggcuccauccccucgccugggggcaguggacggacagguggccuuugcccguagugcuccccagacccuguugagugccuggcaaagauguaggugggcugcaccucccuuuguguggaagguuccagaaggaagugccaggugaccaagccugugucuguccuggguuuucuuggcucuucacccaaacacuucccuuuuuuguuguuuuuguuuuaauaaaauuuuuuuggacauaauuucagacugaccccaaaauugcaagaauaauaggaagaauucccagacaccuuucacccaggacccccauguggcgacauucccugcuuugccuuuaauccuuuccucucauucucuuucccugcacuucuuccuaaacugucaguguguggcagacaugacaucccuuuaccucuccuucaguguguauuucccccagacaaggaauuuuuguaucaaguuaucaaaaucagaaauucacgcugauaaaaucaaaucuacagacccuauucugacuuugcaguaauguccuuaagagucagaagagaauccaggaucaacacagcacucagucgucuugccugucgguuccuuuuaaccuggggcugcuccugagucugucucuggguucucugacucugauguuuugggggcguacaggccgucauucuguuaaaugucccccagguggguuugucugaugguuccucaggaccagauucaggccacacacuuuuggcaggaaaguccuggagccgacauuggguccuucuuagugcgcccuaucaggaggcccaucaugcuaauuugucccauuucuggugauguuaaccuugauccuuugguuaaggugggcccgccagguuuccccacccuaacauuacuauuguaccauuugcaucucauggggaggccaguguaaacacgccguuacuccucaaacguucacugcuuguuucagcagacauugauucuugccgcauggugguugucuaguccugucauuucuucugcguuuauuaguugaugucuccuauacaggacagcugucccuuguuccuuucuuauuucuaucagggugggcuuguggauucuuacuuuguucaauggguuauaauccacugccaucacgauugaucugguugcucagauggcuccacauuuuuccagaaagagcccggucgagcuggcuccugggccauuugacauguccccacccugcucggagcacuucccaacuuuuuggcacugggaugcucccagcucauccuguagucucccucauggucgaucccugggauugaccaaucuccaaggagcccugguucuguuuguggagaaugccacuuagaaaccgagauccaggugcuccgugugcucagugcuacuggggugucuuugcuucuagguccucuaaucagacagagcugggaaguagauguguguacaucuuacacacauguacauuguguguguauauaugaauagacauguauacauacagacaccugacauuuguauccaucucugcauccaucuauccacccacccauccacccauuuacucaccuauccaucuauccaccuguccacccacccacccaccuguccaucuauccaucuauccauccauccauccacccacccacccaucuacccauuuacucaccuauccaucuauccacccguccacccacccaccgacccacccaccuauccaucuauccauccauccauccacccacgcauccacccauuuacucaccuauccaucuauccaccuguccacacaccgacccacccacccaccuauccauccauccacccauuuacucaccuauccaucuaucccccuguccacccacccacccaccaaccuauccaucuauccauccauccauccacccaccaaucccauuuacucaccuauccaucuauccaccuguccacccacccacccaccuaccaaccuauccaucuauccauccauccagccacccaccuauccacccauuuacucaccuauccaucuauccaccuguccacccacccacccacccaccuaucuaccauccauccacccacccacccauccacccaccuauccauccacccacccauccauccacccauucacauauccguccauccaucuauucauucaccgauccaucuguccgucuguccauccauccauccacccacccauucaccuauccauccauccaaccguccaucuguucauucaccuauccauccaucugucuguccauccauccauccauccguacauccauuuauucauccauccauccauccauccauccccauuaaugcccaugaguucacacugaaaccucuaguuccagccccacacccagggucccuuaccaucuuuccccaucguuauuuguaacucccuuggcugacagugagaauccacccacugccuaccauaaaagcauccuccagaguaggagccaauauuucuuuuuuguuugucucaaagacauacagucccaaacuguauuuaaaaguuuacauggauuaguucuuccauuuuuuucccccuucuuuacugugguuauauuguuugcuugaaauaagguuugguuuacuuguuuuuguuuguguuuuggacaaggauuuuccuccucaacucuugcugauuuuaguugccuguugauugauuucuugauucaacauacgugauguaguguauagaacauuagcaugguuccagagucaggacugcacaaaaaggcaugggcggagaagugucaucaacccccuuucuccuccccauuccugcccacccccugcaggaaaggaaucucguuagucucuggcucagccuuucagggcagcucaaagaagcagauguguauuuuuuuaauguccccuucuuuuuuuuuuuugagacagagucuuucucuguugcccaggcuggagugcagugguguaaucacagcucguugcagccuucaccuccuggguucaagugauccugccacuucggccuccugacuuagcugagaccacaggugugugccaccaugccaagcuaauuuuuuuauguuuuuauagagaaauacagggucuugcuauguugcccaggcuggucucaaacucccgggcucaagugggcucccaaagugcuggaauuacaggugugagccacggcgccuggccuuauaccuuuucuuucgcacgugaaaguggcgcugugcucuguucauuuagcuguguguccuggaaaccacuucauuggccagggagcucuuccuggcuccccugcacagcugcguaguguuccuugcagggaugcagcgaaguccacccagugucucuccugcauguagauauuuaguuuguuuccaggcucuuacgguggcgaacugugcugccgugaguaaccugguguauauggauuuucacauugguggaaggguaucuucaugguagauuuucgugagugggauugcugggucagaagugcagacauauuuuguuagcuuuuaugcuaaacacccauguaaguccuguuccgccagcugugucgucugggagggccugguuccccugccucgccagcagggugugcuguuucaugucuaaauacuugccaaucccagugcugagaaaugggggcucaguggaguucuaaugauuguuccuguaguuaugaguggugaugaacaucuuguugugauuaaagcuguuuuuguaucuuuucugugagcuguaucuucauacuuuucacuugcuuuuuucuauuggauauuugacucuuuccuccuaacuugaaacuccaauaugugaaccucugugguauguauugcaaauauuuccuuuguguuuuuuuuuucuuuuuuuuucuuuuugagacugaaucuuguucuguugcccaggcuggagugcaguggcacaaucucagcucauugcaaccuccgccucccagguucaagcaauucuccugccucagccuccugaguagcugggauuacaggcgugugccaccauguccagcuaauuuuuauauuuuuaguagagauaggguuucgccauguuggucaggcuggucucaaaauccugaccucaggugauucaccggccuuggccucccaaaaugccgggauuauaggcuugagucaccucacccagugcaaauauuuucccucggucucuggauugccuuuuggcuuuguuauugguguuugguuuucuuuugcccugcagaguguuuuuuuuucuuucuccuuuccuuuccuuucucucuccuuucucucuccuuucucucuacuuucucuccccuuucucucuccuuuccuuuccuuuccuuuccuucuuucuuuccuuucuucuuucuuucuuuucacuuucuuuuucuuuauucucuuucuuucaagacgaggucuuacuauguugcccacgcuggucucaaacuccugggcucaagcagucuuccugccuuggccucccaagcagcugaaauuacaggugugagccuguaauuagccacaccuggcuaauuaaaaaaaauaguuagcugggcacgguggcuuacaccuguaguccccggacugugggaggaucacuugagcccaggaguuugagaccagccugggcaacauggugagacccccaucucuacaaaaaagaaaaaaaaguuagccaggcauagugguguaugccuguggucccaccuacucaggaggcugaggugggaggauugcuugagcccaggaguucaaggcugccaugagcuaugaucacaccacuguacuccagccugagugacagagcgagacccugucucaacaaaagucacauuucugagucuuuacuuucuuugccucuugauuagagcugugguuguaaagcccuuuccgucucuggggcuggagaggaguucaccucguuuuuuucuggcucucguaugauuccuccuuuacacucacguuccgauuccaccgccguucauucucgcagaggugcgagguggggaccucacuuuauuguuuucugaauggcuacccuguugucccagcuccauugauuaaaaaaaucccugcuugggccgggcaugguggcucacgccugugaucauagcacuuugggcccaggcgggcggaucaccugaggucaggaguucgagaccagccugacuaacauggagaaaccccaucucuaauaaaaauuagcugggugugguggcgcaugccuguaaucccagcuucucgggaggcugaggaaggaggauugcuugaacccaggaggcggagguuguggugagccaagaucgugccauugcacuccagccugggcaacaagagcaagacucugucucaaaauaaacaaacaaacaaacaaacaaauaaauaaaucccugcuuggccaggugcaguggcucacaccuguaauccuagcacuuugggagggugagguggguggaucccuagaggucaggaauuugagaccagccuggccaauauggugaaaccccgucucuacuaaaaauacaaaaauuagcugggcaugguggugggcgccuguaaucccagcuacuugggaggcugaguuaggagaaucgcuugaacccgggagguggagguuguagugagcugagauugugccacugcccuccagccugggugacgagagugagaccccgucuaaaaaaaaggucccugcuuaccccacugccuuggggaacccccucugucccccacacagucuccguauaugccugagucuguguuuggucuuccucgucucuccacagcaggucugccccguggguuguuggccgcggucggaugcucagccgcuugagaaugcugucuccugccugggugcgucuggcuccccucugcgcguccuguuucguguuauuuuuuagaguuugugcauuucucuguguacuuugguacacaaaugcuucuuugaaguuaauacguggcaguaaagcuggcacuggggacggcuagggcgguggauggcguguguccuggagggcgggugugcuggcagagacuuaaggaugagguuaaggauucuccuaaguccuuuucuucugggggaaggagacucgugggaaccccuccagugcaauggccucgccauuuccacacgccggccccuggcacuuuccaccauucgugugcucggcucccagcucuugcccugccacaggcccucgcucccuccucacccggccuggagugcauggcccacagugggccuguucucaccgcgcaucccgccagcuccuuggcccuucucagcccuugcugccccccgggcucauacaccucuacccacgauccagagacggaucgucaggcccaccccagcccggcagcuuccuagagcaaugcccucagccaggcauguugucuggggacgcucggcagugucuagacacagccagucccugugacccggugugcaugugugcugccgugcacguuucagcuccccaguuucauguaguugagaacgcuugacugugagaugcaccacggcucugugcucccugggaguccccguacccccgugcggugagcgugagaagucacccacagaggggcaggaaggcgguuauauuuuaauggucacaggugggcaguaccccuggguguugggcagaggccaccccugcuccccuccggaauacacucccuacuguccaggcagcccucagauuacagcccccagccugaccccagagacaugcaaauaugggacagacguaaggcuuuggugccggaaccaggagcaucccgggcaaagugagacgagcuggucacccccugcacagucucccacuuccccaggcuucauucucccaccccuggaagugguaacccuucuagagguaccuguguagcgucuuccuuuucugcgcgcucugugugugccggccuguccugcggccgucaccuggcagauagcugcugucccagggauccagcacaaagcuuggagaugcgucugugcagcccacucuguggcuguguguggaguugaugguggacuucugucaccccaugacaucugaggcuacaggaguggccuguggagauguugguggccagguggcacaaguauggagaacacagaugcccggggcagcuggcaagaaggggcaggugcuuuugaaagauguuaccaaaccguccuucccaguggugcugccaggccacuggggcauagaucagugugggcaccuguuccuccauggccucugugaccugucgugucauuggacuugcuggucagccuccugagugacaggauggugacagcugccacuuaggggaccucauugagcuuccugaagaccccacgaugaggguguuaacauggggagcccccuuuacagaugaggaaacugaggccccagaggugggggccucacccuccuccgggccucauggugggugguggggguucaccuuccuuuauuugcauguggauaucaagcaguugucccagcacuguuuguugaaacaccuuuucuuucugcauucaguggucuugggaccaggccuugggggacugugcucuguaccauguccucacccaggacgucccucuaagaucgcucuuagaggcuacagggccacgggggagaagguccccaccauucuccagcggcugccucgccacacagcugggagggaugugggguagagagcccccugcuuggcacuggcccugggggucuaagugauaugaggggcaggggucgccccugcagucaccgcguccuccucuggcggaggugaguggugaugcugggucacaagagguggcuucucaucccaguggucucgugcugcacuucagggccuccaucaccugaucugggggcuguggggguccugggagagggcucauggguaggggacaguuuuugauguucucuuagugaaggacagagaagaaggauggggggcugguggcggcggcagggagccaggauggugcuggucccgccucccuuccuuccaucccugcugcaggccugcccucuucaugccuggcuccccgcagccucucccuguccccgucugucccgccacuacuggaaccccacccugccucuggguagugugcaccccauccucagagcggaacccccauccccugggcuugugggggcuucacuuccugcuguuuccccgcagcccacggccauucuccugcuccucccaccccuccucacuguccuuccuggcacuccaggccccuccgccgcaucuuucugacucguguugccacaucaucugcccuggcugggguuuuaucucccuggcaacuggaaauguguugguuaagauauggugaguuaggccgggugcaguggcucauggcuguaaucccagcacucugggaggccgaggcagguggauccccugaggucaggaguucaagaccagccuggcaaacauggugaaacaccauuucuacuaaaauuacaaaaauuagcugggcaugguggcgcaugccugucaucccagcuacuuuggaggcugaggcgggagaauugcuugaaccugggaagcggaggcugcagugaccugagaucaugccguugcacuccagccugggcaacagagcgaaacuccaucucaaaaaaaaaaaaaaagauauggugaguuaagaggguaaccagcccuggagcugacagccuggguuagcaccucugggacuugggacggccuccauguuccgcucugugaagugggagugacaacagugccuuucccauggggcugcugggaagugacucaacgaggagcaccagcaaggggacaccagagcgggccccagccaccuccuggcagaagcauggggcucacgaggcggggcggggguggugaggaccaggcgcagaccugggcagggaccugggcggaacgggggaggcggaaucuucuagaagggccuugggggagggcccuguccccaccaucccucgugagcacccccugccaaccuccaucucccauuugagaguuggggaacguagcaaaguuaucucaggacuggaauaugaauggcagcucuuggccaggcucugccauauuggagagguuucuagaagguccuggaagcccacuggcuccucugucauuuucggcaugguuuuggccucuccucuucucccuugcuucauugcugugaugucaagcaucucuuccugugacuguugacucuuuuuguaucuucuuuggagaaaugucugcuccauccuuugcccguguuuucuguuagguuguuugucuuuuguugaguugcaagaguuguugacauauucugcauacaaguuccuuaucagauaauguuuugcaaauauauguucuccuguuuuguacauugucuuuucacuuucucucucucuuuuuuuuuuuuuuuuuuuuugagacagaguauuguuccaucuccuaggcuggagugcaguggcacaaacauagcucacugcagccuccaacucccaggcucaagcgauccucccaccucagccucccgaguagcugggacugcaggugugcaccacaaugccuggcuaauuuuuuucuucuuuauuuuuuguggagauggcaucuugcuguguugccuagucuggucuugaacuccuguguucaagugauccucccaccucugccugccaaagugcugggauuauagacaugagcugccaugaccagccaagucuuuucacuuucuugaggucuuugcaaacaacuuuucuuuuuccacaugcacuuuugguguuuuagccagaaaucuugccugauccaaagccacgaagguuuaauccuaugguuuuccuaagaguuggguaguucugagcuggguauacuagcucacaucuauaugcccaaugcuuuggaaggguggguugggaggaucguuugaggccaggaguuugagaccagugugggcaacauaggaagauacuguugguacaaaaaguuuuuaaaaagaguuuuguaguuugggcacuuacauuuagaucuaugaccuauuuggaauuaguauaaauauauggugugagguaaggguccaccuucauuuuuugugugugaauauccagcugucccagcacuauuuguugaaaaaacuguucuuuuugcauugaguggucuuggcacuguuauugaaaaucaccugacuuuaagcguguggguuuauuucuggacucucagcuuucucccguuuaucuaaugucuguacuuaugccaguaccaugcugucuugauuacuguagguucauaaccgugaauuauuuuuugucuagucuugaguguagauguuaaggaaaaauaauaugguucuuacauuaacauauagagacccagauuagcugaugagacuacagccuucuuaguugagauccagaaaacccuggcuguucccugccuccuuguuucuucuuuuucuuuuucuuuuuuuuuuuuuuuuugagacagagucuuacucugucacccagacuggagugcagugccacaaucucaauucacgguaaccucugccuucuggguucaagcgauucuccugcuucaguccccugauuagcugggacuauaggcauguaccaccacacuuggcuaauuuuuuuuuuuuuuuuaauauuuuuaguagagacagguuuucaccauacuggccaggcugguaucgaacuccugaccucgugaucugcccgccuuggccucccaaagugcuaggauuauaggcaugagugaccaugccuggccccugccuuuuuuuuuuuuuuuuuuuuuuuuuuaaagacagaguuucgcuguguugcccaggcuggagugcaguggcaugaucucggcucaggcagccucugccucccagguucaaguaauucuccugccucagcuuccugaguagcugggacuacagguggaugccaccacgcucagcuaauuuuuguauuuuuaguagagaugggguuuugccauguuggugaggcuggucucaaacuccugaccucgaaagaucugcucaccuuggccucccaaagugcugggauuccaggugugagccaccgcucccggccuauucccugcuuccuuuauugagccaugccaccuuccucaguuggauuuugguaucaauaaggauaugaagguuuuggugacauauuucuaaauaagaggcuguuucccuaggaugcagagguuggugacaaaugucagcuuuucaguucuuucacucaagaaggaucugcaacuugaauucagcagguuuggucuucaguggggccuggaaguggaagggauguggugguguccacuugguuucugaucaccuuggcucuuucacggccugacucuccucuuccagugaaaaccugcuaugccuugagcuucagaggacagagguccaggugguuguuugguuuggucuuuuuaacuuuuuauuuugaaauaauuuuagacucacugaacuguugcaaagauagcacagagcguuccuguguaccuuucacucagccccuaaugugagcaucuuauguaaccacagaaugcucagaaauuagccaauuccauacuaccaugcaauuuacucaacuauagauucuuuuuuuuuuugagucagagccuugcucugucucccaggcuggagugcaggggcgccaucuuggcucacugcagccacugccucccagguucaagcgauucuccugccucagccuccugaguagcugggauuacaggugccuuccacuacgccuggcuaacuuuuguauuuuuaguagacacaggguuucaccauguuggccaggcuggucucaagcuccugaccucaggugcucugccugccuuggccucccaaagugcugggauuacaggugugagccacugcaccuggccucaacuauagauucuauuagaauaucacuaguugucccaccaaugucccuuuccuggucuaggaccucguccaggaccccacucaccauuuagucucauaggcuccuccaggugugccaaggccuccaucuugccuugacuuucacgaccuuggcacuuccaaagagcaccaggcagauguuuuguagaaggaacuucccuuggcuuucagacguuuucucaugguuagccugggcucuggacuuuuuagaagcauaccauagggcucaugcugcuccuucccugugcaguguaucaggaggugcguguggcugauguggcugaugcggcucagcguggugguguugaccguggccgccuggcugaggcgucggucaaguuucuccacugcaaaguuacuccuuuucccuuugggacuuugagccugugaacauguccuguuccuucaacuuuugcucaccaauuuuuacauuuccgcguggcucuuuccugcaggaaauauucccgugguguuggacuggugauuuuauguuaugcuuauuccuuugacacuuaugaaggagaauucuucuguggaggaaagcugucccucuuccccauuuaucaguugcauuuuauuuauuuauauauuuuugagacagagucucacucuuuugcccaggcuggaaugcaguggcgcgaucuucgcucacugcaaccuccgccucccagguucaagcaauucuccugccucagccucccgaguagcugggauuacaggugcccaccaucacaccuggcuaauuuuuguauuuuuaguagagaugggguuucaccauguugcacaggcuggucucgaacuccugaccgcaagugacccaccugccucggccucccaaagugcugggauuacaggcgugagccacugcaccuggcgcucaauugcauuucacauguucucucaggaaagccaucuguguguuuguuuuauccuguggguuguaacaugaugcugucauucauccuggugcugagguaggugguccucguuuuggccaucaggagccccucgcauguccuuucugcccgcucccauccugucaagccuucccuuccucucagguccugcagggcgaucugggcucagcuuguauauucugccccagcccuggaauugaccacguguccugcagggcucccugguuccucacaguggagaaugauguuuacaaacuguggccugggugcuggccgugcucgaugcuguuggggcaucauugcuucuagguuuucucugcugacagggcuuggaaguaggaacgcuaacccauguguauaugcacaccuguauccaucucacugucucuuuuccagagcuccugaguucauacucauagggugccagagcguucaugucgugggcccaucugaggcuuuggguguccacccccaaccuguaagggguacgcagagccccuggaaaaaggaggaccuuccuguggggcugaagacuugggugggaggcaggagauggcaugucccuuuugaaggccaccuggggcuuguggccgugggagaggcaggcagggcugggcccugggccaucccggcucaggcaaccucgccaggcgugcaggugagaggaucccuucuuucugguucagagacuccuguuuuuggacccgugcucagacccgggaaagaggugggcaguguggucuggugcaggcccaacuuucggaacccacccgagggucagcccugggggcuccggugacuggcagccccauggccaagaguaccuccuuuugggggguucuugggggccaaguucugugguccucaggccucugugcuguggugccacugucuccucccugauucccgccaguggucucuucuuccgccccacccgcgggucuuggcggaggggcucacagagccagcacuguaucugaggcugcccucagggucagcacgugcggggcaguggcuguuacguaaucgguagcucgugcuguuugggggcguugucguccgaugccuugggcugucacugcaggcuucugucaugcugcggugggcuccccuugccaguucuauuccuagugcccagaucugccuagaagccgcagcaggguugacaggcugggcccguggcagggugcagucaaaccuaagccaccugggucuuccccuccuggcaguuaauagaacuuagcuuuuggagcaguuuuagauuuacagagaauuugggcaagugguagugagaguucccgucucugccugccaccccccacccguuuuccuugugggaacauccugccuguuguggcgcauuugucucuugauuaacacguuguuaaugacacuucccgcuucauucggauugccucugcuuuccccuaauggacuguuuucugucccagggccccccacaccgggauuccucguggcccguagccgucccaggauccuucguggcccguggcaguccugggaucccucguggcccauggcccucuccucaggcuccucugggcugggaccacucccgacacguucccuguguuuugugccuggacaguguugagggggcuggccaggcagaugguagggcgccccucgauuggggugugucuggcauuuugcucaggcuggcacgcgguggaggcuguugggaggacuucagagguaagggcucuucucaucacaucccggugagcgucaggacgugggccaucagcaggaugggguuggagccguguggcuguugcugcugcccugacggcguagcugcagggguucaucauccucuccccgggaugcugcccccgacuuuccauuugugcacugauggaaggaagucaccgcauagcccaugcguaaggaauagggagcugccugggccccaaccccucgucuucccuccuggaggggcaguggaggcaggcuagcccggccucucaucuauugcggauggggaccaggguggacagaggccuaggcucgggcugugccuugagaacuggggcccggccucagccccagagccuccagccucccagcuuggagugggcgcuuuuggggccccagagagggagggcagaaggacccguggucuugguagcaccgggcugaggucuguccagcugagagccucagggucugguggcuuccaugccuucuugaccaagugcugagaguggggguggcccgucgugcagcgggggagagagcuguacaaagagacaguuacuuguggcaggggagacccaggaucccguggggaccugguggcagccaggagcagcaggucacaggggagaggccuggguggccccugggaguggacaggcccuugucuccgcugaagucagggagguacccuuugcugcuaugacaaauggccgcagacacaguggcugaaaacagcacccguucauucucucccaugccuggaggagagaagucugacaugggccucccugggcuaaaaucaugaugugggcagggcuguuccuucuggaggcucccggagacaguccauuccuuuccucucccagcgucuagagguguccgcaucccucggcuuggggcccuuccucccccuucacagccacagcgcagcguuuuccaggccuugacucucacccucuggccuccucccaugaggaggcugugaggacauuccgccucccggaucauccccuaucucaagaugccuaacucagucccauccgcaaagccccuguugccauggaaggugaaauagucccagggucuggggguuaggauggggacaucuuugggaaccauuguucugcugcccacagcugcguggagggauuccgguccucggguucaguuggugacagugucggguaggccugggcaggugggagaggucgugaagcccuuugcagggcacuuggccgcucaucuggcacaggggaagaggcgcagcccguggcccggcaguccaggaccugcuguucccuuccuacccggggcggggccugugggaagauauggaagucgggugaaugagccgugcccagugauuuuaaaaagcagauuaaaauaacauagaaaaugucagagcucauugcgugcucuagggcauuugugaaacuugcauuauuuauuuuuuugagacagggucucgcucugucgcccaggcugcagccuugaacuccugggcucaugcgauccuccugaggagcugggaccacaggcacaugcuaccacacccggcuaaguguuuuguuuuguuuuguuuuugagacggagucuggcucuguugcccaggcuggggugcaguggcacgaucucggcucgcugcaagcuccaccuccuggguucacgccauucuccugccucagccucccgaguagcugggacugcaggcgcccgccaccacgccuggcuaauuuuuuguauuuuuaguagagacgggguuucacuguguuagccaggaugguccgaucuccugaccuugugauccacccgccucggccucccaaagugcugggauuacaggcgugagccaccgcgccuggccuaaguuuuaaauuuuuuguagagacagagucucacuauguuggccaggcuguugagacuccuggccucaagugauccucccucaucauccucccaaagugcuggcauuacaggugugagccacuguacuacuugguguuauuuaaaaguccuggugaauuguaaaaaguguacaacuucgggaggccgagguggguggauuacaagguuaggaguucgagaccagcuuggccagcauggugaaaccccgucucuacuaaaaauacaaaaaauuagccgggcaugguggcgggcgccuguagucccagcuauucgggaggcugaggcaggagaauugcuugaacccggcaggcggagguugcagugagccgagaucgugccacugcacuccagccugggugacagagcgagaguccgucucaaaaaaaaaaaaaaaaguacaacaaaaccagggccccagggggcgagcuccucugcccuggagguugggccugccgaggggaccuuagagugcuucugaagugagaguuggcauuagcugagcagaaggaagcagagggcagccugagcugagagccagcaccgguggagcucugagacgagggcucgcaggccugggcacccaccgagccccaggugugccaaguccagugggagcugcaggucagguugugaaaguccuuuuuuuucccuagacguagucuugcucugucacccagguuggagugcgugcaauggcaugaucucggcucacuguaaccucuaccucccagguucaagugauucucaagccucagccuccugaguagcugggauuacaggugcacaucaccacgcccggcuaauuuuuguguuuguaguagagacgggguuucaccauguugaccaggcuggucuugaaccccugaccucagcugaucugccugccucggccucccaaagugcugggauuccagaugucagccaccucgccccgccaugaaagucuugauauuggccggcgugguggcuuaugccuguaaucccaguacuuugggaacccaaggcaggaggaucacuugaggccaggagcucgagaccagccuggacgcuauagugagacccugucucuuaaaaaaaauaaaaauaaaaaagucuuggugucacauccaaaguuuggaguucuguuccgcauccauccuacaaguaucugagcgucuuuguguccaggacuaaguucaacgccugggcugugccuuggccccugugcggucgcagccccugccccccucucuccccgugcucugccucuugguguugggaggugggggaaaaacugggugcauuuucugcacuuuuccccuuggaggaagcaaaacuucuugaaaaucucucaguaggugucugcgucuuaaggccuccagaagcuucuuugguuucauuugacuguucacggauacucccgcugccuuggcccguagauuuuaggagcuaagcuuaaaaugggcccucauuggaaaacuugacuggguaaagugcuuauaguuacggauuuuugucuuguuaaaaauugacaagaauguggaaaaucugaauaaaggcaagcguccucgggcugcguacagcuggugggagucgaauuuagaauuaaaacuugagcgugccaucaguuuaguuaaucaugcuuuuauuugcauguuuuaggaaccaucacuguugcuggaggcaccugacaaauccuagcgaauuuuuggagcaucuccacccaggaaccucgccauccagaaguaaguaacacgggccuggcccccagguggccccacaggaccagggaccggaaggcuguggccucuucccuggguggcccgccagggagaaggugguggccugaccggcucugaauucccgggacguccaggcgcaagcugugcuuagacgggagccugcgggccaugguagggagguucuucugcaaguuucuucaugaagccugucugcuuugggcuugcaucucgcccuucggcaucgaaccacccgacucucacuucuagaaacuggaaaagcuguggcuccuccugcauuucgggugacacugggguuucccaggacccacuacccugucugcaucggcccuggggacaccugagcucaaggggcguucccccacacacugucagaaguggggagcaguuagagcagggcucucuaaaaaugggagacucauuuuuaaaugccuuugagguaguuccauggcccagccgccccggguuuaguuccuuuucuugugccuuucuuauaagccgguggcacaaagaggugccucugguggcagcccagggggaccacucaggagaagagagagaaugaccucaucccuucuggccacacccacagggcccgggugacccaguggagggugucaagugugggaugagcagugcaguguccucccgucaaggcagagguggcaguggcagcggcggccggcagagcaccggggaaaggcugccuugugcggcgucgcccuuggauugugugccgcuucccugugcagagggaggaaggggcccauccagggcccccuguagcuaaugagggcgaguguggacuugagcuggggcccuugagucauuugugggugccuuuucuguucuacuacgauuaggaccuugaggagggugguggagcccagccucuuuugggaagucauaaaguguaagggaagaggcucuggucacgugguuggcaaacuauggccccuggacccaaucugacccccuguuuuuauaaauaaaguuuuauuggcacauggcuguguccauuugccugagcauugucccugguugccuucuccucacagugggagaagugacuagcuggaacagagggcguggccugcgcaucuggagauauuuccuguuugggccugugcagaaaaccaugcgccuccucuuguccagguuaacuuacugcuggcuggagcaggauggacgagucucuuggugacuugguuuggaaauuggcaggucugucugugccuccugaaaucuugcuuuuacccuucaaguuugugcuuccuuacaagauggucaauuuucuaaaacucagcuguuuucuuuguacccaaauuaacacagcaugaaccaaguaagcaacuugcucugucaguuagcuuuauuauuuauuuauuuauuuuuauuuuuuuugagacagagucucccucugucacccaggcuggagugcaguggcgugaucucagcucacugcaagcuccgccucccggguucacgccauucuccugccucagccucccuaguagcugggacuacacgagccugccaccacgcccggcuaauuuuuuguauuuucaguagagaugggguuucaccguguuagccaggauggucuccauuuccugacucgugauccgcccaccuuggccucccaaagugcugggauuacaggcgugagccacugugcccagccaguuagcuuuauuuuuuugaggcagggucucacucugucacccaggcuggagugcaguggugugaucauagcucacugcagccuccaccuccugggcucaagggauccucccgccucagccuccugaguagccgggacuacaggcaugcacaccacaccuggcuaauuuuuuuauuuuuuguagaggcuauguugcccaggcuggucucaaauuccuggccucaaaugauccucccaccucaaccucccaaugugcuggggucacaggcgugagucaccucauccugccgaaguucaccacauagcccuugauaaacccacuuuauaucugaaggugcugagugcagcaaccaggaggugcuagaaaguccucggggagagcacaggagacaggaguaagggagcagggcuccugcuuccgaaggccuggagcugaaggagaggaggagcucagggcaaaccaugugggcuugcugugguuuggcagguccccagauaggcugccuucacuuuguaaaaguuaacuuuuacugagaggaaauucacauacaucauauucacucuuuaaaggauacaguuuggaggucguuggugcacucacagggcugggcagcaucaccacucauuccggagcaucucauugucccagaggaagcucugucccccucagcaguugcucuucauccugucccccacaccccaaaaccaggcaucuccuuccugccucuguggacuggccuguccuggacaucucauagaaaugggaucgcgcacuguguggccuuuugugccuggagucucucacugaguggcccauccucagaguucauccacuccguggccugcgucagagccuugcuccauuucauggcugagucgcguucugcuguguguggugccgggcgaccugcuccccugcugaugggcgcucauguggccuccucucuggcuauugggagucgugcugcuguggacauuggugugcagguguugguguggacguuggugugcagguguugguguggacguuggugugcaggugcugguguggacguuggugugcagguguugguguggguguugguguggauguuggugugcagguguugguguggguguuggugugcaggugcugguguggguguugguguggguguuggugugcaggugcugguguggauguugguguggguguuggugugcacguauuggugugcagguguugguguggauguugguguggacauuggugugcagguguugguguggguguugguguggacguuggcgugcagguguugguguggguguuggugugcagguguugguguggacauuggugugcaggugcugguguggauguuggugugcaggugcugguguggacguuggugugcggguguuggugugcguguuggugugcagguguggguguugguguuggugugcagguguugguguggauguugguguggguguuggugugcacguauuggugugcagguguuggugugcagguauugguguggauguuggugugcagguguuggugugcggguguugguguggguguucguguggggguguugguguacagguguuuguguggacguuggugugcagguguuggcguggauguuggugugcagguguugguguggguguuggugugcagguggugugcagguguggguguugguguggguguuggugugcagguauugguguggacaguggugugcaggugcugguguggacguuggugugcaggugcugcuguggacggugugcagauguugguguggacguuggugugcaggugucggugugggugugcagguguuggugugcagguguuagugugcagguguugguguggauguugguguggguguuggugugcagguguuagugugcagguguuagugugcagguguugguguggauguuggugugcaggugcugcuguggacggugugcagguguugguguggacguuggugugcaggugucgguguggguguuggugugcagguguugguguggauguuggugugcagguguuagugugcagguguuagugugcagguguugguguggauguuggugugcagguguugguguggauguugguguggguguuggugugcagguguugguguggauauuggugugcagguguuagugugcagguguuguugauguugguguggguguugguguacagguguugguaugcagaugguguagauguuggugugcagguguugguguggguguuggugugcagguguugguguguagguguuggugugcaggugcugcuguggacaugcguuuuuguuucccuugggccgacacauggguguggaaucgcggguccaaggguacauucuguuuagccuucucaggaaucgccugcccgucuccacggcggcugcacccuucaacauucccaccagccgugcaugagggcugccucuggucuuggaaaagacucucggaauaguugcucacuuucuccauuucgacccuggagccgucgcuuggugcccagaggaagccaggccgcgggcgcugggggaagggggucccacugcagcugcaagucggccucuccuccugccugcuucccgugccucggcuguuggcuuauuugaguauugaaucguaaugguuucuuccuccuaaauagaaugcuagguuuccuuguucaggccucguaacuuuuccugaccuguaaaaaagcacaccuugaacacuucgcuuucugucugugcacacggauaggugucagcugggggcugauagaaaacaucccugacuggccgggugugguggcucacgccugucauaccagcacuuugggaggcugaggcaggcggaucaccugaggucaggaguucaagaccagccugguuaacauggugaaacuccgucucaacuaaaaauacaaaaauuagccggacgugguggcgugugccuacaaucccagcuacucgggggcugaggcaggagaauugcuugaaccugggggcagagguugcagugagcugagaucgcaccacugcacuccaccugggcgacagagugaaacugucucaaaaaaaaaaaaaaaagaaagaaaacaccccuggcugcaggcuucgggcggcccuguguccuccagcucuugggguggggccacucugacaucaugugcuguuuuggggagugucaugaccaggagggcaucuuuuguuuuuucuuuuaauuaaaacaaauacuaggcugggcauggcagcucaugccuguaaccccagcacuuugggaggccaaggcggguggccuugauugcuugaggccagaaguucaagaccagccugggcagcauggugagaccuggucucuacaaaacaaauacagaaaguacugggugugguggcauguaccuguggggcgggaggauggcuugagcccgggaguuccaggcugcagugagcugugauugugccaccgcacuccagccugggcgauacagcaagacccuguuucaaaaaauaaaauaaaaaacaaacacugaaggaaaagaguagauagagugcaggccuggcacagguuuuuuuuuuuuuuuuuuuugagacagucucgcucuguugccagacuggagugcaguggcgugaucuuggcucacuggaaccucugccccagguucaagcaauuuuccugccucagccucccgaguagcugggauuacaggagcgugccaccaugcccggcuaauuuuuguauuuuuuuaguagagacaggguuucacgguguuggccaggauggucuugaucuguugaccucgugaucugccugccucguccucccaaaguguugggauuacaggcgugagccaccauauccagccagauuuuuaauuuaagagacuuggcacgcauuuuuuguuugccucugucugcuuuccguaggcccccaagcaggggcaaugugugaucguccguuuguuuucuccucugcaguuuggggguccuuggguagaaggacugagcauugagcuuggaucaaacuguugguuuuauggacagagucaaguggcccggagguggugacuugggccauguuccuugugaggguuuugucuguggcucauucauucagcacaggcgggcccuguggccaggugcugauaguccuauguucccucugagaguguggcccuggucccucaucuccuggggaucagugguagggccaggccuggccccaggugcucugggucuugugccuguccuuccucacaccaccucucuuggguacguagggcacagggcacaggaccuccgcccgagggccaccgugcugagguguggcucacaucucguggcuucaucuugaggcugguccgucugcuugucucaccacacuuaggccugagugucugaagaaguaaugagcugcaaaccucaugaccuggaaaucccaccugucagagcccaggccucaggaggaggcaacugaggacauugggagugccagcaacuggagcccacuuccaccugccucacuuaggccacuggccacccccacggauggucccgggaguuagcucugugaccaugcgcggcuguuccugcuccaccucuuggagugccgccucugucuguugguguugcaggggagcuggguugggagagcucacucccuugucugauuuucuggaaacugugcuccugucugagugagcgcaggcagaggugcucaguuuacccgaggugugccgggcaggagugcucuccaggugggggggcuuggagggauguggggguugguacuuuuuuuuuuugaaguuuuaauuuguaguuuuuauggguacaagguaugcuuauuucuuugcaugguacauuucccacauggcagucgugguggacugaaugaugguccccauggauguccacaucuuaaucccuggaacccaugaauauauuaccuuaaaugacaaaagggacuuuucgcgggugggacugagugaaggacccugagcugggagaugacccuggaugaucuggggagcccgauguccucaccggguccucaugagaggaggcaggagggugagagucagagagaggcuggaagaggcugugcuguggcugcggagguggaggaagggccuugagcugagggaaccuggcacgcgcuggugcucucuggaguaggacgaagcagagaacguucucgugccaagguuuucucuuuccugccugagggcccuuuauguagaucagaccagagacaagugaaucccggucuugccaggggaggcauuuggagcugcucgugggacguggugaugcggugccaggccacaugcccggggcuggggccgaguggcguucucgugcugccucuguggccagguuucacuugggaaccuggcugcaucgcggguuccuccugggccuucugguggcuuggggcuccucuguccucggucccugcugggaaccgugcuuuggcagcaggaaccagcgagauggcagcacaggggcuggaggccggcugggacucacuggggccgcauggggcuucaccugaugcccagcccuccugggacagggaccagugggagcaggaggugggacaagaggacgagggcucgagggagcccccacacuuccuacccacagaggagggccugauacuuuucaaaaaccaugcacugucuuuuugaauuuuuuuuuuuuuuuuuuuuuuuuugagacagggucucacucugucccuggcuggaguacaguggugcagucugggcucacugcagccucgaucuccugugcucaaggaauccuccugccucagccucuaaguagcugggugugcaccaccacgccuggcugauuuuuaaauuuuuuguagagauggggucucgcuauguucaggcucauccugaacaucuagccccaagugaucacccaccuuggccucccacagugcuggggucacaggcgugagccccugccccuggccuucuuauuuuuaaaccgauucuuugucaucaguuucugcguguggccgcugagagccaucaccuggcuguuucuugggugucccuugcgcccacaccccugcauccugccccaccuucaaguucuuccaucccagaguggacucuggggucaaggagaguccucagaucuuggggacaugggcaguuguggggccuggggucauguggacaggaugccggcccagccccagcagugccagugcagguggggugaaggccugauggggucagccagacuguccccaccugaagcccccugccaagccccugcaucugaagacugaagagugaggguggcagcccgggaggguauccuugggcccagugugucagcgaucaggagagcagcccaggcuggagcgugcggcccugcucagccgggccggaagcgucccucacuuguuccucccccagguugcagaggagcuguccaggacagccgggguggggccgcccauaagaugcagcugcuggucccaugucauggucacagcaggagggcugaggagccaggccuggcccguggugugcagggucccuggaacaaacagcugcccuaaaaaaaaaaaaggcuuuaaggccaggugcaguggcucaugccuguaauuccagcacuuugggaggccgagguggguggaucaugaggucaggaguuggagaccagccugaccaacauggugaaaccucguccuacuaaaaauacaaaaauuagcuggacaugguggggagugccuguaaucccagcuacucagaaggcucaagcaggagaauugcuugaacccgggaaacggagguuucagugagcugagaucgcgccacugcacuucagccugacugacaagagcgagacuccgucucaaaaaacaaaaacaaaaaggcuuuauugagauacaauuugcgaaccauacaagucacccauuugaagcaugucauucagugguguguaguuuacucagaaggcugcucuugggccucaaaaugaguagaggggagaaagggacccuuuuuuuguuguuagagauuuugagagcuggguuggguuaagcggcuuucaugguaagcuggaggcccaagccugucuugagccccgaauaaagaagaaaccuagggguggggcgugguggcucacgccuauaaucccagcacuuugggaggccgagaugaggggaucgcuaagcccaggaguuugcccuggucucccagcuuccucugcggugccccagccaggagcagcuguagacucuguggaccguaugugaaaugaacccacaggguucccgugcuaaaaccauggagagucuucagguggggccagccgggccuuaaacuguguaucuaacugaguggggccugggguacccauggggguugcaugcccuggaagccagcccugccugccauccacuucccacagccagagagagcuuucuagaaauuucgguuggaucgugucuccuugcucugaaccaccugucggcuucccguccaaccccacaggagggcaggcuccuuccagcccagcccccagggcccacccuggucuagccucgauccugccgccuccucugcgcucccugccauccggccucuggggccuuagcucuucccuggcuucgcuggguccuucccuuugccuagacuuuccuccugcccuggaccgcccagaacuugcaccccugcguguuugacaaucacuuccagacgcagccccgcugccacccagaccucucuggucccaaaccaacuucauuugucuuuuuccuuuuuuuuaaauuuauuuauuuauuuuauuuuacuuauuaauuuuuuuugagacagaguuucacucguugcccaggcuggagugcaauggcacuaucucggcucaaugcaaccucugccuccuggguucaggcaguuguccugccucagucucccaaguagcugggauuacaggcgcaugccaccacacccagcuaauguuuguauuuuuaguagagaugggaguuucaccauguuggccaugucuugagccccgaauaaagaagaaacccagggacagggcgugguggcucacaccuauaaucccagcacuuugggaggccgaggugaggaucgcuaagcccaggaguuugcccuggucucccagcuuccucugcggucccccagccaggagcagcuguagaaucugcagacccuaugugugcggccucccaaagugcugggauuacaggcgugagccaccacgcccagccuuaaaauguuuuugagaugaucuggcucuguugccugggcuggaguguagugaugugaucacagcucacugcggccucaaacuccugagcucaaucgagugucccacuucagccucccagagcacugggaccacaggugugugcugcagugucuggccuucauuugucuucgaaacucuugcucgccccucugugacguuguuaauuaguagucuuccagauugggccccgucucgucccagaaccgaaacucugccuggcacgugguggggccugcacauuugcucagcggaggaggauucuggggcccuggguucccgaggcuggcaaguuggcucagagcugcccuugggaugggucagggugggguaggcugggggcagcacagagugggcacaaggcaguuuugugguuuugaaauugaguuuguaucaagagcuuuacugcuuuuguaaaaacuuacuggcaugguaccaagagaaauucaaacaauaguugguaauaaaaucccucccuaccccugcccugguguccccauaggagcugacugccgcccccuuucugcagcauuagcuauugucuagaaucuucuacaaggauggggcagggcggugggagcagggcccgagggucccaguuguugggaacuauguuggccuggcuccagccagcucacaccacggggcagccgaggccuccuuuggcccagcugaggccuucacggcaccccgaggcccagagucccgugagcgggagacagagaaaggggucuccaaggaagggugggccuggcagcagcacuaugagcagcggcaggugcagggugccaccaggcagaggccggcagaggcagaagccgguacgguugcccugcgucuguuuccacaucuguguauuugugccagggcugcuaaacaugcacagcaggcacuguggcgcccaccccaaaucacaggaaggaugugucucucugugaccgugaagcccaccaccacuccauaguguuggcucacacccggcuguuucccacgccuccccgcguguccccaagacaaaaggucugggaugaagcugccguuugcauggcuggggaugucuccuuguccucucucagcugagaagagugccaguuuccucucuucuuuugcgaguucaggagagcauuauucuuucuucuuuccaucauucuuccucccucccuuucuucucucucuuuucaguuuuuuuuuuuuuuuuugagacggaguuucucgucacccaggcuggagugcaauggcgcaaucuuggcucacugcaaccucugccucccggguucaagcaauucucuugccucagccuccugaguagcugggguuacaggcacccaccaccacacccggcuaauuuucauauuuuugaguagagaugggguucauggugcuggccaggcuggucacgaacuccugaccucaggcagucugcccaccuuggccucacaaagugcugggauuacaggcgugagccaccgcacccagccuucuuuuuaauuuuuuugcuaagagcuuuauuagauauaauuugcacacucauuuguucacccauuuaaaguguccaguuccacaguuuucaguauauucaaaaacuugugcaacuaucaucacaauuugauuuuuauucauuuacuuuuuagagacagggucuugcucuguugcccagaggcuggagugcaggggugcagucauagcucacugcagccucgaaauccuggccucaagugauacuccugccucagcuuuuugaguaguuggcaggcacgcaccaccaugccuggcuaauuuuuuauuuuaauuuuuaguagagauggggucucccuacguugccuaggcuggucucgaacuccugggcuagagcaccccucccgccucagccccccagaguucugggauuacaggugcgagccacugcacuggccacagucaguggagaacauuggcauccccuacagagaagcccuguagccugggguguaacacacggccuuuugugucuggcuucucucacugugauguccucaagguuccuccauguggcgccugugucagagccucguugcuuuucauggcugugucguauuccaccgcauggaugggccauguuguguugauucauucuucuguugguggacaccugggucguuuccaccuuuggcuguugggaauugugcuucugcagacgugguguacacguuucuguguggauggauguuuucauuucucuugggcagauacgcaggaguggaauugcugggucaagugugauuuaugugugacauuuccaggagcugccaagcugucuugcagagcagcugucccacgucaccguccugccagccuguguucgagggccccaauuucuccacaucccugcccacagugucaccgucugucauucugauucugccauccuggugggagugaggugguggcucauugugguucugauuugcauuucccuggugcugagugcugcugggcaccuuuucacgugcuuguuggccauuugucuacuuuggagagcugucugcccaaguccuuggccuguuuuuugcugguuuuuuagacaugguuucgcuccuguagcccaggcuggaaggcuggagugcaguggugcaaucuuggcucacugcaaccucugccuucccagcucaagcgauucuccugccucacccucccaaguagcugggaguacaggugcagaccgccacaccuggcuaauuuuuguauuuuuuauagagacggagucucacuauguugcuuaugcugaugucaaacuccuggccucaagugaucuuccugccuuggccucccaaagugcugggauuacaggcaugagccaccgcgcccaccagccuuggcccauuuuuacugggcuguuugucuuugccucugaguugagagccccauuccuuggcguggcgccguugugagcauguugcuguugccgggcagcuccucuggcucuuccagggugucugaugcccccgagucauccuguguccucugucugccacauuccuggugaccuggaaggucagucacaggacugcauuucaguaaauucccucuucccuguuuagcuguguugcacgugcgucaagguuauggcgcguggggauuguggaccauuuuaguuuucucuguaugauuuacuuccuaagcaugucauuuccaaaggcacaaauggcugggcaugauggcucaucccuguaaugccaauacuuugggaggccaaggcgggaggaucauuucaggccaggcguuuauuagcagccagggcaacauggcaagaccccgucucuacaaaaaguacaaaaauuagccaggugugguggcacacaccuguggucccagcuaguugggaggcugaggcgggaggauggcuugagcccaggagguugaggcugcagugaaccgugaccgugccacugcacuccagccugggcgacagagccagaugcugucucaaaaaacaauaguuucuuaaaaagugcaccaaguugccccuagggggcgguggugggugaagugccugagucccugugcugagaguggcucccggugucacggcuccaccuuccagauggaagggcugucugggucuccccagcguggguuuugaugcguaaccugccaugggcuuuugucaccugacacugcagggugugcugcuggcagcuguggccacgugcuuuccagacgagcccccgcaaccccacgagguguggggagccccccuuuuuauuauuuauuuauuuaucuauuuuuugagacaggaucacugucacccaggcuggagugcaguggcgcaaucacagcucacugaagccucgaccucccaggcuagagugauccuccugccucuaccucccauguagcugggaccacaggugugugccaccgugccuagcgcuuuccugucguacagagcacaaguuugaggcaucccuugggccguccagcccugccccaggcccuguccuuccugggcccagcuggucugggggacaugagaguguggcaggccccauacugcauaggucacccuguggccaguccuguggggcaggugggcuuugaugaccuggaggucagagccugcagaggggggugggccagccccucacaugacucuuacuugagggcuuccugggagcugauggcccuugcaguggguuacagggaggcaggaagaggccaugugugcaccggccugcagagaggcagccagggacaggggcugcugggugcacgagggucccagcgccuccaccagcugccaaagcgcagggggagacucaugcggucauggcagugcccuggcauagcaugcagcccagcugugugccguguggccuaggcccacaacugccccucgugggccucugugccuccucaauaagcucagucgaccaugucaucaucugugaugcacagagcagggccagggacccgggaagugcugauguggggaccacuguggccaccaccgcaucugggcacuguuuguggcagauccagggauggccucaggccuuuggcccggccucugagggcuggggaccaguaggaggccugaggugaccgcguucugccacccaguccucccagagggcugcccugacaggugccuuggcagcucccaucguggcuacuggcccagcucaggccggcacugagggucccacagugguccagcugcggccucugcucccucugagccgguggcucccuggggacagugcgcaggcccugggugaacacuacauggccacaucugggugagagcgggagggcaggugcagcguuggggggauccuggggccugugggguuggcggggucgcaggugaggauuggguacugggaccuggcugugggcgaggggcccgcugggacagugugguggccugggaggccccgcgcagucagaggcuggucucugggcacaggcagcucuggugacugugacaggugccuugccuugacacacacugugaccgucuagucuacauuucuaggcugcacguggucacgugccgugcacggugcacuuggggccuccugugcagacacuggcuuugcggcugccccaugggagaagcugcgaggacucugcacagagcaaggguggcgggcagggccucagcccacgugggcuuggagcugugcgguuuugucaaacccagugggggucucucagcagcagcccagcgcggggugugacgucagggcuggggcucagcgcuggguaucagcccugugugcugcaggcaggguaugggguggacccaaggcaguagguggaggccagggggcgaccucggcuuugcuuuugucaggauggaggguucuggacaccagugcaagccuagcuggggccucccugccguccugcucagauuccugggugcaugcugcccucuagugcccgcaguggggagugccuucaggagcggguggcugcaccuugguggcugggaaccccacucccgggacugucugggcggcucccugccuuguuuccuucacacucuagaucacuuugggggucacagcguggggagguggauuuuguuaaguuuuuucuaaguuuuuggguuuguguggacuuggguccuuguuuccgaauccuagagggauucugucgucuuucugccuuuggagauugaaccugccaaggaggacccuuccccagagucugugaucaaagucccuuccuggucggggugggcuaccaguucccacccugcaacaccugggacaggagggagccgcucccgcccgcagccuccguggagaggacagucugacuccgauguuuccaggcgggugccgucagugaaucacuuggccuggugcaaucccccauucuguacagggcuggugggcugguuuaugacccgcgugacucugggcagcuaugauggcaggaaaugagccgucuugggcgggccugcugcucuccugggucaagguuccugcuagggccugaguucugcuggcagcagccagccagccccccgugacccacaggccugcuccgaggggugggucccccugcccuugagcgugugacccucacccauggccgcccucaccuucgaaaacccgcagaugccgcggucucucgugcggaucaggcucagagcagagagacugaugugcagcggacgcugacacaccuguggcgucccugauacguaaaccuuucucuccgaggccccgcuuaaaauuagcgcacuggcucccggugucgccucggccuuagaaacuaggacgccucugcuucucguuagcugcagcccucgugccuuuuaugcucagcagagugacgaggccgcucgugguuuucucuucugcccucacucagccgcgagggcccagccgccuuuguccuccugguggccacgguauuuuuagcacgcuccguucugagggaggacgggcuccaagggcugggcauggcggcaccgcugguucacccucucucgucuuccuccacaggugugcuucccgcacagcugcagccauggggucugaggaccacggcgcccagaaccccagcuguaaaaucaugacguuucgcccaaccauggaagaauuuaaagacuucaacaaauacguggccuacauagagucgcagggagcccaccgggcgggccuggccaaggugggugacauccuggccccagcgcggcccuccaucagccugcgccgcgggccugcggacauccugggucccagcucagccagccccacaggcguggccugugcacguggaauguguuucggggccacucccagcucguuuaccagcgccuguuuguggaguuccaacaaugugccaggcaccauucuaggcacuggaguugagaaguggccggugcaggcccuggcuccagggagcuggcaggggguggugaggacacacagccacacugcagugaagcccaggggcagugggccaccagguuguucuggccgugagcugacgucucacugagggacgccuuccagggguguucagugcccaggaaggccuuacuuuccuaguaaaacuuuuuuuuuuuaagcuggguaugguggugcaugccuguggucccagcuauuugggagggugaggcaggaggauugcuugagcccaggaauuagaggcugcaaugagcuaugaccgugcuacugcgcuccugccccggcagcagagcaagacccugucucaaaaaccaagucagaccacaccagaaacaaucuuuuugagauggcagagugacugggucaggaaaacucaaacagggcgacagcgcagguacauagugaccaggagccuccucccugucccgacccagucccccacccucucccuggaagcagcacuguuauugguucuucucucucucucucucggcauauugugcacgcguguacgugaauacacacagcagacccccgaaccccacaugcugaguauguacaguaccauucugcucgucugggcaugguggcccaggccuguaaucccagcauuuugggaggcugaggcagggggauugcuugaggccaggaguucaagaccaagcuggccaacacagugagaucccaucucuacuaaaaauacaaaaaugagccaggcgugguguugguacaugucuguggucccagcuacucgggaggcugaggcgggaggaucacuugagccagggagguugaggcugcagugagcugagauugcaccacugcacuccagccuggacgacagaggaagauucugucucacaaaacaaaacaaacuuaaaaguuggugcugcacguuucacggcucugaagguggcugccgugguccgugagucucuguguucgggugugggccuguucgagcagugcucaccccucaguuuggaagaugaaucgucguugcauuuuggguucuuccaguugccugcuguuugacuaucgcuguucuuccucaguuaggccagggguuggcgggcagucucuacacacggccagagggugaacgccuaggcucugugagccagaaagagcaaccagacgccgugugaaugaaagugcacggcccugugccaauacaacauuauuccuggaugcuggagggcaaacgcguauuguuuucacgucuucugcuuuuuucuuuucccccaaccacuuaaaaaugaaaacaaacaaacaaaagccuucauaacucaaaggcuauacagaagcaggaaggggcugauucggcccgagggccgcaguuugcugagcgcugaggccuccugccuuuccgggccgccuccacccugccccucccuccacucccugguuuugguggauuuugucaguagccuucgucucucuccuagugauccuucgguaucagacucgcauuguuauuucuuugucucugagcuguagagcgagggaagcagucucgcaccaucuuuucuuccccuccaagauggauguuuuuucuguuuugagagggggucuggcucugucgcccaggcuggggugcuggggugcagugcugcgaucacggcucacugcagccuugaccuccugggcucaagcaguccuccagccucagcuucccgaguagcugggaccacaggugugcaccaccaagcuggauuuuugauuguaacacaccaugacgaugugggaaugauggcacaucuguguccgggucagaacggugggggcugcugccgucccggcuucaguucugucuuuaaaaggcuuugguccuccuaucucaucucagaccgucuucucuggcccucuaggccacaggcugcuaucccaggaaaggcccagguccuccucuuccuccucucccuggugcacauagggcaggugggacaggcgucgccucccuuuauccuggcaccgcaucugccucugucuccugcccuugaccuacuuccacauuucccaggaugcagcagcccuuucuggcuugggauccaaggcguccugaugucaggacguugaggggaaucagcaucucagaccgcccugcgcucuuccgaggugccuuuaaaugcccgccccgucacuucuuccucaucccucaccucccaccgggcuccaugccccgguguuuccggcucucucugcccuccacguggcggccuugggugcagccuggguucccggguggccuguccucccccgcgcuggcaccuccgcuucgucccucccucccucugccuccuuggcugccgccucuuugagcccucaugucgcugcuucagguuucugcacuccccccaggccaguucccccgagauucuuggcaccggcgucuuaagccaguguggggaguaugguuucccugccuugcguucugcguguuccuucccaugccucugcagcggcagcucccaugcugcuucuccuugcaccagugcagagaauccuuucucaaacccguggagggggcugggcaguagggggccguccgggucccaugcuguggaggggcugugugugcacgugucucugugugugugugugugugcgcgcgcgcgcgcgccugcgcgcacaggagacugagguggggaggcagcucucacacagcccagagagcuuggcagcugcagagucacguuggcacccgcauguggcacacgcacacccccuucugcagcucuguggggacagaugggcucagggaagcaucugcucuggcccugggcagcccugcgucuuccaaauggggggcccuuggcucggggcagccagccucuuuggagaaggagcacagugcccugcugguucugagcgagcuguggggguguuggggucccccucucacccuggucugccugccuugaccacugugugugugcgugcauguauguguguggugggggagcuggggguuuccugguuccaucaaaacuguguuugguuauacaucgccccugcccccagcagagaucugcaggcccgauggagcucggugggggcgggagcugcgggcacagcccugagagggcccuggagcuggcggugcccugggugcaggaagccuuccacuggaguugcugggcccuccacacgggguguccccgaccacuugggaagcacugaggugagaggagcccuggaaggccccgucggggguccuguugggaggggugggaacuuccagugccccuccacccccaccagcugccucccaggcgggugccagcaggggaggcccuggcugcccucagcuauaccacccgccggcaucugccucucacuguuggcauguggccggucgccuuccuggccucagcugaaucuggccccccaggagccccgugugaggcacuuucaggggccgccggaggccuggaagacccgaguguggcaguaggaaugucccgagcggcuuucagugccuccuuuucaacccuccccgccuggagcccuccuucuggauuugcgucucggcagauugugggaugucacuucuguccucuuccgcccugcgggauuuucccagagccuucggguuugagcccagcuggaaguggcccucguucacgcugccugucagcaccugccugggcugugucaccuagaguguggcuccgugugugcggcgcagacaccguggggguguuuggagcuuccugcguggcucccagaugucuuuacuacacagugcccgccguggaagggacagaugagcaauguagcccgaggcguucuuucaagagcagaggaaucgggagcgaaguguuuuuguucauuuagcagacuaggaucaugggcgaguuuccucuaauagcacugaagaggcgaauucacggcuuccccucggccagcggcuuuggcguggauuuggagccgggccagguucauggaacccuccugcagaagcagacuggggcuuccuggagaggggggacagugucugugugauucagagcagugcuggccugugggucucugaccauaccacucaguucucuguaguaacaucucgugucugggacacaggcccuuuuguuucuguuucucgccuuuccacuccucaaugucuucgugucucacugacucuucagcugcuccccugaaaucuaagagaacggcagccccgcagcugccccagcacccugccaucacacagccugugccagggacaggugccccaggcgccuuuugcacuguggccauaguggacauggagagucuccagaaagagccggcgcuaagcuggacuguccuuuccuugggaccggccucaucuugguuuaacucuaaauuaguguuucucuucgcuuggcacuguggacuuggggccgcaucguucucugggguggcgccauccugggcauugcagggugcugagcagcuucccuggccuccaucuaccucaugccaggagcacccucagucgugaaagccacagacauccccagacauggccagguguccccugggggacaagacccccccucaguugagagccaccugcucgcugcggcugcugcugcuguuacugcuuuugcuaaagaaaccugugcaugccggccacggaggcagcaccuuccugucguuaacaggcaccuggaggauaaguguuuucauugccaagcaaaacaguuucuucacugaugugaucgcuggguccuuggggacaguaaauggauuuuagccguucuggaagcugccagcgaugcaggcgucaacacacagcucuucccuugguggcccggggcgcggaggggcagcuugccagauuccuggcagaugagccgaagcggguggguuaguuccuucucccugugcaguggguggcccggucgacuccuggaaggaggcguggggccugcagugcccaccccaggacuggguguggcagccccggagcggcugggagggccugcacagaagggugccuggcacccagaaggcccguggugcccaccggcagucuagaaucuggucuugucggcccauaggcucacccccaccagaggagggaacaugaggcuggggacaaggccaggagcccagggugaggcguguacuccggauagcccuggucccucagcuccuggaugucuccagaaagagccggcgcuaaccuggacuguccuuuccuugggaccagccuugucucgguuuaacucuaaauuagugaaggcaccggguuccggcugcagugccgccucugacaggugcugguccuugucuuccucugcugucuucuccgcguguuccagugucugagguggcccaggaccucucugggguggaaguccacguggccgccaggcuagagguccugggccauagucugucugcucaccccagggugccccgggcuguguuguggaucgcugugugccucaguuucuucagcggucagaugggagcucugccauuccucccacccaggagaugggugcgcugggccccagcacgcucugcacagugcccagcuccgcacagcuccuguccugccucacggccccugucccauguggugcugucacccucccugcgccugcacuuccuguuggcucacuccaggcggggcggaggcccaugggggcuggaucuguuucccaguguuuccuagcuccuagaacuuggguugccccauagugggucucagccaaguggagccacuggggauagugucugggcuccaaccccuguucuccaggugcauguggccccuggugggcucuugguagccagugggugcaguucucacuuccugcugccagagggcauugugagcugcagcgcuuaugaccaagcaugaagauucccguuuugaaaaaugccuuaccagggcgcaguggcucacaucugugaucccagcacuuugggaggcugagacaggagaaucacuugaggccaggaguuugagaccagccugugcaacaaaaugagacuccaucucuagagaaaauuaaaauuuuuuaaaaaaauuagcugggcaugguggugcaagucugugguccccacuacucgggaggcugaggugggaggaucacgugaguccaggaguuggaggcugcagugagcuaugauugugccacugcaguccagccugagugacagcaagacccugucucaacaacaacaacaacaaaugccucaaaauacgagucucugagccucaagaugccagaacacacacacgcccagugccaccuauguuugcugagucuaauccugcacacacgugucaggguuggcccuggugcugggggggugcuguacccagcuucccaggccuggaggauggcucugcccuagcaggugaggcccuuguuggcugcagagucuucuggggaguuugauaaggcaaauggggggguuccucgugccccuggggggugucccgaggugcagaucuuggggggugcuggucucuggggagccgguggcacagucugcucucuggcccugcccugagggucugagggugccacugacucccaucuuggucuugcagaucauccccccgaaggaguggaagccgcggcagacguaugaugacaucgacgacguggugaucccggcgcccauccagcagguggugacgggccagucgggccucuucacgcaguacaauauccagaagaaggccaugacagugggcgaguaccgccgccuggccaacagcgagaaguacgcggggcgggcagggcggaccugacccccgcccccgggggcacaccugcucaugggggcccugggggcagagaaggugcgguacacgcagcccccacagcauggccggccugcucugugugccccgugugggcuguggcgaccccugcucccaggguggaucuggacccucucccggccugggcugacccacaccgcccucaucucaguuucccagggcuucccagugcaugucgggcgguguccugguccccggccugggagcacguccuccacacccuccugugacaccugggcuuguggccccuccucagagagggcucccuggcuccacacggguacaugcacaggcacacaggagggcacagacacagaacacacgagggcacauguaacacacauggguacacagggcacacgcacguccauacacaggcacacacggguacacauggcacacgcacguuucuacacagggacacacaggcucaugcacagguacacaggcacauccaugugggcacaccuaugggcgccuacccagguacacauggcaccugcguguaccggcaguguuccgaguacagcucccugguucagcaggcacagccacguagccuccgugcugcgcaggccugucccgucgccgugcccuccucucugucuguggccuccacccugucuguggccuccacccuguugcucucugagguucacgugccuuguggcucuggcaccagagcagagccuggucuguccugcucacccggccuucccagcccccuagucugucgucugagcucagucuuugccacacagggaugacaagagccucccagggccucuguccccugcccacucccccuggcguguguucugaugugggugccccgggccaggauaacugaggagggguacguggguuugggccacugcucgcccguggaagugcgcugucccacccggaagcagguugcgugguacccuaggcggggcagcgggcagucggagcagagccccucccgccucuuucaugggugcccuggguuccagguggcugagggugggcugcguagcacccaggccucacccugagcugguuuugggguguuuguucaccagguacuguaccccgcggcaccaggacuuugaugaccuugaacgcaaauacuggaagaaccucaccuuugucuccccgaucuacggggcugacaucagcggcucuuuguaugaugacguaaguaugaggcuccggggaagaacagggaccagcuuccuggugggugguggugggagggcccugaacgggacucugccuuggcagaugaagcuuccaggcaggcaagguuaacccccucgcccaggcucuggaugcgggccucgcccuguggugacgaaagaggaagccaggcuuucucugauuuuugcagggccccuccugccucacccugcagcccccacccugagcucacccuggccccaccucuggccucagcagccggcccacagcguguuacaaacacguguacuuucccagucccugccgcucgucuuccuggcacuguggagccucgaguccucagcccgccaggccaccugcuggauucggcuccaacccgguccugacuugggcucagggcccggagacacuggggugaggggaucucccaucccgagccuggucugcuggagcguccucuuguccacacagccugggcucuccaugagggcagcuggccggcauccccagagucccagccucaggcauaaggucccccaggccccgcuggacgccagaagugggccugcguggcggguguguguggaacagcagcaggaagcugugacugcccugaggccacggccagccuuggcucugcccugcuuaguggaccuugucugcgcuguggcccgcaggggacuggguuugcucucugagccgagggcgccgguuuaugacacggaggauucuguucaggcuggaagugagcccgcccuggagaaccugagggagacgcccccgacauggagccaggcauaagccagccuugcuuccggccccaccagaagcaaacaugagaccagaguauuucgaauuugagauuuucuuuuuuugaauauuugcauauacauccugagauaucuuggagaugggcccuaagucuggauuagucuguucuugcacugcuauaaagaaauaacugaggcugggcgugguggcugacgccugaaucccagcacuuugggagacugaggugggcagaucacuugaggucaggaguucaagaccagcuuggccaacauggcaaaaccugucucuacuaaaaauacaaaacuuagcugggcaugguggugugugccuguaaucccggcuacucgggaggcugaggcaggagaaucgcuugaacccgggagguggagguugcagugagccaagaucgcgccacugccccgcagccugggcaaaaaugagacuacgucacaagaaaaaaaaaaaaaaagaaggaaacaaacaccugagacuggguagugaauaaagaaaagguuuaauugguucacguuuuugcaggcucugcaagaaacauggcuugggaggccucaggaaacuuagagucguggcaaaggugaaggaggagcugauccaucuuacacagcaggagagagugagggggggggcgccguaggcuuuucaacagccagguuucgcgagcacucacugcccugaggacagcaccgcggggauggcgcugaaccauucaggagacaugagcaauccacccacggugcagccaccucccacccggccccaccgccgacaccgggaccugcaguuccacagacucaagucuaaacacaaaauucaucuguauuucgcguacacuuuacacacguagcuugaagauaacuuuacacaaaguuuuuaauaauuuugugcacgaagcgaaguuuugacugugucuuaacugugaccggucacaugaggucagcugugaaaguuuucacuuguggcgucguuaucgguacucagaacauuugggaccuuggagcuuuuuggguuuuggauuuuuggagcgggggugucccccuuaucccgcacggcguuuaucggagugggguguccaccuugucccgagugguguuuaucggaguggggguguccaccuuaucccgcgugguguuuauuggagugggguguccaccuuaucccacucuguguuuaucggagugggguguccaccuuaucccgugcuguguuuaucggaguggggguguccaccuuaucccgugcuguguuuaucggagugggguguccaccuuauccugcgcagcauuuaucggaguggggguguccaccuuaucccgcgugguguuuaucggaguggggggguccaccguauccugcgugguguuuaucggaguggggugucaaccuuaucccgcgcuguguuuaucggaguggggguguccaccuuaucccgugcuguguuuaucggaguggggguguccaccauauccuacgugguguuuaucggagugggguguccaucauauccugugugguguuuaucagaguggggguguccaccauauccugcgugggguuuaucagagugggguguccaccauauccugcgugguguuuaucggaguggggguguccaccguauccugcgugguguuuaucggagugcaguguccgccauauccugcgugguguuuaucggaguggggguguccacuguaucccgcguggugguuaucggagugggguguccaccuuaucccgcgugguguuuaucagagugggguguccaccuuaucccacucuguguuuaucggagugggguguccaccuuaucccgugcuguguuuaucggaguggggguguccaccuuaucccgcgugguguuuaucggaguggggguguccacuguaucccgcguggugguuaucggaguggggguguccaccuuaucccgcgugguguuuaucggagugggguguccaccuuaucccacgcgguguuuaucggaguggggguguccaccuuaucccgcgugguguuuaucggaguggggguguccaccuuaucccgcgugguguuuaucggagugggguguccaccuuaucccacgcgguguuuaucggagugggguguccaccuuaucccacgcgguguuuaucggaguggggguguccaccuuaucccgcgugguguuuaucggagugggguguccaccuuaucccgcgugguguuuaucggagugggguguccaccuuaucccacgcgguguuuaucggaguggggguguccaccuuaucccgcgugguguuuaucggagugggguguccaccuuaucccgcgugguguuuaucggagugggguguccaccuuaucccacgcgguguuuaucggaguggggguguccaccuuaucccgcgcaguguugaucaguucauccgcugacggacauuugggcuguguucucuuuuuggcuauuuugaauaauggugcugugaacguuucuuguguguuuguuucuuugucuuugagacagagucuugcucugucaccuaggcugcagugcaguggcgcaaucucagcucucugcaaccuugccuccuggguucaagcgauucuccugccucagccucccgaguagcugggauuacagugucacauggagucaucccaccacucuaaugauccccugagcucccccucgucauuccucccucucccccaucccucuccugcgccccaggcaaccacugaugucucacugucuccauagcucagccuuuuccagaaugccgugagcuggaauccuacagucgguagccuuuucccauuggccucuuugaccaagcaauagguguucaaguuugcuccauuuuucauggcuugagagcucauuucuuuucagcgcugaauaauacuccaugguccgggugcaccacagugugccugcucauucaccuauuaaaggacccuuccaaguuuggucaaugugggcagaaguuuucaucuccuuuggguaaauaccaaggaguacaguugcuggaccacguggugagaggacguuuaguuuuuuaagacgccaccaaacuguccucccgcccaccugucccacugugugcuccuagcagcagcgaaugaacguucccagggccccgcuuccccgcccccaucuggaguugucgguguugugcauccuggccacccugggaggcguguugcgcugucucauugccauuucaaucugcauucccccgauggcugccuucgcggcggggccccuuugcaugccuguuugccaucuguguguuuccuuggugagcucucuucaugucuuuugcccaguuuguuguuguuguuguuguuguuugagauggagucucgcucuguugcccagguuggagugcaguggcgugaucuaggcucacugcaaccuccacuuccuggguucaaucauuucugugccucagcuucccaaguagcugggauuacauuacaggcgcccaccaccacacccagcuaauuuucuuucuuuuuuuuuuuuugagauggagucuugcucugucaccaggcuggaacuacggugcccaccaccacgcccagcuaauuuuugaauuuuuaguagcgaugggguuucaccauguuggccaggauggucucaaucucuugacuucgugaucugcccgccuuggccucccaaagugccgggauuuacaggcaugagccaccauguccagccuaauuuuuguauuuuuaguagagacgagguguugucauguuggccaggcuggucucaagcuccugaccucaggugauccaccugccuuggccucccaaagugcugggauuacaggcgugagcuaccgcgccuggccaucuuuuucuguuuuuuaaccaugcuguuuguuuucuucugguuaaauuugagaguuugcuguguauuuugguuaucaguugugacuugcaaguauuuucuuucugacuggggcuugucuuucucuuacggauccugccugauuguuuucaagugaaaguucagccucagacuccagugcaugagagccucuggguuggcuggccugcacugccugcacuuggccuguagugaugacccgggagggacucugcagccgcacgcaggcugugccagcccaggccgaccugccacaggugccaggggaagcuucagggcuuccuugccauguguuugccaugccuagccuaugcacuagccuacuuuuacagcgggggaaacagcccacagcagagaagcgacuugcuguggucccaggaugaauuugcgcccagcucagccugugccuggggccucccucugccccaucugggucucaucacugccucccuccucaccucuucugggcuccugccagggcucaccuugcaaaggaaccgcuggucuugccaagucugagggccggucgugcaggugcaggaacagcuggugggggguggauucaggcugugagagcagcucacguucaugugugucugggcuccucucggccucucagcaggccaugagccucuccggggacugcagugacuaauguguauuuuaugagcucuugggacaggacgggguuuguuugcuuguggcauuaagaauagaugugccugguggguggggauuccguccuuguuugccuaguucugaaaacugucuucgucuccucggucagaagcuguggaagggcugucacugggccuuggcuccgguaccaucgcuggguuagccccaaguggugacuguuuuucuccuuccgugucauugacuuagaggcguguuaauuaugcacucccaaacugcaggcuucacaacaaggccuccacccagcaggaagcacgcagcucaguggaaucugacaggcccugccugccuggugcacgcuggcaugugcgauggggcccuuccuggaagggccaagcuggcggugagcccuucagaaaaggugucugggcuggguauggcggcucaugccugcagccccagcgcuuggaggggccaaagugggagggaccauugagcccaggaguucgagaccagccugggcaacagagugagacuucaucucuacacagaaaaaaguaaaaauuagccaggugugguuucucacgccuauagccuauagucccagguacucaggagacugaggcuggaggauuaccugagccugggagguugaggcugcagugagcuaugauucugccacugcacuccagccugggcaagaaucucacacagguuaagaccagccccuggucugcaggguaugaccggccccugggggggccgcagauacugggguggaggaggaugggcagcgaccccugggacucuggggagaauuagccugcaccccagggcucgcagguucuggggguggccgggcgguugccgacgcugcucugccgccccacaggacguggcccaguggaacaucgggagccuccggaccauccuggacaugguggagcgcgagugcggcaccaucaucgagggcgugaacacgcccuaccuguacuucggcauguggaagaccaccuucgccuggcacaccgaggacauggaccuguacagcaucaacuaccugcacuuuggggagccuaaguccuggugagugucugcacuggcccugccgccggccggaccgagagccccucgggagggagucaaucccggguacacggcugggcgccguggcaggggccccaccaggugaggccgcaaaggucggccuaugacggcuggagaucuuccggaccgccuggggucacccaccagcuuuggggugggggaugugcacccccagagccgaagcucccaggccccuagagcuugcgcuuuguaccccggagugccccccauugagcugugagcggccccagguguccccauggccaggagcguggucuugagccuccugagcugcccaggcugugcugccucacagccaaguggagacguuccuggugaagggacacuguccaugcugcccagaggggccuggccaggaugacccugcagccgcucccucgcagucuccgcccuggcacgucugggccaggcccuacaguuaggagggcagggcguggcgcugcaggccugugugcagugugguggaccugccccugcccgggaggugccgggugcagcgugggcgcugcuguggcgggcugaguuccaggaccuucuccuggcucccugugcacgucgcagcgaggccgugugggggugugugugaaugugcacgugugcgcgcgcaugugagugcgcacgugagugagugugaguaugcaugcgugugugugccccugugucaccgggcucugcuugugacugcggaaccugcugggugcuccgcggggcugcccugcacuguccuccaagggccgcuagguggcgcucccgcccuucccggggccgcgcucaugccuggaaucuucccaggccguccucgcgcuggaggaggacggagccuuugccuggagggcgugggagcuccgccuugccuggcccuucccuggguuggaguuguaagcggggagaggggggggcgggggagaaugcuguaccucuucguuaaaaaaaagcacaaugagcaggaaggggcgagcugugcgcauccucaccugcguccgaagcgcagauggagcccaagggaaaggcccuguagaggaccccgugugacuuggggcaaagcguggccucccaggggugcgugggcagcgggacgcccauggugugaccggguuugugccuccauagggaccgucugcccugugcagagagccccuguggggcgggaaguggcgagcagccggcaaggaggcccagccagacagaagcaggggggucagggacaugggaggugggggaccagccagugagucagacgugaggacuucagugccaaggacugcagugccagcagcucggucuccugugaggggccccggggguugcuggcugucgugggagccugggcugggggagacccuggggcuggggcugcuaugggucagaugccagggccgggggugccugcugcuaggucagaggggccucugcgggaggaggcgacaguggcucccuggaggcggcaguggggcccggccacaggccgucggagggacugacagggaugcgccaggagccgagggccucuccugagcugguucauccaggacgcagccucugagggcaucccgcaccucuccccgaaugccccucacugcaccccuccucugcuucgccuggugccgcaggcguccagcugccacucccaugucuacccuuccccaugacccgucgugggagauggcucaggggagacagcuggggcggggcagcguugaguaggcaacaguucuuucgggaagggaauuccggaagcgcccugaccuuggucuugguuuuugcccaggaagggguggggauggcagggguggggccuggcaugaggggccugagaggagccacaguguaggcucuagcugcagggcaugcccucaaccccccagagcuccccacucgcccccacagucagcucagccugcuuagcacgcagggccccuucccugcucucucaccagggcugaggcggggccccagauguucccacgacaccccaugccugcgacaggcauagaccaggugaccccagcauuagccaacgucuacuacgggcuaucaguccuccccagcagaugguaggggcccuggucaccccgugucccagcucccagcaggggccuggcacagagaggcuuggugacuugccggagccucuuggauccucacugugugcugugggagcugacuaccccuccaggcugcccucccaacuugcagggggguggggacaagguaacuggaaagagugucuggccucuggucccugggcugggguucaggaagcuacucaggccccugggagaugcuuccccccucucccuuccucgggcccuugggguagguagggcucccagccaagagaucaccaaggcugcgccccgucugucucccucauuacacuguuccgcuugcaucugcagccgcuuaauugcaaccauuucagaguauuccagugggauuuuaaagaaagugucaauguacucagguuuacagcauuuuauuaaagcuuucugggucuguugcuacuuugguagcuugauuugugugucaaagugacgugaacagccuggugucaauaacaggcagaaacaugcuucaaaaggcuggcuucuguggugcucucaggcagcggggcuaagaauaucugaagagacugagcgccucaaaaucucuuuggcaaugcggauugaaaccagagccagcaccugcaacuuccccccgccaacuucccgcagccccuucugucacccaggccgggggggccggagugcagguggguguggggaggguccgagcuuuccacuugacccuguauuccagggucuuccuggguggggugguggccuggggucgguguccugaaggcugugccccauagaagccacugucccaggccacacuccuugccauagaucaagacucuccuggggccaggcgcggugguuugcgccuguaaucccagcacuuugggaggcugaggcgguuggaucaugaggucaggaaaucgagaccaucuuggcuaacacggugaaaccccgucucuacuaaaaauacaaaaaaugagccgggugugguggcaggugccuauaaucccagcuacucgggaggcugaggcaggagaauggugugaacccaggaggcggagcuugcagugagcggagaucacaccccugcacuccagccugggcgacagagugagacuccgucucaaaauaaauaaaaaauaaauaaauaaaaagacccuccuggaaccuggggugggggugguuuagccgagcugacccuccaaggccgguccugcggcuguuccccuccaggcauccccuccccaaccugcaccuguggcagccccugcagggcccacccuccugagccgcccgggccaggcacgaaacacaggcgucgccacgaggcugagcgcagugucgccagcagcaucacaugccacaugccccuagaagagaguuccaggccggggugggaggauguugggucucggccagcccugagagaguugcuggucccagggcacuucugggucauucggauugugcugugcaccccaaagaagagaguggaguggccauccccccucgagggcccuggcccacgcugccugggaaagugcccacuguucaguccugugcacccaugugccgggcugggaccuggccgaggcuucggguccccuuuugcccccaacccaucagacacccugcagggcaguguugggguguuuaggggacugugggccaccgccaagagcagaagcuuuggcucucacugcagcagggaagccagaugggggaucagcauguuccuggggcugcagggacucccgaggacgucgugagcugaugggacauggucagcugcuugcacuggcuccaaggcggcgagaggaaggcccuccugaggagugccgcggggccagcgcaggugcguggcagccacagaggccucugcucaggcuuagggaagggggugucccccagggucucugcagcuccgcuugucagaaggggggucauccugcacccaggugaagcccccaagagcagcggggcgaaggagcgcuugcccggacugcgaccuugaccugcccaugacccgcggcagucuggaaaucccccauugccccaggcaggaugggggucccccauggucucaucucuggcuguuuccucaggggaucgcuccgcccacccucuccugccucuguuuaccuuggacacacucagucuccggugcaggugugggaggugggggucucggagcuugugcucccgugaagggcacggagcccccaguugcucuuggccauccugggcugcuaugagccagacccuccugagugcugcggggagggcugcuggggaggccaggggagaggggauuaucagaagacuccaccagccucccuugaccuuuaaggagcugcaagccgagaauuuucccuuuugauucagcuacaccuugaguuuucucucuggcguuuucccucaugggaauuucacagcaucuuuucuucuugcugccagggaaacuugaguccuagcaggcauagccgucuuuugcuucaugggugucccuggaggugugcgugcaugugugugugugcaugggcgcaugugugcaccgaggaaccgugcuccagacacuggggguggggguggggaggguggggguggggaggguggguuccagggcugcaggggaccagcccgggcuuccugcccuguggccgcagguggguggaaggcagagccugggguggaugagucugucgcccacccaggccaagccaggcuguucuugggguggaggcugcgggccugcucccuuaccccucugcugcccgccuaacugccccucaggaccucccuggcccacccgccucccagcuccaucuccugcuggcagcuccugccugggggcagacaccucccucccuccugggcucccucagucuggcugcagguggcacugucgggccccacaauggccucugcccugucccuuggagugggacccaggagucuggugggugauggagcuggcgagcccgucccaggcagcagccugaaggcccaugggguagcgcgcuggcgcccggggacccugguguggguuuguacugcugcugcuggcgagccaaccacugggacuuccagcuucugagcccgggacccggggggucccaccagcaguggggaccuagggucccagucuacugaccguaaggcauggccccccucagugaccuggggcauuccucccagccgcuuugcucuggcugggccaccagagguuggguggccgcagagacagcucuggcggagauuggugucccgacagggguggcguagccugagcugagcacuggguugaaauggaaauugccuggagccugacagcuucacagauugguuuuaauaacucagcuuccccacacugcacucugucaccagaacaagaugcaggagcgagauaguugcucccuccucuccuugccacccgaggcccaacccuggcgagggugccuagggacagggcugcauuggcagcucagagccgcugcggugcccugggaggucagacugagaagacccaccagacugaugggggcagcccgaugcgugccucgcucccaggcaggggaccgcagccaggucucuucccagccacacacacugagccaggaugacagaaauagaaaaggaagaagcgguuuagaacagagagcucccacggagagcagaucagaccaguagggaggcagagggacccuggucauuagaaaaugauaaggugucaggagccaaggcagcuugcucagggcccagguuccugcccgccaaggccucagcacuuccucccuggcucacugagacccgcugcaguggccccagcccauggucccugggagccguauccuuguagagacagcugucuagccugcaugagguuaucuggggaggcucuugaugagggguguccccucucugcagaaggaaccucuuuuugagagaagacaguuguugucacaagcaagugaggcccccaggcccagugcccaggccagcugcuacgccugaguaguaguugccaccagcccagaccagccacuaccccccagcagcgcucagcaccagcccaggggcccagcgucccggcugacuggcucuggguccacauggguugcugcguggccaggcacaccuggugcccagcuucccuguuugaggagcguggccgugggcaggcaggaagcuccuucguggucaccugucccaauccucugcuucugauggcgacuguggccacagcaucagugcagcgguucuuuauuccugugcgugagugggccucagugaccagcucagcucuccuagcuuuauuuauuuuauuuuagaugaagucuugcucugucauccaggcuggagugcagucguaugaucacaccucacugcaaccuuaaccuccugggcucaggugauccucccccuucagccuccuaaauagcugggaccacaggcacgugcacaacuggcaaauuuuuaaauuuuuuguagagacggggucuccccguguugccugggcuggucucgaacuccugggaucaaaugaugcuccugccucagccucccaaaguauugggauugcaggugugagcccaacccuuucccaguuuuaaaacuggaagucccauauccuggaaccugcucagauccagugaacugugaugcugaguccccugagagagagagaaugugugugugugugugugugugugugugcgcgcgcaugcacaugcguacacauguacauguguuuguuagagaaacaagggucuccagucacauagucugucugggagggagucuggcccccugggacucugcccagaagacgagaccugggagucugcuggguaacugagaacuggacuuuacccacuuagcugcgagaacucgggccaggagcugagcugccagcagggcauugcagccguguggccuagagcguggcguguggcgcuggugccgugcuuggguaagugguccaggcugcggccaggagggccggcacaugggagcuaugaauggcagcuguguuuucccuggccugguccccuccccagcccucaucaucgagcccucugccucgcucuugucacuaccacucugucggccugacgccaucagcccaggccugcuuaucaagacuggggagugaacugagcaccagaagcuggcuuuggcguucaaaaaauuaacucgugaugcugcaaagaccuuugagccucacacuggggcguccacagcgaggcugggauugcaucucugcgccuggcguguggggcacaggugccagaaucacagcuucuccggcuggccugaucagccuccugccaaccucacucacguuaagcaauugcggcccgauugugcccccaggacaggcagggcucucagcugugucucgugaugguguccccaaggacugggagaacaccucucggccagggugaccgggaaacccggggcacaucggggcacucaccggggcucccaccguaccugucagugggaucugucccagcaggcuggcuccuggcucuugcugggagcuggcagggacagacacagacacacuugguguuuguucggggacugcagagcaauuuucauaucgccuuuugcugugugaaaaucgcacuccaagcucuccuccagagccgugccacugagcuggggacuuccgguguuuggauggucgauugcccugugugugucuggacagcaggcaccguugcccauggauuugggaaacuggcuucuuggugagcagagaugguggccgugaugggggccgggugggcaccccgcagcaggcgagugucaggcggugggcccgugaugggggcugggagggcgccccgcagcaggcgagugucgggugguggccgugauggggacugggaggacaccccacagcaggugaguguccugcaggucccucuucucauucuugucccaggcuugugcuuguguuuuucauccacuuuuuggugaagucuucucccccuuucucucucuuuaaauaggucuuuauuagaccuguuuuagauucacugaaaaagugggaagguaguaaccacagagaguuccccaccggguucccuguuaugagcauucuauaucaaugugguacacuugugaucauugaugggccaacacugaugcguuaugaacuaagauccauucuccagauuuccucugucuucccccguugucuuuucuguccccugaacccauccgggucccacgugauguugucccgucuccguagggcccugggcuauuacgguguguuugaugcccuggacaguguugaggagggcuggccagggaguuuauagaacguccccuaaucuguauguccccuaaucagcaugucugauguuuuucuugugguuagauuggggugauggguuuuagggaggaagaccacaggggcgaagggcccucccaucacauccuaccaagggucaaaggcgcagccaucagcgugaugucacugcugauguuggcccuggucacccggcuuggguguggauguccagugucuccacugcagaguggcacucccccgcuuuccaugcugucaucugugaaugucaggcccaccaggaucaucucccuuucuuucuuuuuuuuuuuuuuuuuugagauggagucuugcucuguugccuaggcuggagugcugugguguaaucucggcucacugcaaccuccaccucccagguucaagcgauucuccugccucagccucacgaguagcugagauuacaggugcgugcugccacauuuggcugauuuuuguauuuuuaggagagaugggguuucaccauguuggcuaggcuggucucgaauuccugaccucaggugaucugccugccuuggccucccaaagugcuggcguuacagacgugugucacugugcccagccaccucccuuucuuaagguuaacugauuugggaccuuuaucacaucuucgagacccucacggcagcagcacggggcaugugucacucgaggagugugggagcccuggggcggggaguccuggggugucuagagcccugggguggggacccuggggcggggaguccuggggcggggacgcuggggcggggaguccuggggcggggaguccuggggugucuagagcccugccugucccggggcuucccuuuuguaggcauuucuugcugugaaacaugauuugguacagaaacggacauaaagcauguaaguaccagauauauaugcgugugugugugugugugugugugugugugugugugugcgcgcgcgcgcguauguuagcaaaugacucuccggcuguccccuguguaccucgaugucaggacacggcccccaccugugccuccuuuucccagcccccucugcacacuguggugguggcuuccucccggcucugcuggcggcgcccuugccucuccccuuugccaggccgcgugugccuguggcccgggcagugaggcuguguguuggcugcauuggaaggucuuacaaaugggcugauuuccuugcguuucugcucaaugguguguguguaagauucauccgguugugugugguggcagugcacucauugucauggcugugaaauuccccacuguauggcuggacuuuagucgacuuuuuccauucugccguggacggacauuugggcuguuuccagcaugaggcuucugcgaaagaccuaucaucucuucaccugcugcucauguaagaaauucauuuugaucguaagccuugcuaucaguaacugugacuggggcugcauuuaugauguuccguuccucaugcagcagcuuugccuggaguaacccuuugacuugugccccuggcuccacguccuuguucacggacgaggcacagauugaagagacguccgaucugcccuugaagcgcugcccugugggaucaggagggcagcggguccugggagcaggugccaggacgaugugcagccuugaggacagggugugucccaauuggcgaggguggccugaacccgaaggugugggugaggaaggagccauuucuaauggagucaccauauuaagcccugcuuagccaaacuugaaggugacaguuuguugugggacauggagaugaugcagggaugcggggaccgaggccagcaugugugguguccaaggucgcccugggugcugcuguguaggugagggaagagggacugaugggcugcuuagggggccaugucugagggcagggcccaccacuucugcccacaccucauuggccagcacccagucacguggccacaccuugcaucaagggaggcugggaaauguagucugaccacauguccagcugggaaggggcaggugagacuucucuuuccugccaugugggugcugggugcccugcaggggcucagccaacagggucuugagguugaagagauggaucugcccaagcccugacggagugcucaugccugcucagggcccagcaugagcugcgucaggagcagaagccauugggaagggcuuuugguguggccgggcagccagacacuccacgcgcaacccccagagcagugccaggcccgggagcccuugggauggaggcagggagaauggggggcucugaggacugagggaggaggggagcccggugaggggaggaugggugaccagcucaggagcaggggcgggaagggggcauagaagcuuccuaagcaggggagcuacuacucuuggccauguuccaggaggauggaguggcuguaggagcaggcuuucgggccagggccuggguguggugggagccggggcuggcucuggacccugcaggggcugccuuagccucacgcugucugaccagccccugccucacgucgugugcugaguccugucugcggccccucgcucacccgcuggcuuggucuggcaggagcagauggccuucauuuuggagucuuuuguucaaagcgggcgcuucggguuggaguggcagugcacacgcuggcucgugucgcuugugaggcugcaggauuuuuguuuuagggagguaggagccaaacaaaccuggcgcccgcuuccaggcuguggcaugccaggcgagucaccggcauccugucccugcccaccgcuuuaagaaacuguuaguucuguuugaaaugucaucacugggcgugaauucccaucuucagauaaucccgccaggcgguguuuggaugaggaguuuauucaggcugugggggucugugcgugcccgcgggucccucccacugcagccggcgaggcuggcccugacccagagucgcccgcccacccagucuacguaggcauuagagguuuggguucugagcucagggccugguuuccauggcaaauuucucucccuucggcgaggcugcugccggcgggguucagcuccccagaagggagauggcagcaaaucugcgggaggagagucuucguuaucuuugcuuaaaaauugggcagcgcauggcuuccuccccuccacacucgccagcagcaggggacaggagcgcuggcugccuucugaugaaacggggcgggcgcaggauggggccgaugacagcgaugcuaauggcccucauucagcagccucccgccgagggcucgggccgcuuguucucccugaccugauugcgagccaagcagacuuaacccgugugugagccaaacccucccggagcuccagagcccagcccggguccccgaggcccagggagggacccagcauccugcggccucugcccguggugggcacaggcugagacuuaggucauaggaacaggagcgcguagccucauggccaucggccugugugugagacaguucaacucccgugcucuccaaagcuagucccaucauuacacgcgccauuuaggacgcuccaggccaucucggucaccaggggccuggcggucaccguguuuccucaugaggcucagugggugcugugugucugugggugccggugaugaaauaaauguaagcauagaggcaucagagcauuuuaauagaugggagccuccacagccugcagguauccagacgacguucugcacacagagacucagacucccaccagggccucacgccccacugccucuccgggaugccugcguguggcucacucccaccacgggcacaucagcccuggugcccagcuggccuucugcagagccuggugcuggagcagcuucucgaauucucugcugccuccuccccacagccuuccagggccucagagcugcugccaggccagcaccuccuugggcccguguugaggccccacggggcugggcucaugugggagcugaucuuggccgggugaucccucacugcucuggacaaaagggagccaugggccgggcaugguggcucacgccuguaaucccagcacuuugggaggccaaggugggcggaucaccugaggucggaguuugagaccagccuggcuaauguggugaaaccccgucucuauuaaaaauacaaaaauuagccggguguuguggugggugccuguagucccagcuacucgggaggcugagacaggagaauggcgugaacccgggagguggagguugcagugagccaagauugucccauccagccugggugacggaggaagacucugucuccaaaaaaaaaaaaaaaaaaaaaaaaaaaaaagggagccaugauuguucuccagcugcagucccugucucuucagacccucugugcucuuaggagacugucguuguucucuccuuuuuaaaccauccugugccuuuuaacagaauaaacggcaagggguccccacugaggucgaauaaugcuggaggagggccguggguccaggcauggugggggcugccuccugguuguugaugagcagaaauucaggccgguuugacggcaggcacgugagggagguugcugugugucaguggcccugugucccuggcacuguguccgaaccugacagccgccgcugugucacugggcaccugcccugcgcacccuccccugugacgggcacucucacagcuuuccuggcgaggcugagggaaaaacauggcaaacaacucgcacaugacuuugcguuuuuggccuugucauauaauaaaaguaauuugugggccuaaaauaaaucagggcuggggaucagaugccuccaaucuggccuuuaauugcaggcgugacauggcuugccucggcgagucugcuccuaauuaaagugggcuggcgguguaugaaguucgcacggauccucagggugcugacccagccccgguuccggagggccagugugacgacaccucguggcccaggagagcagggcgggccacccauggccaccgugccaggaauggggucuucuggcuggcccugcgagagccgagagcucugucuccuccgccugcugcuccgcuuugucgggcauuccugugggcggcucuccccaucccaggcuccccaucuucccugagccgaggcucccaggacucugcuggucuccugugugucucaauaaaaggucauuauuugaaaucauugucaccacugguuuaagauaccaaauuccaucaucucuugucccguaaaacgauccauuaaagauaaagccacugcagcucaauaaggcuguuuccugggaacaagccacccugcucccuggcagauccuaucucccaagcaaguauuaguaucugccacauaaaggagccccugugcuggggacaaaugagggagguggccuuuccccaggaugaggcuccaugaaagaagauuuuuccaguagaaacaggcagguuggcucaugccuguaauuccagagcuuugggcagcugaggccagaggauugcuugagccagccacuggagcucgagaacagccugggcaacauugcaagacuccaucucuacaaaaaaagaagaaaaaaucagcuggguguagggcgcacaccugucaucuuuuagcuacaugggaggcugaggagggaguauugcuugagccugggaauuugaggcugcagcaaagacccugucucuuaaaaaaaaaaaacaaaaaacaacaacaaaaaacaacaacaaaaaaaaacagaagaaagaaauaggguagcuuuccaucagauauuggaggaguucugucauugccuugggaggagccgugcagcccaggcugggcuccauuucugcagcgguggcaucugggggagcagggcuggccccgcagaaugccagggcuggagccuuccccauggggccugcaccugcucugggacucccguuucuccugugagucuuugcgaaagggucucacuccuccucuuccugcccucuguccgguccccuguaaucucucccucccagcaggcugcgguuggugacaucuccucucccucucucucagccaggauaugggaccucagugcucuuggcaguucccgggcugucuguguguccuggccuguggauccacucccuugccugugcaggcacuuuuucuaacaucuuuaucucuccagacugaccuguggggcagcugccuguccugggcgacccauccuccugggguggccaucgguagcaugccuuuccugcugcuggcgacuacgugaugagcucuggcaccugcccuuccucccguccguccccaugcgcuguugcagggguguggagggguuuuacccagggaggcacuggcuucccaggucagagccugugaguacagcaggcaagugcacuaccaggucuguguguggccuuguuuguggagagaauuccugcuccacccuagacgagggacagguuuacccuaguggguuuagaguguucuguuaauguucuuucugcuguagaggaaacccucuuuuuguugacuuuuuuuuuuaauuaaaaauucugccaccuugcugggcuguguuuaauucuauaguuuuaccaguuucuuuguuugcuuagauuuccuaaguagaaacuuauguuauaauuaaacuguuuuuuuuuuuuuuuuuuuuuuagagauagaguuucccucuguugccuagguuggagugcaguggugcagucauggcucacugcagccucaaccucuuggacuccagugauccuccugccucagcauucugaggagcugggaacacaggcaugcaccaucacgccuuacuuagacguuuauauuaugauuuuaagaaguuugucuuaucccuucugcuugguaaacccuuugucuuuuucuugauauaucacauuggcuagugucucuagugcagugugacgugugcugugaugaugggcagguuguguccucuccugccucgccaugaaggugguagugggagagucccugcuaguccugguugccugagaauuuuuguaccaaaugcuuuggaauuuuugauagauauuaauuuuuggaaugucuuugcaaccuuggagauaaacucuucuuggucuugcaauagccuacugugcuugacucacuaaugcuguauuuaggauuuuuacauccacgugggacuggcugaucauuuucuugcguguucuuuguuggugcugggguuucccauuuguucauuuauucauccauuuggaaaauaugccggauucagaaaacgagcucaguaacgucagauauucccuacugcuugccaaccauguguguacaugggcacugucccuuuagaugaaggucaucgggcaggauucauuaaaaccaccugggcuggugccuuuuccagagaggacaucugugaccuggucucuucaggguuucugguggggccuguguugacuugguggacacccugggcuccacagugcugaagauacucugaagagccaagugcaucuguggcacugagcccagcaacgcaggcagggaccguggcucucugguccuuguguccccagugcggugaauagguccucagguuccugugaacagcuuuguuuguggugcaguuuccauagcauacauagaaggcgcucagagaacuuggccauuuccguggacggaguuaacacggcgcagcacgguggccaccacacagaccugugugucccuggcccggucaccaugcggcucugaggagcagagcagaggagccacccuggcccggcucgucuuuagcuggcuccgggacugcaugucggcugaggggcucguguggauguggggcugagacagcagcucucuguugggucucgcaggaagcccacccuguagccggcuugcucuccuucccggccugugccagccacagggcagugcgccagagccaucuugcugggucacaggccggggccaccauagggcuuuguugcgaggguggcggucaccauggcuuuuccguucuguuugcaacuuggggucccgggggcgccacuggcguuuggaucugccguggcccuccugggcuugcguggguggcucacucugccagguggccucuguccaaccugacaccuggucucggguacuuccagcgugacgugcacgggcucugccucccucauucugugucugcgaugauagcgcauuaaauggcgaaggcccgucugcccaggccugugcagacacugugaaauuaacuuucucacccuccagcacgcauugggcugugccgacaucucugaagggcucuuggucggaccucugcucuuggcacacauuccucggcggcgggggugggggguagggaggagagcguuuucaucccuggcaccuaauugccgagagcuuccgcuggcaggagcugucaggcugggccguggguuggauuccaagugccacugucaccugggagaaagcuacacgaaucuuaaaaaaaccuuacacuaugaugucccguugccugguucagagccauccacagggaccaagcaagauggugccaggcaggggccacugccagaggugagggccacagaguccuggcuugagagccuccaaggagcccauuccgcuugcaguaggagggagagggcgcugggagucaccuggucgcucuggaagugccgcccagguagggagccuggggcagccggcaggugugguggggacauguguggccggcaccagcaucacaccccucauccagagacuuugccccgaucucggguuuucugccuggucugagaggcagcggcccugcugucauugccugcccauggcuggcaaaggcagaggcugugaggggacaggauauuggacccccaccuccuccgccucggguuccgaggucaggugcggugugcuuuggccguggcaggcggggucccugggggugcuggggcgucagccaggcaggcagugcccacaggcgaagcaggcagccccacugcgcagcgucaccuagcacaggaggggccacagcgccugcuuugcagagaccagugggggccacgcuuucauggagccacaugugggcccgccucaggcuggggcccugugggauggugcccagggguggccugggccgugugaccccaagcccgucugcucaccgucaucguagcuaagggcucccuggcaggucccagcugcccaggacggccuguguucccuuuccugacacacucauuuaauuuuuaacucaaaggcauuugcuuauuuauuuucauuguucuugauaauaauucuaagccauuagaggggaaaauuauauucaaaaaugcuguuucacacuuuauuuguuugaugauuuagagcgauagaaaauagcacauuugcuggcuuuuauagucugauaauuauucacauccaucaagccauuccgggggaauaaacaaaacaccaagaaauuacacuauuaauagcauccucugcgguggacagaaaacucuuuccggggccagcguggcggcgagaugacaguggccuguccgcuggcuggaggggagcgccugccugcagagaacgccuuugcuuucauucccugguuccggcuccagcuccggcuccggcucaugagcugcccgccauccauccccuccucugcacggccgggggcuucuggggcccauggcaaagguucgcccacccgucgccaggagccccuggggaauggcgcgagcagaagaagcaaggcugucggggccucgcagcaucccccgggcagcucugccgccagcccagacucaggccuggucucagcucgcuggcugagccugguggggcauccccacccucuggucucggugcugaaacagggacaugcggcucguugcugccuacguugggcccaguccuuggcugcaguccugaccucccgugugaccagugucucuggacaccagucagacucaugugugucaggccgcggggcucagccucaguugcucucugcuucugggucccagccccucgagagguggcccggcccccacucuugcccaguggguggcuuugaggcuuuuagcuuugccuuucuuggguggcaguaaaguguaacguuggugacauucacuacucaaaacaccucaaaguguaaaagagaagcugggaagguagaggguccgggggcugcccaccugcccgugcccacccacccacugccccugugccgggguguccuuccuucuggaucucauguccuuguuggcgccucacaugugucuccccaugggccuaggaggucacugugcugccucacaugugucuccccaugggccuaggagcuaguacacugcuggaccaucauuuuguuuguuaaccaucaugugaccucacgugucuuguguccccaacuccagaggggccacguccuagcauuugucucucccauuguuuuauuuucucacccacgcugcuuuggcuugcacaugacugacuuuccgaaaggguguccgaugccuggguuuguuucuugaccuccuggucaccaccacguauggcucucacggagcuuguggagccuucugcggccagcaccagacaccaaggguggcuaccagguauauggcuccagaucccgggcuggagaugcggagccgaguuucuaugacuuugugguuuacugucuuccagaaggacuuguguacagcauuccagaacagagggaguggguacggggggcagacagccagggcuuugagaacacggagauggagaccccgcugggggugcuguggacaguggugcagaggaguggcgaugcccggguccuggguccugggucccgcguccugcgucccggccgaugugaguccucagaccuccuaauagcauucgcccugauuuagaaccagauuccuccaggcaaggccaggggccugcagugggugcaccugagggaccugugcaggccaccccucccucccgaaggcuccccuggcagccuccucaacagugcugucuucagcccccgcccagacauaccccagggcaccugcuccgugcucggagagcuuagcuugcugcaagaguccuuguugcacugagcuaagucuccccacccccuuaacauuucugacucugcccucugaagccccguggcuguucugccuugcacagacccacgagauuccaggagucgcucuuccugcuugcuuugucuugaccucuucagcuucuuccagcaaucccugugcgcugggccgcagacccuccgcacccugccccuggcuuagggagagcugauggcugcagagggcuggccacacacagccccaguccuggggacgugcucugaagaugguagaagggagggacacguacaaugaccuggccuccagggcucuagagggugagagguggucagcccuugcggggucccggggagguugacagagucagaggacagagagcuggugugggggccuuugugucagcaggagguggugcuggcaugggggagggaggggagggagggaaugccaggggcuugugggcagggcccgugcaggucauggagccgguagcaucucagagcuggacagaggagguaggcugggagcaggcccgguuggggaccaguggccccugcacaggagccagagggccugggcagcugucuguccagaaagcaugcaagaccccgugccacccgggcacacagggcugucgugucuagaaagagaucuccuggggucacgggcaggcaaagcugauugauuuuggccgugaaguuugaccuugugauggaaaccgagcucccagggagugagacaaacugccuccccgugucaguggccaauaaaccugacuugguuuuacagccccgagaaauugcucacuaauagccagacagaugcucccccugccucgagcuuuagugaacaaacauuuccaaaccaaauagcugcuuuugccuuuuuuuuuuuuuuucccuccagagccaaggccaaaugucagggaugccccagcauggccccgagcagggacuaugaggagggggccgugcauucuucgcucuuugggggccugggcggaggacccugcugagacgccccucugggaggcccgaaggcucccugagucucuuguccuguggugacugugggucucugccgugcaucugcuucaguccgccaguuccauggcccgcccaccagugccgucgcaaccccguccuuuggacugggcuuuucaggacauccggagagccuuggugugagaagcaggccccgaggcuaccuucuggucccccguccugggguugguccccuaagcgaacgcaagcgugcuuucagcccuguguggacggagcguggcgccuccagccucacucaguucuguguguccuaagccguguccuggcacuuucucuuggaaacugagguuuuucuuccgccuguguccuuggggguggccgggaggcaggucugccagcaucaggucuucugguccccgaggccgucgcuggguuguuccgaguggcgggaggugcagcucgcuguugggcacuggcgguggcggagcccagaagucuccguggcugcccggccucuuguccaagaguccuuugugauuucugugggggcugcuccucugaacgcugggccugcgucccgcagucugugcuuucugauaacgccagagccacguuccaguguauuaaacuuuuaacauucgccagauucaauuaaucuuaucuuuacaacucccaauuacaggcaguaauuaaguggagcagcauuguaggcuggggauacggcauuaaucaucgcagccuuggagccauaaauuaguuccuucccguccccagcaucuucccagaaggagcagaguguuucauucccugugcggaggggucuuuaaucccacaaaggugcuuuggauugggauuaaaauuucucaucuuuauguaaaucauaaaagcccauuuaaaaaagaggaaugcaccccugucuagacaguggaagacucucugaggacgacagaguugaaggugcuggggucgccuuggcuggggacccugggagcaugcccagaaauuaauuauuuguguccuguuagauuagaggcuccgugauguucgccucuucucuggcuccugcccccuccuuauuuauuuuuauuuuuauuuuuauuuuuuuuaauuuuuugagacagagucuugcucuguugcccaggcuggagugccguggcgcaaucuugguucauugcaaccuccacuuccuggauucaagcaauucuccugccucagccaccugaguagcugggauuacaggcgccugccaccacgccuggcuaauuuuuguauuuuucguagaggcgggguuucaccauguuggucaggcuggucucaaacuucugaccucgugauccacccgccucggccucccaaagugcugggauuagacgugagccacugcacccggccuguuuguuuguuuguuuguuuguuuugagacagagucucacucucucgcccaggcuggagugcaguggcaccaucuuggcucacugcagccuuugccucccagguucaaaugauucuuuugcgucagccucccgaguagcugggauuacagccuccugaguagcugguauuuuguauuuuugguagaggagggguuucaccauguuggcuaggcuggucuugaacuccugaccucaggugaucugcccgccucagccucccaaagugcugggaugacaggcaugagccaccgcgccuggcuucuuuauuucauuaaaaaacaaaguggccuuucagcuggaaggggcuguaguggagcaggggccgucucccacccucugagcuuuuccuugucuugcuucugcccugggagggucucggggagagaccauaucauguguccucucaucugugugacuguucuagaacgggagcuguuggccuuguuacucuagaguuggggucgaggaugggacuugaccauccucagcuggcacucagcugugugcccucaagucccugaggcccuguccucguccccuucgcuuggaaauugagguuuuuguuuugccggaggccuugggagugggcugggugguguccccguuggcacuggggcuucucgcucccccucaaggcugcggcuccuggugcccacccucccugaugggaagagagucccaacaucgcaggucuccagcuucugguacggcaugagcgggaugccacccccacuucgcuucguguguuugcacacuuucaucuuaugucuuucuuauucaugauggagccuuggugaucuuucaaauguaaaauguguaaaaauaaaacuuacaaagucggugacaaaugcagcuuuucucauuuccaaagcugcuuuuucccuguuggcucccagugccgggaaagggugacgugggccuggagaccgugacgugggccuggagagcgggcuggcagcuccgggggccccagaugcuugcuguuccagacucggcccucccaggguccccucgccacccgcaguuccaauccaauacuuuuguuuuuugccuuuucagccuccucgagguggagugccgcuuaaccgggagcauccccacuccuggcuuucugagugugucacaagccaccgagccaugguccucacuccccgcuccuccaccugccccaccucgcuuccuuacggauuccguccugaaagcccccacccccggccauccccuccacacaguccugaccaugacuccacuuugcuucugcccugggcacugucugcgucuccccaaggcuggucccaccagggacacccccuugcguggcugccaccgaucuugccucugacgugccucccuucucucgcagguacgccaucccaccagagcacggcaagcgccuggagcggcuggccaucgguaggugccugcccugagggccccagggaccugggaccaggugggaggggccuguggguggggaagggcagcuggcgucccccgggcucugcugcggucuggguuuggguuuuggggaguggugacauucuuugagccauuacugugugauuuuuuccauuuccucccacccucguggucagauucacgcccuucugccgcgcaguuugucucuugugaaauucgcacagaaugcccagacgcuccuguuuuccaguuuucuuagcgcaaacuucuugggccuggucaaaggcugccagggcccagggagggcagccuguguucauuuuccucccaucaccugaccccacacugugcccuugcuaauucugagaaagccuaggaaaggagacaauucagccagcaguccgcuuaccugcgggggagcagacaugguggccgcacggcguuugcccuuguucugcugggacccaaccuggacaccuuuggcaaauguccucacuggugaugccaccagcucgcguucaugugcucccuggggacucuugggaaagaagggguuugucauagagggucccagcaugugccugagggagugccagauccucagguugugggauacuuggaaacaagucagacagcuggagacacccgggauggggccacccugagcuccccugaccacccagcccugaggcacuugggcaggguccccaugucagcgccggcaucacagcacaacaggggugcaaguuucaugacaccucacugcuccuaagugccuggagagucaugaaaagacacagcuggcuaaagcaguuccucccucccgcugguccauucccagcugcucaagagcuggcuccuccgcauuggcagguggacagcuuggggugcgugaggggugagggucagugagggcccguuguuccucugacagcauugagagggcccuguccgagcaccccgcccuucaaggacggcgucaggcagcucagcaagcgacagccacagcuuuuccaggagcucucacccagccucaguacaggcucccgggacugccugguugcuguccucugucccuuccaaaccuucgagccaaaggacgcccgccacaugcucucuucccccuucccaugggcuuuuggcuuuggagaugggaacugucagucuuucuagggaaauaagggucuccugucccagagacugcgccaggagucacguggcugugcaggaaauguugcccaagcgcggcagauucggugguggggacggaggggaagggaguccuuggggagugggcugggcccucuccuggcaugugcucuccuggcuucuggacugagggcuuugcucuugguauuuuugagcguuucuauuggaaaccuggaccccuuucuuaggcacaggugaauccuggucuuaggagcacgcuucugguaguagaaauucugcagucacagacaggccguagcaaagguccagcucacuuacauacuaaagcugugaaagaaaagcuagauuaaagcauuucucccauuguauguuuuuaauaccaauuuccaaaacaaauuugaagacauaagcuaaagaaacauuccccauguuguauuagcauccugaggcuccuguaacaaaugaccacagaauuaauggcugaaaacaacacacguuuauucucucaccguucuggaggucaggagucuaaaaugcauguuaaggggcuaaaacccaggugcaggcagggccaguuccaucuggaggcaccaggggagaacccacuucccgccuuuuccagugucuagaggccgcccgcauuccuuggcucggucccaggggagaacccguuucugccuucccuucuccagcaucuagaggccaccugcaucccuugacuugggccgcaucacuccagccucugucucuggucuccucacuuuccucugcuguaaccaacagucccucugccucgcuguucugaggacccauggaaugacaucggaucacccggauagccagggugcucccccaccucaagauccuuaacucgaucccaucugcaaagucccuuucagcauggaagguaccacacucacaggucccagggguuagcaugugggugccuuggaguuccauuuuucagccagccacacuuagaaagccacugaagaaaaccucacugagcggucagggagcaccugugggcuccuugucugcugcaggcaugacaccccacaccucugucguccacacggcaguaccucucuacugccacagggcaggggaugcaggcgcagccuggggagagccagcagccccgguggggagcaggcucuaggcuccgcagucuguacuggagcugggcuucacccaggcgggccccuccuggugcucucuggugcccagaucgagagggccaccccauccuugccagccacuucucccccuccauauuuaacugagacuacaguuagccacuguccccucccuucucacccagugugacuuuugcauuagaaaagcagagguugacaggagccugcuggagaggccacaggcaggaucuggugaggccaccccuguccccaagcacugccacauccccucucccuggaaugugaccaguucuacccugaggccaggccaggcaccuggagggcugguuugguuucuaagugugcagagggcucagugccugggcugggugagggggagccagggaagaauuaguucuugguggugcuuucacagggguucuuagaaaguauggacucuggccaggugcaguagcucacaccuggaaucccagugcuuugagaggcugacgucagaggauugcuugagcccaggaguucaagaccagccucaggaacauagugagacucugucucuguaaaaauuagcugggcgugguguuguacaucuguagucucagcuacucaggaggcugaggcgggaggauagcgugagccugggaagucaaggcugcagugagcugugauggagccacugcacuucagccugggugacagagugagacccuagucacccuucagcagggcagagcagcuucuaaaauucugggagccagccuggcugugaaccccgaggagggucaggaagguugugggaugugucagaugccugcagcugcguggaaacaccuugaguccccuguggccucuggcucagggcccugcccuccccucuggaaggcagcugggggcaggauggggcacuaauggggaaagccuacccgaccccccuuguguuccuaggugccccucccagacucuuuuuggggcaggcgauguguuccaucguugggacgguggaaggggugugcgaguaauauggaaaaugaauagcugugcuccaaaugggcucaccgggagaguuguggagccuauggagagagcauuaaugugcuggcgccuuauuggugcuaaucacuuaaaaugugcgccuuuguuagagcuuuaaugagagccacuuaaacugugcauuaaaaagaggaacugcggagaggccgccggcaggccgggcggcaggcagucaucauucucguugaaaugcuuuuaguguggagaaaaguugcuggauucggcaaaccccuguacuuugcaaaaccucaccguggugucugcguggcugggugucagcagaagcaccguggccccgcucucccgccuccccgugcgccugggccuccgugugcuggugcucucgcacacagcugugccgccuuccaccaaugacccaaugggugugugucccguccuggaggcgcuugaggucugugcaggcuucuagaagggcccucgggcuggccgaggcuguuggucaguccuggcaggagguggacgccugugggcuuccugucugcugcaggcgugacaccccacaccucugucguccacauggcaguaccucucuaccgucacagggcaggggacgcaggcgcagccgggagagagccggcagcccuguuggggagcagguccuagucuccgcagucugugcuggagccgggcuucacccgggagugccccuccugguccacaucugacccccguccuccugccuccugggccggccuccugcccguugccacuugcagagugggugguggagcaggaagugcccgagaugaggcgguaaguccccucccugaacugcucuuccuggcuugggcccgucuggcuccccugguguugguuccgggggcccggcugcuucagggaagucccuuuggcacagggauuguguugcacacugaggggcgugggccucagcagcugcugccgggaagccggggcauccuuaccuuacccgccaaaugcacgggucuucaccuugugauuuggaaacauuccugaacugugcuaauuaggaagcuugguuuauuuuuuauuuuuauuuuuauuuuuguagagauggggucuugugauguuggccaggcuggucuccaacucuuggccucaagagauccaucuaccugccucggccucccaaagugcugagauucccugugugagccaccgcgcccagccuggcugugagguuugugaaggcgccaagcugcuggugugagugccuguuucccaggcgcugcuuuaagucagcugcagagcgcacuccuagacagacagccccacacacauguacgcagcccaccaugcugagcacggcccaacaggaagagguugugagcucugaccacagcucggggucaggcccacucugccacuuccugguggugcuggggccgagggugagucaguugguggcccgggccucgauuuccucaccugugcagugacagugaggacacccgcugugcugugugggggggcaggugcacagucucauucauggccuugaaagcaggugcccaagggggaggcagcacugcuaacuccucaccgucccuggcuggucugguucuagaacaucagcuccgagaggagagcggccacacugcguccuuuccccagggucgugcucucucguugacugagugacgagagcggccacacugcguccuuuccccagggucgugcucucucguugaccgagugacgagagcggccacacugcauccuuuccccagggucgugcucucucguugaccgagugacgagagcggccacacugcguccuuuccccagggucgugcucucucguugaccgagugacgagagcggccacacugcauccuuuccccagggucgugcucucucguugacugagugacgagagcggccacacugcauccuuuccccagggucgugcucucucguugacugagugacgagagcggccacacugcauccuuuccccagggucgugcucucucguugacugagugacgagagcggccacacugcguccuuuccccagggucgugcucucucguugacugagugacgagagcggccacacugcauccuuuccccagggucgugcucucucguugaccgagugaugagagcggccacacugcguccuuuccccaggguugugcucucucguugaccgagugacgagagcggccacacugcauccuuuccccagggucgugcucucucguugaaugagugaugagagcggccacacugcguccuuuccccaggguugugcucucucguugaccgagugacgagggcggccacccuguguccuuuccccagggucguguugucucguugaccgagugacgagagcggccacgcugcguccuuuccccagggucauguugucucguugaccgagugacgagagcggccacaccguguccucuccccaggaucgugcucucucauugaccgagcgacugugugggcuguggucugguggauuuugucuggggaggucggaggagaagucucugcauagccgugcccugugagggacccaaguguaugccaugggugggcaccuugucacacaaguaacccugguccuuccccuggugaggaggcccuuggcugccccugcugcugggcagagacgagaccaggcaucugcucacauggucacugcgcagaggccagagggugucaccacugucugccaccugcagagcucacagcagggcacuauggggcggcuccugcgcaucuccuuccccccgaccugcaggcacuggggcccugagaaccaagggcagaucugggccgugcucugugcucccacacgcccgcucuccaugggaggaaagagccagccugcccagagggcagcauccucgcugaccccggccggcuguggcccaggagacugacgucugucuuuucggcccuaggcuucuuccccgggagcucgcagggcugcgacgccuuccugcggcauaagaugacccucaucucgcccaucauccugaagaaguacgggauccccuucagccgggugcguacggguggggccugcacgccugugggugaaguggguaccggguccaagcccagguggccgcacauaccccaggagauaagcuguuuaacccuggagaaguuucuagaacagugauuagcaugccagaggagggccgcauggcucagcaguuagccuccagcucuuccacggggaagcgaagauggcagagcuugaaucuggcgggguguuaaccuccccucccaaaccaaaccaaaacuuccuccuggguguggccaucagaggccccuccgcaggggcugcagggguggaagggcaggggcaggcccugcugaccuggcaggaagcugccaaagaaacagagggcagggccccucgucccgugcaaggugggaaccugguuccuaccgccccaggccacacccuaagucucaggcacccccacggcccaugucacccggccguggagagaacugccuguuuagaagugacauuucgggcucuccugcaccgugaagacugugaacucauucaguucacugcuucaggggcugcugguggaggcugugauggaggagaccugaggccgggggguggggccucccuacaccugauuugauggacagcugggguuuggugucccaggagcagagcaggcugugcucaggguccagcucagcaacugcacccacucgaggcaguuccuuccccauggagaagccuuuguccaugggagagucuaggccuguguccccagcucuguccaggugagaggcacgugccaagaaccugcaaggcaggucugggccgcagcccagcucaugagguuccacgggaagagugaugugcaggcucgggagcgugcucuguggugaggcccugagugucagccagccggaaauugcuugugacauuucaaucaaaccgccaaagcaucagcucacacaucggggauccgcucuuccuggcggggcugcaacccagaggccgccucccagccgcugcaggcauucaucagacagcacagaucucgcucggagaagugcgcauuuccggccuuuccucuucucccccgucuucugguuggaacaucauucaguaccagcaaaaccagacagaucacggcauugcucagggaagugagaaguacugauuuucuggcugguuugucuaaaaccuucuccaaaguggugcuuccuggaggggggugcccaucgaaggggugggcaggcagugaguggccuggacucccaggucagcaucuguaucgcacugcaguuuaucuguaaaguuccugaaccugagccaaagguggcucaccaccagccucagagcggcugcuggcaccaugcaugguagcaggcgggguccaggcaguacggcugcgcuccccaacaccgccagcugguugcuggggccgggcgccaguuucuccagaggcugccacagugaaggccccugucccacugcagcgaacagcacccugugccgcccggccuggggaccguccuucagccucucagacgccaugggcuugagaugaacgucccuuccagacagcagcguggguccccucaucugaauuccuggcagccuucaaacaagugacuccccacacuccccuuauaaaucuuuguaaugguauuuacuucuaggagaaaaagccgaucaauagcagagcuuuuuaauaauuaaaaguguguacuucuguaaucugccauugacucccucauuuauucugcaagagcucgcagaggaaaccgaguuccgggcuuucuccgugccuggugucuggggccgcguccugucaccacugaugacuuugccgcaaagccuauucaucaucccaacgccuucuaauugauuguuggauaauguugacagcagugacacaggggacagacaccgugaguguggaacgaagccaccaggaugcagguuuucucgcaggaacauaaucuucuuguccuaaccgagcacauuuucucuucuaggccuugguucauaggagggcugggggagugagguccuuacacugugagagcuuggcucucugcugccaucacccccauucaaucuuggcauuccgggggcccagcuggaucccugaaggcucugagucugaugucugccugacgcaugccugcaggccugguucuccaggggagagacagggagccgucacuuggccuuagagcagguggucagggaaaagccuuuccgaagccggcucaaauaggauaaaggaaucaguaauggcauuuacuuuacuuucuuaacuuuucuuuuuuucuagagauggggucucacucuguuguccaggcuggucucaagcuccugggcauaaguguuucucuugucuuggccucccaaaaugcugggauuacaggugugagcaccaugcccggcccaguaauuagguuuuuuuuuaaaaagccccaaaccuuaauuuuauuugccccucauuucacggagcucccagcguaguggggagaagcuggcccagagaaccccacguccugcacagugagggccagcccuuggggaccccauguccugcacggcgggggccaggcccuggggccacguguguuccccccccaccccuauuuucugccgcgugcucguucugcugcacguggcugucacuugaaugggaauuuaaaaauauaacuuaaugcacacugacuucccuugauuggugcaauuaauuauuugaaaagaaaaauaucacaguguucuuaaggacuggcauuuuuccaagcugugucaguuuugauugaugucugacgccguggcuggcuucugaaagccucaccaguucugauggcuuauuggcgacuucaguguauccagcaaucucugcucaucuuucugggggaauauauaaugaucagcaggccugagaacuccuacaaaucagagauaagaaaacaaauggcccgaugaauucggcgugaggggcuugagcagacgcguuacgaaggagcugcaggaacgaaagccaugguucagugcccagcaucgguagaagucagaggcagccagcugggagacaccgccagccccaggacggccacgucagaacaccgccaccagaugccagugaggagggcgcagcugcacgcugcucccagccgggguggaugcagggcggugccauggccauggaaaaccguucggcauuuucuuggaaacggaagcauguacccugugccccagcgaugccacucugugcauauuuacucaggagaaaugaaaacauaugucuccagaaagauugguacauaaguguucuuagcaguuuucuucacgagagccccaaacuggaaacagcccgcacguccaucaacaggaggauagauaaauaaauaaccauagauccacgcgcaaccgaguacuguuuagaaaugaaaaggagcggucgccuggugcacaggacagugggaacaaaucucagaaacgcacgccagguggaagacaacaggcacgugucccugccguacaacgccauucaugugaaccacuaggagggaacgaggucuguggugacugagagcgcgugcgugguucgguggggauggccugguagagggcugguaggaggggugccugggggcccggcauguuuuguuccugucuggaucagugguuacgcccagaacuccgagcagccugugaucccugcguuuuacuggauguuaaauaaagaugaggagcccacuugacuucaaggauucuaguucaugagccucaguuuccacgucuguggauugggcccacagccccaccuccuagaagcccuuggccugagccccggggugcagcaggugggagccaucacuccaaauuuguuguugaucuuucuggauggucgucuuucaaaggcuuuaucaacgggcuuagcagugagcagggagugggggucaguguggccaucucgaguguccccagaguggggaggguuccuagggcacaaggcuguagccccccagcccugguaggcagcccugccuuuucuuccagaccuugggguggcuguugggaaaccuugggucuggggucauugugggccccaccccagccacgcacgccucggcuccucaguuuaggggguccugcuucagagaccugcaaagucgaaugggccgaacauccgaauuggaccugggucuggaagcauuggcccgcucuccagggugcugaucuguggugucaggucaugcccccggugugcagauauuucuggaucuccaugacuucauggagauccccuuguugagauacaauugaaagauggcuugggauggcggcgugucgcaggccccuuccuggcguguuuugcgcgugcaguggugguuccuuucucaugcgagggcagaagguguccugagcgcgugcagugucuugucuucagagcacucuaaagcugcugucagcaccacccgccccgaaaccagccccagcugcuucaggacaugucacagugacugugagugugacucagccaccuccaaagcaggaggcccccaucgcuccccaugaagguccggcuggagacacccccacgggcauuguguccagccacggcuccaucugcgguucucccacuggggugaugcugacggccgccuuggggcagggcaggggcugcuggggcuggaggggcccggcugagccgaguggagguugcagagcuguggcugcggcugcucacuauguccuucaugagccgcgugggaaaugggcuggagcccuggagccccuggagccgcuggaucaccuuugacuuugugaaacccccuuggcucauaagccaggcucccuggcacuugcugggaagugcccacgucccauccccuggugcgccucugguggcccugcccucaccugucuccuuucccucugcagaucacgcaggaggccggggaauucaugaucacauuucccuacggcuaccacgccggcuucaaucacggguucaacugcgcagaaucuaccaacuucgccacccugcgguggauugacuacggcaaaguggccacucagguaaaagcuugccugcugggaacgggucccagcagggcgggaggaggcucuuuuuugccucugcagccacacgcccauagcugguccagcagccguuucgcucagcccagggccugggcucucaaccagggucugauucugggcuccucagagagcuuuugcccagaacgcuccuuaccucgaagacuggagaggaggugggcaggucggguggacgaugguggcccagggcccaucuccagcgaguuccauacaccaguuaucccucggccugcgugggccuccugggcauggccggcugcucgggucuagggguugggguguuuccuccaccagcaccauuguccccccugcuggcuggcuccugggcaucuccuggccaucaugguccugggguuggguuguuugcugacaucucucuccugggggccgcuuggccaggcaggagcccacucaggcaucugccccccucccucccugcuccccugucaguggcagucccccagcucccagugccugggugcuuccugcugguggggucccuggaggucacggugagcuuagcaugcccgugggaagacucacagugaguggcccuugcuugauuuuuuucuggugauucucguuccuggucucagaaggccgauuauuggccagcaauuggcgucugaacugagcgcuuguuccccacucuccuaacgccacguacagccaucuguguggcuguucucgaccaugcggagggugugggaggcuacuggauggauaggaagcccacaagagcugcugcugggcacgggugggacggggucgccuuggcuggccacccccucccccauggucucugccuuggggucccagugacggggacguggacggggcuuaugaauccuaagccucagaaaggggagugugggacccgggaagggaagcagcuaggaggccgucugggcaucacaggucuagcccuuuccuggcugccugucuggagcugggggcuggggagccuccucccagggcugucccugaaguccccugcgugcuuuuccuggcugcccccaaguaggacugagcugucccggcaggccaggcucggccacguggcccuggcucagggcugcuguuucugggcagcauugaacagcccagcuccucccagccccucugucuuccccgcagagacagccucagccucagccccucccggcgucucccucugguuuggggucauguggcugcucgugaugcagcaggacgggcagcgggcuggccagggugagagcagguacuuccucccaucgucccucccagugcagagccuuccaguuccuccagagccggggucagcacaaauggcagauucuucucagauccagaugugggggaggugugauaggagagaccacagggccagauccggauucuuugacucucgcagcauuuucuagaugucagaccuuggccuggugcgguggcuuaugccuguaauccuagcacuuugggaggcagaggugggcggaucauuugaggucaggaguuugagaccagccuggccaacauggugaaacccugucucuacuaaaaacacaaaaauuauccaggcaugguggugggcaccuauaaucccagcuacuugggagacugaggcaggagaaucacuugaacccgggagguggagguugcagugagcugagauugugcccugguacuccagccugggcaacaagagcgaaacugucucaaaaaaaaauacguauuuauauauuauauauguaauuuauauguuauauauaauuuauauauuauguauaauuuauauauuguauauaauuuauauauuguauguaauuuauauauuguauauaauuuauauauuguauauuuauauaaaauaaauuauauaaauuacauaauuuauauauauaaauauaaauuauauauguuauaauaauuuauauauuauauauaaauauaaauuauauauguuauaauuuauauauuauauauaaauauaaauuauauauguuauuuauauauuauauauaauauauaaauuauauaaauuauauguauuauauauaaauauaaauuauauaaauuauauauauaacauaauuuauauauauaaauuauauauguauguauaauuaagauggauuuuggccggacaugauggcuucacgccuauaaucucagcccuuugggaggcugaggcgggaggaucucuugagcccaggaggucaaggcaucccugagcuaugauugcaccacugcacucgagccugggcaacagagugaggacccgucucaaagaaaaaaaaugaauuucaccuguuucauuuuacccacccucccccgcccgccgccccggcccacccuuuuauagagacagggucuuaauauguuggccaggcuggucuggaacuccugggcucaagugauccacccaccucggccucgaaaagugcugggauuacaggcgcgagccaccacagcacaccaccucuuuuugcuuuuuucuccuggcuacugggaaaauggaggcagcauagguggccugugugacaucucuccuggccacgccggucuggacgaaugagcuaaccuuuauuuuucuggcuguuucucugccuucaauccaguuuagaaaaagaacaggggucuacagcagggaaggcuugagagaugcccccaggacucaguucagaaagucucgaaugucucuagugaagacucugggcuuagcuaaaggaagagagauccagaaguugggauuucagcuuuuugaucuaaaggaguaguuaaguaucucagggcuguugcuguguugaaagggcaugugucuguguguuugugcugccgugaggacaccacggguguugugaccagcccagcagcagauugagcuguaagccccaggccucgggcuuguccuggaggugcugucggagcugaaacugcagcggggcgguggggacugcccagauauuaaaagcaauuugggguucagccauguguucacaaacaaguuggcauuugggaagugcagacuuagauugggcuccacgcuuccauugucaggcggcguagcaaguggcgugcagcgcucgaaacacaccagggguuccaggcaggcgcccagggccugggcuuccuccuggaccccccagccccgcugucccagccccugcucaggcaccccugguguagucaggccuggccugggcggcgagggccuuacgcagggagugucauuagccacaaggccucuguggccgucgggggggucgguggcucucaggcuucuuggcggggcagccggccccugacucuggcaggguuuucucucccauaagcagcccaggcuggagagucuguuagagcaucucgccgcacagaugacagaggaguguuagaaggcagggaaacggcccaggucagguggggcucgggccuuguucagaucuugugugcagccagauuggagagaaggggcagcccagaaccccccuuuucuggugucccucuggccggcccagcuccccugucccauuugcguuucgggccacuuuguuuugagcacauucuucagaagagagccaaagaggaggcuuuccacccccucgauuugcuuagagacauuuuugcuuguuggcuguucaccuuccuugaccgcuagggaccccugcccccccccaccccguuguccccuuucugucauuuuugugcucaggagcugacaggugaaaagccacccuccugcccuggccgggcccugugaauuuugggugucuguguucacggguuggcaagcuagggcucggaucugguaggccgacgcugugccgucugcaaacugagcaggggguuuacgucuucacaggguugugggaggagggcaauuaaaaggaugugugaccugugacagccggacgaaacugaaaucucacccacaaaugagcagccugugcacagagccacacucuggcauggagguggcgucugcgucugcuucgccccgcggaguugaguaguuccgaaaagccaagaggcgugugcugccuggcccuugcaggggaagccugucuccccgucuacagaugccagcgggguugcacagcucgcaggacagccaccuccucccccccccagcccccagggccucugugggcagaggggcugcuccgaaagcagguuggcccccaccgccucaccacaccucgagccagugcagcucccucuggaguuccggaugggccugcagcagcuacagccgugagcaggccagaccacugccacagaugugcugccaccugccugcggagcaucccuggcugccccauggcaggcaggaggcccagcccucagcccaggucugcccccacagggcagagcucuccaagguucccccggcuguaaaaucccagagaaauacgaucucccugcagcagguggcuuaccuacuuacacagccuuggaccagagccuccggguggagcuuccagggcccugcgcgcacacacaggaggcagccuggggcucuccccucccgucuucugcagagcagggcuggcgccugccugagcucacaggugggauggagcagcccaggccggcacuuguggccuaaacacggccucauucacuccccaucagcagaaugccgugggcacacggaggccauugucaaggagggggugggauuuauucccgugggugucuuuccuuucuagcuggucugugggcauucacccuugccaccugucugugcagccagugacauagucauugccccucggggcaggaggaggccugguggcccugugugucugugugggggagguacggcuguguccccacccccggcucuccacuccugcucauccccuaugaaaccuggugucauggaccugcuccccucggggcuggugaccuuuggaccccaguggugacaaccacagagguccccagacaucaccugcagcgucccuuggaggcaggauuggccccagugagagcugcugcccagggccacuuccgaggucagucaucucuuucuggggggugggguagguagugccagugucauuuuugacuccccugcugguguggccuucuaggcccagguuucccagcaucuccccucuccugcugagggcccccaucucugaguauuccauuugagcugcucaucucugugccacuuuuucccaacuuaaggcggcugagcucugcagcggucugcagccucggugugcgacguuucuuaagcacacagguguuaaguaucucagagccaugaaacucucugccuugccugacagacucccaccuugaggauggacccuggcuuuggggcugggauuucauucacugcacucgagucucuggacgggggcugggcuguucggaggguuuggggagugagggcaccgggcagcacagguuuaagucuccuguguaggaaucucacgucuuucgggagcuaaaugccaggcaggagguugcuuuccccucagaaacuagaaguucuuauccaaccugcucuucacgcccaccuguggggagagaagcccauuccuuguguucacugccugccggagagcaggagggagccuguuuccucgugggcgggaugugccccccgacucggguaggcccgagcaucugagggcccccaagggcccaucguuuucagggugaccguccacaccugcaggggcagggagucggcggcuuagcuuccucuggagcacgguuccaucagccagaugcgcucacauccagcucuuagcggcuccugcaaaaacucgcucugaucaaagggaggugaguguaaaaaugcggcccgggcuuugucuccaacuccccccgugauuccuggaccacgcaggccauaucacucggacaccacggauacaaacccucacuccccuggccccuagagcugagcagagcgcuggguucgacuuccaucuagagcagaggucgaugggggggagguugccccugcccacagcuccacccgugauaaguaggcaggcuuuuccauaauuaaucaaaaccuaggccguucaucugugggccagggcugagcagagaccaccggagucccugagggggccccugaggcugcaggggacaggccaggcccccccccuccccccccccgcaaaagagcagguugugguuauaggggcaggaugacagugggagauuuugacauccucaagaggcagaggagcaggacgccccugccagcuucauccgcacaucccuuggggcagauacagaaggaagaaugugcauuguuggaaacuggggaauacgguaaacaaagagaagugggagcugaccuuaccaucucugccauccgcucagccaugagaaggagcaaggcccagcgugggugaacccugaggacaccccgcucagugagagaagccagacccagaggcuacaccgugcgagaccccauuucuaugaaauguccgggacaagccagugcucagaggcaggaagggaugcuugggugugggggcuggagggugacaacggauggggacggguuuucuuuggaggaugaaaaugcucuaccuuugauggcgaagauggucuccccacucugugaauacacaagcuccugcgucgcacaccuggugaauuguagggcacacgaaucucacugaaacuguccagaaacauccuucccccagaucagcucucagcaaaucaggaacaguaauccagaauaaaaacugggcagccuuucuggaaggccgucugccauggguuacacaugugucuccuguggccuagcgguucugucucuggaacacgugcauaccgguuccaugucuagggauaucuguagccccguuuguuguaguggaaaguucuaugaccaggggauggguugaaccaguggaauguuaugcagcugugaaaauggguuugcuccaugagguuugcucuguaucuuugggcauggagagaugagcgcgacaacuuuaagggaaaaaauaggcuguggacugggacucuugugauucccguuuuuuguggggaugugguucuugaacugggaaagggagauuugcccaaguauugguugauauuaguuugaugucauggaauuugggauaccuuaaaaauaugcacuaacuucucaauaugguucugucuuuuuuuguacuaaaaaaaaaaaaacccacauacuccucuuuccauagucagagggguguagcucuggggagggaagagugggguccgccauuccuaggugcuucuugagcaagcaccccacaguucccaaguggaaaagguuuuuguuguuguugcuucguugguuuguuuucagaaugggaguuaaaaaccaaacaaaaggccaagcgcagugacucaugccucuaaucccagcauuuagggaggccgagguaggguugcaugauuccagagguucaagaccggccugggcaacauagugagaccccauucuccacaaaaagggggaaacaagacaaaaacacaaaaacugugaagacccccaaagccuggcccccuuccucccugcugagcaggugaggcagugcuggaaagaggacagaguggaagguccuggaagcccagcccagcauugcugagcgccugccgugugcaggggagggguccuagccccugggucugccagggagaggugagagugcagaggacagcaggcuugccucccuagccacacaccucgcugcaugcccuggccucgccaggcugaggcuuagggugcaguacccgguucguuuugagaagucucuuucucagcuagagcugucucagugguaacguucucucucucucucuccucaucucucucuccccccauaucucucccccucucucucucucucccccucucccccucugucucucucucccccaucucucuucccccucucucuccgccucuuucucucccccccucucuuucucucccccucucgcccccucucucucccucucccccucuuuccccgcucccccucucucucuccccuucucuuucccccuugcucucucccccucuccccccucccucucuuucucucucucucucugucuccccgcugcgcgcgugcgccccccuccggcccccccuuccccccaccgccgacaguaccacccuccaucaagugccgacucugggccuugucaccuugggaggaccagaguagugcagugacuuugccaaggucacacagcaggaggcugggcccagcacacccuagaccuuccucugcuucccuugccccacuuggaggcacaggccgauggggcaucugggagcccacacccucccugcccaccaggugucuccugggccaguggcuucguguccugggcacguguccugugcacagcccggugggggcagcuggaggggucuccaaggcggcggcuuccugucucagagcaggaucccccggcaugugcuccagcaggcaggcuuuguagugggauuacuaauggggcagaucaaaaggauguuccuauuucacucaaggaaauaaaaugugcacgcagccgccuuucucacgcugaacucaaguuaguccuacaagccugcacgccauguuagauuagcucagcacgcggccgggcuggccccgagguggguggugccuggugcugguagauaagggucucuccuccagagcccaggacucagcggcaucccgaaacacccugccacggggagaguugacugaggauuaaacagagcgcgagagaugugaagccuggcuggaaggcuggggagccacucacgcucucuuaacugguucccugccagcugucugugggugaggccugcugugugccagccuccccggggacaucucgggcucucuggaggugucuggcagggagagcuucugcugagcuugggaaggggacgaugacuuggauuccccagaggcgccauuccaggaaacggcccacucggcaccacccaucuccucccaccuccccgcauccaggcuggaugggggcuccggcaggaaccaggccucuccuaaaaccccagcccugggguguacugaacuuaauuacuguaaaauucaaaccaaauuguuucugcugccugggagaacuguguguuccuucuguuugguaaugaggcugccugcuccaggugauuaacccggagcccagggggagggagcccagggggaggcggcagaaggcaggggcuggggaagggugggagggaggagggcccacggaggugcgggaaacuccagccacuccucugacccgcuggagcccacggcuggccugugcccugccuuuggcuuccugccucagugagccucugauuuauggcguuguggggcuggacgcaucgugugugccgcaaacugcugugugaaauaugucucccuugcucuucccagaucuucccugucacucugacccuggugaggccuuuggggccccuucccaugugugggcuuagggggugucacagucacgcagaagcguggggagaaucugcagcuaagaccaggcggagcggaucccgggccgggccagaaugagugggucccaugcuggcucuuggccuaguguuuaugcugcaugucuggagggugaucuaggagaggaguggucuggaaagaaggccucguuuagucucucccucggcacugcggacauuggggccguauccuucucugggcuggggccguccugggcacugcacggugcugagcagugccccuggccuccacccacuccaugccaggcacaccccaacccagcuguuucaaccacaacaucggcaggcacauccacucccaugggggcagggccacccauugaagacaccugggucuccaggcucccugcgggcccuuccuuccuuucucccacugcucucggcuuucgggaucacgcccucuaauacccccgguucugcugcccaggagcuccgggggggacacaucuccccagaggagggucgggggcuuuucuagaccgaggcucgugguguggcucgagggccuuugccagcucggcagcccccagucuucucuaccauccuucauggacagagcugguucgggggcugcagcugguugcugccuggcaucagaggagcgggucugcuuacggggucaggcagaggcaggacccccucgaggggcacuggcgagggagcccaggggucagccgucagagaagcaggagagucagaggagggggcucgcagggccuggcccugagucagaaaugguggaguucuccccucugccaucucagggcaucccggcucauggcuguuccucagccgucguggaugagucguaaccuggagagugagagagaaccuccaggggcaacugcuggcaaggagggaucaggggaggccgggccccuguaccccugaccacauguccucuccccacccaaggugugacccuucauggggccugugguucauaccuggagcugucugccugggugcagacccuccccuccuagugcucugccucaguuucccuccuagggcuguuggaagugacauggaacagcacuuggguggugccuggcacagaagcaggacugcuguggcuguugaggccccuucagggcagcauguggaggagaaaggcagguccugguggccuggggucaggugugcagcugccugcuugucaugucccugcaggggcucacaacacugauagacucgaggcuacuuucauuuagggagggccaaaggggacaucggagccuccccaggcaccugguggaugugugggcagcauggaaggcugcggaaggccauggaaggcccgugaccuugccuggccuggcuggccgggaggggcagggagccgcuuucugugcugccaggaauggccccgcagccgaagcccagggagcccugggagccggcgccuaauuguuuuguugacgcggcugccgagcacuuccaguagguuuccuaaugaacugguuuguuaucggccucacugcagcgcugauaauuacaucagaaacagggggcccacucguccuucccacgcguucugugagccaucagcgcagaugcgggcgccucugccccuuccucgguguuuaacgcuuugugugccaaggcaccugccacccacacccaccccagacagauggucgagauggcugugagaggagugugaccgccacucgccccgguuggugucugcuuggcaguggucaccgcgcaggucacuguucagcugcugggaaggcaguggaugaggccaucgagguccagggaggagacaggacacgaacaaggguggaaggaggaauuucugcuccuagagagggugcagggacgcugcagcugcggccuggugugucugccaccuggguagcccaguccacagcccaggcagcugaaagcaccagacauguauccucucucaguucuggaggcagaggcugagauggguguguggcgggccgagcccccucagggcgccagggagaccacccugccucuccuggcuucagggcuggccgagaucucagggcugcuuggcuugcaggggugucgcccucuccucugccccauggucacgcggccccuccucccugucuuuguguccucuugucugcuucuaagggcaccaggugcugacccccggcaggcccugaucccauaugugaaucaugcacugaugacagcugcuaccacccugcuucagaaaagcuccucugugaggccccgggugcaggaugcugaguagcgcggggaacagcacugcuggggaggaacgaaaauugcgaggucccugagcgggggaccuggcagaggccaaacgucagaggucgggggcugcaguaagggccuuugaaguuagauuucaucaccaugugcgggggggaggcacugggcauuucagcaagggagaggggccacuggcuggagaagggacuaugggagagauggggcagggagcccggcguggauggccgccgucuagacgggcauggggucugugggcgugggaagaaggggacagcgugugccuguguuuuagggguggugccuguaggaccuggugauaggacagaggugggggcacaggggagggguggggacuugggcauguaggugugcgguggugcugggagcgcacagagggacauggaggagccaggacugggugugcuguugagaugcgucagagccugccuuccagugugggagccacgggccacacguagcaccguauccauuaaccaaaaugaaauaggaugaacccuccacuccucagucaggccagccgcgggucaagcccuuugcuaauagccgggugggcugguggccguguccugggcagcgcaggugcaggucaucgccgucaccacagacaguccugucaccgugcagcugaugcguccuguggaggggucugcagcucgggggcggcgccgggggcggggcaggggcagugugagggaugggacguguugagccauagauguccugucggcagcuaugagaugcugugcccuccccacgccaggaucgcuguuucuaaggccccugcccguccccaucccuguccacagcagggcaagcaccagccaugcaaugucugucaccgucggcuguagaaccgcccgcugguggcuggcauuguccucaauguuccgcccugguuccuggaucagggggcugggaguuggcgcugcagcugacgagagcauucaugauccccguggucagaugcuauuuggguugaugauuuuaucggaccacauauaaucauuuucucauuaggccgguggcugugucuucucucugccacucuacuguuuuacaugagcagacucuaguaucuguucaggcuuuuaaaaaagagauggccucuggugaaagcucagugcuguuuaaaucaggaaagguggcagaugagcccccugggcuccaaggcagcagugguagcccacugugucugcagguggccaggguccugugaugaugcugccagccaggcugcugcacacugagagcugggggcccacgagccucggugcuggacgcccccacaguguggaucagaucgcaaggggcuggccagggcagggcagagccugcuaggaggagggagagggcugggagcagccaggguggaccccucaaccuggaucagaucacaaggggcuggccagggcagggcagagccugcuaggaggagggagagggcccggagcagccaggucggacuccucaaccuggggacccucccccagcagcugcaggcuugagugugugcagcacuuaugugcgagcaugucguuuguguguguguuucccugggaaucagacccuggcaggggcccccagucuauagagugggugcuauggaccccagccgcugugaggcagagugugcgccccaccaaggggcaggcugccgaaaagucagcuucacagggagcuuguuuuaggaggagguccuuguguuauggaaauguaggccacagacugaggcgcacacagggccgguguacaguguggggaaucuuuuuuuuuuuuuuuuugagguggaguuuugcacugucacccaggcuggagugcaguggugugaucucggcucacugcaaccucugccucccgggcucaagcgagucuccugccucagccucccugaguagcugggacuacaggugcgccaccacaccuggcuaauuuuuguauuuuuaguagaggugggguuucuccauguuggccaggcuggucuggaacuccugaccucaagugauccacccgccuuggccucccagaguacugggauuacaagcgugagccaccgcgccuggccauggcguggggaauauucacaacccuaccccauccggacuccuggcagcauggaguggugucaccuuggauggggagcacggucccaggucuccacgggcuugggcaaccccugggguuccugcugaccucagugccccugcccagaccccaguuucucacuuccgugcgauguggcauuucuacacuggagucgcuggugacaucaguggcgccuguugccgcggugcccccggcggugucgguggugcguguugccauggcgccugccugguggaggaagugucccgcggugcccccggcggugucgguggcgcguguugccauggcgccugccugguggaggaagugucccgcggugcccccggcggugucgguggcgcguguugccguggcgccugccugguggaggaggugucccgcggugcccccggcggugucgguggugcguguugccguggcgccugccugguggaggaagugucccuccguuucuggauuugccuuaauagcucagagaaggcugagggaaaccugugagugauuguaaacaucccaugcuagggaagggcuugugaggccacacaggguggcuuccaccagaaucgacacuuuaaagagcacgggcuggcagcaugugugguguggagucagcagggcggggagaaaagaacaaggcacgugccccauggccaucgggugauggggauggugccuguucacgaagaagagucaccaagggaaggaggugaaugguaaccaaagccaccaagaugucaaucucaccguacacaggauucuuaaauauguaguaaaaggcuguaaagccccacguggcgcaucagucggccauccaggcuucgugguuuuguuuuuuguuuuguuucuugagacagucuccaaaaacuccagauuggagugcaguggugcgaucauagcucacugcagccuugaccuccugagaucaagcaauccuccuaccucagccucccggguagcugggacuacagguauugcaccaccaugcccagcuaauuuuuuguaguuuuuguagaguuggggucucacuauguuguccaggcuggccuugaacuccugagcucaagggauccuccugccuuggccucccaaagcacugagaugacaggcgugagccgccgcgccuggccugugcaggccuugguggagcugcuccuucgguccugauggggagcauuucccaaaugugccccauggaaaaggcaaggcgcagagcagggaccguaggaugucauugacaugaaaagcagaggaccgcugcccugugugucgggaggcuggggccucagggcagagagcgcguuggccaccuucccuuuuguucuucuggagcuggguacugggugcaguguuggcuguuccagaaagucuaugaguucugucuccguuuuggcuuggaguucuccugugggaggugcccagcaaggaugauuccccucggccaccagugagaugggaacccuccuccuccucagcucagcagagccgucguggaccuggggcccccagcuucuuuggaucucaggcauggggggcgcaaaugucagucgggagcugucaagcucuguggaagguuucugcauguuugcccgagccccaccaggaggggcuucaaaagugcuuguccaagugcagagcaaggcagggcacagaggcagaggcagacacagcccccagcugggccagggcugguggccaaggggcuuccucaguguguagccuccguggcagccuccauguguaguacauggucaguagaagccccauuaacagcaggggggacucggccucuggggagcggauuucuuuugcaauaugauguuaaaggaaggucuggcauucaguauguuuuuuauuuuauuuuuuauuacaguuuacaaaagcacuccaguuucauuggauuucaggcauuuugcaugggaucguuauggcucagaaggcguaaucucaggcauuagauuagagugacaggcuugggaauucagaccggagaacagcugcccugccuguucccuuguaggugacuggcaggucuugcuuuauaacaggaagugcucccaugguggcccugacuugcccagccugugggguuugcuuguguuaccucauuuaaaaccccuggcagcacgagguugguccaucuaguucccuagaaaggugccauggacugaaggucuguguccccucagagucaucuguugagugcucauaccccucccuagggugaugguauuaagagauggggccucugggaggcgacgagggcaugagggugaugcccucauugaugggaucagugcccuuaugaaagagcccccagagagcucccucgcccccuccaucaugggaggacucagugagaagaugccaagaaucaggaagucacccucaccagacaccagaccugccagugcccugaucuuggacuucccagccuccagaaccauaagaaauaagcaauuugcuuaugagcccccagcuuaugguauuuuguuucaauaauggacuaagacaaaagguucauuccagucacuuccucacaugccauuucccucaucccugccuccaaggaaugugcaggguggauuucugagccuuuaguugcugcuuucuuuccuuuuggcagagauacuuucaggggaaccuggucacauagaacaaccuccgguuccaguagugcugggcacacacuggguagcagugggcaguggagaggauugcagggcaccagaaggcccauuuguuuccuuucucuuuaaacaugaugagcaggucugugcaaauaccccaaaguccaaggaugcugagaggccaaagaaagaagcuggcauucaguuucucagagagaaacauuuaauaaggauuuacaacgagaagccaugucugugucuuggguggcgguagugagacaagacgguggaucccugcaccaucacccccagacccagggcuuauauaccauagggaaggguuguuuugggaugugcaagacaauugaaauauggaaaccucaagggccauuugaccaaagggcaagauuuacaguaaguaccugcucuuauacaaggagcaguagaugaacuggaaaucucagaggccuucccagaauggggguuaaucaaaagccaacauggcagguuagcauccaagauggaguugcuuuggccuccacaccugcugugaccucauuucugagagacauaugcuccaggggcuucuugagaaaggaacacaggcaguaaaguuuugagacuuuucucauuugaaaacagggccugaggguggcacccucauggaggagaucagagcccuuauaaaagagcccccagagagcucccucaccccuucuaccagaggaggacacagugagaaggcaccaucuaagaaccaggaagugacccucaccagacaccaaaucugccagugcuuugaucuuggacuuuccagccuccagaaccuugagaaauaaggaaagggcagaauuugaaaaugaaaccaaaaacuccacaggaugguuaggcaacaaaguagaagaacuugugcaggagaagcugcugucuggguggcggauaguuuggcuggguaucgaagucccuucgaaggcugcacccauccgugguucucauucagugcugcuggcacaaagaugcuccucugauuccucauccuuggugugggaccuguuuuucucccuucuggaggcuuauugaacccuuuuugugucccaaguguccugaaguccccucauuggguaccugauacgugucugauuuuugucacuugccccuccuugggccuuuccauccaucuuuuccaaccuuucccaugauucugguaaacuuucuugaaugguuucauugauuauuugcucuccugucuuucuuguuucuauuucaaacucccaucacucgcuauugggcuuucagaacuaguguuccacuuuaucuuccccaccuccguuuucuacguugucuuuuuuguuuuuguuguuguuguuguuguuguugucuucaagacaggaucucacucugaaaugagacagagucucagccuagagugcaguggugcagucauagcucacugcagccucaaacuccuaggcucaagugauccuccugccucagccuccuguguagcucggacuacaggugugugccaccacacuggcuaauuuuuuguagagauggggucucgccauguugcccaggcuagucuugaacugaccucaagugauccucucgccucggccucucaaagugcugggauuaaggcgugagccaccacacuuggccucuuugucuuuuuuauuaauuuguuuucuggaagaguuccucagcuuccucacuuaaccugucuauugauguguuuuuauugguguuuuucauuucugcccuuuuuugucuucugaauauuccuuuuguuauaagccccguucuucuuucaugauguaguaucuuuuauuucugaggauauugauugacgauagguuuaaauucuuuuugaaaaugucuucucuggcuggacacgguggcucacaccugugauuccagcacuuugggaggcugaggcgggcggaucaccugaggucaggaguucaagaccagccuggccaacauggugaaacccugucacuacuaaaaauacaaaaaauuagcugggcauggcggugggugccuguaaucccagcuacuggggaggcugagguaggagaaucacuugaacccaggaggcagaaguugcagugaaccgagguugugccauugcgcuccaaccugggcaacaagagcaagacuccgucucaaaaaaaaaaaaaaaaaaaucuucucuguccucuguuucuuaccagguuuuuguuuuuuuuuugauaguuuauuuugaucucuggggaucauagugcaggcccaucucucugaugcuuggggguaacgaucuaguguaaugauuacaagugagggacuaggugcaguggcucaugccuguagugcagcacuuugggaggcugaggcaggaggauugcuugagcccaggacuucggggucggcagugagcugcugugaucacgccaccacauuccagcuccagccugagcaauagaguaagacugucugaaaaaaaaaaacaaaaccccaaaacccaaaaaacccaagugggcaauggaugcuggugauggguugggaugcaaggggauagcggggagggccucacucggugcuuuacccggggaggucugggugggcuguggaugcaggggaagggcggggagggccucacuuguugcuuuuccuggggagauccgggugggcuguggaugcaggggaagggcggggagggccucacucggugcuuuucccggggauaccugggugggcuguuaugggggagcccacaucaggcccuuugggucucuccccuugggccagccggauugcacagggaguagcccuccagccuccugccugggcuccuaagggugucacccacauccuccacugugcccaguguccccagcccagacacccaccuucucuggccuccccaguaaaugauccuagggaguccagcgaggaggggcaggcggccgccagggugccaggaggggucgggugcugcggcaguccucgcgcagaccuccguuuugagcacccccacccuuguuuccaggggacccugggccaugaggcguggggugcgugcccgccaccaccauccgugucucugcugggaauggcucccugguggccguccgucugcucgccacgucccacccccagccugcugucgucuccuuuuccauccucccuguccuugcagguguguccucccuaaaggcacuuucucguggcuucaggagagagauggguggcgugggcuugccagccuaccaaggcaucacuuagagccaggagccaugagcguggccuccuuccugcaguugccucuggcugcccaggagggaugugguguugccuggcagggaguggagacagugaggccuucuagggguccucccuugaagggucagcagaccaauguggaagucaccaaggaugaaggccagagccugggggaggguggagcuggacaccccugggaagucugggagaggggcugagccuccacaggccaggggagcaggggaggaauggggccggggccgggguggcaucuggggccacucccggucucuugcuguuggcguugggagggaucucgcaccacagcagggaaucgaggccccggcuccccucaggcucucccuucaccggcaaugggcggcgggcgacgggugacgggugacgggugaugggugcagcacccgccccgcccauaggagagcccugguccacuguggccuguggaugccgccccugacgucagcaucucucucuggccucccugggagcagucucagagcagugaagagcucuucacguccggugcuguggcgauacuaaguaauaagaucuccagguuuuauugggcauuaauauuuauucccaugaaaagguuaaauuuauuucacuuuaaagcccuggagagugcaagguggagccauagucgccucuccuggcaacggcccugcccaccacguacccaccucucccacacaggccaguccuggugauggccugcaggacagggcagauguguggggcaguugggggcacccccuuuuggaaggcacugcugccaguggggccggugagugugcagagcccagggccaaugugugccuccugcaggcaccgggcagcccuggccacuccucagcucucugaccccuucccccgcucucugcagcaggcaccacacgagccaauuucgcuuggcacgacguccugaagcaggcccugggcucugcggcugcuggcucugagcccaucgacauucugauuuguauuuuuucaugcuuuggaaaaaagaaaucuauuuaucucugcgucgggucccgcucugcauaaccggaggcaaaccagcagccccgcccgcuuucucauuuuccugggaagguagcagcggguccucugaggccugcgucaagaauaucgggcugucggacgcgucagucuucaggggcaggugacggccgcacugcuuccagcucuuuggcuugguguuugggcaccagcugacgggccagccagcagcagcggugcugagguuaguccagguccccugaacucgacggccaucaaucccgggccugucauuugcaagcagcugcagcagcuggucgagccuccugcuagacccucucuccaccccagguuuuucuuaagggucugugacgguaucugucaguggagacucauguuagccaugucaggagggccuguguuggagaaggauggagggaacagccccgagcccagggggccuggcuuuugcucugugaggcucgcuccacacccuguucacuuccugauccccuuccccacccugccuugguccuuaaggaggugaagauggggcacgggggugcacggccaccuccuguagaaccagggcaggccagccaccuucugaguagcuuccgagcuccugaggcuuggccacccgcacaucauggggugggugaggagcagaaggaggggcccuccccacggcugccugcagucuggcccuccccuuuuuaucugggaaaaaguguccuguggcugcuggguggguggcagggaggcuggccgaaucccuggccaaugagucccgcuggcaggaccccgagaagcagaggagcucgcuccagcuggugccccuccaccccggcagcagcaggacgagcaggcgugccagcacagcuccugggcaccugccccuuucugcucccggguccccuggcuucucauaugugcuuauuuugucucccaguuacacugugagcugcuucagggcagggcccagcguugcacgguaaaacuacauuaauucagacucauuaauucagagccuauaauaguucagacaugggagacgugacucuuuuugagcuaaaaguuggaaaccguuuugcucuggguuuuuauggccacaauugcagaaccuaaucuaagaucaguaccuuuuuuuuuuuuuuccagcaacuaaaaucuugggaaauuaaagguccuuaaaacaugcuuucaauugugagccagacaguucugaacccggcaaagagcaggcacagggaugcucugucuuggaaggggguuuugucugggaacgccacuuccaggauucagaccucaugugugucccucgggagcuuccaaaauaggacugcuuuuagguggagcguauuggaacugaugucagugagaaaauggacacccucacaccccccaaaaauuagaaacagaagaccucacuccucaggccgugccucuucucuuccccagacccugggcaggucucagcaaacccgggagaaccagagccugacuccaggucccaaaguugucauuucagggaccugaauugcuguuuucucccauguaugagugucugggcucauuaagauaacuggggccaucccagccggaaugugcaaaguccaugggcuccgggaguuuggagcugggucagguggugaggccgggagagucgcacccccugggcuccguccgggcagcaggauccagguccccaugaggcugaggugcaaauggccccgcucccugagcugccccugaguucugggggcagcgugcccacaguacauggcuggcuugggcugauggugcagagggcacaggacccagagcggggcagagcaggaggccaggacucuccaugccuggagccggacugcuucccggcaggggcagucagaggcccggaagccgguaguggggcgcgcgcagcugccacgcucaguacaaacugggacugcugcccaugucugcaacagacacaccugcgauugcucccagagugugcugaagcuggucugugggacgugguguucaccccgaugcuguuacacugcgaguuacacuagaaaaguuacuucaugacuuaagucaggcuucagcaagcuuuuucuuuugagacagggucucagucugucgcccgggcuggagugcuguggcaugaucacagcucacugcagccuugaccgccugggcucaggugauccucccaccucagccucccaaguagcuaagacaguaggcgugcaccaccacacucaccuaauuuuaaaaauaaauuuuuguggagacagcgucuugcuauauugcccagggugguuuugaacuccuggccucaagcgauccuccugccucagccucccaaagugcugggauuacaggugugagccaccauuugagccagcccaaacuuauuguaaaggaccugauagugacuguuugcagcuuuacaggccgugcauuccccaucuugaauguucagcccugcccuuguagcgugaacacagcuguggaugauacauaaaugaaugggccuggcuaugugccaauaaaacuuuauucacaaaaacaaguggcaggccagauguggcccaugggcccaccuuagaggauaugccuucucaauaaagagauuuagagaaauaaguagcgcagaaguguuuacuccuacaauugaaagaaccacaguuauuguuuugauacauuucccugucuugagagagcucugcccauaauugggcucuugcuauauucaugaccgugcauuuuguguuucuucagguaacagacacauccugaggacguuucugucauugaaagcguccuguagaccgcaucuugccagcgcacaccucccuguugugugucguuuauuuagucuguccacgaugguugaacgguuugguuagagucauugugugugugugugugugcgcgcgcgugcaagcguacuugucuuucaguacaaaagcaaaggacaucuuugaauuccuuccuuccuuaggcgagaucgcuagcagggggagauuagggaugagcuugccuggagugugcaaagauccacguugcacccgucaucugcagcuuggaagagcugcucagcuccuccuugcauccuccugaggccgccagggucugcuccaugcucacugggggccgaguaggggccgugaugcugacgcacccuccuccucugggggauuccgcaggacccagcagccacccggcagccaccccucccucugcugucacuagcuuugggcagcgcgugucuccugcgugcaggagcacugugaagccucugcugauucgcuggcaagcggcacuguccaggcccccagaggugcacuuggcaggguggucaggcugcccccugacaugagcacuguccaagaacuggguucugcuuggcaucuggggcaccaagagggggggccuugcuuugagacccugcucugcgggccuuagccaggaaugagaagaagcuuauggguuccagcccagcccagagcagugagaccaggaucuuaggacuggggagaacggugggggcagagagccugcaguuggugggcccaaccuguagaugagaggcugaccccaaggcagggcaauccagggccgugaccugcagagaaugcggcguauuugggaacaaagacccucaguggagacuggcagugggacccuggcuucaugcuccgcguuccucaccugaguccccaccuccuggucucggaccuccaccuguccccagaggcuguucagcacugagggggcaccgccacccugcguuggccagaugcgcccagcuuccccggcagcucucagggcggccucacccaugcacacgguucuagcggccauguguaucacaccacacgaugggacacaggcccuggggcgugcucaggccuuugggggccgcgcagaccuccucuugcccuguuugugccugauuucuccaucagaaacuaaugacacagccagauucccccggauggugccuuccuuaucugucgcgagugcugacagaggaccaccaaguugggcagcaggaauuggagcgggcggggccuguucccuccagucacuccugcacagccucacagacacccgugucccagagaguggggagcuagacagggcuguggugagaacagucaggggccuggcuaaugaaaauagacagcgaggucugcccugccggaggacucuguggugaggcucccuccggccugcucugaacccuucccagcugcaguagaacagcccacagaaguccucaugggccuggcucacccuuuucaugggcacguggcucccacaggcacgcagccgaucagaagaggccggaguugguggcucgcagugggggcugggcauguucagcaggaggcugcugcuaaggggagcugggucuccucaccagcccuagcggguuucucucccacacuguggcccugcugagcugcccagcacucagaagcgacuacccuguguccucgaaggcugugcuucccucccugugacccaccggccuugccuccuuccugcuguuugcuucuuggguguccuggcuccccagcucccugcagagccacguggagacuugcaggaaugcucccagccgccaccuccuuccaguccagccgugggcagccuggcaccagcagcuuuguccuggcaguggcagccccuggagcaggggaugcaucuggagccgugccagccccagccgggcaagggggcucaggccgugcuccaggccguggcagugcacuccguggagcgugucugccuguccccccuccacgggugcacacaggugcuuuuuuuaauuaaggaaaagcaauugcaaagccgcucaauacaaauccccuaagcugcuguggauggggaugccggggcagucggccuguccaggagucugaaacgccggcaccaucuguguuccugccacuccauggccaaaugacaccaccagccuuucucuccugugcuaucuuucauuaaaugaauugaguuugcugggaauugcccagccacaaauauucccuccugcucagcaugauaggaaucuaacuguucccaagccccugcuccuggauccagcagaagguuccauggccccccugggacuggguaagguggggggaggcacgagcugcaggaaauuccacaggaagguuuccgucguccccaaccccgucagauuuggggucguaaauaugugagugucuccaagcaaagugugggccaccuggaaagguuugucagggcaagggaauaguugcguugaauuaagucuuucccuucccauuuccuucaucccauugagcacggguggugacagcaagacagguacuugaaauggaagagugucucacgauuuuuggaaaugggcuucuucugugccuguuugauggagaggcagaaaguucccugugggcuucugaggcugagauaaggguuggcagaggucggggcagccugugucuggcacgcggucccugggcccgccucuccccagcaggagaugaggucugugccccguucagacgggggcccgugccucugccccccacgccccgagcuuccgcauggcccucccccaugccuguggagacucccaggggcuacuuuguccccuagaaucuagaccagcaauuuccaaacugcugcccgcaggucaacucugucccuggccucuguuuauuaauaaaguuuuauugacacacagccaugcgcaugcaugugcccaucauccgugaugcuuuagaggcacggugcagaguuucucgaagcugaaaacacucagcguuugggccucugugacaguuggccagcccugcccuuucccccuuccucuugagguugggguuuuuccagccccaucucagccucaucccaguagguacgugacagaccagagcuuccuggccgccuccugggaucugagugccauggugguaaucgccgcuugggcaucuggguucaugcccucuggggccuggcuucucuggccccaagucccugaaauguugagcaucaccaggucaccugcagaacauccuucccagugcccagugugaccaaagugacgcagcggcagagccaccaagaacagugaccugggaagggcugagggcgugagagcggcaggucugcccggcaggcagcuggaggggacuucaacucauccuugccacucgcuugacguucccaaacacaaggggccauccuauuggguguuugcucaauucccccaagaccccaggcaagccggcugcagcacauggcacguuaauguccuuucuuagccgcugagucccugagccucccagacccucagcaucuucuucguuaacauugucgucccuccagcccugcaagcuggaggcagucaggugaggcgugcgggagccugugggccaccgucgcccucgugaggccuccugaggaggggccguugucacauuccgggauuccuguugguucucucagcucuuuggggacugcuguugucucccuucuucccagcccucuuggaacgauugcuguuauaaaauacuccguauccauuuuuaccuaccugggggcacccgcgucugacgggagggagauuuuugccuggaccaacaggaggcaucugaaccucagccucgcuggucucuggacagcugugcguggggcagugcccaguccugaaccucaggccccucacugagcugcgcccagcccccauuucucuuggguguuugcucaguggccguuccaacuccguggaggcaaaccagggacucacaacugggggaugccguuuccugacuugugauagaaguucuagaaacagagcaggagugcuggugcacaccuguaaucccaggguuuugggagacugaggcaagaggaucacuugaacccaggaguucaagacuagccugagcaacauagcgagaccccaucucuaaaaauucucuuaagaauuagccagaugugguggugggugccuguauucccagcuacuugggaggcugaggcgggagaaucgcuugagccugagaggucgaggcuacaaugagccaugauugcaccacugcacuccagccugggcgacagagugagaccgugucucgaaaagaaaaauguucuagaagcggaaugcucagcggugggauggggugugggaggcccgggccgugagcccuaccugcucuggggugggguguguggagccagccguccagguguggcgcgagggcucagaccguguccccugccgcagugcacgugccggaaggacauggucaagaucuccauggacguguucgugcgcauccugcagcccgagcgcuacgagcuguggaagcagggcaaggaccucacggugcuggaccacacgcggcccacggcgcucaccagccccgagcugagcuccuggagugcaucccgggccucgcugaaggccaagcuccuccgcaggugaguugccaagggacugccgcgugacugcccagcaucacgggggguggcccugcuggguggcccaggccccuucccacuggcaggggcuccgggccgugucccacuccucccuuucuuccuauucccaccccgccuccucuuucguccuccuccuccuguucuguuucuccuccagucugaggcacaguguuuucucgaggccucgcuuugcuggggugggugggcucugcucuggcgggcagcgucugugccguucacacccgcgggcuccccauacucccugucauguccccgccaggaggcugacccuggguggccccaggccccgugccauugccucagcagagccaccagccacauggcucccugucccucucacucaccgcauuucugcuguccggcuacucgggccccucccuggcgcugagagcagucggguucccugcaaggacucaacggggcaucagguggggcugcuuggauuugagaucguggagaggauuucagaaggccggccccggggcgugacccuggaugcccuccucccacucagaaccccucccugcguaucgccgcacagacccucccagccagguaucugguguccgccuggaggagaggccaaagcaucugcagccucuuggcuucugaccacaagaggccauggggacacggaggcaggucccggccuaggaggagauccacuucaugcccagagugaaggcgagcaccggccuccccagccccuccucugggaaguguccaggcuuccagggcucugagcugcccuuggcacaguugucgacagaucucacuccuguuuggugcccaaggaacauucagggagccccugagcaugagcuggagccgggagggacggcacagagugggcucagccaacuccuccggggaagggccagagagcaaacauuugugacuuggcgacuuugcaggccaggccuccugugucucgacgucucgacuccgcauggcaacucaagacccuugcagaugauagacagcgaagaaaugcgcguggcuguguccgugaagcuuuguuuacagacccugaaauccagaucucaugauuuuuacaugcuaccaaauacgauaauuuuucuguuuugagccacuuaaaaaugugaacauuggccaggcacgaucgcucacaccuguaaucucugcacuuuggaggccaaggaaggaggauugcuugaguccagggguuugagaccagccugggcaacauauugagaugccaucucuacaaaaaauuuaaaaaucagcugggugugguggugugcgccuguggucccaacuacugagaaggcugaggcaggaagaucacuuaagcccaggaggucaaggcugcagugagccgagauuguaccacugcacuccagccugaaugacagagcaagaccuugucucuccaggaaaacaaacaaacaaacaaaaaaacauguaaacacuguuccuagcuugugggucguacccagacaggcugcuggcaggucuggucuuugagccaacagugguggccuuggugugggggcagccucccccuucccuuugagcagugaccuucccucugcagccauccagucucugcugccuugaucuugucccagcuggcgauggauggugcccacucgagacccagccacugagcaccaagguugggggcggcucagccuuggccccccaccacgcucugcagaaacaggccuuggaacugguuucugaaaagucacuucugguccagaaccuucuccucuaaaugggcgccuucuuuuucaacacguccaucugucugugagucugggacuccugggcggucugggcaucugucucggccuccucugucuuccccaccucgcggccucucucggagaauguucccucugccccgaguguuuucacagccccuccugacagcccugccaaggugaaucugucucuucugcucuuguucuguccuuuugauuuccugccuccugugugcuccucaugaagagcugccuccuggugaggcuacuccaggcggcccccgcagcacagagcucgugcaccccagcucccaggcccagccagacgugcuauuugcauaaugguuaauugauuguggcucaggcuaauuggucaacagaguggauugccaauaaaccggcaccacguuccaggaguggaaugggacuagaggccgucuaaauugccugccaggaggagaugcggaagccgcugcgcucaccgcugcuuggaaccuucuuugcacgcaggaaguggaccccccagaaccagcccuugcguggccuggccuggccucccugccccggccacccccucacuucuagucacgaccugcuccucccaggagcccccucccgcccucucccgcgccgccauccugggggcugccuucacccagcagcaagccugaauaacaaaugaagucagcuucccaaggauauaauuuucuugaaagccuucaguauguaaaacaaggcugauucacuuuuuuuuuuuuuuuuuaaagucauugggggugcuuuucucuggagaggcagaugggugacucacguuccaaagcccaagcugccccucccuccaccagggagguggucgguuccccccugagcagugcccucuccacguggccugccuuuuccccugagccaggcucccucccugagggcauaucuuggggccagggcagcccugucugagcaucuguggcucaggcuggaucgggagacacaguggacuggcucugucucccagacaaggggcuuguggacacaggcgggauccuucucugguugggggagcauccugggcccugcaggguaaugagcaguaucccuggccuccacccacuccaugccaggagugccccaagucgugacaaccacagaugucccuagacaucgcccagucccccgcgugggaaccccugcccuagaccaagggauggcaucagggugggcgccaugcccucacccccgugcaguccagccuucccugcccucggcguggcugugggauggcccucauguguuuaccaggugccccauggggugcggaugguucggcacagcugccugagcucagaggacacggccuacucccugcucgccaccuuacaugggucucuuccagaacuaaaucucguugagcgagcguugggggcuguuuguauucuucccccugauggaugggucgccuaaaacugcagccuggcuccuggcgggugcccucagccuccccacucccgguggcgcugugcguucuggugcccugccugagccggagcccucacagugcucucuggcacccacgcgacgcuccuccaugcaaacucuuuccacgcgagaagcgccaugugcacgugcuccagcagguacgcgcucccugcaggacaucugugcacccgccucaccacagccucccuggcccacugcugcucugugagcccggcugggcccaggccucgucuccccuaccccuccgagcucggugcugccuguccccuccugcucugccuuggccugucgccccugcgccagugcaggacaccgccacgccucuggccccgacuccugccagggcugccacggcugccacaccccagcugcauuccugagcccuccccaccaacagggaccucagcccucagggacagaaccucacgagcacagggaccugccagccccugcagggagugcgcagccucagggacucacuugcugucuccugucucuuuccuagagcugcccuucauuuucucaaaggugaaauuccucagcacagggucuagucuuggggguggggagcacugggccacuuugggucgggggugggcggcucugagggcucagccuggggccagccucccaguccuccccaccuugugagaagcccugagccagcgcggcacugaaugcugauggucccacucugggugcugcaggugcccuguguuacugggugacagggccagaggccguccaccccgccuccugccauacaagcugcaaaggacaccugcuuccaccuuggaaauauuagugcaguuaucuggacuaugucccgacauuuggcucauaggaaugagcccagcggcguccaguuaagccuggcaggcuaagugcuuauuuaucuccacucucuccugaaacgccacugaaacaccagagagugaagugcagagaacgggagagggggcaguggcagcugagcacgucuccaggcuuugaaaagcagggaagggugggcaggagaccccaugggccggcaaccaggaggacagccagcagggagcagcugggcugcaccauggggccacagaaagacacagugggcagacaugggcagcuccuggagggcugcagggggaauguaccacggggccucagaaagacacagcgggcaaacaugggcagccccugggggugcuggggggaugugggggcaaccagcagaagacaguggguggcucugggcagaagggaggcgccuuccuggggucagcaguggggcccagcugccagccucacauccccccaacccccaaggccaggagagacaauagaggggguggggguccucugccagagaacaaaggggcccaguggagcaaagccacauaugcugauacuggggcucuccuaaagucacaggcuccugcccucagcagccccugccacugccuucaccaggcccagcucacacacggcuuggcaccgugcacagagggaucaacggccaggggacccgacacauuggaggcugcgcucccaugacaaaggcagggccugcacagcaaagaagggcagagcuccgaggaaagaggaugcagugagugcagggcccuggagugggccgggacuuugcauuauggaaaaagagccauugcugugaagaagaaacauuccaggaacgaguggcucucggauguuaccaucuagagaagagacaagcccacaguggauugggaggcccuugaagaauccccucccacagcacugacagacagagcuggaagauaggaaggaucaggaagucagaggcguagucuaggaaaucuagccccugauaggaguuucagaaaaagaaaagugucccgggacccaaaggcuuugcauuuccagguuaaaaaguccaccagaaaguccgcccaagaauggaaauuacccaaaccacaaugcaucgcugugaaauuucacaauuccuggauuaaacaaaggcccugaaagcuuccagagcaaacagaucacauaaacagcucaccagacuggggcugggcaugguagcucaugccugugaucccagcacuaugggaggccaaggcaggaggaucacuugaggcccagaguucgaggucagccugggcaacauagcaagaccacaucucuaaaaaaaaaaaaaaaaaaaaaaaaaaaauuauaaagaauaggagacucuguuagcauuggauuuacagucauaaugccacaagcuaaaagacaaaggaaaaaggccuucaaaagucagaagaggaauaauucuccccaaaucuuuuaccuagccaaauugucaagaaaugugugaggggaauaaggaucuuuuuagacacacagagucucguauuccaccuccuuucucaggaagcugcugcaggaugugcuccagcuaaacaaggauguaaaucgagaaagccaugggguugaggaaacaagaucuaacccaggagagucaaggggagucucaagaucaugggagaaggaaccaagacccccaggggugucauggagagaaggggacacccugcauaggagaccacagcaggaguuuaagagcaauggcagggagcucagagauaccaaggaagcuaggcguccaaagcaggaggccaguuccagaccccagggugggggcagggaaugcggcccgaguugcucuguggcucauggaugcacaauguuuauggggcauaaaagcguaaacguggaauuuggcugcaauggaagacgguggcaggugcagggagagaaggggacggucauggaggcgagcaaggauggccacacccucaacaccugugccgggagccagacccagaaacaagcauugggugcagaaacacgcgaagggggaugaagaugucagggucaggaagaggcgugcucuuaggaccccacagaugccccaagugauggcugccccucugccgugggcugugccccccuugcugugucugugccgcccuugcugugucugugcauugagcccuacccaguuccauguagugugggacccaggggucucagccuggcacuacugcagguaggaaagggcugggcugcaaggaugaggccccagagcucugguugggcaccaggacaguucuggggcccucuggggcagacacaguaaggcuugaaggccgugggggugccccuggaaggcugcagcaggggagggccauggucggaagcgaccucuagggugaguuuucaggguggggguggagggagggacugcagugggugggagaaggggcuguggagcugggggcagcugaggccaggugagcggcaugggagggcgcccuucugcuggugcugucugggaccagggcggguccacugugggaucccggcccuacagcccuggggcauucccagaccaggagggcagcccaccuugggaugacaguggugacaagagccaguugcaccccagcgccggucugaagcuuccuccuccugagccugcugucuccaucuggggcaggcacccagcauuugccuagcccccuaguggagccugaggcugccuucccagagccguccuugggcugcuguuguggagaacguucucuggagggcaggggccacucccgugucccccauccaccuccugcucccuguguuagugacucuggccccacgcccgccccugccugccucccaccccugcccggccaccccgcagcgaccuugugugcaccaugcugugugaugccaugccucugguccacccgcuuucugccuugagucauuguggugggccaugcugcagacaucggggagcacugauucuagcgaguuaggcagcugaggagcaaggagggccggcagugacuaguguucuaggaaggcuuccuggaggaggcgccccagaagccagcauggagcacagggcgggcagaguggcugggagcagcggugggcaggggucagguccaagugucccgagggagcaugggcugcugcuggcccaugugacagccuggcucaggcagaggugaggagguccugguaacagaagccccggcagcgggcccaccccaccccugucagaugagccugccccaccuuggugaccacuugguccuuggaggggcagcugccacagggacccccgugggauugagguguccgagucugagcccauggggacaggggacacgggaagcacccggaagccgcagccggcauuggugauugucccggaaacacuggcgcucccagcucugccugacugcuggcaggcuugacguggcuggaucucaacuggggaaggggagaaaggccacuggggagccgggcugugcggccucgagcucauggccuagagaggccccuggccaggccagggcuuagggcagcugcagggggugggccuggaggaggugcagauaucacaugcccaggggaggcacuagugaccagccaggccucggcuucucugcacucccggcuucugccugagcccccugggaaccacccccuccgcaucuccaaaaagcuuuugcuuccuuccuggaaagacccuggaggucccugggggaaccuggugugaggcccuggccgcucagcugcagggucaccuggcugucacuuuuccucccuuuuucagccccucucucucauuucuaagaagucucagcucagccaagccuguaagccucagguugaaucccuuacuuggggcuggugugcagggaccgggaccuccccgauguaccccaggauuguggguguccagguugggcaugcaggaugcgccuccucuuggcccacgccugccccgugagcagauccugggcucagggcgcagaggaggcccuggcaggcccuggggugugggcacaggucagagcagcggagugugagcuggggcucccaugcaccucaugggcugcagagagaggacccagggaguuggggacagagccagguggccaggaccaggcguccuggggaguugagcagaaguccuagagaaaaaacccgugaaauuuacauucuagacaaauuagucugaaagaaaacagacacuggagaaagacugaggaggagaggaaaccaagucuagaaaggaagaaagagcagaccaaaaggccggggcugucguaagugucuuuuucguuccguuugucgucuaggcauuuuccaugagcugcuguuucccucggagcucacacucccugugucucugucccguggcacacgcggcuccugccgccccgucccgcccgucaucccaccuggugucagucggcuucccaucuccagcugucaucagcgucccccgcuugacaccguccccgccguguccauugccccgucucccuuuggucucuccucccaacacggcuccugccccgcaagagcagaaccccacccaggguucccuuuacccccggccuccagccaggaggcccccugcucauggagcgcucuucugggggugggcgggggcugcgugcugccggacagagugcacagaccuagggcucuucccucccuggucuccccuccugccugauaaaccucccucuccaggucucaccggaaacggagccagcccaagaagccgaagcccgaagaccccaaguucccuggggaggguacggcuggggcagcgcuccuagaggaggcugggggcagcgugaaggaggaggcugggccggagguugaccccgaggaggaggaggaggagccgcagccacugccacacggccgggaggccgagggcgcagaaggucagucccugccgggccaggccuggcaccgcuguuuucccacccccgugggcaucuccuagaaggaaccagugccugcuacagccagaguccccguuuuguaagaaucugauucaguggcuuucuugccaggguggggcauuucgugaaaauagacaucguaagguggaggccguaagaaaagugccuccguccccagaauugagaagagcaguuacgagaggccaggcgcaguggcucccaccuguaauccuagcacuuugggaggccaagguggcaggaucacuugaguccaggaguuugagacccugucucuacuuaugauauaaaaaaaauuuaaccaggcuugguggcuugcaccuauagucccagcuacuugggaagcugaggugggagguugaggccguagugagccguguuugcaccucugcacuccaaccugggcaacagagcaagacccaguaucacaaaaauaauaauaauaauaaaagaccaggaugcuguauauggcccagaugcuggaacgugccugcagcagccacagccacuugugggcagagggcugguccugacugugagcuggggcccccgucagcaggucucccaccugcccucgggccuccccacucucccggggcuggcaagacagggggcagccgccuucccacaggagugugaaccagcaguugugaacggggugcggggggccgggaggcagucucagaaacauuaccuuccccagggggagguuuuggcuguggaacucccaccugugaguguguaaagguuccuauuccaggguugacagcauuuuguuucuggugacuggguuuuaucuucucaguuuagagcuuuagcugcuugggagucugugcaaaguggcuguucccagcuagggcuccccgcugggagcccuucccucucccacccuuuccaggugccaugcagggagcagguuuguggggugugcuggccagccugccucccaccaagggcugcccccagccacagugccugaggcccaggucaugggggccacauucgccggaggguccuaguccucaguuucccucuguaugagcccaacaugaccuggucugccucugaggugucaggucuccaggacgcgcuggugcccaaggugaauauuguccuuggaacauggcaagaggcccagcuguggugccauucagcagaugugaggucccucccaccugccaggggcagccguggggugccugaucugugacgauggggucguggcccucgcaguacuccaggaggcaggcacgccccugcccuccccauauacauggggcagauauugagggucacaguuugccagugccugugggccugaggcaagaaaagugagcaucccugggggaaagagcagaggccgggggugaguuugccccugacggaccacuuacucggugggguacgugggcccugcgucuguucagcacgccucaggagggucugccggccuagagaggcaagacgaggacagaaaaggcaucguggguagaagagaaaagcacagcugucguggcacuguuauuauguagcgacaauucucuacugagaagcagcaagcaagucuacaggcagccgccuggugacucggggaucgagcggagcugccagagaugagcgacaggcacagaaacccaaucucgccccucaucugcgagccgcucgcagcaaacauggcucccaaagaugccccuuauggugcuagcaaccagaaauaauggaucuuagaauaaaccuaaccaaaaaaaugaucuuuauggagaaaauuaagagacuuuuuuuggaaauaagaaagaauuccuaaauaaacagaaggaccuaccagguguuaggagagcucuuaagcggacaacuaacggcuucccccacauucucugcagguucagugcagcuccauuugggaucccagcaggguuugcugauuuaaaugcaggcggaugaaagcccaaggccugucaagaggcuggggccacccuuccagaaggcagggcuugccacagagcuugcaggacccaagcaaagauggcaaaaggucuaggaauaggaaucccggagcaguggacuuggugugagaccucaguccccucccucccccuguccacgcugcggccucugugagugcccuggggccgcugaaaugaaggaccaugaccuugguggcguaaaacaacacacgcuccuugucucacagcucuggaggccaccagucugacaggccucacugggcuaaaaucaagcugugggcagggcugcuuccuccuggggggcuccaggggagaaccuguuuccugccugucucagugucuagaggcgcccacaucucuuggcucagagccccuuccuccuccuucacagccacagugcagccucuuccggucucucucugacucuuacccuccuaccuucuacccggugaggacccuggguucccaggucucccagaugcucucccaugucaggguccuucacugagucccaccugaauauuccuucugccacgggaggggacagauucccaggcuccagggauaaggaugcagaugccuuuggggucauuccucugccugccacaugcuuaggcauuucugucaaaagagaacuggcaaacuggaaacacaaagcaggaaaguauauaacccaaggcuaagugauuguuuauuaaaaagcacaaacuagaaaaauaaagaugaacaaauucagugacucucaaauccacugcuguuuaucaaaggaugaaccuuuaagaaagugagaagacaagccgauaaguagggaagacacucgccacccgucaccgaccaagagcagauaagaaugccugaggaccaggaggggcucagccccccaaggaagagggcaccagaagaggagaucccuuaggcuaaugagcccagccugcucugggaagcgcugcagacacgcugcugugugcuccucggaccaccagagguggaaacacccaccgugcccagcccuggaagccggugcagcgggcagcccaguccccuguugccugggaccugcgugaguccggcugcauuggagauggaccuggccuuauccagagaaguggagcauuugcaaacugcacacccagagcugcccucagggcacguuuccuggagagacccccugcugguggggcacuaggacugugcagaugcagggacaggcaaacuaaccaaccuccaucgauggagagggacggggaaccagcgccuccugucacccucgucugcccuggaggcaugagcgcuggaggccacugcuccacgcccuguggcucucggacacgaccucgcguggcacggggcuucucauaugcugugcuccguuuguuuaaaguccacagauggggcggcugaaauggcugaaauguacaaucucacaccuguggaagcgggaaggucacgguccaggugucagccgggcuggcccauuccgaggacccaggaggaccucucccaggccccuuuccugggcuuggaggcagcaccuuuguguucccguguucucccggagugugucuguccagauuccccccuuccuaaggacacuggccacgcugggccuggcccgccccaagggucucaucauaacucauuccgucugcagugacgcccuucccaaacaagguggcaccccagguccgggggcuaggacugcagcaccauucaacagcacagggacucagcucugcagcaggcgaggggcuuccugcagggcaggagcaggcacaggugcccauuuguguugucauccugcagggccugugucuacacugcagguccucugggguuugggaaauccucagaaauaaugcagacuccagcaggcaagcugggcgccugagcaugggucgugcugguagaggauaaguuccugggcuggcugcgguagccaggccuccuguuuucugagcaggagucuguguuugauucuggagacggugagccccaggcgaggucggcaggggagugggggaugggcgcaguucagguucuauuccaagggggacugugggaugucgcuggagggacuggcgugggacagggagguggcugagccgugaccauucuccccacaggaugggcuggcaggggugggcugggcuugggcuggggucccuggggguggggggcugcgugggccaccuugagcuuggaccuugugaagcugcccuucucacgagucagaacgugcugggggcuguguguggucucacaggagaugggugaguuaugggaaaacaagcaggcagagaaagauccaggcuugggucuggggacccgggcccacccaagcccacccguuaacugcccaugugacccugagcugggacaccgccuugauggacccuucaggagggcagagauaagaggacacgcauccuccccaggccggcgcggugggggaaaucgggcaggcugcugccgccgccgcugccaccuguggguucaggcagcgaggaaaguggcccaguccugggaaggcuuuuacagaguggagcuggcuggucagagucuguccuggguucucaguggggccuccugggaggggucacaaggaucccccguaccaugggugucuuccucccucuugagcagacucuaggggcuggccagccucuggcuggaggaagggcggccaccagcuccugugacuuguuuuacccaacuggcuagcaaaggacuguggcuucuuuuccuuuuccuuuccuuuccugauggaguuccgcucugucacccaggcuggagugcagugacgcaaucucagcucaugcaaccucuaccucccagguucaaacgauucuccugcgucagccucccaaguagcugggauuacaggcgcccgccaccaugcccugcuaauuuuuguauuuuuaguacagacaggguuucaccaugucggucagaauggucuccaacuccugaccucaggugauccacuugccucagccucccaaggugcugggauuacaggcccgagccacuaugcccagccuucuuuucuuuucuuuuuuuuugaaaccgagucuugcugugucccccagguuggagggcaguggugcagucacggcucacugcagccuugguuuccugggcucaagcaguucucccaccucagccuccucaguagcugggacuguggacgugcaccgcaacuccgcucauuuuucaaaauuuuuaguagacacggggucucgcuauguugcccaagcugcucccgaacuccugggcuccgccucagccucccaaagugcugggauuacagguaugagccacugugcccagcuuucuuuucauuaaugugacuaacuguuauuuacuaaucuucccaagcccacugacgagacagccacacccuccccagccccggcguuaccugcucucacuugggccucaccauggccuuggccuccaagagacucagguucagggagguccugaaccaggggguccugguucuccucuggucuccccuccccaugcgugguccuggcuggaugggcggcuuuccuccccugacaguggcaguugcccgcuggagagaagccuacaccgcgugggagggaggggaaaccaauggcucguccagcugccuggcguaggugaggcccuggccuggucacucaccauccuguuuaaagauguacagggcaacucgcucccucccgagauccccggggguccacacgcccggugcaguggucacggugccaggaggcugggccuggugcaucucugaggccuguggcuuccacgggucucugaagggaucagcccccacagaaaggccagggaccagcgaggaggguuaggggcuacguugguggcacgucagggucucugcccagggagggcucaggacuggugcugcccaccccccgccccccgcccuggacacccuuaucucuguuccacgacagagacuccugggaaggacccaaucuggcaggggugggcguuuucuuggacacagccguuuucccgggagcccgaagucccaggagccucuggacgagagguuuaucucgagagagccucauaaaugcauguucacagucaggggcacgacaggaaaugcaugccacagugcugcgggaaagauuuccuaaagcgguuucugguccuccuugaaugccaguuucacgccccuaaaagcuaugacgcugaggcaccuuucagggccuagcaguggggugugggguuuuguguuuucauauggaacaagcugggaaggggccagaaccuguugcucacaggggccagggggcaucagcaucggggaggaagccccucaggaggagaggugccuggggggcgguugagaggcugcuucccaguggcugcugguguccccuaucccauucuuacuggcugcuucaaggucugggaagagcggccgcccuauugcccagcgcuaggagggacuagcagccccaccagccagcccuaaccccagaaccaagcagaaagcaggaaggcggccucguccaccucuccugagccuccggggaggccccgccuccuggaagaaggccugcagugcaggacacacagggucagggggcagagccaggauggggacccaggagggcuggcauagugccguccugccucccagaggguggaaaggcugcggugaguggggcagccagcccccagcccuuccccuccccucgccccggagugcugcucucaggagaggccucguggcuggugacugguuuuagaacacggaaagcaaaggcugccaugucuggagggcggccccagcucauagugaggggcugugagcucagcccggggacccgccagcacaucccagcugggccucugggaccgucaggcgcacccggcugcggguucagcacgggaggguggcaguguugaaggggguggccagagagccccugagaccggggcugguuggcccaggcauggaagccaagcacgaaacuugagggaggggccccauaagccaggccgaagcuggugaguugaucucggcagccucggagcaggaacagagugguguccuuggaaaugggugguuucuugcccccuccacagggcagccugggccucgggccugucuugggguuugcuggaggcucugguggaaaccccggcgcuggggaggaguggccucgccaccaggcaggcuagugagcccugguggugggguuuccgcugugacaccuucccuccacccaaaaagagugcuagcagggccucagcuggcugcccucgggggccugggugcauccugggccccaucuguaccauggucccugcucuguccugaagccccucacccgcuucccucccucaggccaggcaggugaggggcgugccaaggucccuguggaguguaguccccauggcagggacagagccccaaggaauggcccacagcaaggacagagccccgaggaauggcugcggggugugccgccgucuuucaggguguccuuccuagccuugggcaucucccucuaacaggguccccugugugucugcccgggcuucacugagccugggagccgacagggagagggcuggaaacuuguucuugugaguuugagaauccagggcaccagcaggugcgggcuaugcguggagugcguugaggcugccgccauugucauucacugcugucuccagacaggggaugggguggcacucaucagccgggcaccugaggcucaaauuaugucccacuuugucucccaugccuggucccuccgggagacagaaccaggcagccaaccagggagggcuguggggaagcgggacuuggggccaucccuguccuuggaggaggagggagagagcccuacaguguggcccuuggugagaggacagcccccgggaggccuaggggacgaugguggccucagcuccccacccagccuugccucccgagcagaaccagggccuggggcggucacaccagccgccccucagcucccaggaggccccguuggucgggggaggaugccagccccuuagagaggcggggacuccccagggacccucugagcaggcaccuguggucucgugaggacagcccggcucugugucucuggccccacagcccuggcuggaguccccugugcacagagcugccuguugugugugaggacagcccagcucugugucccuggccccacagccccggcuggagucuccugugugcggagcuaccuguugugugugaggacagcccggcucugugucccuggcccccacagccccggcuggaguccccugugugcggagcugccuguugugugugaggggugggugggggugccggcuggggacucugaugaguguuuccuccucgccuccuuccccaauuccucaugugugcacugaguggcccugcagcuggaggccgugaggcuguguccuggcaucuuccucccucuccugagaccaucgaugccccagguggggcccuccugggccagaucccacgccagccccugcccuugaaguugaacccggcuugggaagccggcccagcaguggggggccugagucccaguccccggugaggcuggaugggcaccgcagccugcaguccugagugaggcugggcaggcgcuaucauggacgaaggaauauuggauuuccuuaggggaacaaagcuguuuguccucaagugccuuuuacacacgcaggacaguggcuuuccugacaggcgcucggggugaggcgugcggccucugcagccuccccgggcugcuccagcuuccagcccuggugaagcuuccggccccuccccucugcaucuccacgccucugcucccagccucccagggagggggugccuccccucuggcaucggcagggaaaaaguauuucuucccacgccagccugucugcuguguccaguguuuaccuccccuggccagauaacagcugaggggccagauaacaguggaggcggggggcgggggggggggucauauaacagcggggggcccggauaccagcggaggggaagacugcgcucccugcaaggccagacaggaccuggggguguuccaggcuccccugccgggguggaggucagggaggagcccggccagugcccccagugccccagaaugcucaggacuagcaggggugggggccagggcaguggcgggggcugccuucaccuuauggcugcucgccuguccuucuugagaaacaggugggcgugugccugccaaggacaccgugggcggucccccaagccugcagauggagcuggguaggguguggggaggagagcuggagcagggagggcagggccgccuccacuccugggggaggcugugggcugggggccccuugugggaguguguggggcaguguggcuuccuccuggcugcagggucuguugggggaggguccucacuugacccuuacuggggucagugugggucaaggguuaagugucacccucggcccuugggagccucauugcugagggucucagcgcuuaccacugguccuggcaucacggacuguggagcugggggcagcccgugguggguuuuauagcaaguggugagaugugggcgcugugcuccaaaccagaccccguuaagugccacauggucaacaguuuagugugcagaaaugaauuuccuucucuuaauuuuuccuuauuuuuccagccuguugggggagguggagguggugaaauguuagcagugaccaguucauccugaucugcuugggaccuuccaguuuuagcacugaaagccccacagcccaagaaucccuuggauaucaaccacgguuccuccuuccagaaugucccaagagccuuagggccuggagacacacaggugggggccugagccccugucccccuccuccagauggagcaggcagggccccagggccccagggcucacgguguucugggguccacagugugcugugcggccaggcuggucuuccucgaggacagggcuccaaguugccgugccacaacuuacccugagugcggcggcccucagagggauugccccggcacgagcuucccacagcccgacacagagcgccgcugggcucacauggagcugugugcagggacaggcccuccugggcacuccaggacagaaaccuuucccagcaucuagaggccccugcaucccucagcucgagucccuuccucucccuucacaggcacagcgcagccucuuccagucucucucugacucucacccucccgccucaucuugugagggccuugugaggacaucgggccucuuggaucaucuaggaucaccucccauuucacucagucccacccacagaguccccucugccagagucccccaugucccucugucaugucccacauccacauguccaggagaguugggacccgcacgcuucugggggcugugauucagccagccaggcugcucaucccaguuuuauuuuauuuacugcaaacccguccuggccccaaaguaaaaugccaccaaacacaugagucaacuguccccucccugucaccugucaggaaaucuccccauugcuggccccggggaguuccacgcggaagggugucgggccccacaggcccaucugacgcuuccugguucgcucaugugaccgccagguugggguucguugauuaagauuuugugcguuguucaagguuuuacuuucgucaaaagcaaaaccuuaacguuucuacaucaacaguagaaauguacguaauucggauacacgagaacacaaaaagugcuucucccccaccuccaccgggaaagugccauuugguacggcccacccaggugggagcccagaagacagagcagccuccccuggcuggguuuggugacgcgucuccucaccucccgugaccccagaaggcacauagagcaacaccugguggguccucacaggccuuggcaggcaagugccgcugcugcgccugcguuguggggagaccaaggccugggggugccuggccaggugccccugcggugaucugagguggcccgaagccuguguucucugcccacccauguucguguggccucucuggguggaaggagcccucgaccaucccagucaaaguugggggauuucuggggagcgugggaccagcacuugagcccggguucuccucccugaccucccucuccucuucccacagaggacgggaggggcaagcugcggccaaccaaggccaagagcgagcggaagaagaagagcuucggccugcugcccccacagcugccgcccccgccugcucacuuccccucagaggaggcgcuguggcugccauccccacuggagcccccggugcugggcccaggcccugcagccauggaggagagcccccugccggcaccccuuaaugucgugcccccugaggugcccagugaggagcuagaggccaagccucggcccaucauccccaugcuguacguggugccgcggccgggcaaggcagccuucaaccaggagcacguguccugccagcaggccuuugagcacuuugcccagaaggguccgaccuggaaggaaccaguuucccccauggagcugacggggccagaggacggugcagccagcaguggggcaggucgcauggagaccaaagcccgggccggagaggggcaggugggguggagcgggggaggcagggaggaggggggcaggugggguggggcaggggaggagggggcagguggggcacaggggagcugguggcgggggagggggcagggaggaggggacaggagggcugacugcugguuucacagggaacuguggcucuucucacaggguagguggggugucuguacuuagagaacagaggagcccugugguucuuugcugggacagucaccccaggagaggagacucaggccucaggcacgccgagccccuguguggcuccgagggagccccacccaggggucuguagcggggcccucacuacagccuguuguguguuucaggcaccguccacauuuuccaaauugaagauggagaucaagaagagccggcgccauccccugggccggccgcccacccgguccccacugucgguggugaagcaggaggccucaagugacgagggugagugggggguccccaggucggcucucaucggcccugcuccgcgcucugcugcugcuggagggggggccuggcuccccugcggcuuccuucccccacuuccugggucuccuccccugaacccaggccuuucuguggcucugccguagcgacaggcugucacuggggcagguggucgugcggggaggcagcugcuguuagagaugcucggcucugcucugcuggcugggcugcccaugaugggcgguucagggcuggggagcuuguaccuccccauggaagauuccucccagggcugagcacaggccucuccaggacuuggagagguuggaacaaaaggcucccgcgaagcuuugagugggaggggaggagauggaaucuucgauuuaacccucagccgagagcugcugucuugugugcagaaguccugcuaagccaguuuuucaacuucugcuucggccuuucauuggggaugcauguagaaucugaaaauggucuggauggcgucuuucauccugcaugcaauuggagggguggggagaggaggguucuagaagcgcgugggaucacagggcgggagcucccaggaguggaggaaucggcacggggacagaggaaugaccaggggcccccgcgggcuggcuugggaaggggucuugccuucuacccagguauccuuccagaaggcaucucuggggccuccguggacucccccacuccccacaccccacugugacccuuuggugagaccggagcauuugccugugagaccaucacggccccagaaccccaggcauucugggguugugagugacagacgcagccaguggcucuguucucauccccagggccucggggccgcuuagggccuucccugggcuccgcuggcgguacugucugguuuggguuuucagaggagucuuggccuaagggcuuccugaguccaccaugggagaccugggccuccaccucggggagccugcccugcccugcccugcccuccucuaggugaaccaggggcagugccacagcugggcugaucccaggaccccaggcuccccuuuagguugggcugaggauugggccacaggagugggcaccccacuuccuggggacagcaccccuguguccacaggagaugcagggaggggacguggggagauuggggugcggcagcuggcaauggaggccauuagaguucaaugggaacaggcaacaggugggagagagaccgccgcggcuucucagcagcagaccugccuuccgggagaguguccccgucacgcagcucuuccuggggcgggcugccuuggcuuccuagcccuggucacggccccuccugacucccugucgcacuccucuggcaccucccuugaguucagugagucugugcccaccuaagacaggaaggacagugucucugagucucggcuggucacugccgacgcccccacucagacucagaccccaggacggguguagggcagccggggcagggcugggcacugaguuuggccaguccuuggcccagaaggcccugggugaguggacggcucuggauguccagggagaaccagguguugggggaggggcucagaggaaccauguuugggggcucuggccucagguggcagucagccgagacagacgugucccccuccuguugaugggaugggacgcugcagugucagcuugaugggcauuguggagaauggggcagccaggaggcagguggagggggagcuaugggccagggacccugugggcagccagggcuguagacccggggccauccccugggcaguuggggugauuccuuggacgaguuuuuagggggcucaagugucucucucccucuccccucuguucuucuagaggcauccccuuucuccggggaggaagaugugagugacccggacgccuugaggccgcugcugucucugcaguggaagaacagggcggccagcuuccaggccgagaggaaguucaacgcagcggcugcgcgcacggagcccuacugcgccaucugcacgcucuucuaccccuacugccaggugggcaggcgggccucacgggucccagagaaccccaggcaggggcggugggagagggcgagggaccgggcaccccacacgccucccucucucacgcagggcaggguguuggccagcaccccgaguugugagggcuuguuccugacagccguaggcagagccuggucucuggguuuuauuggaaugaagcuuacuaacgugcccaugugcaacaugagccaugguggauggggcagagggaggcugcggaggcucggggucacugcccucagggagcgcccgugucuggugggcgcugagaugggccggguggugugggagugcagugaaggcccagguacaccaccuggguggccgggcggggcucccgcaaacccuggccugucuagcugagcugggcaccuggcuaagguccuguuucuggugcucuuuccaugcuggccucgccuguccucugcacccagauggggagcuggccucugcccacggccaucccaggcaucagcacccagcccagccguuuuccucggaucucuuagauccccccuucucucuuccccugggcaugcagccuccccaggacaggaccuggccacaugcuuugcacucccagcuccuagccccaugccaagcauguccaggcaucagcagagcugcccuggguuggggacgucaccccccaggccugugcgccggccgggucuggguggacagagccagggagagugcugugccgaggguggugagccugucuuggggcucugcugcugggagcuggauuuagugcucugguuccugagacaaacaagaccugacagccgacaccgucuccaggcacuugcuguccuuugugaggccagagaggcugcugggagccacagggccuggaaugccacuucagacaugcgucuuccuaauuccccuugccaggcagaguguggagacucguucaucacacaccacccccagcauaccccagcgccaggggccacccagcaccaggggccacacaggccagccugagcucugugucuggaugcaacccucaugggaaggucuucggcggguuggggacagggucagacaguguuuggggauccugacuuucuggaggagugagaagaggggccgagguggcucuggccaucuccccgaccucccccuccagagccagggggugucgaagccuggggcaggugcccugagagagguccgcgccgcccgcccgccugccccacacauggcucuguccccugaaggucgccucuccccuacaggcccuacagacugagaaggaggcacccauagccucccucggaaagggcugcccggccacauuacccuccaaaagccgucagaagacccgaccgcucaucccugagaugugcuucaccucuggcggugagaacacggagccgcugccugccaacuccuacaucggcgacgacgggaccagcccccugaucgccugcggcaagugcugccugcagguccaugccagugagugccacuguggggcccagaggagcugcgcccuccuucaggguguuggugggggugccggugggggcuccauccuccccugcggagggccacaccggccccucuccccaggcugcacuuucagggccagggcaggggccucccccggugacuuccugcaauuucugacuuucucauccuucccguuguggucccaccaucuagagcagggggaaaggcuguggccauggaagggcuggaugaccgcaugccacccuggggcaggacagggccuccaccgcccccagcauccagaagaugccagugcaggcccaggugcuggccucuggugccagccucugcggaggaagccucugcuccaaggggcacugggcucaucccacccugucccugacacccagaagcucacccuagggccagagcaagaaaugggccaggcaccccgucucuccgcaggcuguguucccugagaauggcugucucugccaagcagccuuugggggcaaacaucccugcccuugaccuuggcccaggcaggguuccuccucacuggcccucuggacaguucugccgagucuucuccaaggccugggaggcgacaggaggaacucaggcagccgcuacgccugugauuuguggcugugguugaaacugauggucacagugagauugcagcguggucagggcgucugauuuaucucugcucucagggaccccuccccaguccugaggcucgaccauggucacagacaagaaaauggaugucugucucuuucccacgcacgggggggcgguggcaggaauuggacuuucagggaaggaggagggcucucuggagacguuuaauuuucugugccccuggcagccauagaucugugucgguuuccuccuggcgguggccugccugggggcucgcguugucuccuggcugggaggcucuucacucugcuuugcugggccuggguuugagaugugcccccggggcagaugggcucccugggggaaggguugccgagggucccaggccugccacagccgggccgccccagccaggcuaccccagcagacgcccccacccccagccgugcccaccacccugcugcucuggaggcagugagguccccgcccccagccucuucagugggccaucagcacuggcagagagccccuuccacacugggggcagugauccccagcagaggcagagcccuggggggcaggcggcaccccugcccucgcucugggggcaugauucggccuuuugugcccuuuccccauuuccagacccagggccacaucccacagugagucucccuugcggcuuuggccuuucuggacauagcaggaggagcugcuguugggggugcagacacccaacaaggaggggcccucaagacaccaccaggcugagcgcggcagacccagcuggagcucagggucccugcuuccccuccugcguccucuuuccacacaaguagcuuccagaccuuucucucgcuccacaugcaguggccuggauugaagcucagagggugggaacagcacgcacccugaaugcugcagcugcgugcggaggccucgucacuccacauacggacacuggcccccaaguuacccggccccucccccugaguuucacucggcuccccaagucucaccugccccccagaucucagccagcccccgcugucuuccagguugcuauggcauccgucccgagcuggucaaugaaggcuggacguguucccggugcgcggcccacgccuggacugcgguaacucgcuccccgcagcggggguggugcucugagaggccugggccccggccccacuccaguggggugacuuuggggcguagucuccccuccgugggccuggguuccuucaccucugcccugaggggguggaacccaagggauucccacccgucacuuugguggcugcuagguugaaauauaagggccgugggcuggggacgguuggcagaucaggccccaagcaguguguggggagccugcuccgagcccugcucauccagggcugucuggucuccacaggagugcugccugugcaaccugcgaggaggugcgcugcagaugaccaccgauaggagguggguggcaccgcgcguuggggcuggagggccggaggggagccugcccugggcugaggcucugcagggugugaccccagugccuagggguugaccaucaccuccacauaaccgcccugugucauggaugggguggccagggcugaggaggagcauacgccugcaccgaccuuccugaaguuccccaggcccugacccagccgacagccacaucacgcccagccccucugugaccagcccagguccucagaggcgcaccugaccccgcugcaccugcccucccagguggauccacgugaucugugccaucgcaguccccgaggcgcgcuuccugaacgugauugagcgccacccuguggacaucagcgccauccccgagcagcgguggaagcugguagguccuugcggucgaggcccacccugcccgugccucuagggcugccggccaugcucggcuccccaccugcgcgaucugaagcggucuuuccuccaagcucugcgucuccauggggguggugggcagcuuucaggaagccagugaucccgacuucagcagguguguuauuuuuugaauccuuccccgaggugcaagguacaaaaaucagaaggcaucaaggguggcagagauaagcaggccccgucagguguggccuugggggcauccucugcagaaucgagcaccccaugcaguuuccaccuucccacaaaagcagaggcaccgcacgugccccgacacaaccgggcugucugaucuuugcuguuuuucuaauaauuauaacaagccugggcaacacgaugagaccccaucucuauaaaaaaaauaaaaaacacuagcugggcgugguggcacacaccuguggucccagcuacucgggaggcugaggugggaggaucgccugagcccgggauacccaggcugcagugagcugugauggcaccauuacacugcagccuagacaacagagccaggcacugucucaaaaaaaaacaaacaauuguaacaaugcuuagcgugagaucugcccucuuaagaagcaucugagguucaguacagcauucaccacgggcccaguggugggcagcagggcucugcggcccgcucacccguccuguauaacugacacuucacacgugcuaagcagcagcucccuccgcccaccccagcacccagcacucugcuucuguguguuugccuguguuauagaccccacgugagugggauuguacagucuuuauucuucugcgaccggcuucuuucuuaagagacagggucucucacucuguuacccaggcuggagugcaguggugugaucacagcucucugcagccucaaacuccugggcucaagcgaucaucccgccucagccuccugaguagcugggaccacaagcacgugccaaaaaguuagguuaacucccaauuuuuuuuuaaaagauggggucucacuauguugcccaggcugguuuggaacuccuggccuugagaucuuccugccuuggccuccuggguagcugggauuacaggcgcgaguggugucuuucauuuggcauaguuuccucaagguucauccacauucauucaacccaaauauggcaggaguuccuucuuuuccuggcucagugaugugccaccauguggauggacgacguuguguugauccgggcacccgccgaugucucugccuucaggcuguuguggguugcgccgcagcggaugugggagugugguugugguuuggagauucugaugucauuuccuguggauacagacccagcagugggcuugcuggaccgucgggcagcucuguuuuuagcacuggaggaaacugcucucccuugcggcuggacggacucccauccgcaccccccgggugcagggcuuuccccuuccccucguccucacucacaccuaccuuugacuuuuuuguagcagccgcccuagcaggugcgagguggucucgcuaugguuugauuuguguucuccuggcggucagugacgcugggcaucuuugcacaguccuguuggccaucugcaugccgucuuuggagaaacgucuguucugcuccuucgcccauuccgugccuggguugcuuggccuuuugugguugaguuggaggaucucugcugcuccacucuuggugcacauugaggccccccguagaugcgcgcagccaccuugggcguagcggggccucaucgugggggcuugugaagcuuccuccugcucucagcaaugauggccccccuuuggggaaccccuuggagccacagggcagucaggaguggucagugcuggccaccagcuggcugugcacuugggacagauuccucgaccucucugugccucggccgucccuucugugcugugggguugccacaguccccgccaugcaggguugcaguggugugagcugggcccacucccuaaagcauggaccacccugucugagcacuagcagcugcucagggcuugucaaaucugcagccucgcucccccaggcccccagugucaccuacugcauuugauccacacagugagagccuguggggucauccugcacugucuguucugcaggugaggagccuggggccuggaggggcuuggccgaucauggccugggcugcagcccugcagggcugucugcugcacacccuguagcccaccugcgcacaaggcacuuggggcuguccacgccugcuggaaaaugacacucagcuggcccuuuaaaucagcuuccugcagagccuugggaccuggcccagaaagaagaugaggaggccaggccugguggcucaugccuguaaucccagcacuuugggaggccgaggcgggucgaucuccugaggucaggaguucgagaccagccuggccaacauaugaaaccccgucucuacugaaaaugcaaaacuuagcucugcauggcgggacgugccugugaucccagcuacucgggagacuaaggcgggagaauugcuugaaccugggcggcggagguugcagugagcugagauugcgccacugcacuccagccugggcgacagaguaagacucugucucaaaaaaaaaaagaugaggagagcaaaaugcagauguugcuggggccgcguccccacuaagggcugugcauguggcagcgcugauggggaggacgcauuugucccugugcacuccggccucugcacacgugucucgugggccccuggaggcugggcccgcagccaguagcacccagcagcguccugccugcuuuuccugccugguuuaucuucccagccgcggacacagugccugguguugacauucaggcuugcguggagguggggcuggaagcagacagaucagucuggcagggugggucugcuggggagaccacaagggugggacugaugccggccacaaagcccgggcucccaugcacuggugcgaggugcccacgagcccggcgggcuuggaugccaugcuuggagcccacaggugcugggccaccugggcagggcugugcaggcagucacagaggcucaucuggaaggggagcccucuuuccuuguucguggaguggagugugcagugggucacgccggccuggccgggcacggccaggcgauuaggaagccggcagcccgcgggugaugcuuccgaggcaccagugacucaguccacaaacgugggcguaaaaggccucaugauucagguggagugauggugcgaugcguggugcagugauaaguccuccugcccgacgccuuauggaucaucugacauuuccagaacgcagccucuucauuaccggugcuuguaacgaugaauuaaaaauccuuuuacacgaggcccgcuuguacugcuuaauggggcuuugcaaggaggcggcgguuaauuccugcucgcccaaccgcccagccaccuucgcgggccacgggcaggcugcaggcauggggcacucacuccugguuacccauccgucaguuugucuccaggacuucuccagccaccggcucagggcuccaggcaguccuggugagucagggggcuccggcuggccgcccgccugggccaaguuaucaccacguucucaaggccgugcugcugagaagcuucucaccuaccggcugggcagguuccuggcagcaggcaaaagcaccgggagcucccuggaggaucugggaggucugggaggggcuugggauggggggaggcgccuccagggcagcaggaggggugggcaguugcaccagcucucuccacugcccacaguccugccuggagggguagggcucggucaggagggaggggcucucugcuccucagggguugggguuguuugcgaaagcagguugguggacagccacugcgccucagugugugacaggcugaggacacagcuucaugggugguaccuagcggugaccaccugcuuccuccaggccguggugcucugcagaccucugaagcccacccgcgucguccucacagcccuguggccuccgaggaaggacaccgagccgggaacuucgaaccaaacaccagugccugggcccuuccaggccccccacgggccguagacccugacuccccggcacacacuggccugggccaggccagcacuggaugugggucuucaaacugcggcucccaggaagggaggugacggccaagaacgccugcccgaccuccuguggccacagcgcguggcgugacuggaccucgccuuaguagggguggcucugggcaaccucggccccaggcacagcuccugacaaauggucccauggguccgggggcacgcuuuucacaacguggagaugcagggucaugggcugccugcuaccacgaggcggaaggggauggugcugggcaccagccugccccggggcuggguuucuccugggccugggccgagggguggaggccugugggugacguguucaagacggcucagcaaccccaccugacaguguccagguggggccucucccccacccccaggcuccccagggagcacagccuccacuccuacacacuggcuacucugccggagggggaggccgugcuggagugaugccuggcgcguguugugugaugggagaauuggguauuuacaguuuaauaacgagaucucgaugccgucgaucggcccugcuccaggcccuuggcuuaucuggcuuuugaacgugguuuauagaguggugacggugccgcuuauuaaaugcuuagcugggccuggcguggguguggcggccgccagggccccggugcuggcucgggcagguguugcagcgggagccucaagggaugaaagguggcucuccggugcucccuccucaccaaggaggcuucucucagggcuucuuauuaaaagccgauguaaaggaccugcgcgauggcucacgccuguaaucccagcacuuuaggaggucaaggcgggaggaucccuugagcucaggaguuugagagcagccuggacaauauagcaagacuccaccucuacaaaagucaaaaauuagccaggcaugaugguugcaccuguggucccagcuacucaggaggcugaggugggaggauugcuugagcccaggaguuggagaccgcagugagcuaugaucgcgccgugugcuccagccugggugacagagcacccaggcucaaaaaaaaaaagaaaaaauccuucacucuaaccauucuaaagugugccacucuauguuuuuuaguacauucugaguugugccaacuaucacaccgucuaauuccagaacaguucaucaccccaugaagaaugggccccauuaccagucgcucccauccccuacccugugcccacgagcccacuuccugugucuggggguggccugcccuggggguugcagaacacggggucacauggucugcacucaccucuguguccccagggcacaucucugucgccacgugguuccucuggcugagcgacaccacguggggcucuucagugucugucccagcagucagugacacgcagggggacgggagaggacuccccgggggcugaucugucccagcagccagugacaugcaggggggaugggagaggacuccccagaggcugagcagcaggaggcugggucagugggucuggagggcuuggccagggaggcugcgggcucugggcuguggaggggaacccucacugggcagagcgcagggccacucccgcgaugccucccuugaaggcugugccgggaggggccggggacuccguuccagggucccuagggaagcucgagccccaugccccugccuguguccccauccccagaaaugcguguacugccggaagcggaugaagaaggugucaggugccuguauccagugcuccuacgagcacugcuccacguccuuccacgugaccugcgcccacgccgcaggcgugcucauggagccggacgacuggcccuauguggucuccaucaccugccucaagcacaagucggggggucacgcugugagugccugcccgccuccuugcccccagccccuggcucccgcccccaccgacacccgcgcugaccgccccccacacccuccgcacccucccagguccaacuccugagggccgugucccuaggccagguggucaucaccaagaaccgcaacgggcuguacuaccgcugucgcgucaucggugccgccucgcagaccugcuacgaagugaacuucgacgauggcuccuacagcgacaaccuguacccugagagcaucacggugagcugugggguggggcagggggcggggggaggcugggagcacagcgacaaccuguacccugagagcaucacggugagcugugggggugggcggggggaagcuaggaguggccugacuccagaucccuucaugggguccccuuguccucagggccccaggccccuucaggaaaagcaccgcucacuguucagcagaaagcgacccgcagccagggcucugcaccgccccgcuaccccgggcccccgcagccagcuuuggggcuucaggcagagaaccucacuugccagcgcggagagggucuaaaacccagcgacagcccccagcguaguguggccaggaccucaccucccaccucuucucccugcagaguagggacuguguccagcugggacccccuuccgagggggagcugguggagcuccgguggacugacggcaaccucuacaaggccaaguucaucuccuccgucaccagccacaucuaccagguaagcgggggaucuggcagccgcgccaugccuucaccaagcucuucuuguaggugcggggacaggaggaucacaccccuggcccaggugccuuugccuggggcacuggcgggugugggccaugguuagugaggcccgcaggacccagcugagccuuggcucgccugccuaaguuagaagcacagggcuuguuuguuuucaaagcuaaaggggccuccacucgggugacauuucccuuugagacaccuucucaauuuuucuuaacauaaguucucccuuucaccguuuuggaguguacagcucaguaccccuggguuuuuuuuuuuuuaaucaaauugguagugaguuucuucucaugacuguggaagaggaauuauuuaaaaguguggaaucuuagaccgggcacgguggcucaccccuguaaucccaacauuuugggaggccgaggcagguggaucacuugaggucaggaguucaagaccagccuggccaacauggugaaacccugucucuacuaaaaauacaaaaauuagcugggcuuagugacaggcaccuguagucccagcugcucgggaggcugaggcaggagaaucgcuugaacccgggaggcagaguuugcagugagccgagaucacaccacugcacuccacacuccagccugggugacagagcgagacucagccucaaaaaauuaauuaauuaauuaaaugaaauaaaagcguggaauuuuaggaggagagcugcccauaucccagcagcuagaagcgucgcucccaagccuggugccgcacuucccuugagcuccccuggcucgaggcucccgggaggaggcgacagcuugucucuuccagucacaucugccccauuugaggaguggaaacgaagccucacucagagucaccucgggucacgcggcgggucagucggugacguccuggccuuagcucgcaccccgagccccaaguucuuuguaaacaucggaguucagcucuuuaccacgucgguuaaggugaaaacccuaaccccugcgauggucccgaggccgcauuaaggaaaggucccgcccgcaucucccgccagaccugaaugaacugaaaugaucgagugucacugagugcccaggaccaccccuaccccccgccgugcaggccggccccgcccggucaccacucucggaccugucacugagcauccaggacccccacccccggccgugcaggccgaccccgcccagucaccacucucaaccugucacugagcauccaggaccgccuugccaugcaggccggccccgcccggucacugcucucggaccugucacugagcauccaggaccccccccgcuccgccgugcaggccggccccgcccagucaccacucucgaccugucacugagcauccaggaccuccuugccaugcaggcuggccccacccggucaccacucucggaccuugcagggucuucccugcuccuugagaagggggugguuucggggacaagccauccccauggccagcccugugggagcuaccaccaaucuccagacacugucacuucugcucagcuccagccuucccuggggggaggcucaggcagcuccuuggacuuccugauuguguuaggcuuagaccaagggcaaggucgauuugcaccccuuagcccaucccaggcagcagcaaaagagaauaaucccugcucagcucaccuggcagcucuucucucagguuaugaguuucaggugggcugggcgcggugguucacaccuguaaucccagcacuuugggaggccgaggcaggaggaucacuugaggcuaagaguucgagaccagccugggcaacaaagugagaccccccccccccccacaaucucuacaaaaaauuuuaaaaauuagcugggcaugguagugugcgcguguagucucagcuacucgggaugcugaggugggaggaucgcuugaacccaggaggucgaggaugcagugagcuguaauugagccacuguacuccagcuugggugacacugagacccugucuccaaaaaaaaaaaaaaaaaaaaaaacaaaaacucugcugggaagcauucuggugcaucuaguacacggcaggauggguggggucugugugacagugacaacacccuccgccugccccgggagccucagagucuggcccaggcaggucggacuggacuccgaggaggggagguugagccaggaccucuagaacaccauggaaguuuacuccagagaucaggcugagcaugugccagucucucucccucccucaagaaaccuauggagaugauagaaaacacacaaauagauaaauagccauuuauaacguacacagagcacaacugugguggaaaaugacaagggagacucagggugggucuugacaacaucccacagaagaggcgcugacgcagcccccacccugguggcgaaggaagugcucccaggaucauugucaugucaccagagcccaggcagggccagcgucaggggagcucaccucaaggaagccgagcuaaugagacagucagaaaugagaugaugccagccaggcgcgggggcucaugcugugaucgcagcacugugggaggcugaggugggcagagcgcuugagcacagggguucgagaccagccugggcaacgcagcaaaacccugucucuacaaaaaaacaaaauuagcugggcaugguggcacgcaccuuuagucccagcuacuugggaagcugaggugggaggaucacuugagccugggagguugaggauucagugauccaagaucgcgccacugcacuccaacccgggugaugaaacaaagcccugucucaaaaaaaaaaaaaaaaaaaagucacauuuccagagugcucggggcgggggggcagaggcuguggaaucaggaaugggugguaucggaagccagcaagccaccguggagugcgcgccugccugcgagguggcggcaggaccucgaucacacaaucaugcaaacgcccgcugugugguggccaaggagauggggcuggagcugccugccccgaggccaagggccuggucagcggggcggguggcuggggugggcccaggugacagcgaggccgaguggcugagacccccacaugccaaggccccaagagccuccccgccuguccggaacacuuggaacauguuucccucgcacgugaccccucgagaugcuucugagacgugccgggcaagacgucaccacagggagcccgggccgaggcgcacgccucugauuuccuguagcugcaaguauauccaguuuucucaaaauguuaaaaagcaaacgccgccuucagaacucgcccuguggagacucauagugaaagcacguuccagggaggccacugggaggaaaucagccugagucuccagucagcccccaguucccaaaugacccaggcacagaaguuucccuggagcccacuuggacccggcagugugagcgccauccuccuaggcgguucugugcuccugagaaucuggggcggaucucugcagucuuccugacccagaaaccugagccaguuuccacugaguuucuagaacgcgccuuccccuccuggcaaggcugcuucugugccugacugaaucacugugugccacgccugccagaagccgagaggccgagucggggccggggagcuggggaaaggcagcaggugggcccugggacuccugcagugggagcucuaaaacccgcugcugcccguggcaaagcggagccuccaaaacccgcugcugcccuuggcaaagcggagccuccaaaacccgcugcugcccguggcaaagcggagccuggccacgccggggguggaaaucgcuuuccggggugcuggggcuccgacacuaggacuccuucacccagacucuccucaccggacagacgcugggaaggggccuucucccgguggcuuuccucuacaaaugagauggguaggacggggcagaggguggcacccauguccuugguucccagcaggcuccuccacacauccccgagagaugugugcugucgucccaggacacggcccagaggcaaccggccaucugagaguccacacugggcacucccagcccugcuucucccgccgccugcgccggccaagaggcauguggaacccacagcagacacuugcuccagggccuacgucugucuccauccccacccaucccuggaggagucacagggaccggcaggcuuggcugccccaaggcagggucugugcucccuuggagagggaggugcugcgaucccgggcccccccgcugcacacuacguggggcgucuagccccagacacacuuccgcgauggucuuacugugugacuuuuauacacuuccgucauggucuuagugugugacuuuuguacgcuucugugacagucuuaugugugcauuuuguucauuuugagacggggucuugaucugucacccagccuggagugcagugacauaauuagagcucacuacagccuccaccucagccuccuggguagcugggaccacaggcacaugccaccaugccuggcuuguuuugaguuuuuaaaugugaaaagcgagcccucugauaugggaaccuucucccccuggagcagaacggcagucaggcccagggagugaccccagcaccuuuccuggcuugggaacacggcgcccaucgcaguuaugaggugggccuggagacacgccccucccuggcacgcccuucaugggacaguguuguguugccagagggccccugagagagucuccgcgagccugagcuggcaccaagcuuaacgaggaggaagcggggugcucccagugccccucaccagucaggcaucugccaccuggaacaaggcaccagcuggggaggcuggaagggggugauuuuucucugaguugaagggaagaggugacugagcuguuuucagagggccacacauaagccagggacccuguccuucaccuucugguugggggcuccugagcucaggccccugaguccgccuguccggccuccccugccucccaggcccuguuagggcacugcgccuccugccuggcucuguguccaccagugacucugucaccuuguccuggggcugugucuucauggagacagaugucuuuugagcugggaggaggugaggggugaguguucugucuccauguggaagcugcggggcccugccucugccccaggcugucccguccuccgucauccuugccccgugguacgggacccucagccugauccuuguuugcugcaggcggugucagagguggacaugagcuucagcuuggcugcauguggccucuagcgggccccaugcacccaagggggcuggccucccagcucuugaggccguggccugccuggagcaccugccauccuggcagugccaggccccugagagccacaucccccugcagguggaguuugaggacgggucccagcugacggugaagcguggggacaucuucacccuggaggaggagcugcccaagaggguccgcucucggcuggugagugcgcgaggcuggccugguggcuccgggugacucagggagcccgucugggacgaggcagggcacagacugcgucuuccaauggcguggaccacccccuccucuugcaccucugcuggaagggggucccggccgccccagcacagcugguccaugggcuccuggcaggagacccuuccuuugccuugacuccuggugccgcagcuccugggcgaugccguuaauguggggagggaggguuggagaagccccgccccuccccuuaucacgaaugcagaacagacccucccagcccccugugcccugcaggacccgcgcugccccacccugcacagggcggccucugaaccaucacagguuuugggguacaggcgaaguacgggcaccccaguugucggcuuaaaaaagcuuuuccugagguuuuuccuuauuaaacgggagccugaguccuggaggcagcggaggcagcuccagcuuucgcucccccagcccucaugggcuuccuuuauucucuuucuaaucgagaggcgagaggcgagguguugaggggcagagcccgugggggagguuccugguccuggccacagcugcucagccgcagaggggucccucggaaaacagaugggagcugccagauggacggucccagccccagccagggugcccaccccacuagggggccagaggcuggggccgagugcagggccccucugcuggcaggaucagggguuuacaaacacgaaaacaggagccugcugagcagcccccacagcaaucagggcucuguguccagccagcuccucucagaggccauagacaguggcuggggccgcacagagugucuccaccgugcuaaccacugugcuuccgcucucccgcagucacugagcacgggggcaccgcaggagcccgccuucucgggggaggaggccaaggccgccaagcgcccgcgugugggcaccccgcuugccacggaggacuccgggcggagccaggacuacguggccuucguggagagccuccugcaggugcagggccggcccggagcccccuucuaggacagcuggccgcucaggcgacccucagcccggcggggaggccauggcaugccccgggcguucgcuugcugugaauuccuguccucguguccccgacccccgagaggccaccuccaagccgcgggugcccccuagggcgacaggagccagcgggacgccgcacgcggccccagacucagggagcagggccaggcgggcucgggggccggccaggggagcaccccacucaacuacucagaauuuuaaaccauguaagcucucuucuucucgaaaaggugcuacugcaaugcccuacugagcaaccuuugagauugucacuucuguacauaaaccaccuuugugaggcucuuucuauaaauacauauuguuuaaaaaaaagcaagaaaaaaaggaaaacaaaggaaaauauccccaaaguuguuuucuagauuuguggcuuuaagaaaaacaaaacaaaacaaacacauuguuuuucucagaaccaggauucucugagaggucagagcaucucgcuguuuuuuuguuguuguuuuaaaauauuaugauuuggcuacagaccaggcagggaaagagacccgguaauuggagggugagccucggggggggggcaggacgccccgguuucggcacagcccggucacucacggccucgcucucgccucaccccggcuccugggcuuugauggucuggugccagugccugugcccacucugugccugcugggaggaggcccaggcucucugguggccgccccugugcaccuggccaggggaagcccgggggucuggggccucccuccgucugcgcccaccuuugcagaauaaacucucuccugggguuugucuaucuuuguuucucucaccugagagaaacgcagguguuccagaggcuuccuugcagacaaagcaccccugcaccuccuauggcucaggaugagggaggcccccaggcccuucugguugguagugaguguggacagcuucccagcucuucggguacaacccugagcaggucgggggacacagggccgaggcaggccuucggggccccuuucgccugcuuccgggcagggacgaggccugguguccucgcuccacccacccacgcugcugucaccugaggggaaucugcuucuuaggaguggguugagcugauagagaaaaaacggccuucagcccaggcugggaagcgccuucuccaggugccucucccucaccagcucugcaccccucuggggagccuuccccaccuuagcugucuccugccccagggagggauggaggagauaauuugcuuauauuaaaaacaaaaaauggcugaggcaggaguuugggaccagccugggcuauauagcaagaccccaucacuacaaauuuuuuacaaauuagcuaggugugguggugcgcaccuguggucccagcuacucgggaggcuguggugggaggauugcuugaguccaggagguugaggcugcagucagcucagauugcaccacugcacuccagccugggcaacagagcgagacccugucuccaaaaaaaaaaaaaagcaauguuuauauuauaaaagaguguccuaacaguccccgggcuagagaggacuaaggaaaacagagagaguguuacgcaggagcaagccuuucauuuccuuggugggggaggggggcgguugcccuggagagggccggggucggggagguuggggggugucagccaaaacguggaggugucccucugcacgcagcccucgcccggcguggcgcugacacuguauucuuauguuguuugaaaaugcuauuuauauuguaaagaagcgggcgggugccccugcugcccuugucccuugggggucacacccauccccuggugggcuccugggcggccugcgcagaugggccacagaagggcaggccggagcugcacacucuccccacgaagguaucucugugucuuacucugugcaaagacgcggcaaaacccagugcccugguuuuuccccacccgagaugaaggauacgcuguauuuuuugccuaaugucccugccucuagguucauaaugaauuaaagguucaugaacgcugcgaa

SEQ ID NO: 192714 - RNA, 7453 nt, Homo sapiens
ccuuaauggcgcccgcccagacuccuggaagugagcggccuagcgagcgagcucccaggcgcaaagcacgccggaagcuguaguuccgccaucggacggaagccgaccggggcgugcggagggauguggcccggaauauugguagggggggcccggguggcgucaugcagguaccccgcgcuggggccucgccucgccgcucacuuuccagcgcagcggccgccgcagcggacacuccagaacggccuggcccugcagcggugccugcacgcgacggcgacccgggcucucccgcucauucccaucgugguggagcagacgguacggcggccgggcggggacacgguucgggggcuccgggcuggguggggaucggcuggcugccccggccccucaccuccaucuuucuacccccagggucgcggcgagcgcgccuaugacaucuacucgcggcugcugcgggagcgcaucgugugcgucaugggcccggugagcgccccgcgccgggacccuccccaggacucucccaagcgccugccgacacucccugcgccccuccuucccuggccccagacuuucccucaggcuccgcuccccuucuaacccccuucccuccccuucugacuccccuccuggcucccggucccccaacccgcuccucaccccuucucugcuccucggcucuuaaucuccgacuuccuuccugacaccuggcaccgcuccccucauuccuacgcucaagacucuccccagccauucucaccccuuccuuuccugugucccuagcccccugacuccccccuuccugugcuccaaacccccuggguccucuccacuacucucuccccauccccuucuggggccuaaauucuuccccaucccuuuuacuuugggcucuggucccccuuccugguucccugacccauccccagccucccuuaaaacucucuccccaccccgaaucuggggacaccccugcccucuccaccugcagaucgaugacagcguugccagccuuguuaucgcacagcuccucuuccugcaauccgagagcaacaagaagcccauccacauguacaucaacagcccuggugagcagggucuuuccugggugccaggggcacucgucagggcacacgggugacucaggggaccagaaucccgggucagggauguucucucucugggaaagggugcagagcgucagaguuccagaaguggcuuuaaaccaccaaaaggugccuguugcuggcuuuugagccucgguucacaagucaggauguggccucuuugauccugcacauacuguucugccaaccugacccggcugacauuuaaaaauugguagauuuuaggccgggcacaguggcucacaccgguaaucccaacacuuugggaggcugaggcgggcggauugcucgagcucaggaguucaagaccagccuggguaacguagugagaccccaucucuacaaaaaaaguacaaagauuagccgggcaauguggcgugugccuguagucccagcaacucggaaggcugagggagaaggaucacuugagcccaggaggucgaggcuguagugagcccaucucaaaaauaaucauaauugguagauuuuuucccccuccccaaaaaaaguagucaauuuugauugagcacuuaugauggaggcauuuuuuuuuuuuuuuauugagauggagucucguucugucacccaggcuggagugcaguguugcaaucucagcucacugcaaccucugccuccuuggguucaagcgauucuccagcuucagccucucaaguagcuggggauuacaggcaugugccaccaugccugucuaauuuuuuguauuucguagagaugauguuucaccauguuaggcuggucuugaacuccugaccucaagugauccacccgccucagccucccaaagugcugggauuacaggcaugagccaccacgccuggccugauuucuaguuucucuuggaaauuuaguagaucugaucccaugguccacuggcacaucuggcaagagucagcugacuguaaagcaagcgcucugccuuuugccugcaccugggccgugucacuuguuuuugucaccucccaaccccuggaagcauuuguguuugugaacccugcuuuaaagagcugcuucuagaccggacgcaguggcuuacgcuugucauuccagcacuuugggaggcugaagugggcugaucacuugaggucaggaguuugagagcagccuggccaacguggugaaaucccaucucuacuaaaaauacaaaaauuagccgggcauggugguguacuuguaauccagcuacucgggaggcugaggcaggagaauugcauaaacccgggagguggagguugcagugagcugagaucgcgcuacugcacuccagccuacgugacagugagacucagucucaaaaaaaaaaaaauagcugcuucuggcugggcaugguggcucacacguguaaucccaacacuuugggaggauugcuugagcccaggaguucgagaucagccugggcaacauagugaaagcagugaaacccagucuuaauuuuuuuuuuuuuuuuuugagauggagucucguucugucgcccaggcuggagugcgguggcgcuaucucggcucacugcaaccuccgccucccggguucacgccauucugcugccucagccuccggaauagcugggacuacaggcacccgccaccacgcccggcuaauuuuuuguauauuuaguagagacgggguuucacuguguuagccaggauggucuugauuuccugaccuugugauccgccugccucagccucccaaagugcugggauugcaggcaugagccacagcgcccagucauauuaauuuuuaaaaaaggaggggggcugcaucuguuccacccuccccagguuuaggagauggaauagggaaagggucggggggagcugguccagccccucacuugcucccccgcccacaggugguguggugaccgcgggccuggccaucuacgacacgaugcaguacauccucaacccgaucugcaccuggugcgugggccaggccgccagcaugggcucccugcuucucgccgccggcaccccaggcaugcgccacucgcuccccaacucccguaucaugauccaccagcccucaggaggcgcccgggugagugccagacacgcgagcugcuguugggaaucaggacagggucuagacagaaggacugacugggcggaagucaagcgugggaggggauguuuuuuuuuuuuuuugagauggagucucacuuugucgcccaggcuggagugcaguggugcgaucucggcucacugcaagcuccgccuccuggguucacgccauucuucugccugagccuccugaguagcugggacuacaggcgcccgccaccacgcucggcuuuuuguauuuuuaguggagacgggguuucaccauguuagccaggauggucucgaucuccugaccucgugauccgcccacauuggccucccaaagugcuggaauuacaggcgugagccaccgcgcugggccagccgggaguggaugucuuaaaaugugcaggccaggcugggugugguggcucacgccuguaauccuagcacuucgggagacagaggcgggaggaucacgugagcucaggaguucgaggccagccaggggaacauaaugagaccuugucucuauuaaagaaaaaaaaaaaaaaggccaggcaugguggcucacgccuguaaaucuugacacuuugggaagcuggagcagguggaucauuugaggucaggaauucuaaaccagccuggccaacaugaugaaaccccgucucuacuaaaaauacaaaaauuagcugggcaugguggugcgugcccauaaucccagcuguuuugggaggcugagauaggagaaucacuugaacccaggagguggaagugagcugagauugcgccacugcacucaagccuggaugacagagcaagacucugucucaaaacaacaaagggaaaaaaagaaaaugcacugaggaguuguuugcugucucuugagaauuagcuucagcugggcacaguggcucacaucuguaaucccagcacuuugggaggccaaggcaggaggaucacuugaggccaagaguuuaagaccagccugggcaauggugagaccccaucucuaccaaauauuuaaaaugacucgggcaugguuaugcuugccucuggucccagcuacucaggaggcugaggugggaggauugcuugagccugugaggugaaggcugcaaugagcugucuuguaccacugcauuccagccccagcaacagaggaagacccugucucaaaaaaaaaaaaaggcggccaggcaugguggcucaugccuguaaucccagcacuuugggaggccgagacaggaggaucacuugaggccgggaguuugagaccagucugggcaacauagcaagaccccaucucuaaaaaaaaaaaacaaaaaacaaacaaaaaaaaggcuuagcuaaugcugagacagagagacacuguuccucccagucugcaaggcuucagaugcagaaaauaacauauacuuaauccagucagaaagccuuccugguaguggcaagacugaagcaggauaucgggggauuuacacaaccccagcccaccagccucaaaccggaagcccaaagcccagggaagcuccugagugccaccuccagccucccugugaggggcugacgccgauaccaaccuuuacccccucacucccuuggacgucccucagggccaagccacagacauugccauccaggcagaggagaucaugaagcucaagaagcagcucuauaacaucuacgccaagcacaccaaacagagccugcaggugaucgguaagcacccuccuuuauuucauccugguccgugcacagacggaccaggcguugcucuaagccagggcuucuccaccuggccccugcggacuuucagggcuggaucguucucugggauggggggaccaucccagaggucagccuggccaacauggugaaaucccaucucuacuaaaaauacuaaaaaugguguacuuguaauccaguuacucgggaggcugaggcaggagaaucuguggaauaugagaguuugagguuacagugagcuaauuuuuuuguuuguuuguuuuuuugagacaaggucuggcucugucgcucaggcuggaaugcaguggcaugaucucggcucauugcaaccucugccuccugggcucaagcaauucuccugccucagccuccucaguagcugggacuacagggaugcaccaccaugccuggcuaauuuuuuguagagacgugguuucaccauguugcccaggcuggucucaaacucgugagcucaagugauccagcugccucagccucccaaaguucugggauuacaagugugagccaccacgcccagccauaauuuuauuaaaaucaaaaagugaggccaggugugguggcucacaccuguaaucccagcacuuugggaggcugaagugggaggaucacuugaguucaggaguucaagaccagccugggcaauauagugaaaccccauuucauagaaaagaaaaaaaaauuuuagcugggcaccauggcucacgccuguaguaccagcacuuugggaggccgaggugggcggaucacgaggucaggaguucaagaccagccugaccaacauggugaaaccccgucucuaccaaaaauacaaaaacuagccagguguguuggcacacgccuguaaucccagcuacugaggaggcugaggcaugagaaucgcuugaaccugagaggcggagguuguagugagucgagauugcaccacugcacuccagccugggugacaaagugagacccugucucaaaaaaaaaaaaaaaaaaaaagugaauguuccacagcaucacagaugaauuuugcaaauauguugcaugaaagaagaauaaacacucugugauuccauuuauuuaaacuauaaaaacaaggagagcuaauuuaugcuguuagaggagugguugcuuugggguauggggaggggguggcaaggauuagugacugucgugggcccaagugggguuucaggggugcuggcauuauuccaucucuuggucugggugcugguccuguaggguauguucagucugaaaauccaucccaccagacauuuacgaaucaugcccuuuccuggguguauauuauacaucaauaacaauuuuuuuuuuuuuuugagauggagucuugcuuuguugcccaggcuggagugcaguggugcagucuccaccucccagauuuaagugauucucauaccucagccucccuaguagcugggauuacaggcgugugccaccacaccuggcucauuuuuguauuuuuaguagagacaggguuucaccauguuggccauggugaaacuuugaaggccaauggugaaacaugaggccaaacuccuggccucaagugguccacccaccucugccucccaaagugcugggauuacaagugugagccaccgugccuggcccaauaacaauuuuuuaaaaaacaaaauugaaauugguauuuuacugauaccuaggggaaacugaggcacugcagaaugaggacaugucucagucagcuugagcugcuuaacaaaacaccacagaccucaacagagauuuaugucucacaguucugggggcugggaaguccaaggucagggugccagcugauucgguucuuggugagugcucucuuccuggcuugcagacggccgccuucucgcugugucuucacaugguggagagagagcaagugcacuggugucuccucuuauaaggccacuaaucccaucaaggggccccugaccccaucucuccuaaugacuucccaaggaccccaucuccaaaucccaucccacuaggggauggggcuucaacauaugaacuugggguggugggcacaaacauucaggccaaaacaggacccagaccuggcccugggucucugcucuuacccuaaugugucucaccuccugcuuccccaccagaguccgccauggagagggaccgcuacaugagccccauggaggcccaggaguuuggcaucuuagacaagguucugguccacccuccccaggacggugaggaugagcccacgcuggugcagaaggagccuguagaagcagcgccggcagcagaaccugucccagcuagcaccugagagcugggccuccucuccagaaucauguggaggggccagaggccugccagacccccagcugggcccugcucaccccuuguugcugggcuuggaggggccucuugaggaacuuuuaauuugcaggggugcccgcuauggacggggcauuccagcugagacacugugauuuuaaauuaaaucuuuguggucuuugc

SEQ ID NO: 192715 - RNA, 7709 nt, Homo sapiens
gggcuugggcgccagaggcggagucggggaggagguggcuccagagauggcagugagcgagaggagggggcucggccgcgggagccccgcggagugggggcagcggcuacuucuggugcugcugcuggguggcugcuccgggcgcauccaccagcuggcgcugacggugaggcccgccgcgcgagggucuggggucgguggcgcaacuuugucucggagaagcccccuggcuuggaguggucucguccgcccucccccguccccgaggcgguggagugguccggcgccccccguuuccgggcccggaguggucucgucccgggauccccuucgguccuccggauggaguugccggguccgccucgcuggggucggcccccucccuucgggggcgaggcuccaucucuuggggacuacaccccccuuccccccaacugggucuuaguccuuuaaauucuuggaaucacuuuuggggcgcuagagacccuggagccgcacagcgggguccuggggggcuauagagugggguccucugggcacuuaaugggauuugggggguucuguugaaauauugcugggagcucaacuggaauguaaaaguucuucgggaaggugaaggucaggcacgccgaggugaauaacuguucuccgggcggugcucaccccaguggggagacuuccaggugccgcaggaucucuguuccuggguucucagaacagaggucggagaaugcaggaccacccuuccccugcagggaggaagucccucucaacuuucucuugucauccucugggccuguccuaaauagagggguaccaggaggcccuucuggagguccucgugccagaccccuggggcugggcaggcggaaagaggucugaacugccucugccuccuuggucuccggcagggggagaagcgagcggacauccagcugaacagcuucgguuucuacaccaauggcucucuggagguggaguugagcguccugcggcugggccuccgggaggcagaagagaagucccugcuggugagggaccuugaggaguuugcuggaggagagcacggugcaaucccccgguucuggguucccagcucugccgcuacccaugugaucuuguacaagucccgucaucucucugagccuguuucgucaucuguaccugggaguaaugaugucuuacacaggaugugcuaggcacuuuucuuaagacuugggggacaggcggggcgcgguggcucaggcuuuguaguccuagcacuuugggaggccaaggugggaggauugccugaggccaggaguucaagaccagccugggcaacauagugagaaccccgucucuacaaaaaguuuuuaaaauuagccgggcguggugaggugugccuguagucccagccagucgggaggccgaggugagaggaucguuugaaccugggaguucgaggcuguagugagcuaugauccugccacuguauuccagcuugagaaacagaaugagguccacccaccaccccaacucuaaaaaagaaaaagagcgugugggaucuagcacauguuagguguucaguaaaugugagguuagguuucuauugcuacugaaagggauagcugggaggucucuacugucccucacacccuccccuuuuuuuuuccacccaccaggugggguucagucucagccggguucggucuggcagaguucgcuccuauucagugaguggagggcauggggaagacgggagaaggggcuggagggaggggguagggucuguccucugcaucuguaacccaagggccccuguucuuugucagaggcaggagcaggaagaucccguggguggacagggagggagacaggguggagcuggaccaggagaggaguaaccaagacucacucccuccugcccaccccccagacccgggauuuccaggacugcccucuccagaaaaacaguagcaguuuccugguccuguuccucaucaacaccaaggaucugcagugaguuggggaccgggggcucgcucagauccuucgucugcguuucccuggugugaugcccacacgcaccugggcugaucaggugggaugagaagcagagagagaaagccacuuacuuuuuaguuuugccuucaagucuucugauuguuggaaggaaggagagagggacuccgcggguguuggugucucagggcagaagacccggauacagaggguuguugugagaaugaauaacaauuguucgcacauguugagugcuuccggugucccggagcuuuaauacacuaacucacccauuccuuauccugugaucaucuccgcucuucagacaagaaaacugagucccaggaacugggauucuggggccagggucugacaaaaccauguugcuuuucuguagauaaaauguuuucuuuuuaaauaauauacuuagggccaggcaguggcuuacgccuguaaucccaguauuugggaggccgaggcaaaaggauugcuugggcccaggaauuguagaccagccugggcaacauggcaaaaccuugucuuuacuaaaaaaccaaaaaauguacaggaauuagccaggcaugguggugcacgccuguagucccagcuacucuggaagcugaggugagaggaucuccugagcuggggagguggagguugcagugaaccaaguuugcacugcugcacuccagccuggacgacagaucaagagccugucucaaaauaauaauaauaauaauaauaauaauaauaauaauaauaauaauaauguagggcuggccaugguggcucaugccauuaauuccagugcuuugggagacuggcugagccaggaggaucacuugaagccaggaguucaagaccagccugggcaacguagggagaccccugucucuagaaaauuuaaaaauuagccaagcaugauggugugcgccugugguuccaucugcuccuguggcugaggugggaggauugccugaucccaggaauuugaggcugcagugagcugugauugcacuacagcgcuccagcuugggcgacagagcaagacccugucucuaaagaaaagagaaaaagaguagauugaugucaugggaaaugacgaauaacugcggaugcaggcagcacaggaaggcggcagccuccuugaccggugggaaccaaaggcugaaacucagugauaacugacucgacuggaccccgccccucagggaggacacgcagaggguccaaggggccacugaguccuuugccggugccugagccaaguucagccccccagccucaugccccaccccacccucaccccaggguccaggugcggaaguauggagagcagaagacguuguuuaucuuucccgggcuccucccggaagcacccuccaaaccagggcucccgaagccacaggccacagucccccgcaagguggauggcggugagucaggcuggcugugcagacggggguggaugggcaggucugcccuuugcacuccccaugccguuuucccacugccccucuauccauccauccaucucuuaaaaucacugcccggucucuuacaggagggaccucugcagccagcaagcccaagucaacacccgcagugauucagguuucggggaggcggggcaggagggaagaugcacaccccagggcccugcggggacccagaaccagcugauggaggggcucugucccuucaggguccuagugggaaggacaaggaccugguguugggccugagccaccucaacaacuccuacaacuucagugugaguguuugcagcgccugcggcccuuccgucaccccagagcacgggacccccaagcugagcccuccugcagcccuaccaucgccccagaccaugggacccccaagcugauugucgccccagaccacgggucccccaggcugagcccuccucucuccccgcccgcccaguuccacguggugaucggcucucaggcggaagaaggccaguacagccugaacuuccacaacugcaacaauucagugccaggaaaggagcauccauucgacaucacggugagcggaguggagggcagcagggccagggagcgcccccugcaggccacugcgggcccagagugccucaccccgcuuagcuuuucccagcccucccgggugcgaaguaggagcuguuauacccauuugagagacggggccaacugaggcucagaguggaugaguggcccaguagaaagugagagagcuggagacccccacucgcugcucucccaggccagcggucgggcugugccccugccgccgcccaccacugcccccuccgcaggugaugauccgggagaagaaccccgauggcuuccugucggcagcggagaugccccuuuucaagcucuacauggucauguccgccugcuuccuggccgcuggcaucuucuggguguccauccucugcaggaacacguaaugccccugccccugagggucccccacgucccuucaccagacccccaucccuaugcucugcugaugccccgcacccccaucucucccugacccucccaccagguacagcgucuucaagauccacuggcucauggcggccuuggccuucaccaagagcaucucucuccucuuccacagcgugagagccuuggaccggggagcagcggggggugggcugaaaggcccacccgggccaucccccaaaucucugcagacccugggccugugggagggccauccgccagcuauccacguguccacccauuuuaccaguguggccagucacccauccccucuguccaccaguccugcggggcagcucuguccaccacugucccuugguucagcugugacuguccgucucugauuguccaacuauucaccccuucagcugugacuguucccuccauuuuuucagccccgauuaccaguuuugagucccacccaccguccucauuauucaacuuucugaccacccaucugauggugacgguccguguuccuaaucccccaccaccaccaucagccucccaccccucugugcgccucacuguccgucuguccauccacccccagaucaacuacuacuucaucaacagccagggccaccccaucgaaggccuugccgucauguacuacaucgcacaccugugagugucccccacucugcugggcagcuggggggaggcaggcaggggaggguuggccccccaccucaucaucacgcccuccccugcuccuucaggcugaagggcgcccuccucuucaucaccaucgcccugauuggcucaggcugggccuucaucaaguacguccugucggauaaggagaagaaggucuuugggaucgugauccccaugcaggugcggauggagcagccuccggagcagggcggggagggcugcacagggcagugggggcaaaggggagcgugccaggcagugcccacccacccccgccgccugcgcagguccuggccaacguggccuacaucaucaucgagucccgcgaggaaggcgccagcgacuacgugcuguggaaggagauuuuguuccugguggaccucaucugcuguggugccauccuguuccccguagucuggugaggacccugcccccgggcugaggcucugcccugugcacaugggcgauguccgcgcugaccguacccuguguccuccacuugucccagguccauccggcaucuccaggaugcgucuggcacagacgggaagggugaggcccugcgccugcaggcccucugcucauggccccauuccuccuccgggcccuucuuucugccccuuggaugccccuccuggccucucugcccagcccccaggccucugccucccuggaugccccagucuggccucucuuucccccgaaugccuuuaucuggccucucugcccuguuggguggcccuucccuccucucugaucucccccuuccgccuuucugccccaccuaauguccccucgagacuugcugcuccuggacacucccucagauguucuguuugucaccucucccagcccccagcccccuccccucccucccacccucagucuccccugaccgcccucucugugcccacccucaguggcagugaaccuggccaagcugaagcuguuccggcauuacuaugucaugguaggagcccgccucacucacagcggguuuggggggauuaccggccugcugcacgcccaccccagccccucagcugcugccccaucccgaggcccccauccaggcuccccagcccgcaguccugcagucuagccccaugccugcccgugccccuacaguccuggccccacgccugcucgcgccccugcaggucaucugcuacgucuacuucacccgcaucaucgccauccugcugcagguggcugugcccuuucaguggcaguggcuguaccaggugagcccgaggcccaggugggacgggagggcggccacggugggggugggggugcgccugacgcccccacuccgccccgucccccagcucuugguggagggcuccacccuggccuucuucgugcucacgggcuacaaguuccagcccacaggaaacaacccguaccugcagcugccccaggaggacgaggaggauguucagauggagcaagugugagcugggcaccaugggcagggccggcggcucuggggguggaguagggggugggcagcucuacgggcagggugggcaggggggagggacuguagcagcccugggggcaguguuagggcagagccugcuguugagaagggauggaggggagauggggggcagccagggcagcugugcagguggggaccggacagcuguggaguaccuaaggccaggcugagcuaggggugggguuagggccgcuagggagacacccagggccgcucugggggcgggggugggcggggccuagguaguucggguagaacggguggggccugggcugcuauggcaguaaggugggcggggccugagugguuacggguagaguggguggggccagggcugcugggggcggggccuaggugguuggaguagaaggguagggccugcgcugcugugggagcgaggugggugcagccugggugagucugggguagagugggcaaggccagggcugcugugguuggggggaguggggcggggccugagugguuccggguagaguggguggggccugcugcccugcaacgcuagacgccuccucgcugucugcccccagaaugacggacucuggguuccgggaaggccucuccaaagucaacaaaacagccagcgggcgggaacuguuaugaucaccuccacaucucagaccaaagggucguccucccccagcauuucucacuccugcccuucuuccacagcguauguggggagguggaggggguccauguggaccaggcgcccagcuccccgggaccccgguucccggacaagcccauuuggaagaagagucccuuccuccccccaaauauugggcagcccuguccuuaccccgggaccaccccucccuuccagcuauguguacaauaaugaccaaucuguuuggcuacgccguugucuugccuuuuuggggguuggggucuacacggagguuguguuuacaauguagaaaccuguuuucgcuguguguggcgggggcgcgggcacaggguccgugucuuuguauauucaauaaauauucauucaguaa

SEQ ID NO: 192716 - RNA, 11823 nt, Homo sapiens
ucuaggaacuuuauauaauuucuuuuuuuuuuuucccauuuuuguauaaaacaaaauggccggagccgagcggcagaaagaaaagauguaaaacaugaguauguacaucaaugguggaacgaugguagaaggcacagcggguccguccggugugacagguaggacuggguuggggguggagggggcagcagguuacacaggucucagccgaagccacggggucagaaauaaagugcauagguccuggggcuccccguggcccagaagcagcagccgacagccccccucuucccgucucuggcaggguucaauugagcgugacucggagguaggaggugggcacguagcccucgccucccucuuuccgccugacccggguccagccguccccuuugucuucuuccauaagacugaggucuucacccucggccauagagauagugcccucgcuggacccugugaugggggugggggugggcccagaucugcuuuaggcaaaauuuauuauuuuuauuuuuuauuuuugagacagagccucgcucucgcccaggcuggagugcaguggcacggaucuuggcucccugcaaccucugccuccagguucaagggauucuccugccucagccucccgaguagcugggaucacaggcgugcgccaccacaccuggcuaauuuuuguacuuucaguagagaugggguuucaccguguucgccaggcugguauggaauucuugaccucaagugaucugccugccucagcuucccaaagugcugggauuacaagccugagccacccgcccagcccugcuuuaggcgaauuuaaacugaaccuagccagagacacugccucccauaccccgccaagcccacucuggccguucucaccuucaaagugguagauggccacacagugaccuaugggggauguggguuccuccucgaaauccucaucaaacuccguguaaauggggguguccuggcucucuucugagggaggcucuucagagcuguuuggggauaauucggcagauaaagacaggcccuccugggacccugggaacagacccacucugacgucaccccucaccucuccuugguguccugugaugcgcuguugcugcugcugucuggcggggcgcuagcgggggggucgggaggccgggcgugccggcucaggcugucuccccgguugcuaaggacucgacuuucagcuucugccagccacgccugggaggaggggacaggaaaaucguuccagggcagagcuccggggucagcccacuuuggacccagagguucccugagaucacccacgcacagccaaggcugugauggaaaacagcuggagaccccccgcuccgaacaccuccccuguccccgaccccccaccccacccagcagugacucagccaggcccgcuggcucccgccccuccccagggucuuuccugaccucauacuucugcacuuccaauuucagccguucaauguugcucaggguuucagcgaucuggggcuccaagcuggcggggucccccaucugaggugucuucucauagacauccuucauuuucuuuagggcuucccuaugacaagggagacaggauagacaggaaaacauacuuccgugugaguuuuuuuguugcuguuguuuuguuuuguuugagucagggucucauucugacucuuuccccaggcuggugugcaguggugcaaucauggcucacugcaaccuuaaccucccgggcucaagugauacuccugccucagccuccugaguaacugggacuauagacccgcaucaccacacucgccugauuuuucaaaaauuuuuaguagagauggggucuggcuauguugcccaggcugaguucaagggauccuccuggcucagccucccaaagugcugggauuacaggcaugagccacagcaccgggcuccaugugauuuaacaagcaaaaaacagggguuuugcaucaaggagcaaauagcaaggcaggacaaugguuaaggaugcaaauacuagugcccgacugccuggguucgaaucucaguuugaauauuuccuagcugugugagcuuggcuuaaaucauugaacccccacugcuguuugcuuauuuuggaaauggagauaaugauccuaauaucucaugugggucacugugaggauuaauacaaugccugauaccuaguaaguccucacuauuacucauauacauauugaguaccuacugcauacagguccuauuccaagcaucagaaauauaacacugggcuggccgugguggcucacaucuguaaucccagcauuauuuugggaggcugagguggaaggaucacuugaggccaggaguucaagaccagccugggcaauggugugagacuuugucucuaguaaaaaaucaaaauaauuuuuaaaaaauaaaaaaagaagggggggcaggggaaaaaauaaauaaagauaaauauaacacuaaacaagacagaucuuaagucugcauacaaucucucaggaaaccuugaaaauucgaauaaauccauguacacuguuucgaauagugccuagaaugcaguaagugacuaauaaauacuguuaucauuaucaucaguuucucaucccugucuccccuaugucuauauauacagguagucacgacuauaauggaccuuuggaaaagaccagaucugagcucaacuuccuuccaguuauuuuuuaucuuuuuuugagacacagucucacucugucgcccaggcuggaaugcaguggcgcaaucucggcucacagcaaccugugccucccgggaucaagugauucucgugccucagccucuggaguagcugggacuacaggcacacgccaccacgccuggcuaauuuuuauauuuuuaguagagacaggauuuccauauguuggccaagcuggucucaaacucggucucaagccaucugccugccucggccucccaaagugcuuggauuacaggcauaaaccacugcacccugccaacuucauuccaguucuaauaccugauccacuuuacagaugaagaaacugaggaauuaaaagguaaaacaggcugcccaaguccugagaugaagcuggaaaucaaguccaguuugucgugacucuagaacaugcacccuuaaccccuccaccguagaaacucaggaacuagagaguucugaauggaacuuuacaccaauaaaagccauucuguccaagagguuacaugcaaauggcaaaauauaauuuggcugccuguuugcaaguggcaaacaucauuccuauuauguaacagaacugggaagaggauuuuguugccuggaaagagugaguaaagauuuuuuuuuuaaucugccagauuuuuuuauugucaauauuuuaaguguuugagcuauuaaauagauaaccauaugcugcuuuucuuuuagccaauuaauguggugaacuagauggauacauuuuuugauauugaacuaucuuugcauuauugggauaaaacccaaccaaugguggauuuuuuuuuuuuuaguuuuuaaaaaaauuuacuuggguuuuucuucuucuucuucuaagagaugggguuuuacuacguugcccaggcuggccuugaacuccuaggcucaagugagugauccuucuacccagccucccaaagugcugggcuuauaggcaugagccacugugcucggcuaauguauuauuauuauuauuauuauuauuugagguagagacucgcuguguuacccaggcuggagugcaguggugcagucuugacucacugcaaccuccgccucccagguucaagcgauucucccaccucagccucccgaguagcuggaauuacaggcgcgugccacaaugcccagcuaguuuuuguauuuuuaguagagacgggguuucaccauguuggucaggcuggucucgaacuccugaccucacgugaucugcccuccuuggccucccaaagugauguauuauuuuuuaaacacuggauuugcuuggcuaggauuuugccucuaugaucauaaauaagguaaaaugagcccuuaauuuuaucuuauugaauucuuggccacagauuugggaaucaggauucuucagccuaaagagguugacagcuuucacacuuuuucuguuugcuggaaugacuuguauaagacaagaaguaacuguuucuuuuuuucuuuuugagacagggucucacucugacacccaggcugaagugcaaguggugcagucacagcucacuguagucuccauuucccaggcuuaagccauccucccaccucagccucccaaguggcugggacuacagacacaaaccaccacacccagcuaauuuuuuuauuuuugcuagaaauggggucucacucuguugcccaggcaggucucaaacuccuaggcucagaugauccuccugccucaaccucccaaaaugcugggauugcaggcacaggccacugcaccuggccaagaaguaacuaagugugguaggaaucaccuguaaaaccgucggggccuugggauuauuggggagaucuuugaguaccauuuaaaugucauucauuuacagacccgggcaguggcucaugccuauaaucccagcacuaugggaggcugaggcaggcagaucaacugaggccaggaguucaagacagccuggcuaauauggggaaaccccgccucuacuaaaaauauaaaaauuagcuggugcaugccugugguccuagcuaaucggcaggcugaggcacaagaauugcuugaaccugggauguggcgauugcagugagcuaagaucacagcacugcacuccagccuggacgacagacuaagacccugucacaaaauaaaauauaauaaaauaaauaaaauaaaauaauaaacaaauaagugaaguucauuuacuauuuuaucauguuccuugccuguccuucccuaccccaccaccuuaccucuggucaaccuccuucugaaguucacgacugcguucuuccaacugcuguugaagccguuuucgcugcugcucugggggcaaguggcuaaaauccucggucaccacugucugcaagguggguagagggcugaauuugggaucaaggagucuagccugccagacucugcacccgucugagauauuucacucccuuccccagccaugguucuugacagcgaagccaugcacagagcaaagcaggucuggguugggcaaccagggaagaggggcccagccagcggcaggaagcgagcccagggucccgccacccgccgcugggcaggcuagggccaccaccuccuccugccccgaggccucacuuaccccacggcugccucgaaggcugcggaaggaugcuagccucgguuugaccgacuuacugaucucgcucaguauggccaaggggucacggccggagcggggggacggggguccguuaggcaaugccgaggguacggggccccccaggggggagagggguggggggcgaggcuaccggcgggggccggggagggggauagguugaaggggugggggggcauaggaggauguagagagugaggacgaauggacggagggauggacgcacggauggacggauggacgcaaaaaaaggaaaaaggaaaaacaaaauggagaaagaaaaaaaacgguaagaaaaccacaacucaagaugcacaaccacacagagaaaacgcaugcaggagcgacacaaaaaaaucuggaagguggcggggaggauguugaacuguaagcccgaaagccagaacucucacucccccgguaucuccuaggucucuggaauguuauguccgggagcaagcauggguccaggaggcagggaggcccaugucucucuguccacuuagcuuucugggcugacagucuagaagacgcaugcaggaaucaaggucucagacagguaagaggccacagaggacaaaaauaaauaaacaaaaauaaaaccacaagccgagagggaguggaaggcaggaaaaugagagggguuaggggcaucagaaguuuaagcucggggaucacagguguuaagucaaggagagguaugagaguguaagugaagagggacccaaaguauaaaucaaagguauaaaccaagggugcuaagguauauuaaaauccaaaaacccaagaaagcaagacaugcagggcggcucccagagucccaucagcaggauggagagagaaacucggggaguccccagggauggugucaccagcccucaggccagcccugaauuccaccagcagguuuucucccagcaucccgagaagcagcagacaaacgccacggaccuccccaccuccccacccugcccccgccuucgccucgggggacucccaggccaaucggccgccuuccuucccuccaguccgggcuggcagccaagaggaaaauuccugcccgagacucggcguucaggcggcuggggcugacucaauaggggccccacuguccccacuucacuguccuucucccccaccaucccaagggucccggcccccaccuuguucuucuugccaaaaggccagcgcuuggugcggcugcgacccgggccucggaguucaggccguccauccgagggggugcccagacugcugucggagggugcacgguucaugggcuggcugaaguccucgaauuccacgucgcccgggcgggcaaaaccugacuugugcagcucuauaaggacgugggaguccugggggagggggacaguggaugagcagucgagugccuagccuauggguaccucccucugcccuucccguagcccaguggacccagaccaggcacccacguucuugggauccacagcauuugcagccaccuucaugcccuccaagcacuuggcuauuaugggcaccaccuccagcucggccuccgacaggagcccauacccggcacccaggcggguggcccugcguucauccaugucuuggagcuucuguaaggacagggacaaggguggcucaggggugcuaacagagggacuagaagcacagugauucacucugcaaauaugaucgcgcuccacgcuggccccagccccaagccagucuggaggggaagacagagucgggaagagagacuccagcccacugugguuggggaagagacacagggccagggggaucucagagggggacgcgugccuagggggucagcaaaggcuucucaaaggaggagacaagggaacagggauuugaagaaaaagcagaaccagcccugauacucccagggccacggaugggacagagaguggagcgcuagauugaaacaggagaggggaaauucgagaccuuucagagggguuguuagagguggagcuuagaagaauaaguaggaauuucaaaaagaaagaaaggucacuugagcacagggguuccaggcugcagugagcugugauuaugccacugcacuccugcccgggugacagagccaggccccaucucucuauagaaguaaauaaacaaacaaguaaaaggcaugcccagcaggaagaacagcugacuaaaagcacagcucacuguuacuauagguuucugauucccuuucaaucuagggacugggacauugcagcugggguuuugaugaaugcguaggaguuggcuaacauuuggaggcuuucgggaagguaggucugagaacugggagcacucacaucgaauaucuggggcaucugugaaaaauagaagugggcuuggucucgguugaagcgcugcaguugagccgcauauucguuuuugcuuucuucggccaugugacuccgaaggugggcuugcugcuuggccugaagaaugcagagguggaagguacugccagguuccgaucacgucccacucggacuccccaagcuugucccagaccccgcaccccccccccgcccccgccacacacaccuucuccacaucagccuugguggcguugauauccuggucuagccguucagcagucugggcugccuucucugccucccggcagucccgcucaaauuuacgcuuacucuguguaggggacagaaccggagugagggagccaccaucccaaagacagcagggugggaaaccaagguuucagggauuauugggaugucauccaguaaguaggggucaagggaguacuggaagccuaugggggagggaagguccaggucugacaaagagggcagcucccugacuccggauccgcaacccugcccccaugccuccgggccacagucacugcuaccucugcaaacucacauucuccagcuguuuaaagccauuuuccagcugcugcugggcccgccgcccuucuuggaagugcuacagaaagaagagugauaaggcucgccaggguuccagcagaagcccuuuguaaaaccugaaucggggggcuccucaccaucuuccucuccuguuucaucucuugugaguacuuggucagcucaagacauacacggacacugagguucucagccaccagcucccgcuggccugcaaagucauucaccuccuggagaaucuguacgaaggacuguugcuggcugaaucugggguuggaugagaaucggggaacagggagucaggccccuccucccgagcaggcugaugccccaggacgcaccuccagguggaaaaggguuaagccccaagaauguaaucccugaagcgaugacaaauucugguccauauuccuuaaccccaacccuugaguagauuuuuuuuuuuuuuuuuuuugagacagggucuugcugucacccaggcugcagugcagcggcaugauugcgucucacugcagccucaaacuccugggcucaagugauccucccaccucaggcucccaaauagcugggaccacaggcacacgccaccacaccuggcuaauuuuuuuuuuccagaugaggucucaaacuccaauccccccgaacuccgcaucuucccgccucacccucccaaagugcugggaguacaggugugagccaccgcacuggaccucgaauguauauuggaacacagaauuuuccaguuuuuaaagaugguguacaaagcuuauaccaucuuuucugcaucaucuuagugggguuggggacaucauuuuguaaucaaacaccguaucuauuuguuuuggagacagagucucacucugucgcccaggcuggagugcaguggugcgaucuuggcucacugcaaccuccgccucccggguucaagcgauucucaugccucagccuccugaguagcugggauuacaggcgcgcaccacaacgccuggcuaauuuuuguauuuuuagaagagacaagguuucaccauguugaccaggcugcucucgaacuccugaccucaagugauccaccugcgcacccucccaaugugugggauuacaggugugagccacugugcccaacccuauuuuuuuuuuuaauuuuacaaugagagguguuaacauucacacuaagugggauaaaagucaaaacuacaauuaccagccuggcuaacauggugaaacccugucucuacuaaaaauauaaaaauuagcugggcaugguggcaggugacuguaaucccagcuacuagggaggcugaggcaggagaaucgcuugaaccugggaggcggaaguugcagugagcugagauggcgccacugcacuccagccugggggacagagugaaacucugucaaaaacaaaacaaaacaacuacaauuaacaaaaaguucaggucagagauugcugccaaacaagugaccaaaacaacuugauuuccagggcuuuuuuggauuuuggaauuggggacucaauuccaagucaaaugcuccuuacggcguuugauauggacugcacacuguuuaaacacauucacucagcucguguucaugaaagcccuacaaagcuggaggaaucgucaucauuccauuucacagaugaggaaaacagaggcgcaaaacuuuaagucaucugcccaaaguuacugguuuuguaacugcuggggccucuguauuuaacaguuaaggaaaauaguggcagaaaaccugagucacaagcccaagucaauuucucuacauaguaguggacucaggauuccaagccagauaaucccgcaucuugcauccaugcucucaccucuagaaggggaagugagaggagcgguggggugucccagcugagggaggggaagugagacccaagcaccgccuuuccccacaaaucuagcccugcagccccucuccaaccuuacuuggacucaggaucauccuuggcaggucucuugggcagauauuuuuucaccaggcuccuaaggggagacagagguaggagggcugagcccgcagcccucccaccgcuccccgucgccccaggcgcguccuccguagcguccaccccagggucucaccgcaguuguuuggcguaagccuguuccacuucggugcguucuuucacgaacuuuacauaucuguccaacagguccagcccccacugcguguggcgcucgagcaccucgaacugauccugacaugggacauggugggggaggaggggagaggggccggggucacgauuuugggaccccacagcccgccgaccagacucccagggagggccaaggcucugcgcuccuagaaggaguggcuucccggcgccgccccggcguggcgcggggggaggcaggaaacuggcgggaacccccuccccuucccgggaagggccggagaacagcgcccaggccccagccaccccggccgggagauggaggucuccgacauaggaccgccaagaggggcguggaaggggacagggccacucccccagcucgggcuccccuaauccccccggauuccggaaaauccggccggcccggcgugagucaaggccagaggggcaggguuccuggcagacugggggccccugaguggccagggggcaggcaccagguucccugaaucucccugcuuccagggaucccccgaugggugacucaauuuaccccacugaccccacuacacauccaaaagaaaucgcagaauuggaggaggggguggcagucugguuacccccgcugcacuaagaacucagggauuccaccgcccccagcaaggggaggggucagagguccggcuaggauagggggaaauuucuggggcuuccagggcugagguuauaggcgaccagggggcggucccgcccugggccuggggugagcagggggaagccagggagggggaucaggccgagcuuagcaucccccuuccccuccaugagcguccccagccccuagguguugauuaaaggcgagggaaagggcggucaggacuucuaggucccacguggguggggaugagggugaccagaggguccccuccccccuccuagccggacaggcggacgacgggcagggacccaggggccguaagauaagccgccugcccggccagggcgcccaaaauaggugaccucucucagccgccccggccuggccccaggauuccuucugcccgccucauucgcaacccugugccucaguuuccccacuccgguccggcaaagucgcccuucgccccugagcgugcugagacucccagauaaacuucgagagagagcggaggguggagggcggggacccaggggucgguggaagggaaaggcgcggagcccccucuaagauacauuggggacaaaaggggggugccuggaccccagcaaaggggaacuuagaggcgggccgauuggacuuacccacagcucagugccccaauccaugcugcucccgccgccgccgccgcagccaccaccgcacccgguccccgccgcccgccgcccgccgcc

SEQ ID NO: 192717 - RNA, 439851 nt, Homo sapiens
gucacacccucgaauaaugacgcauaccuauccuacuguuacugaucaccuaguaauaaucuuguaguucacauuacucauuuuucaccaaauucuuuuggugaaggacgcuucagaaacggccaucacugaagagcagacccguuuggguucuccacgcauucuagacucccgaagagguaagaauuuauuauagggggccacucccaggaccugcuguaugcuuuuaaacauccauuacaauuccagcauugaguuucuaacauuuuuaggcaggcucaggcacugggaguacaggauugaaagacaguucccguccuuaagggacucagaguaaacuggaguugcugaaaaccauucuaaagcaauccacguuaauaacagauacaaguaaaacgugggaacguacaggaaaaagugaccaauucugaggcugaaaagugccuauuuuaggggugggggccucgcggcccuaaagcagcuucccuucccggagauuucagcuccagggaucgcccagcgcccuccgggcacacuuaacauuuuaaucacgccuccgcccccacucuccgaauuccuuuccggcugccgacccgccgaguagucccuuccaggcggccucagcuuaucaucgccgguccggccacuucccggccgcggccaggcgagccucccaaaguuuccugugaggccuucguccgucuccggccccaucucaccacggcagcccaggacacccgcuagggaggagcagguuaccgaggcggggagagcggcacaaacgcgcagaccucgggacuccacccgggcuggugagcgagcccagaaagcggcgaccgcagcuccgcgucuccacucccagggcccgcagcuugggcuaagcgugcgcccacccagccuagggcccaaguccugccccuucggggaccgggccaaucggccgcuccccgccuccugggagguaguggaggagggggcugagggccgggcggcugcgcccgccuuccgcucuugcccauuggcugaggccucgagggugcccggagaccggagugcagcgggauugguugcagagguucgugacaguggcgccuauuggcuguggcagcccccgugacgcgggguggugacuggcuccggagucugagggguucgggcuugucagguucuagguaggugcguuucgcgccgccggcgguaggcgcuguugcccggggcaacgcggggggaggggggaagaggagggaaggcaagccuagagcgggggcaacaaugccugcccgcagaggggcgcccgggauucggccagggcguugggggcugugccgaggcucuuccuccgcccucagccagcgccccccccaacccccgucccuggcugcagggucauccgcucauccucccgcccgcagcagagcauuccugguuggggcuugggccgggcuacacacccagccccacgagggccgccccucccaccaucccgggacccgaaggcugagggggcgggugccggcgcgaaagggcuguggcgggcguaguggcuccgccccgucgcggggucugggggcugaugggcgugaggcggggugguggggggacugugggcaccacccaaucuugccuguacccucaccccuuuucucggcggcacucaucugggcgccgccgucccgcuacgggggcauucucaaccccugguauuccccccaucccuuccugcuucuggagccccgcagucucccuugacccgcucgguccuccccagcucuccuccuaucugucaccuucucccgcuuuuaucccccaccucaucuuucuccuccggucuuggccagagguguccuccaagagucuaaucaagagauagaucuuaagugugaagcuaguggugucgucgguaauuucugcucuguggucucuuugccaguuagaauuggggagauguuuggaggcaccuucaggggucauccuucugccuuacaguuaccccuaggaucuacuuucugaauacgcucauuggguuguguugguaggggcaagguacuucuuaaacaaauugaggauuguacuaugaggugggcacuuuguacguuugcgauuuugccauccacuguagugcaauucaaaaucuaauaauuuguuacggcugguagccuuacauuuuuuuccuucgccuuaugguuaaaaaaagagcagcuuuuuaaccuuuuuaauucagaaguugcguauauuaaugguugucucacuaucacuuugacauaaacugcuguaaagguguacuccauuuuccuuuucuccagauauguuaagauaauaaauuucucagaugagguuaccauauauaaaaguguaguggaacaucaauaagagaauagaucaaaacuauuuuagugauuaaagauuagaaaauacuuuucaauucauauguggaaugagaauaggauaaaaaaaaaaaacuauugcaaaaucuuuagugcaguauuuguaguccugguauauauaccuguguugcccuuaagaagacauuugugaguagcuccagguuugucagucgggaaagcagaguguaucuuuuuguaguccaggaaagcuuuucugcuaguacuuuugagccaagagaauuaugcuuccaaagaugcugggaauauauuaagagaguacauaggcauacuucuguuuucaucuuugaaagaccuuuagugaagaucuguuucucuucugcauugauuguugacagcauuaaauauacauaaucuaaaacuauguagugucaaguuguugcagcuucugcacugcuucaaagguugaugucuuuaguucagaagaaauaauucaagcuuugguagacaaaucauuuacauuucaucuucgauguagauguuacuguaacucuggaccgugaacauuucaaauuugccaguuuuuucucaacuauuuuacuaugaaaaauuucaaacaaugcagaagagucgaguugaacccaccaccuauauauuuagcaauaacgauuucaagaccacuguuacacaguaaacauuaaggaauagaggaacugaaaugaucaagcuuaaaaaaccagcguauguggccgggcgcgguggcucaugccuguaaucccagcacuuugggaggccgaggcgggcggaucaccugaggucgggaguucgagaccagccugaccaaaauggagaaacauggucucuaauaaaaauacaaaauuagccgggcaugguggugcaugccuguaaucccagcuacucgggaggcugaggcaggagaaccgcuugaacccgugaggcggagguuguggugaguggagaucacaccauugcacuccagccuagguaacaagaccgaaacuccaucucagaaaaacaaaaaacaaacaaacaaaaaaaccacaaaaagcccagcauauguauauacauguauauguaguauacauguauauacacaccaccaaauuauaaggugcuuauuuuuguuugugagugggaauuguacuuacuaaaacuauacuaacuuaauuacaugagacuauucaaagcaaucuugugagugagguaggaagucaucaucuuuguaaucaaggcccaaauaaguaaacugcauuuugguaaucagacaaaaggaaaucugaugaacuuguuauacaaaaaaacguuuugcuucaaaauuggacuccuguguaaauagauuauaguuuuguacuugauuuauaaauaaacaucuuuuggagggaaguccaagggacuaucaauuauguaaaauuuugguaacuugauaaauugggucaaucuuaugucuguucauuuggaauaagaauguauuuuuguaauggaaaaagcuuacaaaggugaacuuuuuuuaguagaacugcuucauggagacugacguaauuagagaaauuuaagucaguauuucgauaggacucaacgaucuuggguguugucucaugguucugaggaauauuuugauauaaaacuucaauuuauaguaaaggaauaaguggaaauggguauaaauucacacauuuguauauuuguaauuuuucuauacccgagaaauuuguguacaccuuuuuaaguauuugaaucuugcuuuuuaguuuuugcauacccuaaaucuguuuuucauacuuaccucguucauauaguaauuucuuaaauauuaagggcuaugucucagaauuuauagaucucuggauugcuuuauuacuauuuuuccaaauuucauuugucuuugguaugcuuauguaugguuaaccuaucaugcuauugagagacugaaggaaacaauuaggucacaguuuuagaacuuuaguuguagauucagugaacucagaaacaauuggauuuuuuaaaaucaaggcuccaauuuucccuucccucccuuccuccuucccuuuuuuuacuccuuuucuuucuuauuuuuguuugauuauaaauguuaaaugccuuacaaucaauucagaaaacuauagagaagaaaaugaagucacucaucauucuaccauaaugauuugaaaacuaacaaacuuugauuucuucuguaacacucuaccaauuauugagauuuuaugguuuucauuucaguguaucugcauucacaucaaaauuuguaagaguuccugaacuugaggcuguuaccuuaaauuagaagagggcuccuagaucugggggaaaaauggaaaagaauaaauagaggacagauuagagucagaacagaggaauuagacccaagcaguuacuguuucuuauucuguaaguauaaauauuuuaguuuaccauauaaaacugcuguauggcugacaaaauaugaggccauauuuuuucuuuggaauucaaaguaucuagguaaaacaaaguuuucuugguucuuuucaagaaauaguucagauuucuucauuuuuggaggauauuacauaauucagcuuuaaaaauuuaaugucaugcauguuuggaauuauuuuaaaaauauucauaucagacaauuacuaauuuuuauucaucaucaccauucauuauaaacuugauauugucacuuuuuuuaguagguauuaaaagacuggacauuuuauguagguuuuccuugcuagguuucaaaguguagugaaaagaggagccauuuauuuuagagucagauaaucggguuuuaguuccaguuucuguucugugggaucuuggacaaguuauuuuaucucuuuaagucauaauuuucucaucuauucaauagggauaguaaaauugcuucacuagcuuguuacauagaagaaaugagacaauguagguaagauuuaggaaguauuaaacugacuuuaggaaguauucagcuucuguauucaguucuuuaugugauaacauugauuuuaucucuccuuguauuaauguguuuauuauaccauccacaaaguccuuguuucagacauaagaaauuaaaauauaauuaaauuuacuuaaauuuaaauuuacaauaaauuuacuuaaguugaaugacauuugcauuuauacaaauaaauaguuagaaauaucucagauuagcuguucuuuuuauaaaucuuagcuuauuguaucucagcagggauaauuauaaauuuacuuuaaaugauuuuuaacuccaaaauaucuccaguuugucuggauuccugauuuauuuuucuuuuugccuagaugaucauguguuuuuggaugguugcccuaaauuccuuucauuuaaaccacagguauuagcuacacguuacugucuuaaaucucuaacuagugcccccgcaaacacauuuucucaaucuguuuaaaauuuaaacuucauuuuuaaauuuaauaauacccuuauuuguauauuaguugugucuuuuccaccuccuacugaaacguaugauuauuuuuuaaggagcaguauuuuacagauaucccuguuucagauuguguguucuguaaauacaggguucuaauucuuaaagaacauacaguuuaaaugggcagaccagccuaugguuauucuguguagagaagcaagcacugaacugacuuagcaguugaacuagaguccauauggucucauccagcaguaaaacagauuuuugugauccaagucaguuuucuuauauuuuuucccguccagguacaagauauuuacauguaugacauauuccacugugcaguuuucuagcaugcgagcucuaauucagucucucuccuauucaagaaagcauauuagaaugcagaugauugagagugacaucauuauggguauaaacuugaaucuacucugauuuauuggagaaagugagucauuaaaaaaugugggcugggugcaguggcucaugccuguaaucacaguauuuugggaggcugaaacgagaggaucacuugagccuagaaguuugagagcagccuggguaacauaacgagacggcacucuacaaaaaaguuaaaaaauuagcccgauaugauggcaugugcuuguacuacuacuaagguggcuaaggcaggaggauuccuugagcccaggaguucaauacugcauugagcuaugauugcagcacugugcuucggccugggcaacagagugagucccugucucaaaaaaaaaaaaaaaaaaaaaaaauaguguguaaguauuguuaguaacaaguacugaagacauaccuuacaauucuguaagggacccaaguuauuuccacauuuuccugaagugaaugccccuuuaguuuuucuuaucauucuuauaaugcuacauaagaaaauauuauuacacuaauuuuaugucauuaauagagaccuauauuuaaaaguuagaauaacuuaaugaacauguaaaaauauuuagguaacaguaccucagucuguauugugacuggaauaacacuaauuguuguacaaaaauugaaauuaguuuucuaguguaaaucauuuugcuugcaaaaaggcuauuucuauauugggacucaugguuuuaagagaaguggaaacaguacuagaauuuuuauuuucuaggcacuuagaauguaaaaaugcucuuuacauuggcucagucagaaaaguaucuuugcauuaccaugaauagagcuuaauuuuaaaucacucauccuauguggaaguaccacguauaauauacaguuccaagugaagacuuaguagaccuuugauauuugcaagugguauuuccugaaaccuuugugaaucuaggauauaaccaccuccauaaaaugcagucaaauuuaauggaaaaguuuaagugaucccuucagacccguacaauccgguaaggaggacucgagucauuaaagcuauuaauuuuuuugcuucugaaaugaagacuagacaacuuugcauuacauuauuuguauacaggcaagguucuuauucuugccccuuguauccuauaguuugcagaauaaaagagcauuucuggcuuaaucacaaagcuugcugcguugucacaagguuuaguccuuggucgcuguaaugcuuuucuguaugcuucuguuucuuggauguuuucuccuuggaguugaacacuucuguaguauguguccuuucucuggaugucuucagcuugggagacuuucccaagcuuccguggauugauggggcucccuuguuaauuucacauucuacaaagaaaagugcauuugacucuucuagcaguguucaggguuuuuuuguuguuguuuuuugagacagaauuccacucuuguugcccaggcugaagugcaauggcacaaucucggcucaccgcaaccuccaccucccggguucaagcaauucuccugccucagccucccgaguagcugggauuacaggcaugcaccaccacgcccggcuaauuuuuuuguauuuaguagagaugggguuucaccauguuagucaggcuugucacaaacuccugaccucaggugauccacccgccuuggccucccaaagugcugggauuacaggcaugagccacaguggcuggcugcaguguucaguuuugauaacaaaugggucaguagccacccuagcagcuauaccacaucuuguuuuaugaaaauauacaguaucagccgggcacugugggucacaccuguaaucccagcacuuugggaggccgagguggguggaucaccugaggucaggaguuugagaccagccuggccaacauggugaaacccugucuuuacuaaaaaaauacaaaaauuagcugggugugauggcacgcaccuguaaucccagcuacuugggagacugaggcaggagaauugcuugaacacgggagguggagguugcggugagccgagaccaugccauugcacuccagccugggugacaagagcgagaaacuccaucucaaaaaaaaaaaaaaaaauaauaauaauaaauacaauaaaaagaaaauauacagugucuugacuuucucuugaauuauuuuucuuuuagaauuacaugcuuucuauguacguucuuauauagguuaaccauuacuuaaauuuucacuaagguuuuagaaacuuugcuuuacuaggagcaaaggaaacauuuucagguaucaccuuuuuucuuuguuucaguauagaagugugugauggacuuuguaauauggaaaauccagucacuaucgcauuuccugaccauucugaaucuacuccaaauuuauguauuuggcuaaguaccauuacuuugugaugccuguuuacuuuuaauauauuuaauaaauuugcuauaggagaguaauuaaggggaacuaaacaauguaguuguuucagauaauuauuaaugauaacauauaaugguaauauguaauuaauuauaggucaauauaacuuauuaauauacuauauaauuaaugauagaucaguauuucaauuauuuacaagcauuuauguuggggaugauguaugagaaucuuuauguagauuuauauacaauagaaaauuuuacaaaggaagaagccaauuucuuucuccuacacacacacacauuuuuuguuuuguuuuuguauaguucuuuuuucuccccuccucaacauuuuaaccucccagguagagacaguuucugucaauauaagucuuaagucuuuuaguaaauuacauggcuucagauauaauggugggggcacuaacauuucuuuagugccugcuaaaagugugaugcacuuuuguacauuucuuuugaauuuaugaauuugauggcuugcauguucuuuuugugaucuggaaccaauuuuaggucauaucauuuauccaaggagacccaguuauaaaaugauacugggauuugaacuuggguguuucauacucuaaaccugaaauaaauguaaaugguaaaagucuguaguaaacuauuaaugguccuggauuuaauagaaguuucagcuauuugggagcaacucuaaaggucuauguugaaauauuugcaguuuugcugagauuacuuccucucauuagaagcaagacccuaagauauucaugcuccuggcuaacagucuugugucuauaucuugcuuuggcuuuguucuguuugagauuguccuaaacuauaacuucugugaaguuauaacauguuucuuuguaaaaaaauuuccugaaaaagaaagccagcugcuagaaguggagagagaauaaagaggccugagaaggugguggaucuuagcuagaaaacagacauuuuugaauaaauuuaacaauggaauguugaauucagugagucuuugaucuugacgcacaucaauccuccaugccuuagagguaaaaaaaaguuaauuugugaaacauuuucauugaguguuccagcucugucaaaaauucucauggucuuuagacagacuucuugaaaaugucaggaaucuuacguucauaaauccuguccuccaucccuucugucgcacccucaacaauaauauuugaaaggaauuuguuuauuaacagcuacuacuuucuagaaguuaauauaguucugacaaauaucuuaaaauguuaacauaaacaacaguguccuaacuucugggauaauagggguuugcuauggugacuauuucacaauuaaucauaacaaauauaggagcuagaccuuaccuuggugguugccuguuuuaaguuucugauuucuuuucuguauuuuggagccugguuuacccugugucuggaacuggcauucuaagaucuaaaugucuuagcuuggagauacuugcuauuauauacacuaauaucauggauuuugaaagaggaugaagauggugaagagauagacauggccuucaaucuacauuauaaaaauaauguagaaauguucuaugcuagacaagaggcaagcuguugcaggaaugggacagaaagcaggaagggaugugauucuuccauuuucggucuuucuacagauguuacuagaauacacaccccaugugaggauuuagcuuauggguacagauauuauaaagcauagagagguuucggacuguuuuccugagagggagugugguguggggaaaagagcaaaccuaccuagaguugaaucugugcuccuaguaauagcuguaugaauuuagacaaauaauuuaauucuuauaacuuugggauuuuucaaguucaaacuaagggugauaauacuagaauuuucacgauucuucaguugcaugagaccaaaacucugcucauacuuagggcacugaaacuagaaguauauucucuuuagguacagauagacccucauguaggccuucuccauauggagcucugugacauuucuuucaguuggguucaggaagccaaacauaaagacuucuguuuuccuuaguucuagcaaaaguuccaggauugugucucguugaaggauuccaaucauuuccccaucccugaucccaucgucacagggaugauauaugaugauaggccauaucuggauuaggugcuaauuacuggaacuaggaauaggaaguguggucagcuaugucuaagcccuuuggccugagauucacaaugguuagaaucacucgaggaaggagaagauacugugacccuggaaggagggaguagaugcugggugagcaaaacgcauuuacuauaguccucuagcgugcauacauuuccuccuuuguauauaugcccuugaaaaaaaugcccucaccuaucauuguguaaauuucuugcuuauaacuuucgaugcauuuaccaccugucccucaagaaaagaagacaacuaagagauuuguuuaaguacugcaucuagcuuuaagacuaggaucucuggauaauuucuuuagcucuguuugaacagacugucuuagggucuagcaacuugcaguugaccaguauaauuaauuguaguaaggccaguuuucagugauagaaggaaaauagcauguggacaacaaaaacccuuaauugauauccuacuucaucacucuuaaguucugccugcuguaaaguccuggacauggacauaauucaggcaagugcuuaaucacuuuauaacaaggauggccuuucccccaguuuccaauacuuuguucucauuucugucugagaccucaucagaauagccuuuacuguucauaugucuaccaauauucuguucauggcaacacaggcuuuuucuagcauucaucuucagaacuguuauagcuucuacccauuacccaauuccagagcugcuuccacauuuuuagguauuuguuauagcaacaugccacuucucugguaccaguuucugucuuaguccauuuugugcuucuauaacagaauaccacagacugaguaauuuaaaaauaauagaaauuuauucucucacaguucuagaggcuggaaauuucaaagucaagguguagacaucucaugagggccuucuugcuguguccucacauggcagaaagccgaagggcaagagagggaugaacuguguguccucacauggcagaagagaagagaacacauuccugcaagcucuuuuuguaccagcauuaauccauucaugaggacuccaccaucaugguuuagguuuagguuugagaccuaaacaccuuccaaaaguccacaccuuccaauacaaugacccuggggaaguuuucaauacaugaauuauggagagcacacauucaaacuauagcaacuggaagagggaaaaaggggaaacagcccacagagauaucucauccauaauacagguauauuucacuggauagauaugacaaggauuuuuugcccuggcaguggaauaagauuuuugcuuagccaauauggcagaauggauguugcguuagcagucacaaaaacaacauuacucuaguacaucuccaucagaguuuuugggugaccaggugcauuguugaugaucaauaauauuuugaaagcagucuucuguuuuuuuuuuuuuuuucugagcaguaggucugaacaaugggcuuaaaauauucaguaaaccaugcuguaaacagaugugcugucauacagccuuuguguuuucauuccuauagcacaagcagaguagauuuaguaucauucuuauggacucugcaauauuuagaaugggcaaugagcauuggguucaacuuaaagucaccagcugcauuagcccauaacaagagucagucuguccuuugaagcuuugaagucacgcauuaacuuuucuucuguagcuaugaaagucccagaugacauuuucuuucuauauaaggcuguuucauauacacugaaaaucuguuguuuaguguagccaaauucaucagugaucuuggcuagaguuuuggauaacuugcugcaacuuguacaucaccacuugcugcuucaccuugcacuuuuauguugagauagccucuuuccuucagccucaugaaucaaucucugcuaguuucagaguugucuucugaagcuuccucaccucacccagacuucauagaauugaagagaguuaaggccuuguucuggguuaggccuuggcuugaggaaauuuuguggcugguuugaucuaucuagacuacugaaacuuucuuuauaucagcaauaaggcuguuuugcuuucuugucauuugcguguucacuggaggagcacuuuuaauuuucuucaauaacuuuuccuuugcuuuuacaauguggguguuugguucaagagguucagcuuauuuuggcuuucuuuucuuuucuuuuuuuuuuugagauggagucucgcucuguugcccaggcuggagugcaguggcacgaucucugcucacugcaacuuccgccuccuggguucaagcaauucuccugccucagccuccugaguagcugggauuacaggugcccgccaccacgccagcuaauuuuuguauuuucaguagagaugggguuucaccauguuugucaggcuggucucgaaccccuggccucgugguccccccaccucggccucccaaagugcugggauuacaggugugagccacugcaccuggccuauuuuggcuuucaacaugccuuccucacuaagcuuaauuuagcuuuuaauuuaaaaugagggaugugcaacuauuccuuuuauuugaacacuuagaggccuuugaaggauuauuaauuggccuaauaucaaauuguugugucucauggaacagggaaguccaagaagaaggagagggaguagagaauggcuggucaguagagcagucaaaacacacauaacacuuaucaguuaaguucaccguuauauaugagugugguucuuggugccccaaaacaauuaagauaguaauaucaaagaucacugaucacagaugaccauaaaagauaauaaugaaaaaguuugaaauauuguaagaaucaccaaauguaacacagaggcgugaaauguguauaugcuuuggaaaaauggugccaauagaguugcucagugcaggauuauaauagaccuucaauuuguaaaaaagggaauauuugugaagugcagaaagucgaagugcaauaaaacaagauauacuugucugauuuaugagaacagcaauuuaccagcuauuuugcuuauuaagaauugcugacuucuuacccuaaaguagaggauuaccaaguuuccuucacuuucuguuauugacucagucccacauuuuagaaguguaacuuguauuaccuuauuucuaguauaauuauuauuauuauuauuuuuuuaagauggagucucacuuugccacccaggcuggagugcaguggcaugaucucagcucacugcaaccuuggccuccuggguucaagcgauucuccugccucagccucccaaguagcugggacuauaggugugugccuccacaccuggcuaauuuuuuuuuguauuuuuaaugcagacaggguuuuaccauguuggucaggcuggucuugaacuccuuacgucaggcaaucugccugccuugugguauaauuuuuuauguuuguuaggcuaguuuuggaugccaguggcagacaccuauuuaacaauuuaguccuucccaucuuuguaaauggcagcuccaucuuuguuuuugcccugaccccagugugagcaaaguuauccuugauucuuuuccuuuaguucuucaacuuagucuuucagcauacucuguuuucuucaaagaaauaccuauaaucugacuugcucucaccaccccuacuucuaucauccugguucggcaacauccuuuuucuccuucugcaugauuccuaaaaagucuccccacuacuacuguugcucuaaauaaauagccuguguuauccuuuuuagacguaagagaucaugucuuuucuugcucagaaucuuucagggguuucccacauaaaagcucaaguccuuaaaaugagcuauaguuucaugguccugcuuuccuuccuucaugcaggaucuuucucugaacuaguucuucucugaacuguaguuuaaaaugggccacgguuuugugguucuguucucccucccucaugcgggauuuuuuuacuauuuucuccaccauucacugcacacaggccuccuuguuuuuccuuagauagacauuuuguacuuucuguucucugcuuagaaugcccuucuuccagauagcgguuccuuuagcuaaccaugugacuaacuuccuuaucuccuucaggucuuugguaaaugucacuuuaucuguaaagucuuuaaucacucaacauaaauuugaaaucuccuaccuacuucauacuuaccuuuuucugcuuuuaaaaauagugcuuauuacuaccuaacacuguguauuuuacuuacuuauuuuguauuuuguuuguuuccucuuucuagaauauaaucuccaggaaggcaagaauuuuuaccuguuguauaggaaaacucauggcacacagauagcauaguaggcuuucagcaaauauuuguugaacgaauuaauaaauaagaaaaaaaaaaugugucguugccucacguaaccauuaacucugaaacucugaagggacuuagaauacccuguuugcaaacaagcaaguuaccuugccauacuuuuauauacauacauuaauagaagagcccugggucagagacucagaggguuuauugcaguaaaagcaguggccagagaaauaucuuagugcuaguucucccugccccaucucugugacaaaacaaugugaugagggccagguguuuaccuacacaugcagcagauuugcaucauaggagaggagccuugaaaugaggagacuccaagcuuguauaggguguuggcacaucugccauccuccccugcagagcgagagagagauuacuuauuaaacacaucgcuuccagaggagagggagaagguaucuuuagguuucuuacccuagaauauaaguaaauguuuccagggaggggaaggagaaggcuuaauuucuccaaagcucuuuggaguuuucuaucuuuagggagauacugucucuagcuuccaaggcugucuguuaugcaaauauccauuuguaguacauuuuggucagaagauucugugcaggaacaugagaaaugcagagugaauuguuucccagcaguaauucugaauuccagcagcuauaucuauuuacaucugaacucauauauaggggcaaaauauuuucagacauuucuccguuucucuucucuugguucuuuguuuggguugcuugauugucuaguagguacuuaucaucaucuuucaguuuagcaaccuuggcugaaagaugacuuuccuuccugauuagcuucugcaaaaauguugggauucaguauuaucuguucaauuuggguaacauaccuauuccuaaacuacugcuugcgagaaggaauaugcugauuucccagacccagguuauguuccuaccccagaaacauuagagugcuggugaucaaugccacccaaaccguguggauugaugauaagagaaggauaguuugggaaaagaaaauuaagaugcugcuaccaacagaaggggagauagaugcuucagaguaaaaaacaacacaggucuauuacuuacaugcacaugcaacucacaaucauuuaaaaaaauauaaucuuacuguauauagauauaacuacuucauuuauuuuuuaccuaccacauaucaugaacaagaaauuuucuuugaaaacaauuuuauuuuauuuuuuaaauuuaauuuuauuauuuauuuauuuauuuuugagacgaaguuucacucuuguugcccagacugcagugcagugacgccaucuuggcucacugcaaccucuaccucccguguucaagcgauucuccugccucagccucccaaguagcugggauuacaggcaugcgccaccaugcccggcugauuuuguauuuuuaguagagaugggguuucuccauguuggucaggcugaucuugaacuccugaccucaggugauccacccaccuugaccucccaaagugcugggauuacaggcaugagccacugcaccuggccguggaaacauaauuuuaaaugguuguaaaauuauacuuaaauucuuuguuuaaaauaaauauuuaguuuaucagaauuggauuuugaaaaacuaaggggauauuuauuagagaaguggggagaguagagaugggaaagagaaguagagccaggacuaggguaaggcaagagaguugccuaggacacaaaauaugagacauaaucacuuuuagggucaugcagcugcaggguggcacuugcaugauccugagaguaucuccuuaaauuuugcgccccagguauuucuuuugcaucacccuagucccauuugugaagacaagcauauuucagggaauaggaacuauuuuuuggcuaugaaugugcguuagagaugaaaguauguguaauugaggaaguucuuggggaagauuaaggugcauuagaaagcagucauuaugcauuuucaacuguuauguauggaaacguuugcugagucugguaagcaugauaauaccuuugaaguaacgcaaggaauauaauuuuuuugauucauagguuuauaguaguuugaauuuuaaaaaguuccauuuagagaugccaccaaaaaaaguuguuacuuuuaacccaaaucuuuucaauaucaaagaaaaaugcuuuuuguuucauuggaaaauaaaaauuauagaaaagacugaguuagagauugagacacaauacauggguccugugacuagcuuacuuucuuuucucuuuucuuuuuuuuugacaggguauugcucucuuacccaugcuugaguacagugaugugaucacagcucauugcaggcuugaccuccuaggcucaagugauccuucugccucagccucuugaguagcuaggacuacagugggcuagcuuuccugagcaagauacuugacacugcucaauauugggcauggaaucucaguugaauaguugucuuucuugaacuuaggucuguggaaauaaccauuuccauagcaaagugagagacuagaacagggaauucuaaauaaugcaacuaucuuugcugauagagaagagaguuuaaacauuuuucauauuaauuggaugaucuaguaauuuuuggguuugucuuuggaguggaauuggauacauauauaauguguuuuguuccucagaaagcuguaugaguaauacuguuuacugaacuauacccuggggauuuaauuaaagaugauguguugaaagcagucaaaagugaagucaugacugaauuuuuuuuuuuuuuugaagcagggucucacuuuauugccuaggcuggagugcaguggcacaaucauuguucacugcaaccucaaauuccugggcucaggugauccucccaccuuagccucucaaguagcagggacuacagguacaugccaccaugccuggcuaauuuauauaauuuuuuuguagagacgggcucucacuauguuguccaggaggguuuggaacuccuggacucaagugauccuccugccuuggccucccaaagugcugacauuacuggcaugagccaccucaucuggccaucauuaaaauuuuauauuuaaaaauaauuuugucaugaauuuuaucguuuuauauaacaacucuuguugaugccuuacuuuacaccaaaguguacaaaucagaggaaaccauaauucauuuuggaauuucauucauuugguagucacuuguuugauggcuacuguguuccagguacuaugcaaguggcugacuguguuaagauagaaauucuugucucauuuaugucacaguuuuauggaagaagagaaauguauuaacacuuuaauuacauauagauuagauuuccaaccaauucuagcuuuaggagcuuugcuauaucuagaagggaauaaaauguuuuccuaagggcgaaggcacccuuuggaaaugguuaaaagauuagaaaaguagacuuggagaauaugccugacauacuguguuugaucuguuugcugaccagaaggagaggaauaaucuuguugguaacauuuauggaaugucaucugauugaugugaaagucaaggcaguagaggaaaugaugggagacagaguaggcaaacaaaaaagaagaacuuggaagaaggggagaguuuaugauaaaccaggaaguugggauuaaaaauaguauggcacaggcaaaaagugagacguuguaacagggcuguaaacuacauauauugaccucagugauaaaggagagagugaccaagaaaaccucucagaagaguucacaguuuucaaggacugaagggagaacagccaauucaaggaucauacuuuggcauacugaagccuaugaggcagaggccaggcgcagugacccaugccuguaaucccagcauuuugggaggccgagaugggugguggaucaccugaggucaggaauucgagaccagccugaccaacauggugaaacccugucuguacuaaaaaugcaagaaucagcugggcgugguggugcaugccuguaaucccagauacucaggagccugaggcaugagaaucacuugaacccaggagguggaggcugagugagucgagaucaugccagagcacuccagcuugggugacagagugagacuccaucucaaacaaacaaacaagcaaauaaauaaauaaaacauaugaaguggagaaaguauguguuugcugggggaauccuucccaaaccuuccccagccuuugaaaaaguuuuucuuauguacuuaauuacuacuuuaggcuguaauaauauuuuaacaagcauaaucacuggcuucuucugauggccuuucagacuuuuucgguuuuugagacagucuugcucugucauccgagcugaggugcaguggcaugaucauggcucacugcagccucaaccuccugggcucaagcagucuuccuaccucaucuucccaaauagcugagacuacaggugugugccacgaugccugacuaauuuuuaaacuuauagagacuagguuucacuguguugcccaggcuggccucgaacuccuguacucaggccauccuccuacuuuggccuuccacaguguugggauuacaggugugagccacugugccugguguguuucaaacuugaaguuaguuuuaugauguaaacguggagaaaaacaugaauuaccucuugaaaacugagggaauagguuggaggagaagguaacaauacauuacuguuucggaaaguuagagaaagauaggggagggaguaagcaauggauagauaaguuagguaaguguagcauucuuauuuuuaacguagcaauugucauaagcugucacaguuaauuuccaggaauagccaaguauacugaaaguguacauuuuuaucucuuucucuguagugaacaguucugacuccuugaauuucuucuugcagcucauguuuuuuggcuagaccuaugaccauuuucgcuagacuucacugcacguuuucucaaguaucuucuuugucccuaaugugugacaccucaucauggacacgcuacuuuagcuaaggcaugaccagcaaugaacaguaguaagguaggauuacuuuauucuucuuaguaaguuacuaaaccguuuuuuauuuugggucucugaaauugugacuugucuugauuuuguaguauucuuuauguuagauuauucuacugucuauguaggcuguuacuguuuuauauuuguguuuauuuauuuuuugcuugucaucuaucccaaugauuuuaccucauuugugacauaauuauuuuucucaacuaacacuuauaauuagcagaaucccaaucuguaucucuuccucaaucugugugcccaccaguccuauauuuucaaccauuuggcaccaaacugaacauaucauauuuuucuucucaaauacuugcacuuuguucugauuucuguauuuccauuaauagcauuauuaaucucauugucuaauauaaucauauauucauugauucauuaauucauuugagguacauugauauucuucuaagugucauacagugugcugccucugaggauguaaugaugaauacacuggauguuccauccuuauuucuauccuuauauucugggggaggggauagguuaaaaauaaauugacaaaacaauuaugaauuauaauacaauuuuuuuuuuuuuugagacagggucuggcucugucgcccaggcuggagugcaguggcacaaucuuggcucauugcaaccuccgccuccuggguucaagcgauucuccugccucagccucccaaguagcugggauuacaggagcucaccaccacuccuggcuaauuuuuguauuuuuuuagaagagaugggguuuugccacauuggccaggcucuucucaaacuccugaccucagaugaucuuucugccucagccuccuaaagugcugggauuacaggcgugagcuacugugccuggccuuauaauacaauuuuuuaaggaaagcaaaagaacagauaauuuggaguugaggagguggaaucuacuuuagauagggucauauaaggcuccucugaggggcuguaauuuaagaugagaccuauuauaugagaaggagcuauuuaaagagugaguguuggggcaggggaagggaguaguuuuugauuggaagagcauucucauuagaaggaauauggugugcagaaacccugaaugaggaaggagcuuggugaauuugagggaccaaaaaauaccagugugguugacacagagaaagaggcagauuugaguaggaagagauuauagaaauauuuagggcuuugaaggguuuggcccgagguuugcauuuuauaucauuuuaacugcugugugagacauggacugguugaaaggaaagugaaagcuggcuuuuaggagcugaggugagauagugauggccugcaugaugguuguagcaauaagggagagauggaugaauuugagaugcauuuuuguguuuuuuuuagacagaacucauaggacuuguauguuguuugggcauggaaagagagagagagaacauacucaaggaugacuucaagaauuuugguuuuugagcagcugauuagaagcugguaucauguacagaaaccuuuuagaaaacuaucuuucuuguuaacugauggauugcuuauuuuagcaaaaggcacuuagcuauagugcuagaaauaauauuagugcuggaaauaaagcaucuggcaaauuuguaauauauacuaguuaauacuuuauuuugcuuuuuuuccacugaugaugaugaugaugaugaugauuuuuuuuugagacggagcuucacucuuguugcucagguuggagugcaauggcacaaucucgauucaccacaaccuccaccucuugaguucaagcgauucuccugccucagccucccaaguagcugggauuacaggcaugugccaccaugcccggcuaauuucguauuuuuaguagagaugagguuucuccauguuggucaggcuggucucgaacucccggccucaggugauccucccaccuuggugucccaaagugccgggguuacaggcaugagccacugcgccuggccuuguauaauuuuuaauuaauuaugaguugaauuuuaucugacuucagagucuuucuggaaguaaaaauaauuggucuauacuuuuauacugaguuuuaagucuacuaucccuugugcucuuuuaaaagagauaauucuuuuaagauuuuuggccaguccgaaaucuucccagacuguuaauucaaaguucuaauauguaauuuuauuguuauuuauuucaaagauuuccuuuuuucuuucuuuaugggacagagucucgcuguauugcccaggcuggagugcaguugcacaaucacagcucauugcagccuggagacggagacagaguuuuguuauguugugcaggcuguucuccugagcucaagccauccucccaccucagucucccaaaguguugggacuacaucugugaacuacagugccuggccuauuuggagauuuucaagcaucucacccuuagauguaugucauacuaaccucacuugaaagcaucuagcuugucuaaauuccuaggagguucauuuauuaucuuuuugguuuuacagcuucaucagaggauauuuauauucagcuucuuaggauugauauuucaggugcaaagugaaauggaauaaaccuuaaaauaaaucuguguauuauucguuucuucuaaauucaucaguaguccuaccuuucauuuuuuucucugaaaaaaaauuuuuuuuuuugagauggagucucacucugucacccaggcuggagugcaguggugugaucucggcucacugcaaccucugccucccggguucaagcaguguucugucucauccucccgaguagcugggauuacagaugcccgccaccaugcccagcuaauuuuuguauuuuuaguagagacaggguuucaccauguuggccaagcuggucuugaacuccugcccuugugauccaccugccucggccucccaaagugcugggauuacagacuugagccaccaugcccggccccucugaagaauuuuuaagauguuuucucaaaaaaguuagugugugugcugucuauaaaaggcauuugguuaucuguuuuaacuauuuuauuuuuauccuuaaacaguucuauuuuuuccacuuugcauaugguuaucuuuugaguuuuagagcugagagguaguaguagaauuuuaguaguaguaggauuuuauaacugaaaaaugccuuggagauuauuccacuuccuucuccuuuagcugggaccuagagagguucugugaccugcccaagaucauguagcuggcuuucauaauuguugaggcuagugcugcuuucacucaucaugcuucaaacuggucuccucucaugcuuucuguauuucucucuuuucaacauuuauugaaaauguucagugccacaucaaaauugaguauauaggacaaugaacaccuauauuaccuuuuaccuggacucacuguuaacauuuugccacauuuucuuuguucacauauuuauauauguaaaaaauauguuaaaaaaucauuugaaacaauauuaaagacaucaugauaacuuaaaacuuuuagcaugcagauccugagaacauggguaauuuccuacauaaucacaguaccaauaucauauauaagaaaauaaccauaacauuaagaauguauuugucuuuuuguucauuuuggcugcuaugacaaaauaccugagacugaguaauuuauaaacaacagaaauuuauuuugcaugguuagggagucuaggaaguccaacaucaagacaccagcagguuuagugucuggagaaggcuuguucuucauaguuugugccuuuuuggugaccucauaugacaggagggauggaacugcgaagggggaaugcagcucucugcagccucuuuuauagggcauuaauucugucuaugagugcagaucauucauggccuagucaccuccugagggccccuacucuuaauacugucaccuugggggguuaaguugaauuuuggagggacacauauauucaaaccauaguaguguuuaaugcagugguucguauucagaucuccccuguuaugccauauauauauguauguauauauauauacacauauauauguauauauuuuguuguuguuguuauaggauucaagcagguuucauguauugcauuugcuucuuaugccucuuuauucuuuuuuauuuucaaacagcugcuugcuuuuuuuuucaugaucuguauuuucuuuuaagagauaagauuuguauguacuuaacaucucuucugggaauugccugguuucuuagaauacuauucaaccaaaauuuauuugcaguuugccucuuuguuuaaauucccugagauagcuggagauaacauugucauuuccaagcuuuuuuuuccucaaaacauaauuucaacuuuaaauauacaugacauuggcugugguuuuuacauuugguugcauuaaguuaaagauaagaaaacugggagauguauguuggacuugaucugcuggcacuagucagcaauugaaauucaaggcguuccuccuccacccuccauugccuauacucaccuucuaaccaggaauucuaucuaggaauauguaucuauuaauaguagcuuuggacauuauaaagcaguagcagucuagucuuucagaaaugcauacuuucaagucagaaguagauuaaaaugcaaaugauguguaagcaaguacauagagacacucagagcuaagcacaaucagaaaagauuuaauuaaauacccucucucucugguacuuguguagaacugucacucagcgaguguucucuuuuaccuucuuuccgugcuuuugcguuucauagauuugguagguuuucuuugagaaggguaugaaauuuggaacgaguguagcuuuuuuaggaagagguagggauaacuuuuaaguaggauauuuacuuuuauuuauuaauuuuuuauuauuuuaagcucaggguuacaugugcaggaugugcagguuuauuauauagguaaacaugugccauggugguucgcugcacagaucaucccaucaccuagguauuaagcccaucauccauuagcuauucuuccugaugcucucccuuuccccacaccccugcugucccacaggccccaguggguauuguuccccucccuguguccauguguucucauuguucagcucccacuuaggaguaagaacaugugguauuugguuuucuguuccuacguuacuuugcugagaauuauggcuuccaauuccauccauguccuuucaaaggacauaaucucauuccuuuuuauggcugcauaguauuccaugguauauauguacacuuuuuuuuaauccauucuaucauugauggccauuuagguuaauuccgugucuuugcuguugugaauaguguggcagugaacauaugcaugcauguaucuuuauaauagaaugaucuguauuucacuggguauauacccaguaaugggauugcugggucaaaugauauuucugucucuaggucuuugaggaaucgccacacugucuuccacaaugguugaacuaauuuacacuaccaccaacaguguaaaugcauucauuuuucuccacaaccucaccaacaucuguugguuuuugacuuuuuaauaauaaccauucugacuggugugagaugguaucucauugugguuuuuguuuguuuguuuauuuuacuuuaaguucugguauacaugugcagaauguucagguuuauuacauagguauaugugugccauggugguuugccgcaccuauugacccauccuguaaguucccuccccucaccuccucaccccccaacaggcccugguauguguuguuccccucccuguguccauguguucugauuguucaccucccacuuaugagugagaacgugggauguuugguuuucuguuccuguguuaguuugcuggggaugauggcuugcagcuucauccaugucccuguaaaagauaugagcucauuccuuuuuauggcugcauaguauuccaugguguguauguaccacauuuucuuuauccagucuaucauugaugggcauuuggguugguucugucucugcuauuuuaaauagugcugcugcaauaaacauacgugugugugugucuuuauaguagaaugauuuauguuccuuuggauauagacccaguaaugggauugcugggucaaguuguauuucugguucuagauccuugaggaauugccauacugucuuccacaaugguugaacuaauuuacauucccaucaacaguguaaaagcauucguauuucuccacagccucuccagcaucuauuuuuucuugacuuuuuaauaaucaccauugugauuggcaugagagguuaucucauugugcuuuugauuugcauuucuuuaacgaucaguggagcuuuuuuucauguuuguuggcuacauaaaugucuuuuuuugagaugugucuguucauauccuuugcccacuuuuagaaggguuuuuuuuuucuuguaaauuuguuuuaguuccuugaaaauuuuggauauuagacuuuugucacauggguagauugcaaaaauuuucucccauucuguagguugccuguucacucugaugauaguuucuuucacugugcagaagcucuuuaguuuaauuagaucccaugugucaauuuuggcuuuuguugcaauuguuuuuggcauuuucaucaugaagucuuugcucaugccuauguccugaaugauuuugucuagguuuucuucuagaauuuuuaugguuuuggguuuuaaauuuaaaucuuuaauccaucugaguuaauuuuuuuguaggguguaaggaagugguccaguuucaguuuucugcauauggcuagccaguuuucucagcaccauuuauugacuaggagauccuuuccccauugcuuguuuuugucagguuugucaaggaucaguugguuguagaugugugguguuauuucugaggucccuguucuguuccauuugucuauauaucuguuuugguacuaguaccaugaaugaauuuugaaugaauuaauuguauccucauuaccugugaacuugucuaguuauuuuuacuacacuguaaauuguuugaaggcaguaaucuagauuuuauucaucuuuguaucccuuacgauuaucugucacaugauucccuaauaaaugccuguugauuuauaucaauaccuuaaagaaaacauuuuuguuaauaauucugcucuccuuaaauaauuuuaaauaucaguacuucaaauguaguuuaaaaauaaaaauauaauaguugauuuaaaagcaaacauguuauucauuuguuuauagacuuucaaaguuuuuauuaauuguuuucucucagugggagaucaucaugcguuaauguugcuccaauaggcuggccagucaggugcuguuucacuugcauguaacuuuuauauuaaauugaguuagaaccaacacuuucaaauuaagaaagcauaggaggaguuuuaaauauuauguccauagguagugaaggucagcauauguuaauugguaaugaaugauauuauuuugguagcuaagcuuuggugacuguucauuucugcguuuaagugcuucugaaaaaagaccucgcuuuguauucaugugagguuaguuuuuugguuuguacuugcaugcuuaguggcuuuuugugacuuuguuucuaucuugcuguggcagcuuaauauuuuauucaaacacagucacucuauuugugacuucuaacugucaguauugaagcauguaaaagguaggaaauaccuuaugauaauucaucuuguacuuuauuuuauagucuuuauacaaacauauucugauaauauaacuugaaccauaaacuaauuuugauagguuuuuauuagucaaggauuauaaauucaagcuguauugaauuuccuucuaguuaauaagaauauauguugggggaagaaugaaggauuucuuauuucuguuacauaguuuuuauucacguauuucugauuuuuauaaauuaguguacuuucaguaguauaguugaaucucuauaucaauguuaaaauaaauaaaugaauauuuucaaccauaaaacauaauccuguuaaaaaauaaauugccccuacaauuuaggcaauuuauuacuaauuacaaaaaagcaaauauuuaaaacuaauuaaauuucauguuagguaaaaacaauauuuccaucuuuguacuuggagaauguaaaaauugccaguuguggaggcaaaaguugaaaaacaggagacauuuuauacagauacuugcauauacccuuauauucacaagaaauacugugggaauccgauuauccuuccaaggaaacuaguuaucuguuuuacauuuugcuuuuuaauaacuuccauuucuguuuaaaaacuguguauuuauagauuuauuuuauguaaauuaaacuucugauuuuagaaaacagcaauuuuaaugguuuuuuaaaaaaguuuuaaaucaguauuuauggugaauugaaaacucaacauguaagcacucacuuaauccuaaauaccaaauuaaauaacauuaaacaagauagauuuaaauaaaucuaaauggucaauacuuuguaggauuuuuacuaguuuugcuuuuuaaaaauauacuuuuuaaaaguagauacuguugcuaauaacaugcauacacuuuuguguaauauucuguuucugccugauuuauacuuacuaugcaggaaaucauagaaacuauuguuuaaaaaucucauuuuuuuaaccucgucaugccaggcauauuggccuaugccuguaaucccagcacguugggaggccagggugggaggauugcuugaggccagaaguuggagaccagccugggauuauuguuguuguuuuuuaacuggugaauuuggaaagaucuuuauaguuauaaauuguacuuugucagauauauggcuugcagauauggcuugcagauauuugcucccaaucuguagcuggucuuauucuuauuuuuauuuuuauguaauagaauuuuuuuagagcaguuuuaaguuaacagcaaaauuuggagaaagguacagagauuucccacauacuuccacccacuacauauccucuguuaucaauauuucucaccagagugguauauuuguuuacaauugaugaaccuacacugauaugucauuaucccccaaagacuguaguuuacauuaggguucacucuuggcauuguacauauuauggguuuggaaaaauauacagugacauguaugcaccauuauagcaucauagaggguaguuucacuguccuaaaaauccucuguacuccaacuauucauuccucucuucccucuaaacccuggcaaccacugaucuuuuuacuguuguaugaguccauuuucacacugcugauaaagacauaccugagacugggaauuuuacaaaagaaagagguuuauuggacuuacaguuccacaugacuggggaggccucacaaucaugguggaaggcaaggaggagcaagucacaucuuacguggauggcagcaggcaaagagagagcuucuguagagaaacucccauuuuuaaaaccaucagaucucgugagacccauucacgaucaagagaauagcaagggaaagacccacccccaugauucagucaucucccacagggucccucccacaacaugugggaauuaugggagcuacaagaugagauuuggguggggacacagaaccaaaucauaucaacugucuucauaguauugcuuuuuucagaaugucauauagguauaauugugucauauauagccuuuucugauagacuucuuucauuuaguaaggugcauuuaaauuucuccaugucuuuucauggcuugauaguucaguucuuuuuagugcugaauaauauuccauuguuuguauuuaccacaguucaucuauucaccuacugaaagacaucuugguugcuuccaaguuuuggcaauuaugaauaaaucugcuguaaacauugauguucaauguucagguuuuuguguggauauaaaauuucaacucuuuccauaccaaggacuuacggggcauuuaauuuaaucauaguuaauaugauugcauuuuguaugguaagaguauguuuaguuuuguaagaaacugccaaacugucuuccaaaguggccauaccauuuugcauucuuaccagcaauaaaugaaaguuccuguuguuccacauccucaccagcauuuaguguaaacagcguccuggauuuuggcuguucugauaaaugugagguggugucucaauguuguuuuaaugugcauuuccuagaaaucaugugauguggagcaucuuuucauaugcuuauuuucuguccguguauauuauuuggugaguugucuguuaaggucuguggcccauuuuuaaauuggguuguuuucuuauuauucuuuguacauuuuggauaacgguccuuuuucagaaauaucuguuauaaauauauuuucccaguuugugguuuaucuuuucauucucuugacaguguguuucaaagagcagaaaauauaauuuuaaugaaguucagcuuauucuuucuuucauggauugugccuuugguguuaaaucucaaaagucauauucaaacucaagggaaucuaaauuuucuccuauguuguccucuaggaguuuuacuuuugcauuuuacauuuuggccuaugauugauuuugaguuaauuuuugugaaguguguaagaucugugucuaggcucuuuuuuuuuuuugcaaguggauguccaauuguucuagcaccauauagugaaaagacuaucuuuucuugguuguauugcuuucuuugucaaagaucaguugacuguauuuuuguugaucuauuuguauacucucuauucuguucuaucggucuauuugucuguucuuuugcucaugccacacuugucuugauuacuguaacuuuauuguaagucuugaaacugggcaguaucagucuuccaacuuuauucuuuuccuuuaaugcuguguuggcuauucugggucuuuugccagcaucuauuuacugaucuacacaaaauaacuugauaagauuuugauugggauuaaauugaaucuauaaaugaaauugggaagaauugacauuuugacaauauugacucuucuuguccaugaacauggaauaucucuucauuuauuuaguucuuugauuucuuuaaucaaaaguguguaaguuuuucucauauucaucuugaacauauuuuguuagauuuauauguaaguaugucauuuuggaggcuaccaauauaaauguuguuguguuuuuacuuucaaauuguacuuguucauugcugguauguaggaaagcaauugacuuuuguguauuagccuugaagccugccauugcuguaauugcauauuaguucaaggaguucguugggucaauucuuucagauuuucuacacagucaaucuugucaucugugaacaaacacaguuuuauuuuauuuuuuccgaucaguacacuuuaaaaaucuccuucuuaucucacugcauuagcuaggacuuccaguaagauguugagaaggagaggugacgggacaaccuugccuuguuccggauuuuaguaggaucaaaauaauaaaauacuaauuaccaccuccauccuuuguaccauugcuguuauuuauuacacuuauagauaaacauacauaagcauauaucuguauacacacacauaagcauacauaaucgaauauauuguugcugcuauuuugaacaaaugcuuauguguuagaucgacugagagugagaaaaacacauaagcauacauaaucaaauauauuguugcugcuauuuugaacagaugcuuauguguuagaucaauugagaguaagaaaaacaaauguucuuuaaaucuuaccuucacuuauucaucuccaguacuuuucuuuauauagaucucaauuucugaccucuaucauuuuucuucccccugaagaacuuuucuuuuggacauuucuugcaaguuggaucuacuggcaacaaauucccucaauauuuauguuugagaaacuauuucucuuucacuuuugaaggauaauuuuucaagguacauaauucuagguuaguggguuuuuuuuuuuuaauuuuuuacuuuuuaucuuaagauuuuaaauaauucacuucacucccuucuugcuuauaugguuuuggagguaaugucaauguaauuauucucuuugcucuuugauagguaaugucuuuuuuccacugucuucuuucaggauuuuuucuuuaucuuuuauuuucuguaguuugaauugugauaagccuagguguaguuuuuuguuguuguugguuguuuguuuuuuaaucauuauccugcuuggaguuuucugagcuuuuuggauuggugguuuagugcugacauugauuuggugaaauugucauuuauuauuguuucaaauauuuuuucuguuccuuucucucauucuucuuuugguauucccauuacauguauguuacaccuuuuuuaguugucccacaguuuuuguauauucugcucuguauuuuuucagucuauuuucuguuugcuuuguaguuuuuuuuuuuagguaucuauugggauaucccuuagauauucuuuccucagcuguguccagucuacuagacugagccuaucaacuuaauugaacccaacauaggcauucuucauuucuguuacaguguuuuugaucucugguguuucuuuuugguucugucuuagaauuuucauuucucugcuuacauugcccaucuguucuuauaugcagucuauuuuauccauuagaacccuuagcauauuaaucauaguuguuuuuaguaauugagcugaugauucucacauccuuugccaugucugagucugguucuuauacuagcucucuuucuucagacuguguuuuuuuguuuguuuguuugagauggagucucacucugucacccaggcuggagugcagugguaugaucuuggcauacugcaaccucugcuuccuggguucaagcgauuauccugccucagccucccaaguagcuaggauuacaggcgccugcuuaccacaccuggcuaauuuuuguguuuuuaguagagauggcauuucaccauguuggccaggcuggucuugaacuccugaccucaggugauccaccugccucggccucccaaagugcugggauuacaggcgugagccaccgugcccagcccagccuguguuuuuugccuuuuagugugacauauaaauuuuucuugauagcugaagcugaugucuuggguaaaaggagcugcuguauaggucuuuaguaauguggcaguaagguguugggggauaggaagcauucuacaguccaaugauuauaucucagucuuuuaaugagucucugugucucugggugugaccuucacagauguuuguuagcacuauccccgucucccaagguaagacagcauggcuaguaugggcugcaauugguauuuccuauuucccuuccuauaaguuaguuagacucugauagaaccccagcaggcucugacuaaauaguuucuccugaaggaaagaccuuauuaagaacagaauguucuagcuuauuuaaaaaugauuuuguuuucccucccucugucagaaguaauaggguuuuuuuuuuuucccccacccugucauacauacugugagaaccauauugauuuacuggaggugaaacuaauaaaaguaugaaggcugucuuaugacugagucccccuggcuuuuuaaguuucccacuuguuggcacugagccuucagcaguuugucaauuacaguucaguuuuuccuacccugcacugguuccugcagaguuuucugcuucaguuugaugggauucuuugcagucaccuguuccuccaguuuguggggcagugguuugccgugugacuucauuucucuuacugauccuagaagaguuguagauuuuucaguuuguuuagcuuuucuuguugguaggauggccuagugacuuccaaguauuuuuuuuuuuuuuaagagaugaaauuuugcuauguugcccaagcuggacucaaacucauggccuuaaaugauccucccccuucaaccuccugcauagaccacguuucuuacaugcccaguagaagccagaaguugcaacuuguuuuaucuuguucacaugagcaaaauauuuuacuuuugaugagguccauuuuauucauuuuuucuuuuuuggauugugguuuugguaucaaaucuaaggacucugccuagcuuuagaucugaaagauuuccuccuguauuuuuuuucucuaaauguuagcagcuuuauguuuacauguaaguccauaauccuuuugaguuaaauuuuuguuuucuuuuuauuuuuuugguagagauggggucgcgcuuuguugccuaggcugaucuugaacuccugggcucaagcaauaugccugcuuuggccucucagagugcugggauuacagguaugagccacugugcaaggacugaguuaaauuuuguaacaguugccagucaaguuucuuuuuucuuuucugccaauagaugccuaauugccccuguacuguuuguugaaaaggcuauucuucuucuauugaauuacuguuagcccuuugucaaaaaucaguuaaacauauuuguguugguuauuccuggauucucuguucuguuucauugaucuauuuucugucuucuacuaauaguacacugucuugauuucuguagcucuacagcaggcuggaccauauuucuuugaauuaucuuucagucuggcucucuuucucuucuccuugcacucugaugauacaaauguuggaucuuuuguuguugucccacagguccgugaggcuuucuuaauuuuuucuauuuuuuucuguguuguuuggauugggugaauucuguuguucuguccauaagcucauugacuguauccugugucaucuucacucuacuauugagccuaucuagcuugucuuuuguuauugcauuucuuaguuacauaauuuucaucugguuauuuuuauaacuuuuauuuccuugcuuugaucuucuauuuuuacauuuguuuuaagagaauuuacaauugauuguugaagcauuuuuacgaugguuguuuuaaaauucuugucagauaauuucaacaucugauucaucuagguguuugcauugguugauugucuucucucauucaaguuaugauuuuucuugguucuuggugugacaggugauuuccauuugaaacuuaaauauuuugucuaauauguuaggagauucugagggcuaguucaaccuuuuauuuucacaagcaaucauccuguuuagguuuaucaugcaggucuuagccuauauuuuuguggguugugcuuccaaugauaguuuaauuuugagucugcacuguuguuuugguuggcuucuuguaucuaguggcacuagggcucccacuggucucugcugaugcugccugagggaguagggauucauucuuaggcugaguuaguguauaucuauugcuggggaagggaugggcugggauuuccuuaccaugcucccugcuacccugaugucucuggacaggggaggagagucuuggacauguggagaacaagaggcuuccugagauuggauaucuagcaaaacuggguuuggcuugccaguucugacugccuguucugaugucuguggguagagaaggagauccucagaccugugaaggcugagguucuugacugguuccugacuaggcccucugguuucaugccugucuuuguuucucuugauggaaaaggggaaucucgauuugccaucaucaugacugagcagaugacccuuuguggcacccucagggccccaacggcuggguaaaccagaccacugcuacuccacaguuccuggacaagauccuguccaccucucaagacaagagcaucauuacguagaaauugagcagggaagauuccaacuauggcaucccacaacaugcucuguggggucacucccacuuuuuuagugacuuggucaccuccucagauggucacauuacccucucaagcuccuuggauggaaccccaugccucuaggauuucacaaugggcaucaccgugagacaauuugugggccauaccaaggacgugcugaauguggccuccccugacaaccagcagauugucuguggaucaugagauaaaaccucaaguuauagaaaacccugggugccaagaccagcuuguucguggagacccuaacucagcggcgcuagaggaauuaaagacgcacacacagaaauauaacauguggagugggaaaucaggggucucacaggcuucagagcugagagccccaaacagagauuuacccacauauuuauugacagcaagccagugauaagcauuguuucuguagauuauagauuuacuaaaaguauuccuuacgggaaacaaagggaugggcugaaacaaagggaugggcucuggcuaauuaucugcagcaggaacaugucccucaggcacagaucgcuccugcuauaguuugugguuuaggaaugccuuaagugguuuucucgcccugggugggccagguguuucuugcccucauuccgguaaacugacagccuuauagcaugggagucauggccaucaugaacauaucacagugcugcagagauuuuauggccaguuuuggggccaguuuauggccagauuugggggccuguucccaacaccuggguguaugcagauacacugucuaguaugagagucacagagugggugucuuguguucgcuucuugccuaacagcagcaacccuaucacugucuccuguagcugggacaagcuggucaagguauggaaucuggcuaacugcaagcugaagaccaaccacauuggccacacagguuaucugaacacugugacuaugucuccaaauggaucccucugugcaucuggaggcaaggauggccaggccaugcugugggaucucaacgaaggcaaacaccuuuauaugccagauggugggggcauuaucaacacccugugcuucagccccaacugcuacuggcucugugcugccaugggccccagcaucaagaucugggacuuagggguaaauaucaucguagaugaacugaagcaagaaguuauuaguacuggcagcaaggcagaaccaccccaguguaccucccuggccuggucuguugguggucauuuguuugcuggcuacacagacaaccuggugugaguguggcaggugacaugggcaccugcuagaaguuuauggcagagcuuuagaaauuaagaaacgaacaaacuggaaaaaaaaaaguggggagucucaggccuuauggugaaggagaguguuuccccuggcuguuuguuuuuguugagguuccuaguuaaucucucuugcugguggugucuggcuuccuugauauuugucagagggacaucuauucuauucugggaggaauuagccugcaugggcugccuucugccccuaggcuguggcugggaaaaaccaggucuguguggccuucuucacuugggugagguaggcguaagucauccugccucugugcuguucuucuuguuguaggguuacaaaggaguuugccuucuucuuuccaccuuccagaguucuucguuugucucuugcaguauuuguuuauauuugugcuuaguggggauuaacuggaaaaaauggucugugccaucuugucuggaccacaagcuggguuuuccuucuaauuucaguuucuguggcaugugagugugcagguaaacaaguggagagauacucagcaacacccugaguuuggcuuuguuggaggcccugagauuuacucacuuuuaaaagaguucauuaaacauccucuaugccuggacuuaaauuucauucaccaguucaucauagaguucuggaaaauuguaagccagugcuguccucccuauguuuucuaaagcccuaugcugguacagagggacuuucucuuuagauauuuucuugacuuucccuaguuuggucuauucacucucugccugcuucuuuucauauuggaguauccagugugaagucucaggauuuuguuaacuuuucuuugccagaauaucuucuggccugguugggguaguauuggacucacugaaaccaugcugugaaacuuacggaauaagguuguacuccuuuauuuguuggugauauguuuaaauuuuuguuuuguguuuuuucuuuuuuugagacggagucuugcuccaucacacaggcuggagugcagugaugcgaggggggcucacugcaagcucugccucccggguucaagucauucuccugucucagccuaccaagcagcuggggcuacaggagccugcuagcacgcccagcuaauuuuuuguauguuuaguggagacaggguuucacuguguuagccagaauggucucgaucuccuaaccucgugauccgcccaccucagccucccaaagugcugggauuacaggcaugagccaccgugcccggccaaauuuuuguuuuuucuuaaacccuauuuuuuuucacuauugucaguaggagcuuuugaaguacugcuugaugaugagauuuuugcaguuuuuacaucuuccucuaacuuuugacauugcuaaugauggugguggcagccuaucuggagcagcugcuguggagacgccagcuguggcuggggagguguggccagggcugcacccaucggggcugugcacucugcagagccagcaggggcugggaacaggcgggagcuuugugcuccugggugcagcugcagcugcccagcugcagcuuggggcccaggaagcccccugccccuguaggcuugaaagugccugcucucacccccuggccucucccugcuucuggcgccugcuccaggguggagcaaagcuguggccaaguccaggcacuguugcaacccggccagguaugugcaugcucagaguggugcugauaugccagccccuugccaccaucguccccucuggacuuuggguaucgacaagcguaggaggggggccgcaggggcugagggcagcuuggcaccagccugcaggcgccucuugggacagucaguuugggugccguggauggcauguuaaaggcagacagguuccuaggcagaaaggggugggucccuggugaaacuuuaccucaggccagcgauggccugaagccugggggcugggcugccaguucuaggugaaguccguggcccagagugagaacuucauugaugacuguuuggcaaauuugauggggcuuuuucuaggcccaccauggcugcccauggaugaaucaguaugcaguucccugauucugagcacauaaaaaucccaggcucagccagacacacauuaauccagaugaccugcuugcagaaaggagcuacccacuaugggucuccuccgcugagagcuggaugcuuguugggacaaccugccuguggaaaggagcugcccacuacaggucuccucccuucugaguugggcacacauugggacaaccugccugcagaaaggaccuacccacuuugagucuccugagagccauucugucgcucagugaagcuccucucugccuugcucauccuccaguugucugcauaccucauucuuucuggaugugggacaagugcuugggaccuacugaauggugggacuaaaaagagcuguaacacgagcacaguagaaacaugcccuccagucacuacgcugcgugcaacgagaaagagagaagaucuguggcccuucugggauuccagagcuuggggcuaccugagccaggacugugacaugcuguaacacccuuuuugggacucugugguuccugguaucucugagcuuucuggugccaucguuuucccccuguccagaugcuacugaagcuacguguuguaugucugguccaacugcagccuugcacagagccagcgccugugcuggugccugccuggagcugccuguccugcagcagcuggugugccuggcuguacacaguggacagaucccgcgcuugcucacucacacaccccuugcugcuccacuccuggcucacccuuggcaugugugggauccaggccaguagugugagcugagugcagccugccaggcugaguggauggaaugaguucagcgggcacaagugaaacccaagcagaggcaccacuggcuacagagguuucuggcuggcaaagcaacacccuaaugauccugcgacacuaauaucuuuuuuuuuuuuucccuccugaugccugugacucugccagaccccuguuaucuuuuugcuuacuuaauuucuauccuuugguugguuucuccuccuuucagucuuggacugccagguucucauggguuuuauccuugacucucugcuuuucugucaacauucagucuguugguuucaucugucaccuuuaaguaauugacucuugaauuuggauuuuuaaccuuaauauuuuaccuaaagguaaaacuugcagcugaaacgauuauaguuuacucaaaguaguuccauauucuuguucuuucauuucuauugauacugucaugauuauugauuucuaaagccuuaaaaauuuuauugaauugucucucuuuuguucacuaaauccauucacuaggucaagaaucuuucauuuuaauucgcauugacauugucaauucuagaucuucauuucucaagcuauguugguauaauggcuucuuaugucuuauuagcucccaaaucaaaaucuaucuuugugucucuuuguccuucuguuuauugaacgauaacauacacacagaaaaguguacaaaucauaaguguucagcuugaugaauuuucacaaacugaccauacuugugcagcuaguaccaacaaauuaaucuuuuuaaacuauuguauucaugaucuugguuuucaaaaauuguaaccuuguguuaacaaaaauuaauuuaaggaguuugggcuuuauugguuucuugagcagaggacuagcagaagauaaauuggcaugccaucucccacuacuugucacauagaguuuaauuuuggagauguuugcuauuuuaacuguaucucauacucacuuuuuuuuuuuugccuuauacaucucuauuuccugaaauacauuucccauuugacuuucuauauucuaaaucaugaucauuauuucaguccuaauucauaucuugccauuucuaagaaauuuucuggguuauuccagcuuuaauuaacuugcaguaauauuugcaauaacaacaacaaaaacccaggagauaucugaaauaucuaccaacaggaauuuucuuuuucuucuucuucuuuuuuuuuuuuaaaagacagugucucauucuguugcccuggcuggagugcagucuuggcucacugcaaccuccgcuucccagguucaagugauucuugugucucagacucccaaguagcuaggacuacaggugcacgccaccauacccagccaauuuuuguauuuuuaguagagaugggguuuugccauguuggacaggcuggucucgaacuccugaccucaagugauccaccugccucagccucccaaaaugcugggauuacaggugugagccaccacaccuggcccaccagcaggaauuuuugaugagagaaagguaaacauuguuauuacaaugcauuuagaaacagaagugauauuuuuccaaguuacagaauaaaaugaaccacaauaucagauacaguuuuuuuuaaaaaauguaaaauauucguugggugcaauggcuugugccuguaguuucagcuacuuggaaggccgaggugggagcauugcuugaggccaagaguuugagguggcaaugugcuauuauugugccugugaauagccacugcacuccagccuggacaacauagggagaucccaucuuaaaaaacuguauguauacauauaugcauacacaccacacacacacacacacacacacacacacacacacacacucuuacauacauauacauaugugauuuuuuuucucuauuuggaaaacucuaauuuuuaccaugucuucaaauaagauuauugaaguuagagagcuaaagcucuugcuuuucuguguagcuuagaggauaucagcugaauuaacaagaaauucaccucugguauggaugaacuagaaugaaagauaaaagguguuuuucuucauuucuucuaacuggcucugaaagauuuuacugccugaaauucuaggaaacugggguaccaaauaaauucuaccaucauuuucaggauuuauaauaaacaggguauuuuggggaagcuuaugcuaacugaucuuuagauaauuauaaguuaugcuguaguaauuuuuuuaaacagcuuuuuugaacuauuauuuauaaccaaagaauucagccguugaaauuguacaauuuguuuuuaguacauucacaguuaugcaggcacuacuacaaucaauguuagaacauuuucaucaccacaaaaggaaauccagcacccacuaacagucauuccuaauuucaccccacauuugccagcccugaucaacuaguaaucuaguuuauagauuugcccauuuugagcauuucuuauuaaugaaaucauacccugugaucuuuugugucugguuucuuugaccuaguaaaacauuuucaagguucauccauguuguagccuguaucaauacuuccuuuucauugccaaauuauauuccauuguauggauguugucccauuuuauuuaucuguucaccuguugauggauauuuggguugguucuacuuugcagcuauugugaauaauguugcuucaaacauucauaugcaaguuuuuguauagacauauguuuucauuuuggucggguauauaccugggaggugaauuucuggaucauaugcuaacucuauguuuuacguuuccaggaacugccaaacucuuuuccgcagugguugcaccauuuaauguuucagcuagcaagggaugaagauuccauucucuucagugcuaaacuacaugucugucuuuuuugauuagagacauucuaauggugugaaauaguuaucucauuauaguucugauuugaauuuuccugauauauugagcaucuuuucaugagccuauuggacauuuguacauuuuucuuagagaacuguccauucaaauccuuuguccauuuuuuuguucguuuuucuuauuauugaguuguaaaaauucuuuauguccuccauccagaaguuccuuaucauauauauauacacacacauauguguauauacauauauaugauauauauauauacauauauauaugauuuguaaauauuuucucccauucuguagguugucuuuucacuuucuugaugguguccuuugaagcauggaaguuuuaaauuuugaugaaauccaacuaauguguuuuuauuuugucauuugugcuuuuguuguuguaucuaagaaaccauugccuaagccaagguuacaaagauuacuuguauguuuuauucugagaauuuuauaguuuuagcucugauacuuagguaugucauccauucacaguuaauguuuugugugcgguccaaggaaggcauccugcuucauuguuuugcauguggaaauccaguugucccagaaccaguuguugaaaagacuuuucuuuuccaauggaauggacuuggcacccauguagaaaaucacuuuaccauaaauguaaagauuugcauuuggccccucuagucuauuccauugauuucuauguuuauccagaugccauuaccauaguguguugaucacuguagcuuuuuaguagguuuugaaaucagaaagugugaaucuuccaacuucgugccucuuuucaaguuauuucauguuauuuuggcucccuuacuuuucuguauagauuuuaggauagcuugucaaguucuauaaaaaagcuagccgagauauuaauauggauuguguuaaauuuguagaucaaauuggagaaucuuucuuaacaauauuaaaucuuuugaucugugaacaugaauauuucaauuuacuuaguucuuuuaaaauuacuuucuuuuuugagacggaguuuugcucuuguugcccaggcuggagugcagugggcgugauuuugacucacugcaaccuccacuuccugguuaagugauucaccugccucagccuccgaguagcugggauuacaggcaugcgccaccacgcacggcuaauuuuguauuuuuaguagagacggaguuucuccagguugaucaggcuggucccaaacuccugaccucaggugauccaccugccucagccucccaaagugcugggauuacaggugugagccacugcaccuggcccuaaaauuacuuucaacagugucuuaagcuuacaaguuuugcuuuuuuuuuuuguaaaauuuauuccuaaguauuuuauucuuuuuuggugcuuuuguaauagaauuguuuucuaauuucauuuuuggauuguucaaugaugguaucuagaaauauaauuuauuuuucuauauuguauaaauauaauuuauuuuguauauugaccuuguacccuguacuauuacuuauuuuuuguuuauauuuuaaauuuuguggauacauaguagguauauauauuuauaggguacaugaaauauuuugauacagacaugcaguguguaauaaucacaucaggguaaaugggguauccaucaccucaagcauuuauccuuugugucacaaacaauucaauuauacagcuuuaguuauuugauaauguacaauuaaauuauuauugacuauagucacccuguugugcuaucagguacuaggucuuauucuguauauauuuuuuguucccauuaaccaucccaacuuucccccugcuucccacuacccuuuauaaccuguuguaaccauccuucuacucuuugucuccaggagcucaagauugucuuucugugucuggcuuauuucacuuaauauaaugacugugucuggcuuauuucacuuaacauaacgaccaccaguucuauccauguuguugcagauaacaagaucucacucuuuuuaauggcugaauaguacuccauugcguauauguaccacaucucuuuauucauucaucuguugauggacacuuagguugcuuccaaauauuggcuauuguaaacaaugcugcaaaaaacauaggagugcagauaucucuuugguauacugauaucuauuuuuuuuuuggcggggcggggggggugguuauauacccagcagcgggauugcuggauuauaugguagcucaguuuuuaguuuuuugaggaagcuccaaacuguucuccauagugguuguacacauucccaccagcagcaguguuucaggauucucucuuuucuacauccuuacuauuuguuuucugguuguuuuauggucuuuuuccuuuccugucuuccugucuuucuuuuagggaagguaauuuucuuuguuaguaugacuuaauuuuacuuuuuuuguauucauuguauguuuuuuugauuugagguuaccaugaagcuugcaaauacuguuuuauaacccaguauuuuaaacuaaugacaaguuaacaugauuguauaaacaaacaagcaaaaagaaaacuaaugaaaacucuacacuuuaacuuugaccccucuccgcuuuuuaacuuauuguuucuauucauaacucauuguacuaugucuugaaaaguuguaguuauuauuuuugauugguucaucuugucuuuuuucugaagaccagaguaguuuacacaccacaauuacacauuauuauuauaaugugauaauauucuuuguuuuuuugguguacuuacuucuaccagugaguuuuguaccuucagaugauucguuacugcucauuaauguccuuuucuuucugauugauuaaucccccuuagcauuuccuuuuuuuuuucuuuuuuuuuuuugagacagaguuucacucuuguugcccaggcuggagugcagugaugcaaucuuggcucacugcaaucuccgccucccagguucaagugauucuccugcugcggccucccuaguagcugggauuacaugugcccgccuccacgcccagcuaauuuuuuguacuuuuaguagagacaggguuucaccauguuggccaggcuggucucaaauuccugaccucaggugauccacccaccuuggccucccaaagugcugggauuacagaugugagucacugugcuugcccccuccgcaccccccccccuccccgcaccuuaacauuucuuauaggacuaguguggugcugaugaaauccuucagcuuuuguuuguuugggaacaucuuuauuucucauuuaugcuuaaaggauauuuucaccagauaugcuauucuaggguaaacuuuuuuuuuccuucagcacuucaaauauuucaugccacucucuccugccauguaagauuuccacugaaaaggcugcugccacacaugugggaucuccauuggauguuauuuguuucuuuucucuuguugcuuuuaggaucuuuucuuuauucuugaccuuugggaguuugauuauuaaaugccuugagguagucuuuacauuaaaucugcuuguuguucaauaaccuucuuguacaugaauauuuacaucuuucuacagguuuggaaagaucucuguuauuaucacuuugaauaaacuuucuaccccuaucucuuucuguaccuccuuuuuaauucuaauuacucuuagauucccuuuuuuggcuggacaugguggcucaugccuguacuuuggaaggccaguacuuuggaaggccaagaugggaagauugcuugcacguaggaguuugacagcagccugggcaacaaagugugaccccuucuuuacaaaaaaauuuuaaaauuagcugggcauggugacacauacuuguagucccagcuacucaggaggcugagacaggaggaucucuuuagcccaggagguugaggcugcaguaaacugugauugugccacuguacucuagccagagggagacccugucuggaaaaaaagaaaaacuuuccccuuuugagacuauuuucuaguucuuguaggcaugguuuauucucuuuuuuuguuuucuuuuuuuuuuuuuuauguucccucugacuauuuuuugugccacuguacuccaaccugggagacagagggagacccugucugaaaaaaaagaaaaaauuuccccuuuugaggcuauuuucuaguucucguaggcaugguuuauucucuuuuauucuuuuuuuuaauuguuguuguucccucugacuauuuuuaaauagucugucuucaagcucacuaauucuuucuucugcuucaucgauucugauauuaagagacacugaugcauucuucagugcgucaguugcauuuuucaacucuagaauuugugcuucauucuuuuuauuuauuucaaucuccuuguuaaauuuaucuagauagaauucuaaauuuggucucucuguuaucuugaauuucuuugaguuaacuuuaaaacagcuauuuugaauucucuguguuaaagaucccauaucuuucaggccaggauugguuccuggugccuuaauuuaguuuguguauggagauccuguuuuccuggauggucuugaaucuuguggcuguucgacagagucuguacauucgagaguuagguauuuauuagauauuuauuguagucuucacuucugugcuuuguuuguaccugucauccuugggaaggcuuuccagguaauacaagguacuugggugcugucauguaagcuguaucuguauuaggggccacuucaagcccaguaacacuaugauuuaaguggacuuguaggggcacugccuuuguggucuuggauaagaucugggaggauucucuacauuaccagcagaaacucuuguucccuuucguuacuuucucccaaacaaauggagucucucucucuuuugagucaccuggagcaggggauggggugacacagucacccauguugcuaccaguacuggaauugcacugggucagaccuaaagccagcgcagcacugggucaugcccaaggcccacuguaauugcuaccugacuccugccuauguuugcucaaggcaccugagcuuuauaaucagcauguggugaagccagcgaagcuuguguccuuuccucaaggguggugaguuucuguaggcuccaaguggguccagaaaugcugucuguuagccaaggaguagagucaaaaccuuagaaaucuaccugaugcccuauucuacagcuaaacuggcacucaagccaugagacaaagucuuucccgcucuucccucuccuuuccucaaguagaagagccucucucccuggccaccaccaccguaggcccacaggaaguacugccaggcuacugcugauguugacgugaggcccaaguuuccuucagucagauuguggugaaugcuggcaguccugggacuuacccugcagggcagugggcuccucucuggccagagcaggucuagaagugccaccuaagaggcaaggccuggaauugggggccguaagaaugugcuuggugcucuaccccacuguguucgagaugguaccuaagguguaagacaaaguccccuuaauuuucucuuuguuuuucucaagcagaaggagucucucaccauagccaccacaacugggaaugugcugggucucaccugagguuagcaugucugaaucugacccagagcccacagcguacuacccggguaucacugcugguuauucagggaccagaggcucuuaagucagcaggugaugaagccugccgggacuggguccucccuuucaaggcagcgggguuuuuuuuggcccagguuguguuuagaaaugucauucaggagguagggccuauaauaggcgccuaaugacugcccagugcucuauccuucuguggcugagcugguauccaagaggcaggacaacauucucuuuacuguuugucuccucuccucaagcagaaggauggagucacuuuuguugcugcaagcugugcuggccggggugcagaagggguguugcaagcacuccuguagccucccucucucaugucucucuagguugcugaaacucaaguucugacugcuggaaugggcaauuccccucuggcuauggcuggucuaaaugcucccuuccugggugggcauuggcugaguucauccugguuuugcuuucugcugugacauggcagcagugaguuuauugcaaagucccacaaucacagugcucucuuucuccuccaagcauacucugugcaccauguggccacugcugggugaugggagaggacuggucuugaugauucgagacuguguuuucuacccuuuucaguaccucuuucagcgauaggaaguuaaaacuggguacugugauugcucaccugauuuuuguguguguaaauaguuguuaaauuugguuuuccugcuggcagggggcagggaggcauaauugguggaggcuucuagucauuuauuuuaaugguuuuuguugcauuacauaggauuuucuucauacaagaugauguaauuugcaaauuaagauaguuuuacuucuuccuuuccgaucugaaugccccuuuuauuucguuuguuucacuguaauggcuaagaccucuggaguaauguugaagccaacaauaggguggacuucuucaucuuguuucugaucuuuggaagaaaguauucaguuguguuuuuuuuuuuuaaccccaaagaagaaucuaucauaacuuuuuuuuuuuugaagacuaauuuccuuuuuauuuaagaguuuuucucuuuuguuuacauacacagauaugugcugauuagaaggcucacuugugcaguguggaggauaaccagugccuuacaaaaugggguuugggagugaccugaagaauucacaugaagcaguguuaaaauugcaagacugggaauuacgguuacuggaaacaguaaagaaauuuauggcccugagaauaaaaagugauaaagaauaugcaucuacuuuacagaaccuuuguaaucaaguugauaaggaaaguacuguccaaaugaauuaugucagcaacguauccaagguaagaagaauaauuucacucuuuguuauuuauaacauuauaauuguccuuaaaaugcaauagcucaaacuauugaaugagcauacuuaagucagcauucuaaagcagugauuccacaguuuuacagaguaugaaaaucucauggagaaguuuuuaaaaauuauaaauuuuggaguggccgggcaugguggcucacaccuguaauccuagcacuuuggaaggcugaggcagcaacaucacuuuagccuaggaguuugagaccagccuggggaaaguggugaaacccugucucuacaaaaaauaugaaaauuagcugggcgugguagcaugugacuguaguccuagcuacuugggagguugaggugggaggauugcuugagccuguuagaucaaggcugcagugagccgugggugacagagugagacccugucucaaaaaacaaaacaaaaaauucccuaauuuuuugugccucucugauauucuguauucuauagcuguaccucucugaugcucugacuuaaugggucagguuugagaaccauuguuacaaauuuugguuucuuuuauuaacucuucuggcuuugggucauuugaacccugcuauuuuucccuuuugcacaaacuuuaguuauaaaccacucccugaauucuucugugaaccauuaguguugugaaucauauggaauauuuuagcauguagcucuuauuugcuaucauuucaguacaaaaauauuaguauauuguugaguuagucacucuuaaaacauccauuagaugaauaauguauuuuuuaaauccaagauuauucugucauauaaaaauaagggccagaauuacacuguuaauuguucuuugaaaacauugaagaagaaauauuaaacucuaauaguucuuggauucuugcuuuguuacuuccagugucuuauuuaaauaucauauuucacuauagaauguuaaaaaaauuaaucuucuuucacuuuugggucuuaggauuugaguaaauuuuagaggaaaacucuguuaccuguggagacuguguauauaguguguuugaucaaguaaggaguugugauucuguuaagaacccaguaauguucauaucuuuaacuuccuuucugggccaguaucuagucugaagguagagcugccagagauggccacaaaaaauacaggacaccauuugaauuugcaugcaguauuuaggacaaacauacauuaaaaaugauuuguuauuuaucugaaauucaaauuuaacuggauauccuuuauuuuauuuggcaauuucaucuguggguauaaagccuucuauuauguuaaugggaauagauagggaaaguauuuuugguauuuuaaaagucacauuuuauuuaaucuucuuguuuuugguaagcuaccugguguuucugaguccaaaggcuuucugcuucauuuaucccucuuguuuucuuuucuuuucuuuuuuuuuuuuuugagaugcagucucacuuucucgcccaggcuggaguacgguggugcaaucuuggcucacuaaaaccucugccucccggguucaggugauucuugugucuccgccucaugaguagcugggauuacagguguguaccacuacaccuggcuaauuuuuguauuuuuagugcagaugggguuucaucauguuggcuaggcuggucuugaacuccugaccucaaaugaucuaccugccucggucuccugagcuuuaacggagucaucugaccucauaaaucuugaccucccuuuugcaggacacuuagguuuuaacuuuuccucauaugcuaauuaguuaccacuuaucugcuuuucauuuucuuacauucuguugacauaucuuauuugccauugucacauaguuucuguuuucuuuguuauugcuaauuuauacauuaaauuaacaguugaacaaugguugagaacucacagaaaaucaaggaguaugucagccuuuccucuuuuuuuuuucucuuuaggaucuugcucuggcauccaggcuggagugcagugguacagucauggcucauugcagccuugaccacccaggcucaagcaauccuuccaccucagcuuucuagggagcugggacuauaggcaugcgccaccauaacuggcuaauuuuauuuuuuauuuuauagaaacggggucucaguauauugcccaggcugaccuugaccuucugggcucaagcaauccucccaccuuggccucccaaagaucugggauuauaggcaugagccacugugaccagccauucuuuccucuuaacacagaaaaacuaugauuuauucuaccuauaaguaaagucuaccuuuuaaaaagaggauugugcuuuucguauuauaucuuaaaaaaucuuugccugggccgggcgugguggcucacgccuguaaucccagcacuuugggaggccgagaugggcggaucacaaggucaggagaucgagaccauccuggcuaacacggugaaaccucgucucuaccaaaaauacaaaaaaauuagccgggcgugguggcgagugccuguagucccagcuacuugggaggcugagacaggagaauggcgugaacccgggaggcggagcuugcagugagccgaggucaugccauugcacuccagccugggcgacagagcaagacucugucucacaaaaaaaaaucuuugccugaugcaaaguuaaagaguuuugccuguguuaucaucuggaaauuuuuauaguuuuaaguuuuguuuguaggucuaugauuuauuuuuauuuaauuuuuguacauguggcaagcuauggauugaaguucauauuuuuaucuuuuuuugcuucuggauacccauuuguucuaacuucauuuguugaaaacacuaagcuuucuccauugaauugccuuugcaucuuuguuuaaaaucaguuaaccauaaugcgagucuauuuuuauacucuuuauucuguuccauucauauuuuugucuaucaugacaucaguaacacauuuaauuauuuguuccuugauaauaauaucaaagucagguaguguacaguagucaucccuuauucaugggagauauguucuaauauccccaguagaugccugaagcuguggauaguacugaacguccauuguuguccaucagaauauguuucuuuucaugccuuccacccacacauuuaauuccuuuuccaucuuaacuaagcacuuaucacguacuaugcauauaacuuuugcaguuugaagugcaacaucaaaaauucaaaggugcaaauuuccuuuuucuucuuuuucacaguugcauggauagaagauucauucuuacuguagcucuuagcaaacucagcauauguuuuuuuucuuuccuuaaguugagaacuuucaucccuucacccaaaggagacacuuucugucuucuuuuuggcauauccaaauuaccggcaucacuauccuugcaguuuggggcuauuauuaaguuaaauaaagguuccuuaaacacaagcacugcuauagcaaggauaacugagauggcuacuaagugaguaauauucaaguagcauauacagcauggauacacuagacaaagggaugauucauauccugggcaggacagaguggggaggcuagguauuucaucauacuacucagagcggugucaccuuaaaacuuacgaauuguuuauuucuggaauuuuccauuuuuggauuacgugcaaucaaaacugcaggaagcaaaacaacagauuaagggguacuacugaacuuauuuuuuuuuucaaaauuauuuugucuuuucuaaauguugugcaucuccuuacaaauuuuaggagcaccuuaccaaucauuuuuuuuaaaaggcuacugggauuuugcuuggaauuacauugaauguauagauaaauuuggggaaaaucuauaucuuaacaguauugggucuuucaauaaauaaaaaugauauacauuuuaaauuguuaaaaaauaauucaacuuuuauuuuagauuccggggguacacaugcagguuuguuaccuggauauauugugugaugcugagguuuaugguaugaaugaccccauuaccaaagucguaagcauaauacccaauaguuuuucagccuuuccccccguccuucccucuccccucuaauauucuguagugcccauuguuuccaucuuuauauccuuguguacccaauguuuagcugccacuuauaagugagaacauggaguauuuguuuuuuuuuguuccuguguuaauuugcuuaggauaauggccuccagcugcauacauguugcugcaaagggcaugauuucuuucuuuuuuaugaccauauaguauucuguggugcauaugugcugcauuuucuucacucagagcgguaucaccuuaaaacuuacgaauuuucuguuuucuguuucuacaaaacagaaacaggugucuguuugguagaacuauuuauuuucuuuuggcuguauacccacuaaugggacugcuaggucuaaugguaguucuguuuuaauuucuuugagaaaucucuagagugcuuucucuaguggcugaacuaauuuacauuuccaccaacaguguauuaaguguucccgucucuccacaaccucacgagcauguguuguuuuuuugacguuuuaauuauagccauucuuacuggugugagaugguaucucauuguggucuugauuugcauuuaucugauaauuaaugacguugagcauuuuaucauguguuuguuggccacuuguaugucuuccuuugagaaguaucuauuaauguccuaugcccacuuuuuaauguuuuuuuuucuugaugauuuguuuaaguucuguguagaacauuaguccuuuguuggaugcaugguuuaugauuauuuucucccauucuguagguugucuguuuacucuguugguaguuacuuuuguuguauagaagcucuuuaguuugauuaagucccacuugucaauuuucauuuuuguugcaauugcuuuugagaauuuagucauaaauuucuucccacagcugauacccagaaugguguuucccagguuuucuucuaggauucuuauaguuugaggucuuacauuuaaaucuuuaauccauucugaauuaauuuuuguacauggugaaagguaggggacaaguuucauucuucugcauauaaagcuagccagcuaucccagcagcauuuauuaaauagggaguucuuucccuguugcuuauuuuugaugaaagaucagauggcuguagguuugcauuuuuuuuuuuuaauuucuguguuuucuaaucuguuccauuggucuaugugucuuuuuuuguaccacuaccaugcuguuuugguuauuguagcuuuauaguauaguuugaacuugcguaacaucaagccacuggcuuuguucucuuuacuuaggacugcuuuggcuauuugggcgacuuuuugguugcauaugaauuuuauuauaguuuuuucccaguucugugagaaaugacaguaguuugauaggaauaguguugaaucuguagauugcuuugggcuguaugggcauuuaaugauauugauucuuucagaccguccgcacagaauguuuuuccauuuguuugugucaucugugauuucuuucagcagugucuuguagugcuucuuauagggaucuuuuauuuucuugguuaaauguaucccuagguguuuuauuuuauuuuuuuguuucucuuguaaauggcauugcauucuugauuuggcuaucagcuugaauguuauuaguauauagaauuggugcugauuuuucuaauuuauuuuguauccugauuguuuacugaagucguuuaucaguuucaggagccuuuuggugaaguauuuagggcuuuguagguauagaugcaugucauccauuaagagagauaguuugacuucuuuuccuauuugggugccuuuuauuuuuuucucuugccugauuguucuggcuaggacuucuaguacuauacuguauuggaguggugagagugugcauccuugucuuguuccaguucucaaggggaauagcucaagcauuugccguucaguaugaugugggcuguguguuugucauagauggcucuuacuguuuugaauuauauuccuuccaugccuaguuuauugaggauuuuuaucaugaagcgaugauggauuuuaucaaacgcuucaaucucaaucaucaauugagauuauuauaugguuuuguuucugauuguguucgugugacaaauuacaguuauugauuuguauauguugauccaaccuugcaucacaggaaugaagccuauuggaucaugaugaauuaauuuuuugauguguugcuugauucaguuugcuauuaauaguauuucauugaggauuuuuguguuuauguucaucauggauauugaccugcaguuuucugcuuuuguugugucuuugccaaguuuugguaucagugugaugcuggcuuuuuagaaugaauuagguagaauucccuccuacuugauuuuuuggaauaguuucuguagaauugguacuaccucuuuguacaucuaguagaauuuggcugugaauccauuuagucugcuuuuuuuuuuuaauuggauagguuuuuuauuacugauucaauuuggagcuggauauuggucuuuucaggguuucaguuucuuccuugauaugguucggcuguguccccacccaaaucucaucuugaauuguaacucccacaauucccacauguugugggaggugacugaauuaugggagugggucuuuccugggcuguucucgugauagugaaugagucucaugagauccgaugguuuuaaaaaugggaacuuuccugcacaagcucucuuuugccugccgucauccacauaagacgugauuugcuccuccuugccuuccaccauguuugugaggccuccccagccauguggaacuguaaguucaguuaaaucucuuucuuuuguaaauuggccagucucagguaucagcagcaugaaaacagauuaauacaguaaauugguaccaguagaguggggcguugcuaaaaagcuaccugaaaaugugguaaugacuuuggaacuggguaacaggcagagguuggaacaguuuggaagguucagaagaagacaggaaaaugugggaaaguuuggaacuuccuagagacuuguugaauggcuuugacagaaauacuguuagugauaugaacgaaaagguccaggcugagguagucucagauagagaugaggaacuuguugugaaccggagcacaggugacucuuguuuuguugcagcaaagagacugguggaauuuugccccugcccuagagauuuaucgaaauuugaacuugagagagaugauuuaggguaugugccagaagaaauuucuaagcagcaaagcacucaagaggugacuugggugcuguuaaaggcauucaguuucauaaaggaagcagagcauaaaaguuuggaaaauuugcagccugaaaaugugauagaaaagaaaaucccauuuucugagagaaauucaagaaauuugcauaaguaacaaggaauugaauguuaaucaccaagacaauggcaaaaaugucuccagggcaugucagaggucuucaugacagccccuccaucauaggccuggaggccuaggaggaaaacaugguauugugggccaagcccagggucccuguguuacgugcagucuaaggacuuggugcccugcauccuagccgcuccagccgugacuaaaaggggccaagguauagcuugggccauggcuucagagggugcaagcuccaagccuuggcagcuuccacgugguguugagccugccagugcacagaagucaaggauugagguuugggaaccuccuccuagauuucugaggauguguggaaaugccuggaugucccagcagaaguuugccacagggguggggcucuccuggagaaccucugcuagggcaauguggaagggaaaugugggguuggagcccccacacagagucccuacuggggcaccaccuaguggagcugugagaagagggcuaccguccuccagaccccagaaugguagcuauaccgacagccugcacugugugccuggaaaagcugcagacacucaccaacagucugugaaagcagcuggaagggaggcuguacccugcaaagccacaggggcagagcugcccaagacuaugggaacccgccucuugcaucugcgugaccuggaugcaagacauggagucaaaggagaucauuuuggagcuuugagauuugacugccccacuggauuucagacuugcauggggucuguagucccuuuguuuuggccagcgucucccuuuuggaauggcuguauuuaccuaauaccuguacucccauuguaucuaggaaguaacuaaguugcuuuugauuuuacaaguucauaggcggaagggacuugccuugucucagaugagacauuggauuguggacuuuugaguuaaugcugaaauaagacuuugggggacuguugggaaggcgugauugguuuugaaaugugaggacaugagauuugggagggguccaggguggaaugauaugguuuagcugugucccacccaaaaucucauauugaauuuuaacucccacaauucccauguguugugggaggaaccccgugggaggugacugaauuauggaggcagaucuuuccugugcuguucucauguuagugaaugagucucaugagaucugauggcuuuaaaaacgggaauuuuccugcacuagcucucuuuuugcuugccgccauccauguaagaugugauuugcuucuccuugcccuccacuauguuugugaggccuccccagccacguggaacuguaaguccaguuaaaccucugucuuuuguaaauugcccugucucagguaugucuuuaucagcagugugaaaacagacuaauauauuccugauucaaucuugagaaguugcguguuuccaggaauuuguccauuccuguagauuuucuaguuuguuugcauagagguauucguaauagucucugaggaucuuuuguuuuucuguggaucaguuuugaugucaccuuugugauuucuuauugugcuuauuuucauuuuccgucuuuuucuuuguuggucuagcuaguggucuaucaaccuuguuuauccuuucaaagaucaaaguuuuuguuuuguuguuuauuuguauggaugauuggauaucaauuucauucaguuuuucuuugguuuugguuacuucuuuucuuuugcuaucuuuaggguuaguucuuguuuuucuugaucuucuagguauaguauuagauccugaauucgagaucuuucuaccuuuuugaggugguguuuagugcuauauacuuuucucugaacacugcucuuguugcgucccagagauucugguaugcuguuucucuauuuucauuuauuucagauaauguuuugauuucugccuuaauuucauuguuuacccacaagucauucuggagcaaguuguuuaauuucauguaauuguguaguuuugagauaucuucuugguguugacuucugcuuuuauuucacuguggcccaagaguguuguugguaugauuuaguuuuuuuuuuuuuuaauuuacugggacuuguuuuauggccaagcaugugguugauguuagauuauguuccaugucagaugagaguaauguguauucuguguaugauacauggaauauuuccuagauuucuauuagauccaguuggucaaguguugaauuucaggucagaauuucuuucuuaguuuucugucucagugaucugucugaugcuaucagugggguguuguguggcugucugugucuuuuuguaggucuagauguauuuuuuuugugaaucuaggugcuucaauguugggugcauauauuaaauauaaguuaagucuucuuguugaauuaaauucuuuaucauuaguaucauuauuacuucuuguccauuuuuuuuuguugguccaacauuuguuuuaucugauauaagaauagcuucacuauucuuuuuuguuuucuguuugugugaucuuucucuaacccuuuacucugugccugugggugucaacauguaagaauggguuucuugaagacagcagaugguuggguuuguuuuuuuaauccaacuugcaacucugugccuuuuaaguggaguaguuagacaguuuacauucaauauuaauauuaauauuaauauguaagauuuugauccuauugugaagucauuagaugauuacuuuguaguuuguauugugugguuccuuuauagggccugugugcauguuuuugugguagcagguauuuucguuguuguuguuuccuuguuuagaacucccuuaaggaucucuugugaggcgaccugguauagaauucuguuagcacuugcuuguccggaaaauguuuuauuccuccuucacuuacgaugcuuaguuuggugagaugugaaauucuugauuggaauuucuuuucuuaaagauggcugaaaguacaccccuaaucuucccuggcuuagaagauuucugcugagaaguccacuguuggccugacagauuucccuuugcacaugugaucugaccuuuuucucagcugccuuuaagauuuuuuucuuuaguuuugaucuuggacagucuugugacaauaugucuuguugcuguucacuuuguauagcaucucacagguguuaccuggauuuuuuuguauguggauaucuaccucuccaguaagauuagggaaacuuuuuuuguauuauuccuucaaauauguuuuccagguuguuuacuuuuucuccuucuuucucaggaaugacguaacuuguagguuucguugcuuuaccuaaucccguauuucucagagaguuuguuuauuuuaaaaaauucuuuuuuauuuacuuuugucugacugcguuaguucugaagacauguauuuaggcucugaaguuuccucugaagcuuucaguugucuuuugaaacuccuuaagugaguuuuucaacuccauaagcucugacugauuucucuuuaagaugcugauguauuccuucauugccuggauugcuuuugaaguuucuuuguauugaauuucauccuugucuuggaucuuguuaaucauucuuguaauacaugcuuuuccauacuuugaauuuuuuguuuuguuuuguuuuuuagacagguucuugcucuguugcccaggcuggugugcaguggcaugaucacagcucucuucagccuugaucuucugggcuuaaguaauccuccuaucuuagccuccugaguagcugggacuacaaguguggaccaccaugccuggcuaauuuuuguauauuuuguagagaugggauauuaccauauugcccaggcuguucucaaacuucugggcucaagugauccuccugccuuggcaucccaaaaugcuaugauugcagaugugagccaccaugccaagccugugcuuuaaauucuuuaucugucauuucugaguuuccaguuugguuacagaccauugcuggagagcugguaugauccuuuggugaugucacuacauucacauuuuucauagugccagaauucuugugcugguuccuucucaucuagaggugcuggcacuucuaauuuuuguaauuauuuuugugcagguaggaauuuuucuuuuuucuuucuuuucuugugauauuauuguuauuuuuuaauuucucuuuuccuuuccccuccuuccuagguaguaugucuauagagaauguucaguaaugucuuuuuggcucugccguauggacuuccguuggcagguuuuauacugggcuuuuguauugggcuuucuuuauauauaagccaguacauagcgcuuauagguaagacguggcuguggcuaacacagcuggguguguauacuugauccucgcuuacugagagaagcucucuguugccucaggcaauugauugauccguguagugcacaguggucugauuucccugcucaccucuccaggcuggggagcaacauguguggggccggacugggcaggccugccuaccugucgcccaguggcaggcagaagcaccagcacugagggagaauccaauggguguccaccaagugcucagaggugugccuaggaaaccuccucagccccaaguucuuugcccggggagggagaguuggccaaacuccuaauccaggagaguggguacuccagaugccuagacauggagaguacugcagcaccacagucucugcacaggaaugguggggcaggucagguugcugauucagaagaguaggugcucccaguggagaucugcuuugguguugagcagagagggcccagcugcaauacggugucuucauaggaaggguuggauacuuagucugcugaccuaggugagcagguguuucagcugucuggagaucugccugggggugaggaagagaaggcccuccuuuaccuguaucuuugcacagaaaggguaggguggcucaugcuuccaguccgggcaugcagguucuuugaaugccuggagaccugcccuggugaggagcagagagggcccuauugccccaugaucuaugcacaggaagggugggugugucagccugcuucuccaggugagcaagugcuccaaguaccuggagaucugccuggccguggaauggagagggcccuucugccccacaaucuauguccaggaaggguagggcaucccaggcugcugaaccaggcaagugggugcucugaaugccuggagaucugccuaggugugaaguggagagggccucccugcaccaagaucugugaaugggaaggguggggcaggucaugcugcugauccaagugaguggaugcuccagaugccuagagaucugccuggguauggaguggagugggccccaaaauaccauguuauauuacuuaauuuucaaauguauauauauuuugccauggaucucuucguuacugauuuuaaauuuaauuucauuguuuuucaagaaucuauuuuguaucaguugaauguuuaaaaauucaugaauacuuguuucauggcccagaaaauaguuugucuugguaaauauugcaugugcaguugcuaagaaguauguauucugcuguuguugguuagaguguucuauagaugacaguaaagugaagaugguugauagugguguuuaagucuucuauuucuguauuaggguuuuccagagaaacagaaccaauaggagauauauauauaugauuuaucauggaagucuaaaagacacacgauaugcugucugcaagcuggagaacuaggaaagacagugcuguaauucagucugagucuaaaggcccgagaaccagagguaccuccuguguaaaucccagaguaagaaggcccaaaaaccuagaguucugaugcucgagggcaggaggagaugaauaucuguucuagaagagagagagugaauuugcccuuccuccuccuuuuuguuccauuaggcugucaauagauucgauaaugcuugucaucgaaucuucugguggaucuucuuuacucaguugucucauucaaaugcuaaucucuucuggaaacacccucaaagacacacagagauggguuucaccagcuaucugcaguuccuuugagucagucaaguugacacauaaaauuaaacaucacaguuucuuuacucauguuugucuaccugucccaucaguugagagagggaugcugaaaucucccacuauaacugugaacuugccuguuucucuuuggcauuuauuaguccauuuuucuuauauuucaauucccuauuauuagaugcauaaauguuuagaaauguuauaucuucuugacaaauaaauuaacuuguuuauugggugggaaauguuuaggauuuuuauuuucuccucauuaauuaggcccuuuaucacugagaaauuaacuuaacucugguaacauucuuuguugugaaauguaagcugucugauauuaauauaaccacgcuggguuucauuuggcuaauguuagcgugguaugucguuuuucaucauauauuugguauauuugaaguggguuuuuguaaguaacauauaguugagucuugcuugguuuccuaauaugacaaucucugcuauuuaguuuguguguuuagacuauuucauuuagugugauuauugauaugauuagguuuaaauuuaucaucuuaccauuuguuuucuccuuauccugucugcucuuuuuauguucuuauauuccuuucuccuguuucuuuuggauugagcauuuuuaaaaugugacuauuuuuaucuccuuuauugaauuauugccuauaaauguuuauuguguuauuuuaaugguugcauuaaggucuauaguauacaucuauaacuuacuauaagucuguauuucagugauauguagaaccucaucuauaauaauauucuugcaagaguauacuucaguuucucccaccuguucuuuguguuauuauuguuacagcuuuuaauuauaugugaguuauaaauccacaauacauuauuauuuuugcugauuaucuuuugaauaauuuaaauaauaaguacauaauucuuuauauuugcucauugaguuacaguguaugguagucuucuuuauguagauucagguuucuagcuuguaucauuuucuuucuguuugaagaacuuccuuucacauuucuuauagugcaagucuauugaaaaaaauuuuuuuuuagguuugaaagcguaaaaauaucuuuaugguguccuuuguuuuugaaaacaauuuuuacauguauaagauuccuguuuggcaauuucuuuacauauuuuaaagauguugcuguauuaucaucuuacuuguguuguuucucaugaaaaauuugugccuaauguuuuuuuccucuggcugcacuuaagguuuucccuuuguuacugauguuaagcaauucauuaugugccuuuauguaguuuucucugcauuuuuugugcuagggucuuguugaccuuuuuaaacccaugggcuacuacaguuuucaucaacuuuggaaaguuuucaggcauuauuuuaaauaauuguuuuuuaguucucccucuuccuuuuaucuucuuucaggacccugauuacguauggauuuggcuguuuaaaguugucuuacaguuuacuaugcuguauuuuucuuucuucucuguguuucauugugguuaguuuuuauuguugucuucuacuucacuaaucuuacuuuuauucaaugucuaaucuguuguuaauuuuauccacuguauuuuucagcucagauauuuuuacuuccaacuuccuuucguaacccuauuaaugagguuaacuuuaauucuuucccugaucacuuauuuccagcagugucucuucuucccucacuccuccuuuucuggcaacaauacuuccuuucuugccaauauuuaaauuuaaauuaugccuguguaccauuccuucgucuucuuguaccugccaaaacucaacuuuuccuuuugcuccacacccauacuuuaggguggaacaaauggagagaauaaacagaaaucaaguaguugggccauuuccauguuaaaaaugaacaagucguaaauaucucuaguagauuugaauuccuuuuauaucuuguaucuuuugacuuaauauauuuauucuuuccucuaguuuugugaauauauggaauauaguccuuuuuuggcaauuacuuuuucauucugauccagaauucaauacacagucacuuauuucauuuauuuaauaguuguuguaucucuucugugacuuuuuaucuagaauacgaacaugagaaaucacaugaaccugugauuugguaauuuuucauuuuuuaauuuauuuuacaggaaaggggucccaguucagaccccaagggaggguuauuggaucucgcgcaagaaauaauucagaacagguccacagugcaaagcaaaagcagguuuauuaagaaaguaaaguggugaaaguacagcuacuccauacacaggggagggcguuccugaaaguaagaggagaaauguguccacccuagguacaauacguguuuguauacaggauaaaaaaagaucauugggagaugugcucuguuacaaggguuugugauaaaggauuacuuuucuuaauuacuauauuuugcaagaauugauguuauuaucuuuaaagcaaaauuaggaaugcuucuguucucaagauaucaucgggguauuaggacacuccuaagucuggaucuguuuaguaaacauuaucaaucuguucccuuaaccauaaacaucuagaggcuagcaauaccuaacuuucugggcaugcagcucagcaagucgcagccucauuuuuccuagcccucacucaagauggaaucacucuaguucgaaugccucuguuauuuauaguuauuuugaaguguguacauucugucuuuaauccugagggcauguuucuugugugguuuucuuuucuuuuuuuguucguuuguauuccuauuggaggaaauaguaggagauggagaccuagguagcuaucuuuuucccccaacuaccugguuucuauuuuuucuucauucucugagcacuuguuuacuuuuuggcauaagaagauauuccaaucucaucuugaauguugcuuucuacauuccuggaauaaacccuuuucccuaggaguccugguuucuuuuaguggggaaaauaucugaacauucaaccaauuuacuauauauggaauuuuagguuucacaguauuugcaauuacaaauaaugcugcaauggauaacuuugaauagguguauuuuuguaacaugggugucuucacgcugaauuuuuggaaaugagauuuccaggccaaaauguaaauguaccuguuauauuauauauuuuuguuauauauugccaauauaaauauaaauuuauauuucuagaaauuuccucuguggaucuuguaucauuuugcauauccagcagaaacauaggaggaugucagcuucuacuuaaucuggguaacagaguuuguucucagacuuuuguauuuuuauuauucugauagguaagaaaugauaucuagggugcuuuuauauuucucuaaaaagaguuaaauuaaacaucuuucauauguuuaacagcuauuguauuguuaggaccuguuuucugugcugaagaugaauuuuacuuugcuucuucuucuuuauguaaaauuauaucugucugcauacagucaacuucugaaauaguacagugauaaauacuaucuucaaaugaugcaagguacuuaaaaggaaguauugccuuaccuuuuaaacaugaagugaauugaaauauuggugauguuacauauaccacauaggaauaaaaaguaaugaaaaaugcuuuuugaugaaucagucugauuauuuaguagucacauaauacauauauaauguaacuugagccuguacaacuaggguuucaacuauauauauuuuuaaagcaguaauuuuuaagccuggcuauagagccacuucugcuauaccaccggauuugaaaacauugaaaucuugguugaaaucauuucaacauuuaaaaacuugguuaaugagaggaucaccugaggccacaaauugaagacgagucuggguaacauagcaagacccugucuuaacuaaguaacuaacuaacuacaccaccgcccccccaaacacacacacaccacacauauauacacacaugcuuuaaucuaucaaaaaaaaaaccaugaguuuguucccacacaauugacauauuaggaacgauuugagcuuaacguuaauuuugcauuuguuuaugucugaaaccugaagaagcacuaggugaaugcagaaaacuauaacuagcuuaaccaugcugcguaggaauacauaguagacacacacuucaguccuuuacuggcuaccuucauuuaccuuuuuguugugagccacacucauccacauguggcauuucaacuuucugucaaauuuugaauaacucuccccuuuacagaauucgcaaguugcaaccuuucugaagucgacuuugacaagcaagcuucaggucuuuucaaaaugaagugccauguuaauauaguagucaugugcuucuuaacguuuaauauguguaaaacuaugcaaaguuuuuucuguuagguuucuguuuuuaaaaaaaugugucccugauuaguuucuugaguauuaugccuuuaaccccauuuguccauaagcccugugguuuuuauucuguaauuuuuguacaaucucaugguuauuaggcacaaaaauauuuuguuacaguagagcuuauacauuagaauuaguuguggagcuuuaaaguacugauguauagaccccauccaaagccuguuaaauaagaaucuauggccuuagagccaauaauugguauuuuuaaaaaguuugcaguuguuugacugggcaugguggcucaugccuguaauccagcacucugggaggcugaggugggcagaucacuugagcgcaggaguucaagaucagccugggcaacguggcaaaaucccaucucuaccaaaaauaaaagaaaauuagcugagcaugguggccugguccuguagucccagcuacuugggaagcugaggugggaggaucacuuuagcccaggaggcagagguugcaguuagcagagaucaugccacugcacuccauccugggcaacagagcaagacacugucucaaaaaaaaaaaaaaaaaaaaaaaaaaaaaaaaaagcuugcaguugcuucuuauugcagccagaguugugaaccacuaguccagggaaaccgugaagcuuugaagaaaaugaagagaggcucuuaugaaugggaaguaucuaaaauuuccuuugaacuugcgauugaaucuuugaaaacuucagcuuuaggggaauuuaaggaguugucuucuggauuucuauauuccauaaagacacagagacuccaaaaacauucuucuuauguaaugggcaaacucacaauaaaaacuguuguuucacagaaccauuuauuuugaguuauuguguagugcacagacuaugcauucuucauggaauuuuuauguuguauuuaaaaaaauucaagcaaaaagaaagcaaacaaguaguuggagguguagucugcagugaaaagcuauuuauaacaacuauuauuuagguauuuuucaagcuugagucaucuucgugauuuauuuucaauguuuuaguauaauuauagcuccaguaguaguuuguucuuuaauccaguguuguagaauaaauacuuuugguauaauaaacucagagcacuuaaauuaauaccuguuuauggaauacugauuuaccucacuacacagcuguuaguucaaauuuagagggcaagaaaggacuaauaugcauuucuaaaaguuauguauuuuccccuuauguguaguuuucucuuuuucaaaaguugcaugcagaguuuacuuucuuuauaucauguauuaaucuuaguauaacugguacuauuuaccucuauagucuuccuaagcauaaaauaggcauuguaggguuuauguuaauuauuuuagaagccugagaugcuauuuaauguaugcaaugaucucguuuuugggguagaugagaauaaaauuucuguaaauugaauuauuauuccuccuuuuuauuaugaaauaggugauguguuuauuucuaggaaccauuuuauuuuuggucacaaaacaacacugccaaagaaucgcauuuaagaauuuagaaaauuggccauaugcgguagcugacgccuguaauauuagcacuuugggaggccaaggaggguggauugcuugagcucaggaguucuagaccagccuggacaucauggugaaaucccaucucuacaaaaaauacaaaaagaaaauuaguugggcaugguggugugcgguguauuccuguggucccagcugcucaggaugcugaggugggagaaucaccuaagcccgggaagucaaggcuucugugagccgugauugugccacugcacucuaaccugggugacagagcaagacuuucuccaaaaaaaagauaaaaagaauaaaucuuuugaaaucacauuuuacauuucagguaaaagcaauauuuuuaauaauauuaauauuaauauacaacucagaauucugaaaaauguucuaaaauuuuaaaaucucaaauuaguaauuuguuuuccuggggcauugggaaaugugugcugucuuuuucacuguguuaaaguaguccuauuucuaauuauccagugagauauuggggcgguuagauaagaugauaauuuuauuuaauuguucuguucagggagauuugagagaugggucauuacuuuaguuagaaaggcaguuacagugagaggccucuuucauuuucauauccauagcuucucacagagcaugucauaucaagagugacucaccaaucuugcccuacaaggacuucuuuuuagaugugcucauacuacaaaguagguagccuaaaggaguagauagcuuuuccuauggcucuucacuucuaauuuaaugauuaaguacuaaauagaaauuaaagauuacuauguaauuuguaaccaguuuaauaauauucuccuuaguuuaaccuagauaguuauucuuuuuuauuuuuagaaacagggucuagcucugucgcuuaggcuggagugcaguggugugcucauagcucacuguagccuuuaacuccugggcuuaagugauccucucaccucagccucccgaguagcagggacugcaggugugcaccaccaugcucagcuuuuuuuuuuuuuuuuuuuaauuuuuagagcugggaucugacucuuuugcccacgcucgucuugaacuuuugggcucaagugauccuccugccucagccuguaauuccaaagugcugggauuauaggcaugucccacugcaccuggcuagguaguuauucuuaaaguaguuuguagauauuaagaccuuuagguucccacacugcucccuccaagcaucagguuaugucagguguaacacauuaagaauuaguuuuguauuugaaugugagcucuuccauuauuuaggugugugacuuuaggcagauuaauuuaucugacauucaaacuccacauuuauaagaugaagguauuuucuucauaguguugauaaaaggaguaaauaagagaaggccugcugcgagugugcaagagguugguaauauuaauaagugaagccccaguauguaaaagaggcagagagcgucucucucauuuagauaagcaaaguuagcuuuaauaggagucagguuggaaagaacuaauggagaccaucaauuccaccuguucauucuaugugagagagaaaaaaagcauuuuuuuaaaauagagauucagaagaaggaagugucuugaguauauagauuaguuuauaccuucugggaguaagaacugaguuuuaauuuuuuucccccagaagucuauuugaggaguuugaaaaaagauagauaaggcaguagaugaaaagguugauuggguuggaggaggaaagagaggacuuuguuuuuuaaaaaaauauugagcugauggggccaaugaaggauaaucuggaacuacaggaaauagaaaauaacagaacggcuugucuaggacauggaaagggaaugggaaagaguggagagcaggaauauaaaaaaaagaagcuaaagaagagauaaaaaucucccagaauccuaacuauaguucauucuucucuuuaaaauuuccaaauaggccauuauuguuuuaacaguccucuacuagagcuggaucaacaaaggaaucuucucuggacgugagcuauaaaagucaaggaguuugugaggauggcacuaaauaaggaaguagcuauuaauaaauaggaaaagaucacaggaugcuggaacugaaagggacugugaagguauuuuauucaaugcuuaauuuuugguaggagaaaacugcugagguuaggcgauuuacuucugaagaauaaaggugacuauggcugguuauuuuucugguuacuguucuucaaaagaagaacaagaaagguggcccuuaaguccaagaggaauaaaagcaauugaggagcaccaagaagcuggaaaaguauugggaaagaaaagguaauauaauuucuuaauuucuuuucuggccuguucuguguuuagauacuuagauuuaccuuuuuaauaccaguaguaauaucccgguagucaugugguucucuaacuuuugagacuggaccguaacugagcuaaugcagcucagcaucuuugguaccagucauuagaaaccaauuauuuaauuugauuauauugguuuuauuuaaaaaauuuagucuuuguccacauauuauuuuugcuuucauuuggauucauuuugguuauuauauuaguguuugaugaucugagaaucugaaauacuugaaauaacagagucuuaggccaggugcaguggcucacgccuguaaucccagcacuuugggaggccaaggugggcgaaucacuugggaccagccuggccaacauggugaaacccugucuuuacuaaaaauacaaaaauuagccgagcaugguggcacaugccuguaaucccagcuacucgggagguugaggcaagagaaucacuugaacccaggagguggaaaguauagugagccaggauugcuccacuguacuccagccugggugauagagugagacuacgucucaaaaaaaauaacauggucuuaaaaguuucaaccuuucuauuguuagaaaggcuuuaaccaagagaaagugaaauucugcugacauugaaggucauacuuaacucagaugauucaccuuccucugauuuaucaaguaaccuuaguccuuugguucuuuaaaaaccuucaccagauaggaacaugcuuauaaaucuggacaccaagacauaaaugauccggggaaagagacuagucaauuccugcuguauuuauaggggaaaauuuuuaaauguuauaagaaaaaugaagauauccaagaacucauuacaaugaguuauaccguugaaggaguuucauauauguaaacaguuuuugaaaauuauuauauuaucacuaugaaaauuuuaauaucccaaggcugacacaaauaugguagugguagucuugccuuuuucaugcuucuugugcuuggguucauugagcuucuuugaucuguauuuauuuuucauccaauuuugaaaaauuuuagccauuauucuuugaauacuuuccuugucucucccucugucuccuuagagguuuccaaguacacacauauuauuuuuguuauuaaauucuauaauauaauuauuuuauuuuuuaagaaaaauuauauguauuuaugguauaccuuguaauauuuugauauauguuguauaaugauuaccacaaucaaguuaauuaacuuaucugucaccucacauaguuauuauuucuuuucaugaggagaacacuuaagauacguacucucuuagcaaauucaaaguguauaauaaauuauuauuaacucuaguuaucaugguguacauuagaucuucaggacuuuuuaauccugcauaacugaaacuuuguucccuuugaccaaaauguccccauuuucuucaccccuauccccuggcaaucaucauucuauucucuuuuucugaauuugacuuuuuaaaauuccacauaugggugagaucaugcaauauuugucuuuuuaugccuggcuuuuucacuuagcauaaugcccucuagauuaaucccuguucucaaaaauggcaggauuuccuucuuuuuuaugauugaauaauauuccauuauauauguguauacacacacacacacauuuuauuuacuauaauuucuuuaucuauucauuuguugaggguuguuccuauaucuugccuauuaugaauaaugccuguccuaguccaaguucuguugguauaauagaauuccugauauugggcauuuuauaaagaaagagguuuauuuagcuuauaguucuguaggcugggaaguucaaggucaucacccuggcuuccggugagaacuauugugcugugucauaacacagggagaaaaauaaagggaaguggacauaugcaaagagagaaaauccagggacuuuauagcaauccacuuuugugggaacuaauccauugcuacaagagcuaaucuagucuugccagagugagaacucacuauucugagaauggcaccaagccacccacauaguagcagcccucaugacccaaacaccuuccauuaggcccuaccuaccaauaccaccacauuggggaucaaauuuuauuuuauuuauuuuauuuuauuuuauuuuauuuuauuuuauuuuauuuuauuuuauuuuauuuauuuuauuuuauguuauuuuauguuauuuuauguuauuuuugagacagagucucguucugucgccuaggcuggaauacaguggcgccaucucggcucacugcagccucugccucuuggguucaagugauucuccugccucagccuccuggcuggaaugcaguggcgccaucucggcucacugcagccucugccucuuggguucaagugauucuccugccucagccuccugaguagcugggaucacagguggccugccaccauggccagcuaauuuuuguauuuuuaguagagacaggauuucacuauguuggccaggcuuggacuucugaccuuaagugaucugccccccuuggccucccaaaguccugggauuacaggcaugaaccacugugccuggccuggggaucaaacuuuaacgugaguuuugguggggacaaacaaauaauaugcaagcuguagcaauaugacaaugaacaugagauuacagguaucuuuuuguuguauugauuuuguuuucuuuggcuauguaaccagaagagggcuuguuagaucauauaacaguucuauuuuuaauuuuuugaggaaccucgauauguuuuacauaauggguguccuaauuuacauuuccaucaacaguguauagugcuccuuuucuucacaucuuugucaacacuuaucuuuugucuuuuuuauaauagccaucuuaauaggugugaggugauaggucauugugguuuugauuuguaguuaccugaugauuagugauacugagcaccuuuucauauauccuuuggucauuuguguaucuucuuuggaagaauaucugcucagguccuuugcagauuuugaaaacugagcuauuuuuuucugugugcuguugaguuguguuaguuccuuacauauuuauaucaguucccuuauuagauauauaauuugcaaauauuuuuucccauucuuuagauugccuuuuuauuugguuauuuccuuugcuguguagaagcuuuuuaguuuggugcagucucacuuguuuaauuuugcuuuuguugucugugcuuuuggugucaucuucaaaaaaucauugccaacagcagugucagggaacuuuuccuuuauuuuuucuucuaggaguuuuauggauucaggucuuauauuuaagucuuuaguucuuuuugaguugauuuuuguguauggucuaagauagggauccaguuucauucucuuacauguggauauccaguuuucccaacacuguuuauugaagagacuaucuuuucccuauuguguauucuuggugcccuugucaaagaugaguugauuguauauguguggguuuauuuuucugugcucccucuauucuuccauuggcccauguaucuguuuuuaugcuaguauuauauuauuuugauuaauauaccuuuggaaauauaguuuggaaaaaggaaguaugaugccuccagcuuuauucuuuguaaagauuguuuuagcauucaggguauuuuauggcuccauaagaaguuuaggauuuuuuuuuucuauuucaaaauucuaaugucguuuuuuaucauugaaauuuuaauuaggaauucugauagaauugcuuucaaucuguagauuguuuugggugguauggauauuuuaaugaucauucuuucaauucaugaacguaaacauauuuuccauuuaucugugccuucuucaacuucuuucaucaauaucuuauaguuuucagugcaaagaccuuucacuuccuugguuaaauuuauuccuauguaucguauuauuuuugaugcuaauuugggaguguuuuccuaauuucuuuuuuggauaguuuguuguuacuguauagaaauguuacugauuguuuuuauacuccuggcaggaaaagaaauaaauuuuaaaaaagaaaaaagaaaaacaaauguuauugaucuuuauauguugauuuuuuaauccuacaauuuuacagaauucacuuauuaauucaguuuuuuaaaauuggagagucacagguuucuacauacgagauuaucgggggaccugccccgauaaucacguagguucuuuucuauuuuccuaagcgucggcuggcuugagaaauaaaaggacagaguacaaaagagauaaauuuuaaaguugggcauccgggggagacaucacacauugguaggaucugugaugcccacaagccacaaaaaccagcaaguuuuuauuagggaguuucaaaaggggagggagugugcgaauaggugugggugacagacaaaaaguacuuaacaggguaauagaauaucacaaggcaaguggaggcagggcgagaucacaggaccacaggacggaggcgaaauuaaaauugcuaaugaaguuuugggcaccaccgucauugauaacaucuuaucaggagacagaguuuugagaucaaccggucugaccaaaauuuauuaggugggaauuuccucuuccuaauaagccugggagcgcuaugggagacuggaguuuauuucaccccugcagucucaaccauaagagacagguacgccccggggggcccaguucagagacguaccccuaggugcgcauucucuuucugggggacguuccaugcugaaagaaagaauucagcaauauuucucccauuugggcuuuugaaagaagagaaauauggcucuguucugcccagcucaccggcggucagaguuuaagguuaucucucuuauucccugaacaauugcuguuauccuguucuuuuuucagggugcccacauuucauauugcucaaacacacaugcugugcaauuuguguaguuaacgcaauuauuacaggguccuggaaggauauacauccuccucagcugacaggauuaagagauuaaaguaaagacaggcauaggaaaucacaaggguauugauuggggaagugauaaguguccaugaaaucuuuacaauuuaugcuuagagauuacaguaaagacaggcauaagaaauuaccaaaguauuaauuugggggaaccaauaaauguccauaaaaucuucauaauccacguucuucugucauggcuucagccgguuccuccauuuggggucccugacuucccgcaacacaagauccugucuauuguagacagucauacuuuucuuucugauuuggauuuuuaaaauuucuuuuuauugccuaauugcucuggcuaggacuuuuaguaugccauuaaauggaagugagagugagcauccuuuucuuuuuuccgauuuuagaggaaaagcuaucaguuuuuuaccauugacuauguuagcugugagcuugccauaucuagccuuuauuauguugagauacauugauucuauacuugauuccuugagaauuuuuaucaugaaaggauguugaauuuugcccaauacucuuugugcauauauugacacgaucacaugaaguuauucauuauucuguuaauauaaugugucaaauacaaaauuauugauucguguauguugaaccaugcuugcaucccagggauaaaucccacuugcccacuuggucaugguauaugauccuuuuaauauguauacaauuuuguucucuagaauuauauugaggauuuuuacaucuguguucauuagggauauuggcuuguaauuuuucuuuccuuuuuuuccaauuuauuuuuauuuuuuguagacauggugccuuccuguguuacccaggcugaucuugaacuccugggcugaaacgguccucucgccucaaccucccaaagugcugggauuacaggcaugggccucugcaccuggacaguucuuguuucuuauagugucuuugucuggcuuugcugucaggguaauacuggcuucauagaaugaauuuggaaguguucccuccuuuucaguuuucuagaguaguuugaaaaggacugaugucaauucuucuauaaauguuuuguagaauucacuaaugaaucaaacaaaggucugggcuuuuugaugggaagugcuugauuacugauucagucucccuaccuguuuuagucuagucagaauuucuguuucuucaugauucagucuugguagguuguauuuguuuuuauuccauagcaccuuguucuuugcagacucccagcucugucuccucaauucagggauuccacaggguucugccucaguuucucaauguuauggugguuuuagaaacuuuuuuuuuauucucaauucuuagagacaauuuaaguagcaccaaaguuuacugauucaaacaauuuagauauuauucaauagcaaaacauuugagcuuugcacuuuauuagagguauguuauucauaauugguuuaugacaaccauggacuccaugguuauuggucucuuugaauuucguacuuguaaaaguugggauuccaacaggaaaguggaacuuacaugauguaguucaauagacagguuuuaauuuugggaaaaucuucaacacuuuuggaaaagcuaaaaggaaacaggagagggagagagagugcaagagugagagccugccagccuuccuccuauuccucaacccuaucagaagguaauuagcaagggacagcacagauaaagggcuggguuucuaacugugagcaaucaaaugauccguacccuauaucuugaagugucagucuuggcacuuuauguuucucuucaaaagaagaaaaaaauaguacccauuucuuccauucuuuaguauuuuccugucaaaguucucauaaguuauuauuaaucuaugguuauuucucuuuucuuagacuuaauuuuagcgacuuuauuuccuuuuuucuguaauuaaguaagcucuucuuuguuuuauauuuuguccuagaauuugacuuuauauuauuugaauauagugacuacagggucuuguuguucauauuuuucugggguguuuucacuugucuuuuuguuguugugcuguauuuuauuucuguuucauacguauugcauauagugaaguuuuguccccucucugauuugauaauguuuuccuuuuuauaaguguuuaucccauuuucguauaauauuuaacagauggaguuaguaucuuuuuuuuuuuuuuuuuuucccccaagacaggcucuugcucugucacccaggcuggaguguaguggcaaagucauagcucacuguaaccucaaacuccugggcuuaagggaaucuuccaaccucagccuccugaguagcuaggacuauagaaacaagccaccauauccagcuaauguuuaaauuuaaaaacaaagcuuuucaaauuuuugauuaaaaauuuuuuuuuuguagagacacugucuugcuacauugcccaggcuacucucgagcuccuggccucaaauaauccucccaccuuggccuccccaaacacugggauuacagauaugagccacugcuccuggccucauuuguauuuuguacuuauuuucaauuauuauuuacuuuuuguacuuuguuaaaauggauaguguuaacuuuccuuaaaaagcacuuuugauaauucaggagguauaaauaggcugcuuauuuaaaaaccuucacuugguuaacuuuagaaacucaagaauuauaaacucaaauuuauacuucuugauacacaaacuuaagaacuaaagcuaucuucugacucuucuauuugaaaagguacuaacacuucuuuccgucagucucucauucuucauuuuuguugguauccuguggaauuuuugucuagucuaguaaaauuaaauuauuaucacuuuaauguuuuguagcucuuuuuucaauaaugaugauauuuauauuccguuuugcaaauuuuaacaguguuuuuuccugauuguauuauuguuauuugccuaugauuaaacuuuucuaaaauuaaaauucagguauuuuuacuuuuuaauauuuuuuaaccugucuauaacuuucagcaucagugacuuccuacugguaaaauucaauuguaaggaauacuauuagcaaucagguuucuguauaaugaagcaauuuuaaggucuucaaguggccgacaauauuuuguuuauuaaguuacaaagaauuagcuugcagcugggugcaguagcuuacgccuguaaucuuagcacuuugggagaccggcaggaugauugauugaggccaggaguuugagaccagccugugcaacauggugagacccugucucuauuuuuuuaaaaaaagaaaaagaauuaucuuccacaaauuauccuaauaacaauuuaucuauguccuaaucauugcuaugcuguaaccaaagagcuauaucugcaacgugcuauauuccaguuuuacuguaaauauagaaauguagcuuuacuuuuguuuguuucuuuguuaagcaccuauuaacauuuuacucuccucucuuuuaacaaauaucccacccacccagcuaauucaaggaauuauaucauccaaagaucuuuuuguuugugacuuucaaccauuccuuuuaggucaguguuucauuugcauuacaugcugcucugcuauuucuguuauuuuuucaguugaagauagaccuguuuacuuuuucuucacuaucacauuauaauauuaccuaauucuguguuaaaaaaaauauuuauggcugugcaugguggcucacaccuguaaucccagcacuuugggaggcugaggugggaagaucacucaaacucaggaguuuaagaccacccugaacaacauagugagaccuugucucuacuaaaaaucaaaauaauuagcuggacauaguggugcaugccuguagucacagcuccuuggaaagccgaagugggagaaucacuugagccugggagguugagucugcagugagccaugaucgugccauugcacuccagccugggugacagggugagacccugucucaaaaaaaacuuuuuuaagucacuuuuauggcauguauuuaauucaugguuuuauucuacauuccuccuuccuuuuuuucuuucuuuuuuccuacuucuucccucuuucccucccucuugucucaaacaucacaauaaauacucaaaauauuaaacaugguaccgccuucauggagcuuccauuucaauugaggagacauuauaaaaaaccaaaccaccaauuauacauauagauaaauaauuguuuuaaaugcugagaaagaguaagacagaauagcaaggauuagaccuauaggauauuuagcugauuacuaaaggaagguauggagcuugccaggugaaggugaggaagagcuuccagguagagguagaaacuuucaggaagagauuggagcuugcuauguucagcaaagugaagaaagaacaauauuucuagcauuuauuuagcuugguagagaacagcaauacaugaaguuggaaggauagauuagcagauagauaaugggagacauuauaagucuuagaaggaguuugggcugggugugguggcucaugccugcaaucccagaacuuugggaggccaaaguggguggaucacuugaggccaggaauuccagaccagccugggcaaaaugacaaaaccccgccucuacuaaaaauacaaaaauuagcugggcguagugguucacacauguagucucagcuacuugggaggcugaggcacaagaaucacuuggacccaggagguggagguuguagugaguggagauugcgugacugcacuccagccuaggugauggagcaagacuccaucucaacacaaaagaaaggaguuuggauuuuucuuuaaaugaaaaggaaagccaauguaguguuuuaagggagacaguuauauuaauuuuuaaauuauuauuguauuauuauuauuauugcuacuuuaaagagaauggauuggaaaggagcaugagaguguaccauuugggagguguuguaauagucuaagccagagguaaucauaaccuucaaaggaguggcacuggagauggagagaagaagauggauuugugauugacuuuggagacagaaucugaaagacuugcugaugcauuguucauggagaaggguguccucagauucaaaggagcugggacuucugcagaaacacagagaauguuuauuagcagcguugggguguugggagugagauagagccaggcuuuuguuaaaacuagaagaugaauggaaaguucugauaagagguaugaagaguuuucuaauuauagagcgagaguucuugacaauacaggauucuauagauaguggcuuggguuggauuaggagauacugaggacaauaugggguugacagaguggcaauauaugcuuugagaccuuggacuuccuguagugacuacacugaacagggcuuuuaggcagguugggauguaccauucugggagaggagggcaaucugacccaauugugugguuuuuuggcuugcaagaaaucuucucgccuaggcugcaaggacugcuacauagaauuacaaaaaguuauugcuacaaagcacuuaaagaauauuuauuuuuugaagauacagcaagaagacugucuccucucacuuuuuauuuuuuuguagcauuaacauucuacacaugccauagaauauuucuccaacacugcauaguuugaagugaaaauacuagaugaaaaaggcaaagcuacauauauuauagccauuuaguuuauguuuuuaauccauguuuauauaguuuuauacuguuugcaucuuuguuacauuuuagauuuuaaaguaaggacuacauuaguuuuaaauugcuuugugguguuaagagcaaauuagugauuauauuuucauauuuaaaaguaaauaugauggguuuauaggccgcacauauguuccauguucaucauaucauuucacaacuaaaaauaguccccucccuaaaaaacuguucucaaagguuauuauuuuuuaaaaaacauacaaugcaguguaucaaaaacaagauuggcaagucagauccuggcaacuuuguauuaugacuaagaauuugcuuucuuuaggcuauaauuuugcuuuagaugcuuaugaaauuuugauuuuugauuacauuggaauauuaacagaaggaaaauaauucuguucauucacagaucaaaaauaauagaguagaaaauuauucuugucaguaucugaaaccaaacuuugcucauuuaaaaaauaucuuuuggauccacugugucauaggucuucaauauuguuucugaauagaauauugaauacuauagcgaagaggauuccucuguuccuuuuuuuuuuaaaaguauguguaugucaggaagucuaacuaauaaaugauuuguucuucuagcaguuuccauaugcccacugaucccaaaccuacaauuaugugccucuugcuauugaggcaguguguugugcccuuugguguauugugcuggaagaacuauugagauguaaagguauuuguuaggaaaagaauagagcuauagauagaaauccauacaauaccaguauucucacaggcaacaaaagaacagguaccaaagauugaaaaggaaauuuuagaaagggaggaaaacaagccaggaauuuuggaaauaggaagcuaagcgagccuccacaaaagacaguuucagagugaaguugagucagcaggaucagaugccacagagagaugcagguuaagauguggaugggacaaugucuguugcauuugaccauuaggaacugaagaccauagugggacauuagaaucauguggcagagcaguauuucagugugcuggaaaacaaaugagaagugaacaaaugaagacugcaaguguggacucuuaaagagucccguaaucuuuuucuuaguuuucuguguugucugugauuauagaauuuugaagcauguguaguugaaguugaagacguuaaauaugaaccauucauagaucuuugaacaguugccagaaaccuauuuuuuauauuaauguaauaauuuacauaaaacuaaauauuuaaaguuuugaacucuuaaagcacagcuaaauggaaaccuuuaaugcaaauguuuguuucuuuuuuuuuuuuuuuuaagucuuggcuacuuaugauucagcagacagaacaacuuaguaggauaaugaagacacaugcagaggacuugaacucuggaccuuuacacaggcucaccaugaugauuaaggacaagcagcaggugaagaaaaguuacauagguguucaucagcagauagaggcagagaugaucaagguucguuuuuccauauugaaguucuuucuugaaauuguuuuccaaauucacagaaauauuuuaccuuauuuggcuuuaaaaauuguuuauucaucauuucccaacaagaaauagguuuauggucucuaauaaguaauaucuuauugaacauaaaacauugauuauaggauauacugugacuguauauacuccuaugaaagaaaaaagaggcucccaauuaaacuaugacacaaagcuuucuuaucacuuaggauuuuuaguuuuuauuuacugaaauaguucuuugagacuuuuaaaaauaaauuugucuuaucuaauacuuugcauaaauaaaaaagaaaauacaggcagaauuacuuuugguauucuuaaauuuacguaucccucauuuucccuacauucggagucugucucuucugaaugacuuuuuucaaauuauuuuuauuauagaaauuuguaaauguauaaaacaagagaggauaguaaaaucaacuuccaccuacccaucaccugaauagucaccguuuuuucuauacuccuacccacuuuuuuuuuuuuuacauuggaucauuuuaaagguaucauuuuauccauaaauauuuuagaauguauagcuaaaauaagugaucuuguuagaaauguaacuacaggccagaugcgguaccucacaccuguaaucccagcacuuugggaggccgaggaaggcggaucacgaggucaggagaucaagaccauccuggcuaacagggugaaaccccgucucuacuaaaaauacaaaaaauuagcugggcguacuggcgggcgccuguagucccagcuacucaggaggcugaggcaggagaauggcgugaaccuggaagguggagguugcagugagcggagaucgcaccacugcacuccagccugggcaucagagcaagacuccgucucaaaaaaaaaaaaaaaauguaacuacaauaccguuaauuugccuaaaaauaauaauuccuucauguuaucgaauacuuuuuguugaaaugcuuguuguuuaaauguuuuuuuauaguugguugguuucaaucaggauccaaauaccaucuauaccuugcauuugaaugauacuuuuaaaaaauauguagguucucuuuccugcacaguguuuaauaaaaugccauuuauuuauggaagaaacuagguaauuugcucuauauaauugaauuuucuucauauuggguuuuucuguuagcaucuuaugaugugauuucacauauuccuucaucuuuaauuuuuucuguaaauuggaauuuaaaucuagagacuugauaagauucuggcugcauauuuugggcaagaguacaucauagguggugguauacacuucuugcaguuuuauaucaggagguauauaauguugauuuaucuuuuuauuaugugaaacuugacuaauugguuccaguguugucaaccugaucaaucuauuaaaaaaguuuucuggcugggugcgguggcucaugccuguaaucccagcacuuugggaggccaagaugggcagaucgccugaggucaggaguucaagaccagccugggcaacacggugaaaccccgucucuacuaaaaauacaaaaauuagccaggugcgguggugcacgucuguaaccccagccacuugggaggcugaggcaugagaauugcuugaacacuggaggcagaggcugcaguaagccuagaucaugccacugcccuaacagccugggcaacagagggagauucugucucaaaaaaaaaaaaaaaaaaaaguuugguaucagacuuuuaccaaauaguuuuacaaaguuaaccagugaguuuuuucuugaauggagaaugauuugaacucauuuauauuuauauuuuuuguuuauucacacagugucaucgucugugucaucaagaacauuggugauacagaauuucuuuaaaagggguuugagauuaucuuccaaguugcugauaaccacuuuugcaagguuuugaugcuuucucuuucuuaaucuucucaaauggcaaauuugaagaucuguagacaauaucugggacacauauuuuuuccuuaaauugcauucaaaugacuuuuugacuacagucaaggacuugcauuuguuucauuguuccacagaaauaauauuuuaaugguuuguuuaauuacagaaaauauuucugcacauacuaaguuaauuuuuuuaaauuuuagauaauggcaguguuauuucuucguuugcgccacccccccccccccacuuuuuuuuugagucaaguuucagccaggcuggagugcaguggugugaucuuggcucauugcaaccucugccucccagguucaagcgauucuugugccucauccucccgaguagcugggauuauaggcaugcgccaccauagccuggcuccuuuuuugguauuuuugguagagacaggguuuugcuguguuggccaggcuggucaugaauuacugaccccaagugaucugcuuguuuuagccucccaaagugcugguuacaggcgugagccaccgugccuggccugauuugcuauucucuuaaaaaaguuuauuuguuuucacaugcuauugaauuuaguacugauuuuuaaaacauacuuguaguuuauuuucuauaguuguauauuaaaggacaacucugaccuguaaguagugaaauacacaucaguuaauacuuuggaauuuaaguucuugagcaauuuaaauuuaaacaauuuaauacauuuaugcauuuuguuucuuugacagguuaccaaaacagaauuggagaaguuaaaaugcagcuauagacaauuaauaaaagaaaugaauucugccaaagagaaauauaaagaagcuuuagcuaaagguaaggcaaaauuuuaaaaauuguuuacuuaggugauuuuuauucuuacuguuugaaaguuaucuuuguaaguaguggaaugauuccauuuagagcauuucacauauaaaaaacucaaaauaaacccacauuggcuaauugucaaacaguguaguaagucuuacuaauuuuccauugcuuuaaaugacucaaaguauuuucgaauaguucauacuaaauggaauuauguagcauguguaauagaauugaagggauguuuaaaauuuucucucuugcaucauauuuacuuauuuaauuacagagugcuuaaguaagaaaaauaggaguauauuuauuuagaaacuuuuaaaaucuucuuuuuuaccuguauuauuuaagucauuaaaaccacaucauuuuauagcauuauguucucuuuauagcuuaauuuuaugugucuauauugcccuaaaauuuucauaagaagucuuaaaaauaaauggaaagagaagcauauuauuuauguuucaaacagagauuuaugguuauaauuucuuauuaaguacuuaggugaucuuguaucuaaauuuugaaauguuagauuucaguaaagacuaagcauaguuuaugaacagaaacuucuuuggcuguugcuauaauugggcaauauuuuccuuauguuuaaaugugccuaaaccacucauauuuauacauuuuuucuuuaugaaaguuggaggauuuuucuuuuuguuuuguuaauuuucuuucuagcuaaauaaagcguuuauuagaaucucuauuuuauuuugguucuuaaauucaucuuucucuacauuuucucuuuaucuuucauuuguuaaacauucucguuauuuugucauaguaaaugaaguaaacagcuccuccauuuggcuguaucuugcacaaugaaaauauuguuguuauucccaguacacuagaagugauacugauuuaaaugcaguucuuucucuucuccuuccuuucucucuccuuuuccccucuucuuuaucuucuuccuuccucucccuuggacucccuguuugucccccuucucucucuuccuccuccacuucuuaccccaacauuuacuuugugucuccuucucuccccgcuucccccaauuuacuagggaaguuguaugcauauucacaguuuccuuacuuauuugucauguaacucagccaagacuuugagauuauggucucuauuaauguagauauaucuuuugaaaugcuuuuaucuuuaaauuaucuaaauuauuuuagugaagcaaagaaagaaaugacaguggaaagagcacaggcuuuggagucagagaguccuggauuuaaguuccaacauugugugauuauuucauagauuuucaaacuuccuauaccuaauuauuauuccuuuguuauuuuaggagugcuuuagauaaccaagaaauauuuacugggcacuugcuauguuuaaguuacugagauucaaaacaauauuugccaggcauucaaggagcuuacagucugguucacuaacuugagaacuccaagucucacucucuugcaaaauuuagcuuuuucacaagguaucccuugcuaaaucaucaagaauaguuuaaaaauaacuuuauacauuaaacauuacuucuuaaucugucaaaauaguuaauuuuauaaaguucauugcuucaugccuggcuagcauucucaaguuaauuaaauuacauugcaaauauccauaucuaacuucacccacagcaaccauauuguaauccagcuauguuguguauuucgcacuagguuuguauauguuggagaauuauuaguuagaaaaagaaauacauaaguacuuucaagucuuugauaucuguuuuuagugauacaguuuauuuuuuuaaaagcaaaaucuaauucugaugucaaaguuuuaauuguuguaccuaaugcuuauauuagaaaagauuauggaaaaucauuauucuuuacucuugauucagaugaaacaccauuuaguauuguauuaauaguuggaaggcaacgagagaaucugaagaucauacuuguaauaaauuguaagaagugaauuauuugaaucuuuuuuuaaaaauuauacaagcuuaguugucuuucuaaagguauucaugauaguauuuuucuguuuucaagaauuugauuucucacauuaaauccuacagaauauauaguuacuuuuaaaauaaguacuuuuauauauccacuucacacaugagagauagguaaacuuuucuuuuauaaucaaaacuguguuuauacucauauuuaaaugaaaaaguauaaaauuuuauuuuugaaaaauuuauguuucaaacugcuucuguuuuuauggaaauaggaguuuuguggaguuauuuacucuuuacaaggaugaugagcuguaauggcaaauuuuuccaacauauauaggcuuuaugucagaaccuuaguucaccuacaugggccagauuaggacacuuuuggaaugggcccuagagacugcggggugcuuacaauagcuacucagauauuugucuggcauccagagucauuacuuuagacauuggaaggucuuagaaaaguuauuuacaaucccaaucuaacauagagcauccaauuagagaagacaggccuuggggaaacaaggccuggaaauaauuccuauaguaagauaaauucuauauuugaucaagaaauggguuuggacucaaggguucaguuccuauaacugggaguucagcaguaguaguaguaguaaaccagcaggaaggcugaguuaaugcugaaacuacaaaccccugaccccugcuguauaaauuaaacugauauuuuaaauuuugaauguuaaaauuuauauacaaaggaacacucguuuauguuuaguauaauguaaaauguaacauucauuuacaauaugaauuuagcaucauuuuaauuuucuaaaaauuaaaugcaccuuaaaauaauacaccuuaaacauucuaaaauaauacaccuuaaacauucuaaaaauaauacaccuuaaacauuaaaugugcauugcugugugguauguugagggagcacauguauauugcauuuuaucuuaaauugacuuggacuaauuugaacauuaguugauugauuauuacuuauaauggaugcugaggacaaccaaaauaauuuuaaccuauugagcugaaguuaauaacuuggagguguuucuuuuuuuuuccuucauugccuuaacaaacauuuagauacaaauacccuuugauacaaagaaguacaaaagguaguaaaggauucccccacuguuaccaucacuacuaaacacauacauauccacagcuguucauggcccaugucagugccucuuauagacgggaaaucaccuuuacuagauuuaauaaaaaugcaaaugccucuaaauguuccuucagaauaaguaagaagagcugaccaagaagaaagaacaaugggugaaggauuguggcucccacaaaucaggugaagguaauaguuuggggcuagccaaaaaugaaaggaauccuaggugauugucaaaucaaaaguuaaaaggaaccaaguuaguccagguaggaagagaagauuuuggggaguuaggcuagucaagugccuguaggcugcuuaaggaagucugcucugagugaggagaagggaauggaaaguaucuguaaauauccaauggguuuuuaaaaagaauaaguagagcaggaagcagaaaguagccacagagaaauucuuccuaccccaaccccaugccauuuucuuuuuuuuuuuuuuuuuuuuuuugagacggagccucgcucugccucccaggcuggagugcaguggcgcugucucggcucacugcaagcuccgccucccagauucacgccauucuccugccucagccucuggaguagcugggacuacaggcgcccgccaucacgccuggcuaauuuuuuguauuuuuaguagagaugggguuucacuguguuagccaggauggucgcgaucuccugacuucgugauccgccugccuucgccucccaaacugcugggauuacaggcgugagccaccgcguccggccaucccaugccauuuucuaaaaguaguuaaucagauucuuuaucgggacugacuuuaauuuacacagguugaaaaaaauaucuacucguccagccccaacaagcagccucucauuuuauuuuuuccaaccuuuaaaaaaaaauuaaaacaaacguagaaauuagaaggaugggacagugaauaugcauacuggauucaacaaguauuaaccuucugccacauuggcagaaucauuugaauguauguuucaggcgucauauacucuugaucgguaaaugcuuuagcuugcaucugcugagaauaaagacauucuucuaaaaagccacaaugcaauuaucauuucuaauaaaauuaacaauaaauaauucucuauuaucaucuaauauccgguccauauucuggucuccccagaaugucucuuauacagguugguguaaaaguaauagcuauuuucaccauugaaaauaaugucaaaaaccacaauuacuuuugcaccaaucuaauaguuuuuauuuuuuucuguccaucauuuccuucguuguuguugcuuugaaccaggaucugaucaaaguaaacauaccacauuugauuguugugucuguagacucuuagucuuuucaucuagaacaguccuccuacuuuuuacucaugacuuuuuuuuuuucuggaguccaguuuucuuguaaaauuucucauaugcuggauugucugauugcauucucaugacuacuguuuaacuugucccugaucuauccccuauauuuccuguaaauuuaaggauaguucuagaggcuugauuagauucaggucaaacauuuuugacaggacugcuucauagaugacgauguauacuuuauguugcauccuaccaggaggcacauaaaguuggcuugucuuacucuuagugcucagucaaguuugauuucuuuagucaaguagugacugccagaucucuccauugugaagguaccuuuaccccauguaauugguaaguaacugcagagagauacauuggcaugugugaauaaccuaucccccaacaaccuucuauccaauggcuuggcauccauugaucauccuugccaguagcaauauuacguuaacagcccaucauuuguaaaaugccuagcagaugacugggaagagaaaggaggguugagggaagaaacagagaacaauguaaagagggaauaaaaagcuggaaaugggaaaacaauuccaaaagcuuugcugauacccuucucuuuuuacguuuaacucuuuccaaagucaugaacccuuuaagguaaugcuggcuugaagcagugagcaaagaaagccucuugcucagggcugucacuuuacuagguagugaacgcauuucaguuagaaguguuucuugacaucagcauaaaauaacagguacuuaaaugcaaaauacacagauuuuaccuuccuauugaagguuaaauuccgaacaccuuuaguggguuaaacacuugguuagguuuagccauaaaacaguuuugugaauccauaaagcuuguaucugcacuaaguaguauaaaggaaauaauauauuuuuaaaaacuuuuaacuuguauauauuaggaaauaaauaauacucugagauuuaucucuuaggagacaucgagagguuuguugggggcucuggcaaauauggggaauucagguacuguuugccaugaugugccuuaacaacucccuuugacuaucaucaaugcuguuguuguucaugggaaauaauucuaauguggguuuuagucuguuaauuaauuuuaaaaacaugaauagugaagguuugugucaggaguaacaaaguaguauuuaagcugcugaaccugcagucuguuuuguaccaucaggugagagugagagccaagugggaggucuuucuggaccaauggugugcaaaauacucagucuuccuuucuuuuuuuccuaugucuuaucagugaagaagugauggaugguugugggaauaaauuauguuguaaguaccugggauuuguaaggauuaguauuuuuguauguauuuauauagaugcuguuuagguccuuuuuugaaaaucaacuauuaaaauuaugagauaaccugagaaauuuuacccagacaggauauuugauauuaaggaaaucuuguuauauuauagcuuugauaaugaaauugugauuuuuuugauguucucuuuauuuuugcauuaaaugcagaaauauucacagcugaagugaugugauaucugagguuugcuucaaaauuaucuaaagaauagggaguagauagauagaaguauagaugaaacaugauugaucaugaauugaugaucauucaaaccaguugauagguacauggagauauugaacaauucuuucuacuuuuguauagguuggauuuuuuccacaaaaauuauauaaaaauaaagaaugucaccauaagaaaugaaagaaaacuagacauuggcauaggcaaguauuucaugaccaaaaacucaaaagcaaauacaauaaaaacaaagauaaauagcugggaccuaauuaaacuaaagagcuuuugcacagcaaaaggaacagucagcagaguaaacagagugggaggaaaucuucacaaucuauacaccuaacaaaggacuaaaauccagaaucuacaacgaaucaguaagaaaaaaaacuaacaaucucaucaaaaagugggcuaagcacaugaauagacaugaauagacaauucucaaaagaagauauacaaauagguaacaaaccuaugaaaaaaugcucaacaucacuaauuuucagggaaaugcaaaucaaaaccacaaugugauaccuccuuacuccugcaagaauggccauaauacaaaaacaaaacaaaacaaaacaguagauguuggcguggauauggaaaucagggaacacuucuacacggcuggugggaauguaaaauaguacagccacuauggaaaacagaguggagauuccuuuaagagcuaaaaguagaacuaccauuugauccagcaaucccacuacuggguauccacccagaggaaaagaagucauaugaaaaagauacaugcacaugcauguuuauagcagcacaauucacaauugcaaaaucguggaaccaacccaaauguccaucaauaaacaaguggauaaagaaacugugguguauauaagaguguauacagagugcuccugccucacacucuuccccucaaaucccaaaguccacuguauuauucuuaugccuuugcauccucagagcuuagcucccacacaucagugagaacauaacucagguuuuccguuccuggauuacuucacuuagaauaauagucuccaaucucauccaggucacugcaaaugcuguuaauucauuccuuuuuuauggcugaguaguauuccaucaucuaucuaucuauggaaaacaaaaaaagaaaugaaagaaaggucucagaugauccuuauuggggcaacuauuucaauaucaaauuauucugaaucuauuccuuaucauuuuauauuuauauaugaguacauuuauguauuaauccuucauuuaaucacucauuuaauaagaauuucuuuuguuugguaaaugccagagauauaaaaaugaaaaagauguggacccuaccuucaagccauugaaaguugaauuuuuuuuuuuuuuuuucccaagauggagucucgcucugucgccaggcuggagugcaguggugugaucucgggucgcuguagccuccaccucccagguucaaguaauucuccuccucagccuccugaguagcuggggcuacaggugugcgccaccaaacccagcuaauuuuuguauuuuuaguagagaugggguuucaccauguuggccaggauggucucugucucuugaccucguaauccacccaccucagccucccaaagugcuaggauuacaggugugagccaccaugccuggcugaaaguugaaauuuuuauaaaaucaaauuuuuaccuaauuaaaaaaaauuucaagcccguagaaaaguugaaaugauaacauaaugaacuccugcauacuuuuuaccuggauucaaaaauugccaaaauuuugucacggcuaggcuucugcugucucuguuucgccucuuucuauguauauauauaugugugugaacauauauaugugugugaacauauauaugugugugaacauauauaugugugugaacauauaugcgugugaacauaugugugugaacaugugugugaacacauauaugugugugaacauauaugugugugugaacauauauaugugugaacauauauauauaguuuucuuuugaugaagcacuugaaaguauauuguaacaucauaacauuuccuuuuaaauaccuaagcauauauuuucuaagaacuguauuuuccaacacaacccuaauuuaauaugcccaagaaauuaaacuuugauacacuaaaaaaauuaaauauauaaucuguuuucaaauucauuacaaaaauguccuuuauaaccuuguuuguuuuggauccaggguccaaauaaagguuuauauauuguguuuaauugccauguagaagaauugcccuuacccucuuuauuuuuuaacagguucauuuugauacaguuaacauacaacagacagcaccuauuuaaaauauuuauuuugauaaauuuugacauauguacacaccugugaaauuauuacuacaaucaagauaaugaacaugucuuucaccccugaaaaauuccuagugcccuuuuguaaucccugucuuccaccucucugugaucuuccgucuucuaucucgaggcaacuacugaacugccuucugucacuguauaguuugguuuucauuucuuagaauauuuuaaaaaggaaccauauaguacacacucuauuuugucugccuuaauuuguucagaauaguuauuuugaaauccauccauguuguugcauguaugaguaauucacuuuuuaaaauugcucauuaggacucuauuguauggaucuacuacaguuuguuuauccauuuuccuguuaauaggcauuuggguuguuuccaguauugggccauuacaaauaaaaugacauuuuuggauuguucauugcugguguguguguguguauauauauauauauauauauauauauauauauauauauauauacauauauauauauauauauauauauauacacacacacacacacacacacacacacaauugauuuuugaauauuaacuuuuauccuauggacuuacugaacuuguuuauuaauucuaguagacuuuuguuuuguuuuguuuuguuuuuuuuacauggugucuugcucugucgcccaggcuggaguacaguggcaccaucuugggucacuguaaccucugucucucagguucaggcgauucuccuggcucagccuccugaguagcugggacuacaggugccugccaccacucccagcuuauuuuuuguguauauauauuuuuccaguagagaugggguuucaccauguuggucaggcuggucuugaacuccugaccucaagugauaugccugcucggccucccaaagugcugggguuacaggcaugagccaccgugccuggccucuaguugguuuuuuaaaaaugaauuucuuaggauuuuuuacuuauaggaucauguuaucuauguauaaagacaguuuuacuuuuaccuuuucaaucuaggugacuuuuuuuucuccuucuuuuucuuuuucuuuuucuugccuaauugcccuggcuagauccuccaguaugauauugaauagaagugagaggagcaaacaauguuggcuugccuuguuccugaacuuagguguaaagcauuuauuuagucucucaccuucaaguaugauguuugcuguaguuuuuuaaagacuuaaaauccuacugaaguaauuuuucucuauuccuguguuagaauggauguuggaucuugucaaaugcucuuucugcaucuauugagauaaauagauaccuauuuuguuuguuaauaugguuauuuugauugauuuucacauuucaaauauuacaccaaccuugcauaaaaucucgcuagucaugacuaaggauacaauuuucuuagucaugauguauuacuacuuuuuaaauuguuggaugugauuugcuaaguuuuuguuuauaauuuaucaccuaugucuauguuucuuguaaugucuuugucucauuuucauaugaggauaaugcuggccucagacugauuaccuucucaccaauuuucuaggaagauuuguguugaguuaguauuauuucuuucuuaaauauugguagacuuugcuugugaaaccaucuggaucugcuuguuuuuauuuuuccuuuuugguuaagcuuuuaaaguauaaauucacuuucuguaaucaauauaggcuauuuuagcccaguaugguggcauguguugguugucccagcuacuugggaggcugagaagggggaggaucgcuugagccuaggaguacgaaguuauaugccauuguacuccagacugggugacaaagugagaccuugucucuggaaaaaaaaagaaaaaugaggcuacuuaguuuguuucuuuuuauuuuagguuugguagguugucuuuucaggaauuuguccauuucauauaaguuauagaauguauugauaguaauuuguucauaauaguccuuuauucaccuuuuuauuuauauauuuuuuauuuauuuauuuugagacagucuugcucugucacccaggcuggagugcaguggcgcgaucacggcccacugcgagcucugccucccggguucacgccauucuccugucucagccucccaaguagcugggacugcaggcaccugccaccacgcccggcuaauuuuuuuguauuuuuaguagagacgagguuucaccauguuagccaugauggucucgaucuccugacuuugugaucuucccgccucggccuccccaccuuuuuauauuuauagaauguguagugacauuuccuuuauuaguaguuuuucucuuguuuccugaucauugugacuagagguuuaucagucuuauuaaucuucucaaagaccagcuuuuggucuuuuuucuucuguuuuugugauuucuacuuuaacacuuucugcuuuguccuuauuuccuuccuucugcuugcuuuaggcuuaguuugcacuuuuucuguuuuucuuaauguggaagcugaggucauugauuugagaaccaucuucuuuucaaaugcaagcauuugguacucuaaaguuccuuaaauacuuuuuuuuuuugcaguuugcccucaauuuuauauauuauguuuucauuuuuauuccggucaaaaugcuuucuaauuuccuuuuugauuauuuuuuuguguguguuuuucuuugauucauagguuauuuagaagaauguugucuaguuuccuaauguuuuaucguuuuucuagaguuuuuuaauuuuuuaaaauuuaauuucguuguggucugagaauguuuuuaugacuuuauuucuuuuacauuuauguaauaguuuauuauggccaguaaaugucuguuuugguaaaugcuuuaugugcacuugauaagaauguguauuaugcuauuguucuuuggagugaucuacauugucaacuugguccaguuguuuaauaguauuauucaaauuuguuauguucuuaacaauuuuuuugucuaccuguuguaucaguuauugauggaaggauauugaaaucgccaaccauaauuguggauuuguguauuucuucuuguaguucuaucaguuuuuacuuuaugucuuuugaaacuauuauugguauguaagcauuuaugaguauuauauucuuuugaugaccugacuacuuuauuauuaugaaaugaccuuuauuaugccugguaauaauauuguuugcucuguuauucauuccguuugauauuaacguagccauuccagcuuucuuuugauuaguguuuauguaguauauuuuuucuuuuuccuuuuuuacuuuauauuuuauuuuuuuuacaacagggucucacucuguugcucagguuggagugcagugguggugcgaucauagcucgcugcagccucgaacuccugggcucaaguaauccuccugucucagccaacuguguagcugggaauacgagcauguguugccaugcccagcuaacuuuuuauagagaugggguuucgccaucuucccuaggcuaaucucaaaccccugagcucaaguuaucugccucccugggccucccaaaguguugagaguacagguaugagccaccacaucugaccuaucuauauucuuuuuucauacuuuaaccaguuucagucuuuauuucugaaaugcaucucuuguaaacagcauauaguuaucucuuuuguuucuugauaauccuuaccuuuuaauuaguggcauuuagaccaauauuuaaauguaacuguuuauaauguuagguuuaaucugucauuuugcaguuuauuuucuuuuuguuccacguauucuguauuucacuuugccuuuauucuaccuuucucuggauuaauugaacauuuuucugaagauucuuaucucuucugcuaauuuguuagcucuaauguuuuauuuuauuuuguauguaauuuacuauaauauaccuuuaacugguauuaugccacuuuguauauauaccauguauauaguaugggaaucuuacaauaggauaguucuguuucucccuuuccugucuuugugcuauuauugugauauauuuuauauauuuuacuuuugcuuauguuacaaacuacacacuacauuguuuuuguuuuguuuaaauaguaaauuaucuucaauaauaaaauauuucauauauuuauccaaguacuuaucuuuuccagcauucuuuauuuauuuaucuaugucucuauuucuauuugguaucauuuuacuuuugccugaauggcuuacuuuuaacauuucuuguaauguaggucugcaaguaaugaauuauguauguccgaaaaaauauuuauuucacuuucauuuuaaaauauauuuuuugggaguauagaauuuuuuuuuaaacagauuuuuaccucuuuauguauuuaaagauguuucuccagugccuugucacggagaaaucugcucuaauccuuaucuuaguugcucugaacauuucauuuuccuuugguagcuuuuaagauuuuccuuuuaucauuaguuuuaagcaauucuaucaugauuuacuuuguuguaaguuuuuuauuaaaguuuuaauuuauguuuguguuuuuugagcuucuuguauuugaguuuuuaguuuucaucaaauuuggaaaacuuucagccauuauuucuucacauauauuuucugucuccccuucucuuuuugcuuucuuucagagacuccaguuacacauauauuaggcugcuuguaguucucuuacagacuccuaaugcucugauaauuuuuuuccccuugucuuuuuuuuguuucauuuugguuaguuucuaugacuaugucuaacaguuuaguaaucuuuucuucugcaaugccuaauugccuuuaaucccaucugguggugguuuuguuguuguuguuguuguuguuguuuuguuuuguuguuguuguuguuaucucaggcaguauagguuuugccuccucaaguaugauuugggucucuucuuaaaccuuuuauauaucuacuuaacuuuuugaacauacugaauaccacuauaauaacuguuuugaaauccuugucacccaguucuaacaucugugucagucacuuucaguugauugauuuguuccuucauuuugguuagauauuuuugcuucuuugaaugccugauaacuuuugaugagaugccauacauugugcauuuuaaacucauuagacugggucucauuaacauuucuaauaaagcuauaagacuucuaguccaaggagaaaauguagaacauugccuugauucaugacagagagaauaauaauaaaauuuuguuugugaaaugauggaaguuuaaaaaucacauuauuagggccaggcgcgguggcucacgccuguaaucccagcacuuugggaggccaaggcggguggaucaugaggucaagagaucaagaccagccuggccaacauugugaaaccccgucucuacuaaaaaaugcaaaaaaaaauuagcugggcaugguggugcgcgccuguaguccuagccacuugggaggcugaggcaggagaauugcuugaaccugggagguggagguugcagugagccuagaucgugccacuguacucuagccuggugacagagcaagacuccgucucaaaaaaaaaaaaaaucauauuauuagugccuuuuuugagcuuguuuuuuuuuccucuugaaauuuauaaugauccucuacuguuuuucuguaugauaucuauaauauacuuuuccauguguuuauuuuguuucauaaauuaaucugaggauuccaguuaagguguuucugauuuuucuucugcauaaguuaaauaauugaaguuuuuguauacuauacuuagauaauccuuuuguaguacuugauuuuucaagggauuccauaaguuuagguuuaucacuguacaccuuuaaguaauuugucguugugcuugauuugucuuuugaucucaugugaaaugagaaaaaauuuuauauaaaacuugaaggaaaauguguuaucucuuuuuuuaaguuggaauacuauuuguuuuucuauuagaaaacauuaaacuuuuaagauuuacuuuuuauuuuuuuucuugucaagggauuucugaagaaaugcugcaaagaauaucuguguauucuguuuauuacaguaauuuuguuuauuuagggcagaucauaauugauuuuacuacaccguuauuuuacaguauucacaaaaauuaauaauggucacuuacaauguuagauaguuucucuggaaauuucucauagacaaacaguuuucaaguacaugauugggagaauaaagaaauaguugaaaccaaaucugucugauuucaguguccauggccuuuguugguuuugcuucuuccuaugaagaacaugaauuaaauuaaacucuguuaaugauaaugaaagaccaaaacacauuaaccuaaguuuuagagucuuaguggaguuuaucauccuuccuaauuuguucugagaguuauaugaguuuauuuauucccagauauuuugggcucaccauuuccucaacuuguucauguuguagauaauauacaucauuguauuaaucuguuuucaugcugcugauaaagacugggcaauuuacaaaagaaagagguuuaauggacuuacauuuccauaugacuagggaggccucacaaucguggcagaaggcaaggaggagaaagucaugucuuacauggauggcagcaggcaaagagagagauugggcagggaaacucugccuuauaaagccaucagucucaugagacuuauucacgugagauuuauucacuaucaugagaacgccaugggaaagaccugccgccaugauucaguuaccucccacugggucccucccacaacaugugggaauucaacaugagauuuggguggggacaaagccaaaccauaucagucaucuucaccuauauauauacacaugcagguucuugugcggaugccauguaguacuuuguucaaaguaaaaaaaacaaaaacaaaaauuaagaguaaauauaaugcaugccaauuuuauaauauguaagcaaaaccauauuuaauuguaugguauugaauuuaauaauuucaaaugugauuuuucuuugaaauuuuauaguuuacuuaaagauauucugaaguaucagaaaagauguuaaaaauaacuaccuuguaauuauauauucagauauagccuacuuaauugauucuguauguuuagaauuaugcuaggguuuuauguuuaccaagccucaaaauacccaucauaguauuuauaaaggcuuucucuuacaugaguaggagucugaaugcuucugcuuuaucauacaucauguucaggaaaaagaaagaaaacaggauagcuacuccacauuacacaugcccaugucagucagucuagaggcacuugaaaggaguucucuucacccucuuuuaucacacaaguggggaaacaaacuaucuuccuaauuauccuuucucuaugauaaauaaaagaaugcuaagggauggguaaacccaaugauaauuuauaagccgucauuuacccuaagcagacagaguaagaggauuaccuacugcuagaacuguggggaguagcugcaagucucauucaaaaguaaauuuuucuguaauugggaaguagauuuucuuaaauugccucuucaugcauuaugaauaguuugugauauuuuauagccaauuaaaauugauuagaucuguugaguugucucuguagaguacuuuaauuaugaaaaccaguuugaaaugaguccagccuugagacagaugguuaaauuuauguuuaaauaaguccacauuuuaaaaaauggauacgacuuuuuaaaagcucuuuuaguugauuuccucaauuugaggucaccaagaauggcaacuagccuucuuauucaauaucuguauauuuuggcgauauuuaaauaucaaauuuauguucaggugauauauggagguccuuauauucuggaauucaaauuucucucucaguuuaacauauggaaaaauucauauuggacaugguaguggccaaaguagaguucaagcuacaguuguuggucaugaauucuacugaaguuaccugaaaaugagagguuuccacuuauuuuuggauuuagugauuaauauauaucagcagcuaacuuauggaaugaaugcuuuuugcugcauaaaguaugaagugaaauuucauuaauaugauaggaauuuuacaagguaauuaaaaguaauggcacucuuagcuuuaauuugcauugguuuaaagcugugcagaaauuggaaugacagcuauaauaaucucauuaaacacugaaauauaugggauggaauaugcuauaugauucauuuauauucuuuguauuacuuccuaaauuuguccauauuuugcuuaguuuugauaaguaaacaaagcuaaguucuacacaugaaaaacuuaagagaaguucugucuuuuugcuaauuaucuucuauauuuuaucgguaagcuucuuugcaauauuaguuuuggacuuaauuacuaaaaagaugauauaaauaucagaggguagaauugauaauauaaacagcgugaucugaacagcacaagguaaaauuauaaucuuucaauaacuuuuuaaaaauugauuuguuuaaauuucuuuuuuucaaauaagaacuauaucaauuuaugcauuuaagaacuauuuguugaguucuugcuauauguuagucacugcucucuuaauuugggauauuguagauaacaauacauacaaaaaucccagccuccuugaggcuuacauuuuagagcagaagauagcugauucauaaaauaaauaagugaaacauagcauaugaaauggugauaaauaccauggagaaaaaugaaacaagguaggaagauuggguauugagaagaugaucauguauuccucauggagaaagaaacauuuaaauaaagaaugaaggaagucagggagugaaccaugugaucaucuguagcaaagaguacucuagguagagggaauaaccaaacaaagucauugagauuuuaucauuuccggcauauuugaagaucaguacagauaccuuuuugucuauaacugaguugauugauaagagagaggcauggagguaugagaugaggucagagagggagaaugauggugguugacaggcgaugcauagauuauguaggaucuugguaguuccuuuaaaacacugacuuuuacucaaguaagaugggaagccauuggaguguuuugagcagaggagugacgugaaugaacuuacauuuuaacaggauaauuguuguaaccuuuuugagaauagucugaaaugagagaggaagggcagaaguaaggagacaguuacuuccaggcuauugcaguaguuuaggcaaggggucaugcugguuuggaccugguugguagcaaaagaagugcugagaagugcucaaauucuguauaaacaauuaauucuuguuauucaugguaguuugauaaagucacuguguacauuaaauuaguuagugcugacuuguuucaccuaggggacauaaagguuuguuuccugcaagcagugacacaacauuuucagcaacugaucaauacauaacuuuauuuuauguauguuuucauuuaaagacaccuaauuuaacauugaacucacaaccaauggugcuauaacugauggcuaaaugaaacuuaucuaguacagguaucuucucuuaaagggucaucacagccuuuuugaguguacgaccauuauacuucggcacuagagccguuucaaacagugaaaucaccaacaaaauucacaaaaaugugaaaauugcaccacauagacugcaaauuguuuacaguugugaaagcugaaacaaaaaguggagccuaacuuuguucaaccucagcuaagaaccugugccuuuacucaaauuuuuugcugcucugcacauggcaugccuguaacugaccuggaaugcaaugcauguauuguuuuggggguuuuaaagaaauuuuacccaguagguaaauucaggaaugcagcuuucacaaauaaugaaaaucuaccauauauugaaaguagagcgggcuggacgugguggcucaugccuguaaucccagcauuuugggaggccgaggcagauggaucacuugaggccaggaguucaagaccaaccuggccacuggccaucauggugaaaccgugucucuacuaaaaauacaaaaaauuaaccaggccugguggcacacgccuauagucccagcuacuagggaggcugaggcaccagaauugccugacccaggaggcggagguugcagugagccaagauugcccccacugcacuccagcugggcugacagagcagcaagacccugucucaaaaaaaaaaaaaaaaaaaaaaaaaagcguagaggauuugccauugaauuggauguaguuugugagagaaagaagaaaagacugauuccaagauuuuuggccugagcaacuggaagaauggcauuauuauuaacugaaaugggaaaaaugugggaagacugguuuuuagagucuuauuagauacucaaguggaacuguugaauuaaaucucuaguucagcaguuccagggagaggucuggaguagaacuauaaauaugaaauguuaauugucauuuaaagccaugagauuuuaugacauuaccaguaauauaaaugaagauaaaaaagagaagagucuuaacaaagacugagcccaacauuaagaagucagcgaaauaaagaguuaaaaagaauacaaaagaccggccgggcgcgguggcucacgccuguaaucccagcacuuugggaggccgaggcgggcagaugacaaggucaggagaucgagaccacggugaaaucccgucucugcuaaaaaauacaaaaaauuagccgggcgcgguggugggcgccuguagucccagcuacucgggaggcugaggcaggagaauggcgugaacccgggaggcggaacuugcagugagccaagaucgcgccacugcacuccagcgaaaaaaaaaaaaaaaagaauacaaaagaccaauguaaaaggaaaacuaagugaauguacuauucuggaagacagaugugggaagauagguuucaaggaagagcaagugaucaacuagguugaauacugcuaaaacauaaggugaggauuaagauuuggaguuagcaaaguguagguuauuggugauuuugacaagagaaguuucaguggaguaguacagggaaaacccuaaaugggcuggguuuaagaaagaaggagaaaaaagaaacuggagauaacuaguaucaguuuugcgguaaaggggaggaaugaaauacggaauuaacuggaagaaguguaguaaagggaggauuuuuuuuuuuuuucaagauugggagcuauuacagcuuguuuacugauggaagugcacuucuagggaaggaaaaacaguugaggcagcaggaaugaaggaagaauugcuggagaaaugucccugaguaggugagagaggauacaucuaguaccccaauaaauagauuagucuucacuuugaacaaggacaguuuauucauaguaauagcuuaggagagauggagagauauaaauucagauaaaaagguuagauaugcuggugaaagcuuauggaaguucucuucagaguaauuuuuaaaaaugggguucacagacucccucuucacacuaauaugguucagauuucaaaaucauaagguacaaaccauuaaguauacaaugaaaaaguuuuuuuucccacucauuauucauuuuuuuccuccagaggcaacagauauuaucugcuuuuucuagagauauuuuaugcauaacauguagcuuuuaagccaguuuguuaaguguguucaucaacuuauuagauaccuuucguaucauaguacauauuaggaguuggagguuaguauguguuuguuuaugcuaaauuaaugaugaucucuacauuuuugauacagucauauccuaacaugaugacuauuuggucagcuuucauuuuaauuuucguauccaguaucuuuuaggaagagacuauaacugugcaucccucacauaaccuaggacaccauggauuguagauaaacauuuaaaggaugaaugcccuaaauuuucuguaaauguuguucuuccacacacucgacuagucuucuaaaguagaguuaaaucuuuuuuuuuucagugugacuucuuuguguguuaauauuacguguaguggaaacauaccugcuaggagacauacaaauuaaaacuaaauuuucuuuucugaacuaggaaaucaguguuuugauauuuaaagaacaaauuguugagguuucuuaucuguaggcuaaauaauaccaguucuuuagauacaaugaauauucugauacuuuaaaauuuugauccaauuuucacagcuuucuuuuaacuauauuuuaacgucauuucaguccuagagaaauguugaaagaauaguagaaagaauucccauauaccguucacucauguuucccaaauguucacauuuuaccacauuugcuuuaugcuuuucugucucuguauguggugcauacauauauaugcauguguguguauguguaaauauaaaaacguaaauguauauuuauucaguugucauaucuuuuuaguugccuuuacacuggaacaguuaauagucuuuaugguucacaaaacauugacauuuuugagcaguauagaacaguuauuuuauggaguauuccuugauuuguuuuucugcauaauauuuauuuauuuuucauaggaauaccauagaaaugauguucuguuguuggugcuuuauaucagguccaugaugucaguucaucccauuauuggauauuaauuugaucauuggaguaaggugguauacgcuugauuucuccacacuuaaguuacauuuucauuuuucuuuuuguuaauaaguauuguagggaaaacguugacgcuauguaaauacgguguuacucuucagauuuucacccacuaguuuuuaugucuaucaaugguuccugccuaaaucauuuauuauuauggcaauugugaaaugguaauuuucuaauucaauuauuccuuuuacauuuauuaauuuguuuuuaauauaaggaagggcuuuccccuccuguuuauuuuuuaaauuuauguauuaauuuaauguauuagaaugaacucacagauucugauuuuuauucauggauuauaauuuuauacuaucauaaugauauacuaucaugcucggauuuggccagugggagccacuucaaacuggcuccucuguccuuuugacacauuccuaucauucauugaauacguauuuucuggcucaucuuauacuuuuccuacuucagguuccauuucucuaugaaacccuaguuccuuuuaguggagaauuauauuuggaaaacaguaucuggccauuggugugcucauugcuaguggaguaucuuauucuagguccuguuaauugacagacacaggaaauaagcaacacguacacauucauguacaccugugcuuucuucuguuaucuauuggucugucuagggauacacugagggguucacauugauacuucaaauucuaguccaauaccauacaguuuauuccuccucuuccuauuuauauauuugcaacugcuuucucuggcagugagaaaccuagguucuguuguucacaauauuuuacuuacuugcucaaaugcuagaauacacagaaaguaauuucaguauugcuaacucaugccucugaaaaaugaaacuuaaagacuacaguuugguauuuguuuaaagcuuuuuuugucuuuagcuuucuauuguaaucaaauacuguuuuccaaaguuacuuaguuuuuuacaaaguuacuucccuacuccuuuuagugugguuaguguuauucacuggaaauacaguuugguucauuuguuucuguuguaucucauuuuauuuuccccccucccucuuauccuuguuaauuuuguuuauuuauuucuaugugaaacuuuagugauuccaaaaguuaauacuguucaaaaccauauagggaacucaaucauuuuuauuuuccuuucuuucuuacacaaaacuacgauuauauaauauucuuuuuccuuugcuucuccauugauaaugcaucuugaaaaugacaacauuugaguugguagacaguuuuuucauuuuuuuuuuuuuuuuuuucuguccucacagucucuugcucguuuuuucauucguuucaacagcugcaugccacuuuauuuuaagauuauuuaagcccuuuccuacauauggacauauagcuuauuucugauuuuucuaauuauauguacuccuacuauaaauaaccuuauguauguguuuuguauguguguguguuugugugugugauuggagauaugaauucccaaaagugugauauaaauuccaagaagugugauggcuggguuaaaagguauacuuacaugugauuuuguuagauauugccaaauuuccuucuauaaggauuauaccaauuugcauuucuacuagaaauguaugaauguuuuuucuccacauccucgccaacagaguguuucucaauuugguagaugagacauaguaucucacuuccucuuuucuuuaacucuuacauugcugucacugcugugaucuaccacuacaguuuuucaguauuuucacaaguagagcagaccuucuuuuucugaugguuguuuuuagaucagucuuaagcauucugcuguuucuucucuucaccccgaccccugccucaccccccaacacccaccuccaaccaacccacccaacagcauuuggucuucguaaaggcuugcuuugggagggggagagaucauuuguagagauuugguguuuacuuuucuacucauagccaauuuaaaauuuggacuuucugugccuguuaugcugaggguaugaguuauguuuuucauuuuguucuuuauuauauuuuuggguaauaugugggagauucagaauuaugcugcugccauaucccagcuacccagaacucccucauucacaguauuaggaaauuauggaauguagauuuggacaugguacaucauucacuuuacagguuguuagaagacuguggaucaauugaauguagcaaucacuauaugcaaggaaauuauauuacacagaguuugagaacuugcucuuuaaagguguuuuauauugaauuuuuaaauaaaguaucacuauuucaguucucugaacaguucaaaacccauaaaauguuuaguaaauguuucuugauaaaucaaauuuucuuaugccaggaaauuuauuaaaaguagcaagauauguauauaccuauuauuauuauuauuauuauuauuauuauuauuauuuugagauggagucucucucugucgcccaggcuggagugcaguugugcgaucucggcucacugcaaccuccaccucccggguuccagugauuguccugccucagccucccaaguagcugggacuacaggugugcaccaccacgcccagcuaauuuuuguauuuuuuaagagagacaggguuucaccauauuggccaggcuggucucaaacuccugaccucaugauccuuccaccucagucccccaaagugcugggauuacagaugugagccacugugccuggccauaccuauuuuuguuuuuaaugcuuuauaggagcauauaaacacaaacauuuucuuuuugucuuuccaaauucugugcuuuauuuagccuuugcuauuaacugcauuuugucaguuuucugccauuuaaucuacauuacaacccagugaauuagaaagggcagauaauuuaauuccuauguuuaaaaaucagaaacuaaaauuuagauuaaauguuuugcuuggggcugcacaucuaaucaaaggaaaagcugagacuaguacugacuuuuuaacauuguucuugucagaaccacacugaguaaaaaagguagcuccuucauuguuucuacauaucacacuugaauuuaacuuccaugugaaaaaaacauguguauacauuugacccaaguaacuauaaguuaagaugaauuccuguucauuuucuucauacucagugugccuaggauagcgaguguagaguaauaaguaaaauugugaaauugagcagcguauuagucuguuuucacacugcuauaaagacauauaauuacuggguaauuuauaaagaaaagagguuuaauuggcucacaguuccacauugcuggggaggccucaggaaacuuacaaucaugguggaagaggaagaggcaugacuucaugguggcaggugagagagacugagcaagaguagggaaaacugccuuguaaaaccaccagaucuucugagaacucacuaucacaagaacagcauggggguaaaaauaccccuucaugauuuaaccaccuuccaccugguccuucccuugauacaugggaauuauagggauuauaauuccagaugagauuuggguggggacauagagccaaaccauauuaacaaggaauguucugaaagaaaggaaaauuguaaggugguggaauguuuaguuauccaaaucaaagcagagucuacuuguaggcacuuuauuuuuagaaaauaaucacuucuuauuuauuaucagcagguuucuaccauaauucgcaaauggcaaacacuucagaaguuuauaauaaaaaaagugacuuuuuagacuagcuuaaugaguagucuagccuuucucuuguaaaugucaaacuuacauaauugaguuuugcuagcuucauaauauuguugauggcaugauauguuguuuaugcauucuguuauuacaaaacauuaaauagauuugucaacaaguuguggcaaacaaauuauaauuuaaucucuuugugaauuuuauuauguggaggaggaaaaauuggauguuuuccuccuuguugauugacauguagaacacucaugcccugcuccaaugccugucaucauuuaaagaaaaaagaaaaaaagcacacaaaacaaagauaggauacugugucuguugaaugaaaaauaagaauuuuuucauucuauguacuucacguuaauuuuaagagcauaugcauuuauuuaaaaguuaagaaaguauauuagugaucuaagauauuucgaaguaaauagaauuguauuagguuauuuuuugcaauaauuuuguuaaguaaaaggaauuuuaaaauuuuuauuuguaacauugguuuuuauaugguauuaacauuucugaaauugacuuauguauccuguauagcacccuaaacauuuauuuuaaaacaaaucaguaaaaaguaacauagaaucccuuuccaaaucaugguaagugagcauguuuuuaaaacucuuuguuuuuaccugcaagggaaggagauaacagauugauugauaaugugcaugcauaaguaugccuuauaaccaaauguagaaguguaugugagcuguggaguacuccuccccaaaaucugucaaaacauaaccugaaaucugguuuuaaaccugaaagugguuuugagaauuuauuauuauuauuuuaauacaauagauucugcauuggauauuuccaaaggcaguaaauauuuuuguaauuguuauuaaugaccauugguaagcuguuggugauuaaauuuuggcucuaaugacuucaggcuguuugucauauacuauauuuaauaaagaaaaagguaucugggaaauucuuaacuucucuaauguuaucuuggagcauaaaaucuuacugaguugaguguuguauguuuagugaaucauuuuacaccagcuagaaagacagauggguagugugcaguuuaaauaucugugcaaaugagaggacagaugggugguuuaaaugguuuaaaugucucaaugaaaauguguagagagauugucuucugaaguuagacuaaaaaauucagggaauuaauuaggaauaauaguuaauauaacaaaauaaaauuuuuaaauaagaggcaaaauauggaauucagugaauugauuauaccuuuugaacugacaguaaaaaguaacaucuuagaacacaguacucaaauacacuugcaugguaacugccuguuuuguuuucuuauuaugaacauguggacuguggaaagugucuuuauuacuuggaauuaacuuaucugguuaauuguaccugaccuuuugaacuguugucagaauuaauuuguucaauuucaaguaguuaacagaaacuuaaacuagcuuaaaaauggugaguaaaaaaaaaaaccagacuaaaaaccaaaaaccuugaaaugggccucagaaaaggcagcuucuguagcaggaguuagugaacuuuuacucuuauucaggaauuaauaugacuuagcuucuagccaaaauauugguuccuauauugucagguauguaccuuagaucuuggaugucagcuccauguaggagccuccuccuaacuuguguggguggggacaaaaaggggugaucacuuuuagauggaaggcugugggcuggccauagauaugucaguugcacugaccuuuuuuuuuguuuguuugacagagucuagcucuguugcccaggcuggagugaagaggcuugaucuugguucacugcaaccuccgccuccuggguuaaagugauucuccugccucagccucccgauuggcugggaccacaggcaugcaccaccacaccuggcuacuuguuuuguauuuuaguagagaugggguuucacuguguuggccaggcuggccucgaacuccugaccucaaguaauccgcccgccucggccucugaaaguguugggauuacacgugagcugcugcacccaggcaauugcauugacuuuuggggacuuuuaaugaaauauauucuguaagaagaaugcuaaguaguaauauucauggauaaaaaugcuauuguauuauucuaugaaaaauuauuaguaacugaucaugugggaggauauguuccuuagaacauuaaaaaucauucaugguuaguauuacugaaguuauuuuauuaauugcuaaguuaaaaaauugugccaagugucaugcagagugagauaaaucuucucuagggauuuauuuuaacugaggcaaaaaauuuacugauuucugauaaacauuaaaaaaauucaaauagauuagaauuuuugaaaaaaucacugggcauaccucauaguaaggagaauaaucauuuuauauuacauuuauauaaacacauauuugauuauuuacugguucaugacauaaaauauauuaucuugugggugguagucaaaaaguuugaaaaguauuacuuuagugauucaaguuuuuuucuuucuuucugauuuucuucaggugagaacuaaauuaauguacuugcuucccuccugccacucuaguuuuagaacauguuucucuucagcagugacagggguuagagauacucaggugaaaagauuauuuucuuauuaagaaguucuuuauguuauaaagugaaauagauuaucuggguaacauuuuguuaaaaacuuggacaguuauuaauauccucaugugcaagagccagugaauggacaauggguacagaauuaaacucuuuaaaaaaauuauguguugcuccauagaagucaguggugauucuaguauuugugaacucuagaauuuauugauaguagagacauacaagucugccagaagguuuguuucuguuuauacgauguggauguaguuccugagcaucagaauuggagggaugaugagaaagcaagggaauucuauuucucauucuguuguucuuccuaggaauggucugaggucugaaauugucccucuuugcaaaaacccucaccuuuucucugcucuuugcucugggguacugagauucuuaaaugaggaauacucagaugguugcugagccuaagcagaauggcaacagaagggagccugccgucaaaaauucucaacuuaagaucuguuucuguuucagcuuucuacauauggcuagccaguuuucccagcaccauuuauuaaauagggaauccuuuccccagugcuuguuuuugucaggguugucaaagaucagaugguuguagauaugcggcauuauuucuaagggcucuguucuguuccauuggucuauaucucuguuuugguaccaguaccaugcuguuuugguuacaguagccuuguaguauaguuugaagucagguagcaugaugccuccagcuuuguucuuuuggcuuaggguugacuuggcaaugugggcucuuuuuugguuccauaugaacuuuaaaguaguuuuuuccaauucuuugaagaaagucauugguagcuugauggggauggcauugaaucuauaaauuaccuugggcaguauggccauuuucacgauauugauucuuccuacccaugagcauggaauguucuuccauuuguuuguauccucuuuuauuucauugagcagugguuuguuguucuccuugaagagguccuucacgucccuuguaaguuggauuccuaaguauuuuauucucuuugaagcaauugugaaugggaguucacucaugauuuggcucucugucuguuauugguguauaagaaugcuugugauuuuugcacauugauuuuguauccugagacuuugcugaaguugccuaucagcuuaaggagauuuugggcugagaugaugggguuuucuaaauaaacaaucaugucaucugcaaacagggacaauuugacuuccucuuuuccuaauugaauacccucuauuuccuucuccugccugauugcccuggccagaacuuccaacacuauguugaauaggaauagugaguuacaccuuauacaaaaauuaauucaggauggaguaaagacuuaaauguuagaccuaaaaccauaaaaaccccagaagaaaaccuuggcaauaccauucaggacauaggcauggguaaggacuucaugucuaaaacaccaaaagcaauggcaacaaaagccaaaauugacaaacaggaucuaauuaaacuaaagagcuucugcacagcaaaagaaaccuaccaucagauugaacaggcagccuacagaaugggagaaaauuuuugcaaucuacucaucugacaaagggcuaauauccagaaucuacaaugaacucaaacaaguuuacaagaaaaaaacaaacaaccccaucaaaaagugggcgaaggauaugaacagacacuucucaaaagaagacauuuaugcagccaaaagacacaugaaaaaaugcucaccaucacuggccaucagagaaaugcaaaucaaaaccacaaugagauaccaucucacaccaguuagaauggcaaucauuaagaagucaggaaacaacaggugcuggagaggauguggagaaauaggaacacuuuuacacuguuggugggacuguaaacaaguucaaccauuguggaagucaguguggugauucuucagggaucuggaacuagaaguaccauuugacccagccaucccauuacugaguauauaccaaaaauauuauaaaucaugcugcuauaaagacacaugcacauguauguuuauugcgguacuauucacaauagcaaagacuuggaaccaacccaauguccaacagugauagacuggauuaagaaaauauggcacauauacaccauggaauacuaugcagccauaaaaaaggaugaguucauguccuuuguagggacauggaugaagcuggaaaccaucauucucagcagacugucacaaggacaaaaaacuaaacaccgcguguucucacccauagguggguauugaacagugagaacacauggacacaggaaggggaacauuacacaccaaggacuguugugggauggggggaagggggagugauagccuuaggagauauaccuaauguuaaaugacaaguuaaugggugccacacaccaacguggcacauguauacauauguaacaaaccugcauguugugcacauguacccuaaaacuuaaaguauuaaaaaaaaaaagaaucagcuagaaacugaugccuugacaccaaugaaucucaaugcaaugaaauacaaguuacaaaagaaugcaaauaaaauuuauuuacauuaaaaaaaaagaucuguuucuggggagaggauuuauuuggaggacuucuuuggaaagggcagaaaguaguaaauaucuugaacaguuuauuuucugagucuacaaugacaagaaauauuuguguaauuugcaucaaaaguuuaagaucugcuuaaaauuuucauuucuuuauaucuucauuugcuuauauuggcaaucuguaaauguuuucuaaaugacuaguaaaggaaccauaaaauguuuuuaacucauaacauuaucaguaucucucagacuucuuccacaugaagucuaaauuucucugcuugauuuucaagucauucagcaccuagaacugcacuaccuaaggagaccuauuucuucaacuuucucaaaacuugcugucuguagacaagcuuaucucuauguaacuuuguucuuuccauguauucacucaauauugcaguucacaaggcucuauuucaaggacuguuuugccaaauacugaauucccaauguuuagcacaguuccuaguagcguucagcuaauaauauucauugaaugaaaggaaggaaggaaugaagggaaaaaaggaaggugagaggaaggaacuaucuguucuuaucuuuuuuaugcuuccccagauaugucccauauuuuaagguuugucuucuccacaaagccuccucugacuacccuugucuuuguugauaucucaaacauagaccucaaaauuuaacauuauuuacaaacuuucuugguuucuugguuuuacaguuuuaugugcacugcuguuucaauuugguauaagcuucuugaagaugaaaaggaucauauaucuguacuuuuuuguguuuuacuuugaccuuuauucaccauuuaguauccuacaugccuccuuggcaaccuuuguguuaaggauuugcaaaucuaacaguaccuugcauaaagcuaagcacauauuauguguucaauaaaauuuuuuuguuuaaaaaaugcgugaaauaacauaaaacaguaguaauucaguuuguauguagugaagauacaauuuuuuuucuuaucucuuuacuaacuuucuucaguuuuuuuuuuuuucagggaaggaaacugaaaaggccaaggaacgauacgacaaagccacaaugaaacuucauauguugcacaaucaguauguauuggcguugaaaggggcacagcuccaucagaaucaguauuaugauaucacacuuccccugcuucuggacuccuuacaaaagaugcaagaagaaaugauaaaagcacuguaagauacauuuucuuuuuaucauaaaaucccuucacaaaaugauuucaacauauuuucucucuaguuuagguguugcuucauaaguuuuauuauuaacccaguccaggggguauuucagaccuugauucuucuugauuuucacuuuucaugucccuucaguuugugcuuauccccuaaaccuucuagcuagcuuccaaaaugguccuucuuuuguauguuuuuguuuuguuuccuuagcuggaaauuuaaaugaaaaaauuauaaguugaaaaguguuaggaagugaauaucugccuccagagaguuggguauuuaaaucuugaacaacugaagaggcucaaggaagagauuuuuugaaaguuuauuugucagcuucuuguuuuuuuuucuguauaagauuaaaaucaacaaauguuuauugaaguuuuacguaugcaaagcacauuaucugaugcuuagggauauagagaugagcagggcacaauucuugccuucuugaucuaacaguauacuuuaauuagugagucaaauggacacauguuuaucacacacacugauacaaaaugacagaaaaaauaagucauccuuugguagacccuauuuccuugcuuaguuguuuuagugccuuccaaaugacuaaauucaauuuucuuucacugaaaauugugucggggaauucuucaauguuagaguugcugugaacuaugaguaggguugaagaaugguguaguaauggaagagcauuagaaaagaaguaaaugguuaucucucagguggaguuaaaauucaaaaaaaguagugaaguaugagaaaaggaacuuggaccaguuuaaugcagguucuugcauuguacuuaauuuaucuguaauuacauaaauuagcacauaagcucuuagguuuagcauauuuugaaauguagugguaaauugauaugaaaaauuauuaugagcauuuuucagguuauggugcaagaggaagccugaauauuacaucaauuaacccauuuaagccagagguugcaaauuuuuuugugugaacauuuuuuuuugugcauaaaaucagaccuuagcgauaaccuugagcaguaggauaugaauaacucccauaaguuuaguguuccaauaauggaacacuagucauaaauggguuaauaaaugccaaaguaacuguuaaagguaaaaugauaauuucuaaaacaaaacauuucauuuauagacuacauugcaguuugcaaagcacuuucaugugcauuugcuuacuuguuccuuacaguauccuguagaguuaggaaguacagguuauauccaggguauaucuaugacagacaagugagaauggacccagauucacaaagcuaagagguggcacaucuggaacuugaagcuugagucuucugacuaacccugcacucuccgugagaggaauguagugauuugaagaauguacccucaaaauucuuguguacccagaaucucagaaugugaacuuauuuggaaauagggucuuugcagauguaauuagucaaggaucucaaguugaaaucauucuggauuuagaguaggcccuaaauccaauggcuggagucuuuauaagaagacgggaggaaggacagagagagacacagagaaggccuugugaagacagaggcagagauugacaucguuuucuuugaagggcucccccgugccaugacagauuuaguauaacuagcuaucauuguguuauauuauucuguuuuacauacaaauauuucagauuagggauaauauuucuugggcuauugacuuccacagccucugaaauuagaagcgcaaauuugucuuugcugccuuccagacucugcuugacugacuuuuacuucucuuuaugugaaaauaaagauaauuugauaguauauacuuguguguagguaagacuaaauuuuaggugauccuccauauucacauaagaagauaaaguguuuuuaguuaauuugaauauguaaacuuuuuaguguugauaaaauagugaaaugucuaguuaaauauuugauucauagauuuacuuaucucuaaaguacuauugauuuagaaauauuuccuuuccuacuuucauuuauuaauagacauauuuaaacuguucacaugauuuucaauaauaguaucuucaucaucacuggaauauuuuuuugagacauauaaugguuucucaugguauguuaucuguacuuuguguaauacauuauuuuagauuuagaauuuuaaaaauccaagcaugauuauaucaccacagaugaaucucauggaacaaauacccauucauauaauauuaggagauguuuuucauuuuuccuccccauuuguauuaaagguaaauguuaaugaucuccacauuacaccuauuuacuguauugcuuuaaaagaguuauuuagauaggcucauuuacauuagcaacauucaguacuuuuacuuaugagauuauaaucccagagauacugacuaaaucuguauuaaauuuuucugccuccccuuuucuuuaaauugugucugccaguugauuucucuaauuauuugaaacuagcauugccugaaacaauuuaaaucucaguuuuuuuacccaaaugauauuuuccuauuuaaaauaaaguaauugagagaauacuucacaauaagggagcuuuuguacauauuaguuuuuuauaaguaaugaugguggaaaagaaaaaccaugcuuuguauuuauuucagcauaugcaggauaaccuugucugucuacacuugcuguugacagugaccuauggcauauuuuuacaguauagcauuuuuaaguaggaagcuggucucugcgacagaauaguuuuuucccuuuugcauuuauuagaccaggcuaauaauuuugaugacauuuuugcuacugauuggaggucaagagaagaaauuuagaugucauucaagguauagaaccaguucaacuaaguauacaaaaaagagcagaggcccagaggagcagggaagaaccagucagguagagcaugugaggaaguaacagacacuggaaaggaacauuaaagagucaggaguugaucagaguuccauguuauucaacccaaaauuuauacgagaauauuuagacauagaaaguuaucaacucuggcccugcauuuuggacauaucaaauacauuuuugaaaagguaaugccauauucuauaucauuuguaauuauuguauuauaacaaauauaaauugcuaaucuguacauuuauauaaucccucuucuuuacucuccagguaugaaauaaggugguacaggaaacaaccaucuguacauuucaacauuacauuucuuaugcuuauuguucugaauccuuuuugagauaguaucucucuugauaaaacuuuaaaaugcugcaaaauuuuauuuuuguuuucagcaaagguauauuugaugaauacagccagauaaccagucuugucacagaggaaauagugaauguccauaaagagauucaaaugucgguugaacagauagauccuaguacagaauacaauaauuucauagauguucacagguaugacauguuuauuccucuuuaaggauuuaugacaguauuauuuuucauucauacaauaguuaaccacagauaaaaauaagaaauacuuaagaucuuauuaagacauagaauauuucauauuaauuuaucugcuuuuaauuuuaaaaguucuuugucaaugaugauaacuauauaauguauaguuuuugauauguaaaaauuuguuaguuguuaauccauauuuaauccaugcuuaaauccauauuuaauccaugaaauuuuuuuuuuaugcuuauauaauaaaaccaugacuuuauauguauauuacacuuuaugaugcgccaaauacuuuuccauggcaucuuauuuuauacuuaauacaauugugacaggaauaaagcagguuaaugccugaauucuacagauaaggaaucuaagucucaaguuacacaauuuugaaacccaggauuuaguuugauuuauacuauuuguguuuucuuuguuaacauaauuuuggauaaaaacaaauauucugccuuuaguguauaugaagauauauuaugauacuguauuuacaaugaucaaaauuauuugccaugcuuuacuagaacaacggcugcuaaagaacaagaaauagaguuugauacuuccuuacuggaagaaaaugaaaaucuucaggcaaaugagaucauguggaauaacuuaacagcagaaaguuugcaaguaauguaaguauucacaaaauaucaacaguuuaaauacuaguauuauuauugcuuuauuguuguacucagauuuaaaauaucaauuauuuuuacaaguauugaacaguaaauuuuuggggucagagugacauguuuugagaaauauguuaauuuuacucauuuucgucacuacuuuugguaauuccgaauaucaaaguucugugugauguuacauucauuugcccaauuguugcuaguauuugacauuggaauaaugcuuuaugcuuuucaaaauuuauauauauauuaaaaucucauuucauccucacaauuuauuggaagaaccauuuuggaaauuagguuguuuacuguuagagauaagagacuuauugaugucagagcacuuaguacaaaaaauugacuuuuaauugaauuauuuucucuugaagcagggaugucuucuguuauaggcuguuaaaucaguuccuucuucacuuuguuguuuuuguuguguaaaauauuaaaggaauuuugagaaaucacaauguguuuuuaguucuuuucaaacauuaaaagcaauuaguaguauauuuuugaauuuagaaaacauaaggugcucuacuucuaaauauuuaaccuaucucuugauuuugugugggagcaacacaaggaaauauauuuauuaacaaacauugcauguauuuuuuauuuaugccagaaccacagcuauaaaugauuaugcacucauugcuccucaauguuagacauguuauaucauaucaccuguuggaaauuuaccucaaaugacucagccaaauguccccaccuaauauaauuaaacaaucuucuuucuauuguucaguaacaugguggugguacggguaauuagcuaagguaggaaaugcagacuggcucuuggaaagagguuuggaaucuuuuuuuuuguuuuuuuaauuuuauuucauuuuaauuuugagaugaggucucacuuuguggcccaggcuggagugcaguggugcgaucucggcucacugcaaccucugccucgcaguucaaaugauucucaugccucagccuccugaguagcuggauuacaggcaugugccaccaugccuggcuaauuuuuguguuuuuuuuguagagaugggguuuugcccugcuggccaggcugaucucaaauuccugacuucaagugauucacccaccucggccugccagagugcugggauuacaggcgugagccacugugcccagccagguuuuggaaucuuuaaagcuggcuagauaggauugaagaaacuaacaaauauuuguccgcaaaucauguguacaagaugaaggcuuaguaauuauggcauacugacuacuggugagagcaauggaggcaugagaguacacugcauuacagaguuuuuccuagcagccuuauugggauuuuugaagcuguuccuaaguuuuucaugcccuauacaggggucucacuugacuagguuucugaccauugauauuuacaaugucagccaucucuaaaccaguaguccuugcccugggugauuuuauacuccaggggacauuugacaguaucugaagacauuagccguagaugcugcuaaacguccuacagugcacaggacagccucccaaacaaagaauuaucuggugaaaauaucaguaguguugaggcugagagacucugcuuuaaacaauggaguugaauguauggugcaaaauggauagcagaguuucucaauuccugugcagugagacauuccauuucucaauucacgugcugcuggugaaggaauaugacauagauuacuccuguuucuuuuuauuauaauauugcucccaaauaacuuacuaauuuauucaucugauauauuuacuguauaucuaagguuguaaggguuaaugccuucaaggacuuuacacugaaauugauuaauauguuuuaauaaacaccagaaagagugaguauauagauuuuggaauauagugugguaaaauuaaaaauagcuaccuguuauaagcuuauguaaaaucagagauuuugugaccaaagaagaauuuguuuuauagcuuucuaggguauaaugagaccaaaauuagguaugcucauaaaucauuguuucuuaauuauagugaugaagcaguaaacaaaaaugcaauaaauugaagguaauaaaucuuugauaaugugguagaaguuuuaauugcucacauuuuacugagauaaacuuuaguuacauuucauuuaacagugucuguauucaggauaugaguuuaagauuagggguuucuucaagaauuuuauucccagagaguuauucagcaucucuguuggcacuuucaaauaaguauaagguaauuccauuaaaacuguauguauuuuuuuaauguaauauaagacuuagaaaaaucuuucuuccuuuuuuuuuuuaacuuaguagugcuuuaaaguuaaacaucuuuucuuuccugaaggcauuaauauuguuaauuuagucguagauucguguuguaauauuauucuaauagaagugaaagaaacaaaugaacaguuaguuccuggaaaaagaaauacaaauuaccaauaguacuuggaaaagauauucuucuuuggcaauuaaauauaaauuaaaaagaaauaggcuauuuaacuuaccagauuagaaaacauuaaauaauuggauaauacccaguguuguauaaaguacagauauauaagcccucuuauaaaauguugcuacauauguaaguugguguauaauuuggcaaauuauauuugugaaacuggacagauaacuuauccccucuguuauggaaaucuaacacuaugacauguaccugauaaaguuaucaccuuuaccuaucugaauauguaccacgaagcauuuuaucguaaucucauuauuuaucuaucagccauauuuaucaaggucuaaauacauaggagaguuaaacucaauuauuuguaggauuaucuccuauuuauaggaaaauuuuuuggaugguaucuuaccauguggucaaaggcuauuucucagcuucagguaacuucuaguacuggacaccugaagcugugcacuucccaucacacaugcauuuaugcuacauuauuuucgggcuuaaaucugagguuacuuucuuuguaucuauuauauauaauauaauuucucuccuucccuaccaacaccuaucucccaucugccucuuuuuuugcaucuaccuucuuugccaaaugcugaaagcguuuuugugcuuaauuuauuuuuaaucaucuauuuauuaaaauuauauaugcaaauauuucaucucaucuaguuacuauuuaauugaauaauuugggacucaguaauuuuaguuuuucaaauuaguugaaaaaguaaaguccauacaauuuugaacauuagaagaauauauuuaagugucuguuucgugcuuuuugucauuauggacagaugagucaucuaauggugaccuauugcaaacuuaaauggaguuuugaaucaacacaucaguaggcuaaguaugacaaauuaaagauagcagguuauucuaaaauaauauaagcauuaacuugucugcaaaagaagaaauuuugauuaauuuuaauaaagcaguaaagaauuaagguccuauuuaguuauuuuguugacucuguuuucugauuucaaaugaggucucuuuauuauaagguguuauugccuaucaguaguagauauauuugaauaccaugauuacguaaaauguguagucuuguauucuaaaacaaaaucuagucucaggccuuaugauuucaaguacauuuuuuaaaguuuaaaaucagaacauauuuagcuuuuagaauauaaauaggauaucucaauugaagaaugguaauucuuuauguggaaaagugauugucuuggaucuuguagggcaugagucagcaaacuauagcccaugaggcaaauccagcuaguugcccauuuuuaugcagcccacgaggcuaagaaugcuguuugcauuuuaaaugguuggaaaaaaaucaaaggaagaauuauauuuugugacacacaaaaauuaugugauguuuaaauaucagaguacguaaauaaaguuuuauuggaacacagccaugcucauucacuuaccugcuaucugugggugauuucacacuacaguggcagagccaagcaguugugacagagaccauauguggcacacucauuacuucacacaucugcuuggcacuauacaaaucacagugacacaguuauaacucaacagcauuuugagugccacacauaucaguauacuguggcaucuuauuuuuauuaucaguucaugccuauagugucaaaagaagaagagaaaauagauuucaaauguggcacuuuuaaggcauagcagaauguggauuauuuuguuauugaauuagaugaagaaacauuguguuuauuaugcaauugcaccaugccugcuaagcacugaauauacuuaauuaaaaucuuauggucauggauugcuauugguauuuggcaguacuagucuauguacuguacaaaugugaaagacuuaaaauuuuauuaaauaucugcauuaauaggugaacauuuauaguugauuuugauuauaaacacuaacuuugaacugcagugauaggaaguauuauggccaucaaaaaauuuucauucuucucauuaagagacuugcauuacgauaacaugugcccaguuauuacuguauuuugaauuugccaacaaaauauuugugaaucuuuguuuucucuuuuguuauauaaauaccuauguaccaugcuugauuuugcuucuugguggcaaagucuaaaauauuugcuuucugugcuuuuaucagaaaaugguugcugacuccuguuacagaggaugauaccaauuuaacccauccaacuaucugaaucaaccuuguauuuaauggggugucaaauacuucacuacuccaucucuugcauagagccuugcuuuuaccaaaucuguuuuuggcuguucuuguuuacaguauuagcucaaguuuggucucugguugaacauauacaguauuauaauuugcucaggcuguguuaggggaauacuuuaagagugaguuggaaagauuuggaaaaauguaaaauauugaagucaggugacaugucggaaggaccguuugauuaagggaaacaaaguuguauggaagaaagcagauggauuuguuggauuggagguggauuaaguggguauuaggaggugacuguauuuaacagaaacucguaacuuucacuugguuguagaagccaucuucuguuuacucuugagaaaagcucauaaagauuugugucaugguauagauugucauccauaaaaauccuaugcucuugcaauuauauuuuaagaaagagauggcaagaaauaguuuauguuuucaauuuauauugcaacaauagagaaaaagagaugccagaaaaguuaccucaggcaacuauaaauuccauuuuuuuaauuaacccaaaugucacacuuaaaguuucagcauugcaaauuucauguaagaaaugaaaguuaagaugguuugucaagucauaauuuuuuuuggaaguuggaaguuugaucccuuuaagaguguuguaagauuuagaucgugacauccaaugauuaugauaugaaaaguguuggauaaguauuggaaacuuuuuauuauccauaguaaagguuuuaagacuuuguaucuuuuuuuuuuagacugagucuugcucuguugcccaggcuggagugcaguggcgcaaucucugcucacugcagccucugccucccacuuucaagugauuuaccugccucagcuuuccaaguaauuggaacuacgggugugcaccaccauacuuggcuaauuuuuuguauuuuuauuagagaugggguuucaccauguuggccaggcuggucucgaacuccugaccucaacugaucuacccgccgcagccucccaaagugcugcgauuacauucgggagccaacaugcugggcuuccuuuguaucguuuaauacaauuaaaucuuuaaaaauuaucuaacuaaagcaugcagaugauaaaaucuauaaaaucuuacaaaaagguauacaauaaaaauuaacauuuuccuuucuucuuuucgucgaccaccaucacuaccuucuagguuuaacucaugaagaaaguguauguauuuuuccagaauguauauacaauguauauacaugugugugaauuguuuucuucuguguaaguaggaauuauuuuaugcauauuccuuagcaucaucuucuuuuuuuuaacauguauuaaaucuucuuaauguguacaguguuuuacuacuuguauguaauguaauuucuuuaguuuuguuauuuauugaugggcauuuagguuauuuccaguuuuuuccauugauggaguuggugcuagguuuugugggacucuaagcuuauaaaauuggaguguggggaacaucuuuaagaaaaucuauacaaacuuacaaauacaaaauuaaguagagagucuuggaagggaucaugcaagugaggcaccugagaacuaagcaucauuagcaucaugauacauuuacuuuuguuuauugugauuauacaauaaacauucuuguauuuacaucuuuguacacuuuugaagcauauauaugggauaaauucuaggauguguaauuacuaagacaggauauuaguuguuaaggguguggauucaggauuuaagcugcuugggcucuauuaucagcuuuucccacuuaccggcucugugacgguggacaagagcuuuaaccucucugcuucaguucuucauauguaaauggggauuauaaggguguuauaagaauuauauaaauuuaagugcuuauuuauaaagugcuuaaaacuaugcuuggcacucaaauguuaaguauuaugucauuuugugauuuuuuuccagguagggucauuuuaugacuuuuaacugcuuugccuuauaauauuauaauauuuaauuuaaaaauauaaagaauaagccauuugaacuguuacuauuuuuuaugcuauuuuauuuuauuuaaguuccagauacaugugcaguacaugcagguuuguuauauauaacgugugccauggugguuugcugcaccuauagacccaucacuggguauugucucgcaugcauuaacuauauauccuaaugcugucccucacccugccggcccuccccucagaggccccaguguguguuauuccccucccuguaucuguguguucucauuugaacuguuacuauuauauuuguauacgaaacauguaauaacaugauggugaauauuguacuuugaaauuuaugaacuauucuuacauuuguuaugucaucuauacaugaacuguaauuacucaaauguuuuucucuucacuuaauucacacauuacagguuuuuuuuuauuuuuaaggggauaaugguaagaaagaguaaauacuuucaccauauguauuuuuuuuagauuaaaaaaaaauauauauauauauauauauauauuugaggcaaagucucacucuguugccuaggcuggagugcaguggcacgaucuugggucacuguaaccuccgccucucagguuaaagugauucuccugccucagccgccugaguagcugggauuacaggugccugccaccacacccagcuaauuuuuguauuuuuaguagagacgagguuucaccauguuggccaggcuggucucaaacuccugaccucaaaugauccacccgcccucaaccucccaaagugcugggauuacagaugugagccacugcuccuggccucccuguauaauuuuauucuucuaaauucauuugucuuuucuucuuugaugucugucuaguagaauguaaguuuccugaaggcaaacuuguuuauuauuguaucccuacugucuagcagacugucugacacaaggaauguguuuaauaaacacuuguuuaaaugaaugauugaaguuuugagaagagagaugaauggaaaauuaaccaggaagagaaugagaauaagggaaaugugcagggaagagcagcaaaggauagaacagaagaaagugauaaggagaggaaaggcuuuuuauuaaauucagcuuugauguagcauggucaaggcagugauaagaagcugguuguuuuuucuguuuccaccagacuugggugucagaaagugguugggacagauucugagguagggcucuguguucuaaacuuucauuugaauuaaaugagauuauauauaaggcacaguuggaacagcaaagcauuauguguuauuuacuuauuuauuuauuuauaauuauuuaauaaggaaguuggagccagugguugaaauguagcuuucuugacaaugaucuugaaucuuaauauaguaauguuuucuuuaucugauagucagaauaugaacuauuccaugcaagccaauucucucaauaacugaagcuuguaucuccaugauauucaaaaacauaauuuuacuggauuugauacaaaugucuuaugaauauauauauaugauuaaagaaaaauguucaaucugaccuuucccugaugacucucgaucauuauuauaaguauuauugcuuuauuuugcuuuaauaucaaaugccgucagagacuuacugaaauuuaugacguuguuucacucuaaauaaaaaugaaauaauauuuauugcuguauuuagcauucuucugaauauguauaauaguuuuucugccucucuuauuucuauuaccuauuauuuaaugauucuaaaaaaaucuauuccuguuauaagagauucaaacaaugauauauauggaguaaacuaugaaagacuucuuuggacuuaaaucacucccuaguccaaucgcacaccucucagaguauugauaaaacuuugguuuauagucaucuguuucuuauccugugcacucacauauaaacacauaccacauaaauauauuguauuagucuguuuggacuguauuagucuguuuucacgaugcugauaaagacuuuugagccugggaagacaaagaaguuuaauggacuuacaguuccccauagcuugggaggccucacaaucaugguagaaggcaaggaggagcaagucacguuuuacacggauggcagcaggcaaagagaguuugugcaggggaacucuucauuuuaaaaccaucagauuucaugagacuuacucacuauugugaaaagagcgugagaaagaccugcccccaugauucaguuaccucccacugggucccucucacaacacguggaaauugugggaguuacaauucgagaugagauuugggugaggacacagccaaaccauaucagacugucauacaaauuaccauaggcuggauggcugaaacaacagaaaugauuucucauagauauggaggcugggaagcccaagaucaagaugucaacugauuuggguuacuuaugaggucucuuuuccugacuuguagauagguaauucuugcuguguccucagaugacccuuucuuugcauacaugaggagagggagaggagagguaguggguucugugcugcuucuucuuauaagggcucugaucccaucaugagggccccaccuucaugacuucaucuaauucuaauuaccuccuagaggcuccaucuccagauaccauuauauuggggguuagggccccaacagaugaauuuuggggucacaauucaguucauggaacauaugcauguauauguauuuuaauauaauuagaacaaugcuauauguauucugcuacauuuugccuuuuaauuuaaaauuguaucuuagaaaaaccuuauauauguguaccuaauucuguuuuagugacuguaugcuauacuagggcauuuaaauauuuuguaguuuuuugcuuuauaaucaauauugcaacaaauauuuuuguauggacagacuuugugcauauuguacaaguguuuugguaagacacauuuuuagauggucagauaauuuucuaauuuaaaauuugagagacaguuccaagaugaccccugaaaaaucugugccaauuuuuucacaucagugauguauaauuguuuccauuaaaaaaaaauaauauugcuauuacuggauauuccaaguauuuuucaugcuugucaauuuuaguaggugaaaaauaacuuauuauauagucagucuaguuauaauaaugucauaugcuuauugaucauuuaauuuuuucauggugaacuuccguuguguuaagcauaugaacuucauaugcuuauugaucauuuaauuuuuucauggugaacuuccauuguguuuuuuguccauuuucauauuaguuugucuuuuuucuaagaguuuuucugcacgaaaagggcucuuucugguaauuugcgcugcagguauuucuucagguuugcuuuugacuuuaugaucucuuuaaguucaaauaaauuuucauuuuuauagaguuagauuauuuaauauuuucuuuuuugucuuuuggguuucaugucuugcuuugaaaagcugaagauaaaaauuuuaaagugauaugauagccauguauguuuuugugguagaaauacuuccguuaaggacucaaugcauuuuauacaaacauaaauuaucugguuugugagcgcauauuaauuuauguauuaaauugucuucaauucuauacagaaaauacuccuaaaguauuacuacaauaugugaaaauagaaauagcuuaccaugaauuuaaaaugacaaauaacugagccucacuuucauuucuuuaaaauaauacuauauaucucauaagauuguugugaagaguaaaugagauaacaucugcaaauaauacuacuuaccauuuacucaaugucuaccaaaguuguucucuucucuuuucuuuaccuacuucucuuuuucuuuuuggugaauaagacucuagaccaguauugcccgaguacuuacugugauuauugaaauauucuuuuuuccaccauccaguaagguagccaguagcuacauuucuguuuagcaccugaaaugugucuaaugcaaccaaagagcugaaauuuuauuuuaguuugaaucagauuauauguggcuacuguuuuggacauugcaacauaagauguaugaauacuuuuuugauauguauaaagugaaaauuaauuuguugguuguuauugaggauacuguuuauucuagguugaaaacguuagcggaagaacuuaugcaaacacagcagaugcuuuuaaacaaggaggaggcuguuuuggaguuagagaagagaauugaagaaucuucugaaacuugugagaagaagucugagugaguaaaagagaaacaauuugaaggaagaauguuuaauuguaauuuuacaaaaauauuuuaguuacauggcagugugaaccuaacauuucuagaaacagaaacuuuuauuuuaaguaugaaguuuuguauaguuaauuucuaggauucuggaaaaaugauucugugguuuuaaaaaauauaguguccuugggaaaaaugauuauguauuuuuguaaauauagcauucugaucauaugucucaauguuuuaacaguuugaacuaucuuucaaaaauucauuguuaaaagcugucuuuacuuuccuacauccauuuucaccagacccauugugaauuccccuguuaagaaaguggcagaccaauauuaccuauaaauagucucuacucuguuaaauggaagcagacugaugagaaaacagauaaaaaucacucagugauuagcugugcuauuuugucuugcugauuucuggauuugcaaauaucuuccuagguccacagacuuuacuuguguugguauacucuucuuuuacugacuucauuaugcuuucuacugcuuaagaauuuaaaauuuaaucuaaacuucaaguuucuaaucugcuuuuauuaauugcaucuacaagagugggugcuggugugguuuuucuaauccugacuagaccucacauauuucuugcuauuauacucucacauauucuuugauuuaucaagacucucaaggaauuugugauauauagaauuucuccaguuuauaccugcuauuucugcacaacuuuucauauauccuccacuuauuucagaucucugauuacuuaucucccucaucauagugagcagauggacauccacaucccagaaauaaauuagaaacauuggaugacauuuuucuucuuuucugagauuagaguuccaaacccacccaaauuuguacucaacaucuuuccuuacuucaauagaggaacaguucuuuguccuaaguucauuucuuaugccugguuuuuuuuuuguuuguuuguuuguuuuuguauuuucucgucucuacuuucucagauuuuacauaauuuauguauuauguucaccuuuccuucccaacuggguccuugugcucacuuuuaaaauauacuuaagucuugacuccgaaaaacaaucuccaccucccuacccaccccaaauaauccuuuuuaaaucuccauauuuuuucccacguacuaucuuugcuuucuguuuucuuaguucgaacuuguuccaagagugauuaugcucacucauuuccucaauucccacuuaguuuucaaagucuggcuuuuugcccuaucgcuauggaaauggguagcucuaagaucacaaugaugucuacauugcuagcuaaauuuagaaacuaucuuacuugaccucuuaauaguaucugaauuuacugacuucauuuauuuucuuuucccuuggccuuuggaacucaaaaugccagaucuuaauccucucuuucuggccacuccuuugcaaacccauucucuuccgcucagccaauccauuuuagaguuagggaaggcacggcccuaggcugucucacuccuuucccugaacuuuuucccuaagugaucuggugaagaugagccauuuauuacucucucucagauuuauuuucugaacuccguggccauguaaccaauugccuacuugacaugccuuuuugaaugucuuagaaguauccuaaauucccaaugucuaaaggcugaauuaaaaaucuccauacaacccaaccaaacucaaccuaaccugguucacucuuaguauucuuuauuucagugaauggcaacaucauccauucuauuauaccacaucaaauuuuagagggcuacuuuucucauuuauacuauagcuguuauuacaacuugguguuaaauuuuugucugggucuguuuggucugcuauaacaaugugccauagacuaggugacuuaauaaagagcagacuuuauuucucacaguucuggaggcuguaagucugaaaucagggugccagcaugauuggguucuugugaggacucuuuuccagacugcagacugcugucuucucauuguauccucacauggcagaaagaggguaagagcuccccgggaucucuuuuauaauggcacuaaucccauugauaagggcucuaccuucaugacuuaauuaccuuccaaaggcccccaccuccuaauaccauuguauuaggaguuuucaacaucugaauuuuggcagcauacaaacauucaguccauugcaacauuaaaugggaaucgaugagcccuguaaaggcgagaacaggaaaauuugaguuacucugaucauuccuuuacuaaaucugcaaauuuuuaguauugcauuaacagaagauuuuauuugaaugguaaaauaaaacaucacccauugcacauauaaaauuaaacaaaagaauuaucuuuugcuuuucuguguuuguggaugaaucucuucacauguuuauagaugaccaagugguucuacuuuuuauaauuuugcaaaaggacacauuauaaugacuccuauuuuaaaauuuaguggauauaaagaaagaaaauugaaagugcuaaccauuucaccagaaugucuggcuauaaguuguuggaggagaugaucuuuaagggcucccuaaucuagaaguuaugagauuauuugaauuuuugcauguuuucuugacaaaucuuugccucucuuuuuaucuacauaauggguguauaauccauguuccucuaccuguuuauauuuaucaggauaugagaauggauauaagagaggagccuugaaggguaguggauauauggaaaguaacauuucuugaguuuuuacuuugugucacauauuaugcuggguauuuauauauauauauuauaacauauaaacauauauauuauauauaacauacauaaacauauauguaacauacauaaauguacauauauauauauguuaacucauugaauguuaucuuucugugccuuuuguauaguagccuguguuuuaccuucaggucuuugagacuuuacauaacuuacuuacaaucacauacauaguaaaugguagaaaagacaugaguuguugacuccauagcuucugucuuuuugaucauauuauuugcuugaucuuaugauuuuaacagcauucuuuagagaauaaguuagcagggguaaguaugccaagcuuuucaggggaugagaccuguuuaacccaacucuuguuaaccuuuguuaccauggaguuauuauuguuagagucaagguauaaucuugaaaauguuaaguauauuuauaugacuaaagaguuacugcuaaauuucauuaaaugcagacauugguaggguuaaguuugccuuugaauuauauguuaacauauuuugcuaaacacauagucugaaagggauuccagggcaaauguuugcauuuuaauuucuuaauauuucuugaauauuuccuuuuauuguguacauguguauauaacuacacauguauguuuaaauaugcauauauaauuaaaaucaauuuuuaucugguuuuaauaauaaacuuacauuaucuuuacuucucaacacuuuguuaguuucauguacuguguuacuugugagacuacauuucuuccuaaaugucaaaaauagucuauguuagauauuugcauucuuaaauuauuuuuaaauuaauggaauuauauugaauguuuacuuaauagaaauaacaguauuuguuguaucaaaauaugagacuaaaaccacauuuuuauaauuugaauuuaauauauccaugucucuaaaauaucuaaugacagugaaaaaauaaauuauaugauaaaucauuugauggcuuugauuccuauaauugaauaauaugaagagaaaaauaaacuucaagaauggcuuuuaugugauuuuaaauugacacauuagcaaaaacagaguucaagcuuauauaaguaaugcaggucuuaguugaaauguagcuaucgcagaauuuuauuuaaaaaauauagaaugaaagaaauaaaaccaaccauuugaaauuuuuauaaaaaaauuuuaauguauuaaauacacuaaauaugcuaaauuaaauacauuuaauguacuucgugcauuuaguguauuuaauaugcuaaaauuuuguauuguauaacauacacuaaauauacuuuaauccaacacagaauaucagucuaguauauauaccuucacucauuacuucuaaagucucuuuauucaaauggaaauaauaccaaucuuuuccugauuugugguccuugacuuuuguauuagaaaaaaguuaugggaaaaaauaccaagcauaugucauuuaugacuugguggcauaaagagcuagugauguuacuguugguuugaaugcuugguuugauuuacaaaaaguaaaugauuauuuaauuuuguauugucuuaaccuguuuuauaucauuaucacuuaguauuuaaaaauaccuuauguauuauaaaaugauagagccaugcagaaucuuaagagaucauuugauuuagccucacugccuuucaaauaaugugacaucugagguccagaaauuuugagagacuugcaaaaugucacaucuagcuucugguaaagcuaagacuuaauaaucuagaauaguguucuaguuuugaaauucaggaaccuuacauuuuuuuccuuuggcucagaguuuuagaauuaugugauuuaaaaaaaaugugcuauguaaauagggaauucauucaacaauguugauugugcaucuaccagaugcugugauugcagugagagguaagacacguauggucacguggcucaugaaacuuacacuuuuguggaggaaaccaacacaaaauuaaaauaauuaccaguuauuaucauugcugugaaauaaggguucagauagaagaauaacagaggaacagcuacuuaagaaguacggucagaggucuccuaggagauaggcagaagauaaccugcaugugaagaaugcauggaaagaguguucagacauaggaaauagcacaugcaaggguucuggaagcuuccacguuuuaaauuuauuuauggccuccuaugcaucauguacuaaauaaucauacauuuacuauaauuucuacuuacugaaguauguauugcuuguuugcucaaugguauuauaaacauaauuguauaguauuuuacauagugagaccagcaauacauuuuuuucaauaauuauugaacaaaaggaacauguucauauaugagagauuaugucauagauaaaggcugaaaugggauuaauuggaagaaaugaauuuuucuaauugauuucaugaucagacauguugauuuuaaaauguuaggacuagagacauacacccccugcaagucucauuauccuuaaaaaccacuaaaaaucaaaaccaggaaauuuacguuuuaaucuuauucuugguauuaagauagugucucugaguaucuaauugauugccagcaugguacaauacaguagaaacuuucaaguccugaaggggaauaaaaaagaccuuccuccaaaacagauuauuuggguaggcgcccaagacauaugagaagauaaaaaccugaacucaguuaguguaaccacuauggagaacaguuuggagguaccugaaaaaacuaaaaauagagcuaccaugccauccagcaaucucacugcuagguauauacucaaaagaagggaagucagugucuccaagagauauuuacacucccauguuuauugcagcacuauucacaauagucaagaguccgaagcaaccuacguguccaucaacagacaaaggaaauguaccuauacacaauggacuacuauucagccauuaaaaaaagaaugagauccugucauuuucaacauggauggcacuggaggucauuauguuaagugaaauaagccaggcacagaaagacaaacuuugcauguucuugcuuauuuguaggagcuaaaaauuaaaacauuugaacuccuggagauagagaguagaaggaugguuaucagaggcugggaaggguagugggaagugcugggcaaaugaaugagaccugauauuugauagcacaacaggguaacuguagucaauaauaauuuaauuguacauuuuaaaauaacuaaaagaguauaauaggauaguuuauaacacaaaggauaaaugcuugaggugauggauaccccguuuaccgugaugugaguauaacacaucacaugcuuuuaucaaaauaucucauguacuucauaaauauauauaccuauuauguacccacaaaaauaaaaaaugaaaaaauuccucaccucaccagaggaagcgugauguagcagcggugauacauauuuuuaaauuaauuuuuuuauuuugagaucauuauggauugacauuuaguuguuagaaauaauacagagagaucccguguacccuauacucaguuucccucaaugguagcaucuuguaaaaccauaaaauaauaucacaacccagauacugacauuaugcaguuaagauacagaacauuuccaucacuacaaggaucucucauguuguacuuuuagccacacuuccuucaguccaucuaccuccuuaguaaccccuagaaaccauuaguguguuuuuucaagaaugugauauaaauggagucauguuguauguaaccuuuuggcauuggcuuuuuauucagcauaauucuucagaaauucauccagcuacuuucauuccuuuuuacuguugaguagugcaguguuccaugguauguguaucaguuucuuagggcugcuguaauaaaauacugcacaguggguagcuuaaagcaacauaauuuuauuuauuaaauuuauucucaguucuggagggugaaaguauguaaugagguguuggcaguguugguuccuucugagaacuccaaaggagaaucuguuucaugccugucuccuagcuucuggugauggcugacaauccuugacauuucuugguuuguagaagcuuuacucuagucucugccucugucuccauaugacccucugccugugugucucuucucuguauccaaauuuuccucuucuuauaagggcaacagucuuuuccauuaauggccuauccuacuccuguauaaucucaucuuaacuacaucugaaacaacccuguuuccaaauaaggucacauucugagauuucaggcauuaggacuugagcauaucuuccugggggauacaauucaaccccuaacaguauggauauaccacaauuugucuaaucauucacccuuugaaggauguuugguuuguuucuaguuuggagcuaguacaaauaaaggucuccaaacauuuauguauagguuuuuaugugaacauaaguuacaauuuuucuggaguaacugccuaggaucacaguugcuaauuguaugguaauuguauguuuaguuuaguuuuguacuauuacacauuuccaucagcaaugugugagugauccaguuuuuucucauccuugccagcauuugguggugucacuuuuucacuaugcuauauuugagccauucuaaaagauguguagugauaucucauuguuguuuuaauaugcauuucccuaaugaaugauguucuggaacaucuuuucaaugugcugguuugucauuuguauauccuguuuucgugaaauaccuguucaacuuuuuugcucauuuucuaauuggauguuugguuguuuuguuuuguuuuguuuuuuaacucugcacucuuuauauauucuagagcuuuauauauucuaguucuuuauauauucuaguucuuugacacauaugucauuuguaaauaguuuucucccagucuguaccuugucuuuuuaucuucucaagagacagggucuuucauagaacaaaauuuuuuaauuuuaaagaaguccauuuuaggcugguccgaagaguggauaacucaauugauuguucacagucaguuauagauugaacuccucguuuuacuccuucucccauucucacuacugcacuugacuagucuuaaaaaaaaaguccauuuuauuucuuuuaagguuugugguuggugcuuugguguuaagucuaagaagucuuugccuaguccuagaucucagagguuuuuuucucuuuuguuuguuuuuuuuuucuuuuuuuuuuauuauacuuuacguuuuaggguacaugugcacaacgugcagguuaguuacauauguauacaugugccaugcuggugugcugaacccaguaacucgucauuuaacauuagguauaucuccaaaugcuaucccucccccuucccccacgcaacaacaggccccggugugugauguuccccuuccuguguccauguguucucauuguucaauucccaccuaugagugagaacaugcgguguuugguuuuuuuguccuugugauaguuugcugagaaugaugguuuccagcuucauccaugucccuacaaaggacaugaacucauccuuuuuuauggcugcauaguauuucaugguguauaugugccacauuuucuuaauccagucuaucauuguuggacauuuggguugguuccaagucuuugcuauugugaauagugccacaauaaacauacgugugcaugugucuuuauagcagcaugauuuauaguccuuuggguauauacccaguaaugggauggcugggucaaaugguauuucuaguucuaggucccugaggaaucgccacacugacuuccacaacaguugaacuaguuuaccgucccaccaacaguguaaaaguguuccuguuucuccacauccucuccagcaccuguuguuuccugacuuuuuaaugauugccauucuaacuggugugagaugguaucucauugugguuuugauuugcauuucucugauggccagugaugaugagcauuuuuuucaugugucuuuuggcugcauaaaugucuucuuuugagaagugucuguucauauccuucacccccuuuuugaugggguuguuuguuuuuuucuuguaaauuuguuugaguucauuguagauucuggauauuagcccuuugucagaugagcagcuugcaaaaauuuucucucuuucuguagguugccuguucacucugaugguaguuucuuuugcugugcagaagcucuuuaguuuaauuagaucccguuugucaauuuuggcuuuuguugccauuucuuuugguguucuagacaugaaguccuugcccaugccuauguccugaaugguaaugccuagguuuucuucuaggguuuuuaugguguuaggucuaacguuuaagucuuuaauccaucuugaauuaauuucuguauaagguguaaggaagggauccaguuucagcuuucuacauauggcuagccaguuuucccagcaccauuuauuaaauagggaauccuuuccccagugcuuguuuuugucagguuugucaaagaucagauaguuguagauaugcggcauuauuucugagggcucuguucuguuccauuggucuacaucucuguuuugguaccaguaccaugcuguuuugguuacuguagccuuguaguauaguuugaagucagguaucgugaugccuccagcuuuguucuuuuggcuuaggauugacuuggcgaugcaggcucuuuuuugguuccauaugaacuuuaaaguaguuuuuuccaauucugugaagaaagucauugguagcuugauggggauggcauugacucuauaaauuacuuugggcaguauggccauuuucacgauauugguucuuccuacccuuguuuuuuuuuucuaaaaguuuaauaguuugagauuuuacauuuacaucuauguuaacucuuuucugcugaggcaguacauucuauuaauccuagaucucaaagguuuucuucuuuauuuuuuuuuucuacaaguauaauaguuugagauuuuacauuuaaaucuacguuaacucuuuucugcagagucaguacauucuaucuuccuagaaguaggaggucuugggauguaguuuuauaaucuggccaaaaugucucucagaagcaggcauaguaaugaggauaccacauggaaacaacaacaauaagaacaaaaacaucccacagacagcauguucagcauucuaggugacaguguccccauaagucuccccccauauuugugugagcggcugaaugacgaacagcaacaagacaaaaggcaacuguguggggcaagcaaaaggaaaggaaaaaaaggccuuauggucauaagagcuugaucuuggaugguucuaagagcauaaaaaucaaugaauagucgucuuuuaaagaaaguguuccuacuuacaguggaggacuccaugaacagauauuuaaauaacacauaaaacugguagggggcuguauuagucuguuuucacacugcuaauaaagacauacccaagacuggguaaauuauaaaggaaagagguuuuuuuuuuuuuuuuuccccugcaucauaaauuuuauuccugaugugggacagauuccuuccaucuccaaaugaaucacaugcugccccugaaagaccuaggaaacucuuccaccaucuccagggaaguagcaacaaaggcaggugcuggggacuggaaggcuuugaaguuuuccauccuacuuuuucucaccuucucaacagaggauagcuguucucuauuauuccucucauccacucaucccuuaaaaaaccccacaaaacgaucauuaguaaacaaacaaacaaaaccucuucaaguauugggcauuagggguucagguugggacuugggggucaccaaugaaagaggaaggggaagaggaggaggagccaucacuguuucugcugcaaggguuccuuccuugcugcauccuguagcaacuguuuguggaccucgucugcuggcaacugcauguaucggaccacugagcccugaaugaagcaguucuucacugauaacaugugaggauauuucucagagucuaugacacugauauuaguuaguuugauguugagauaccgauccacagaauggaggguuccacagaugcucaggucauucuugaguuccacgaccacaugcuugcccucaagggacuugaaaaaauaauagaagagcguggugcugguccugcgggcuggaccagaaagaggacaggggaaaggaaagagguuuaauugacucacaguuccacaugccuggggaggccucacaaucaugguggaaggugcaggggaagcaagacacgucuuacauggcagcaggcaagagagagagcaugugcaggggaucccccuuaugaaaccaccagaucucaugagacucacguacugccgcgagaacagcacagaaaagaccccccaucauguuucaauuaccucccaacaggucccucucaugauacgugggaauuaggggggcuacaauuugagauuugggugaggacacagccaaaucauaucgggcuauucagguucccagugaggauuagagaaaauggauuguuguaguuagagaaucaguuauuagugauuuuuaaaaauuauacaaauguuuuagaaucauuuuggaagaucccauuuauuauccaggguaaaauaaaggugaaauaacaguaaagcauagagauuggaaacaucaugagaagucacuuguuaaaauuaagcuguuucucuaaacuugagaauauauaugacuugaaaucguuuuuucaaaauuuuaacuuuuuauaaugguuuaaucuuuuccuuuuaaaugaacauaaaauggauauguugucuaucaggguuuguauuacuuucaucuugcugcuguagcaaauugccacgaguacaguagcuuaaaacaacacagauuuauucucuuauaguucuggaggucacaagucagaaaucaguuuuacuggccuaaaacuaugguauuccuagggcuaguuucuucuagacacucuaggggagaauuugcuuccuuugccuuuuccaguuuuuagaggcuguccucauuacaucacucuuggucccaaguuacacugccuuuucuuccaccauuuccauugucacaucaccuuuucugacauuguucaucuugccuccuucuuguaaguauucuuaugauuacacuaggcccaccugaauaauacaggauaaucggacaucucaacauccucaauuuaaucauaucugaaaaguuucuuugccacguaagcugacaaacacuacagguucugggcauaaggaugugguuaucuuuugggggacauuauucagcugaccauagguuuaagagaguaaaauguauauuauuuacuuccauaaauaaauguuuuugaauuauauucagauguucaguuaauauuuacuugccuugugccuugucauuucugauuucauuuugcaaaguuuauuuuuauucuuuuaaauuuuuuuuauuuuuccugguagucuuuaugaaauucguuuguguaaaauuacuguaacaauacuacuuuagaguauuauuauuuugaaguauaccucccuguugauuuugcccacauuuuugaaaucauucaccuuuuugugacugauauuccggaaguacaugaaaauauauuuuuccacuuuaccuuguauguuuuaaauuauuucuuauauuguugucauuguuggagucuuuuuuuuuucuugguagcuaggagaugcaaagaggaaacccucuggaagcuuuaaguacauaaugggugcagucuuuuccaggaccugguccuuagaaauuuauguucacaaaagugauucuuuuaaaaaaucaacuuucuuucaagagauuacugagaaaucagaaaugucaauuuauuauuaaaaagaagauacuaacuaauaaauaaaccagcaugaacuuaugaagaagucuguggauuuagaacacagaucacagacuguugaaugauaaugauguaaaugcugauuaccauuuauugaauuccacuggagaggucugucuucuggauauuacuaggucucucacaaauguucuuacucauuaguuuuacuuuucuuagacuuuuuucucuacuguuuguuaggacacucaccugaaacuuguuacaauaaggagauuacagcuuucuuuauagcagucacugagguugcacugugcucaauuaaguuugaauuuaguuuucaaaauauccaucagcaucauauauauaaauaaaucucucuuaguguggguuacuuuugucugugaauauuuauucaguuuauguugagacuuauaguuuaaauuuaagaagauaguauuuucugaccuuauuuuccaauuuugacauuuugucuaauuuauaaucuauugucucuuacauauuaauaacuuacuuucagcagugcauggcacgguccuuuuuggaaauuauuguaauauauagugugggcuauuuccagaaguaucuaccaccacuaccuguuuacacguggcuucaaugugggugaauuaguuugaaauucccauugaaggcagccuccaaggguuaaaaagucacaguaagacaaccuguggcccuguacuuuaaaggagggaugggaaaguauacuguauuuauauuggagacguuggaaagauuuggagaccuuuguuuuacucauuccuccaguuacaucuuagcccuuaguccuugucauaguaguuucacuugccgccagacacacaucccucacaacauauacacaagcuuuguguccagacugucaccuugauuuuauuuauuuuacccuaggcacagaucugacccuagcuauauugccuuugauacuuaaaguaaauuuaagauccugcuucuguuauuuuaauucauucuaggcccuauaccucuggaccuaagugucuacucugugagguauauaguuuagcuaaaauaaaaugaaugccauagaucauaauauauuugaaagcaucuugaauuuggauuugacuccaaacacuucauuauauuuuguuaaugcuagcauguaauaaauacugugauaacuuaaaaucugcuuaguuucauauuuuuuaugauucuaaagggcucuuauaaaaaugaaaucaaagaaaagcauaauuuacauauaugagguuuccuuaaugucuucuuaaugaaguugaaaucauuuauauuuauucucuuuuaguauugugcuucugcuaagccaaaaacaggcacuugaagaacugaaacagucaguccagcagcugagaugcacugaagcaaaguuuucagcacagaaggaauuacuagagcaaaaagugcaagaaaaugaugggaaagagccaccuccaguaguaaauuaugaagaagaugcacgaucaguuacaucuaugguaagcuaaagaauaauccaaugagaaacuuggaagaguagugucuagguaauaagugcauacaaaaauuauuuaaauuugcuauaacaaauuguuacucuuguuaauaugcagguccuauuaaacuuguuuguaaaugcaaaauagacuugucagucaccucaggucaccuggagagcacuuucaggaaccaccuguagagucagaggaaaaaguucuucucuugccuucaaaacugaaaggaaagacugcaguuguuuuuauuccugggagacagcaggaagguagggucuuauucuuaagagagaaguaagcaauaagaagaaagcuauuuauugauuuuuuucuucuuaaguagaaucuuauuuaucugagauugcugguguauuuauugcuuuuaaaauacaaaauauugauuuaguuuaagaauuuuuuuucugcucauaaaugugacccuuagacuacaauaaauacauucaaauucaccaacuugaaauucaacuuuauuucauaguuuuauuaacuguuuaagaaugccuaguauaaagucuuucuucuucucuccuuuccuuuccacuccucuccuuucuucucuucuuugcuccccucucuccucuuccuuucuguccucuccuuuccuuuccuuccucuuucucucuccuuucuccuucuuccuuccuuucccucccuuccccuccccuuccucccuucccuucccuucccucccuuccccuccccuccccucccuuccccuccccuuuccuuccuuccuuccuuccuuucuuuuucuuuuucuuuccuuucucucuuccucuuucuuuucucucucuuccucuuucuuucuuuaucuuuccuuuuucuauuaucuaccuauugaucuaucuaucuauguauguuggugguucucacccccugccacacacauaccugggacauuugguaguaucaccagacacugugauugucauaaccagaucuaguggguagagauuggugaugcugguaaaccucuuagaaugcacagaacagccccucccuucacacucccagcacaaaauuauccaggcuaaaaugucaaaagugccaagguuaaaaaagucugagcuacauccuuggcauuuccuguggguaacuuacagaacuauuauaguuaugcuauagcugauauuuuaguacuuuuuacuuuauguuguucuaaauaguaugauuugauuaaguggguucauaugucuccauagcaaaaaaaaaaaaaaaagaccguaucugagaauacgguaaauguaguaaugaauaugaaguauuuaaacaauugugguuauuacuauuacuauuaaauauuaaaauuaaacuauugugguuguuaguaauauugagccauauuaaucuacacaucacuuugugaauugugaauuaugaauccuugcacucuuucacuguccuagcuauaaggaucucagcacauguaccaaggacccuauuaaauucccuuucuugcuucaugauucuugauaaguaucuggcauauguguucuuucaaaggaacuuuugaaauguuuuccuuuuguuuggcuuuggaauaucuuaucuaguaaaucuuuuguucacugagugugguuuauaauauuucccuguuaccaugacguuguggaauugguuauuuaaaggcuuggcugggcgcgguggcucacgccuguaaucccagcaccuugggaggccgagguggguggaucacaaggucaggagaucgagaccauccuggccaacauggugaaacccugucucuacuaaaauacaaaaaaaaaaaaauuagcugggugugguggugugugccuguaaucccagcuacucaggaggcugaggugggagaaucauuugaaccugggagguggagguugcagugagcugagaucgugccacugcacuccagccuggugaaagggcaagacuccaucucaaaaaaaaaaaaaaaaauucugaucaucuggaguuuaauauuucauaaucauugaagaaaaguuuuguuuaacuaaugaauagauaauguuucugagguaguguauaguguaguuuaagagaaugaauugccuuccggcaccuucaaguucugcucucguguccauuaauucaauggugauaauacuuaauauauuuuuacaagauggugcugcauauuucauuuuaucaaauuuauuuuaaauuguugaaauacuaauuauaaauuagaucuugccuauuugcugaagcaaugcuuuuagucauuaaggauuuuuuuguaaaagaauacuauaauauauguaguuuaaagcaauaaauuaauauuuuacaaauaagacagggcauucuuacaaauuaaugccaguuaaugagauuuuacagcauuuuuucagaacaauuagaaauuuuuacaaugcccaauuccuaaaacuuaagaauacaucuacaugugucagugaaaucuuuguguaauucaguuuuucaauuaauaauuagaauauuacuuuucaguuuacuuggaaacgaaaacaaucaaagcuuuaaaugauuuuguccccaaaugacuguuuaagcauugcuuuaugaauaauguuacaagaaaagccuggaauucacauaagugguucuauugguauuuucucuuuauaaauuccauugcuauaaaugguauacaauuucaauaagagacuuauuugaauauuggaagaauuggaagaacucaaaauuaaacuauuguaucauggaaaauugugaaaauuuguguaaauauuauuugagagcaggagagacaaugaauuaugcuccaugaucuuaguuaauggcaguguuacugaaaauaccgacucuucgguggugaaugcuucuguagaagagugcuuuaaggaacuguaccauugaaaugugccaugcauuggguauucuuauaaagguuccaaaugaucaaauguguaaucaggguugggguuguauagucaaguucuuaguguuugauguuuauuuugucuuagucuugauguuuauuuuagcucuaugagucaaugagaguuaaagcucauuguuacaguuuaaacguuugcucucuccaaaacucauguggaaauuuaauugccauuguaagaguguuaagaggugggaccuuugagaggugauuaggucaggagggcuucauccuuauggauguaauuaaugucuuuauaaaagagggaguuuggcuccccuuuaccucuuugcccaccuccccacccccgccaugugaaaccaaaggauucuuuuccuuuggaggaugcagucuucagugguccaucuuggaauuggagauugggcucuuuucagaugccaggucugcuagcaccuugaucuuggacuuccuggaacugugaaaaaugaauuucuuucuuuuuuuuuuccuucacaacuaugcuaaugaggaaagcugugguuaugcuagauaaguaugaugaauuaaguaagagaggggaagaggagugaagaugcauauaagaaagugauuauaaugauuaaagaauuaaagcuguguaauaaagacagaggccaucaagagaggaauggaguauaaggaaaagugcuuugaggagauagguuguuaaaucaggugauuauggcauaauagguuagauaauagaaucuuaaaauuuuggaauuuccucuagccagugacaguaagcagaaucagaaauaaaagugaagcaucuucaauggcacaccuguaagggaauauaauaaauaauaaucacuuugugucuaccacagaaauaaaacccugccauuuuauaaaccuuaauauuauuuaaaaaauaauuuugguagacuggauguaguggcucacaccuguaaugucagcauuuugggaggcugagguggauuuacugccugaguucaggaguuugagaccagccugggcaacauggcaaaaccuugucucuacaaauauauaaaaauuagucgggugugguggcacaugccuguaaugcuaaccacucaggaguuugagguaaaaggauuguuuaagguguguaguuugagacugcaguguuccacgauugugccacugcacuccagccugggugacagagugagagccagucucaaaauaaaauaaaaauaauuuuggucuauuaguagaguaaccuuuaaaaaccauaaaucacaguuuuaccuuauuugcaaagguucacucuacuucucugaacuuaacagaguguuucuaaggcuuaggauaacauuggaaagauuagucuuuucuguuauaccaucaagcuuauagacuaccggagggggaauaaauucauuugaacuuuggcaguacucuauuaaagaggaaaaaaacgggcuauaagaauacacaucuuuagagcauuuagagaugauaucuuugagaccauuauaauuacaaaaggagaaguacaaugauaauuuauggaagguuuuccuagcaauguuagucauauuuauuuugcuaggcuggcaguaguacuagucugaguuuuguuguauugauuugauucauuagauuagaucuuuauuuucucuguguauuucccauuaguuugugggauguuaagaaguguaccauggagaagugaguugcagaauuugagucauguugggugaagccaaaagaaacaguaauauugacugcaggaacuuucuaagccuuuaauauuaaauguccaagggggaaauaguauaugggaugcaguguuucugaaaauauugucccaauucccuuucaaggagccuccugggaggaccauaguguaauggagcauacuuugggaaaugcuuaguuagaagauaaauccuuucuuauugaauugggauaaugacagauuaaaugucuaauaauucugaagaauuuugaauugcuuauguguuguugaauuuaaggauuauuuuauauaauaguucaauucuagcucuuugggguagaagaaucugccuucuggagcaaauuaggagggugaacucuguugacucacagugaugagaauaucaaaauuuucuaaucuccaaguaaacaucagcugcuuucuuauuauauuuauuuauuuauuuauuuauuuauuaagagacauguucuucauucuuuuuuuaguuaucuaguuguaagaacauaauaaauauucaauuaguauaugcugaauuaaauaauuggacuucguuuucccuucagaauaaucugguuauuuaacuuuaugacaauauaugcuuuggaccaaacauauaauaauuuuuguugaaagagucucccuuauaugucagauaugucuagaauuuauggcaccauaaaaugaauuucuacuuuauaaauguaauuagcuagucuguaugauaauugccuuuguuucugaaauugcacauuuuguuuaagcccuuuugcuagaccaacacacaacauagauuuuucuucucugcacauguuacuuaguuuugcuuaauugagcagcaguaucaguaaaauccuauuuuguuacauuuucaaccaacaacacauuuaauuuguuggcuaaaaauugucaggccaggccuggugguuugcgccuguaauccuagcacuuugggaggcugaggcccguggaucacuugaggucaggaguucgagaccagccugaccaacauggcaaaacccugucucuacuaaaaauacaaagauuagccagacaugguuaagaucccuuaaccuuucugaguuuucuuuuccguagagggaggaaaugaauauauaccucuuuugccuuacaggauuucugugacacugaaaugagauaauguguauaaacauauuuuguauauuauaaaauccuguagaaaaauaucagcuucuauuucaguuuuucuaaaaaauguaccuuaguuuacagguaaauuaauugauauucacugaguucuuaaguaugaauuguagauuuucuguaagauuauuuuacauauuucuuauucauaaaggaaaaaccuuaauuucuuuggauagguaguacaugcacauuuacaugggucuaaguguccuuucuuagugucccaguucucuuccuuagagguaaucuuccagaaguguuguaugcaaauaaaaacacaaguguaaaugauaugccugcuguucuuuuuacacaaguguuacagcauacaacaguaguguucuguaucuugcuuuuuuacuuaaugcaucuuagguaucauuuuauaauagugaauguacaguuacuucaguuuuuuuucauuuauccauucaaaaagcaaauauuuauugaaugucaggugucagguaucauuuuagguuuuggggauacaguagugaacaaaauagaauuuguuuucacuguuaugggccuuuuacucuaauuggaggggacagugaauaaacaaacaaauaaauacauaguaugucacauggugguaaauucuuuugaaaaaaagcaagauugggggcaauaaggcaaugagugcugggaguuauuuuuauacauagugugguuaaggaaggauuccuugauaaagugccauuugugcagauaucuggaagaacugagagagcaaaugagacugcuuggggugagaauauuucaggcagugggaagagcagaugaaaggaggaaccaaaaggaagccaguguagcugaagagagagaaaguaauaggagauagggucugagaaguaaugggcaguuagaucauaaagucauacagacccacguaggacuucagugcuaauucauagagaaauuagaaaucauugagcguucugagugagggagugacauuuuuacaugguuuucaauuuuuuguuguaaauacaucuucagugaaaauccuuguaauacuauuguguguaguuuauguguaagauauauuuuagguuuuguucagcuuauauagguuuagauuuuacugucaaaaaaguugaaaaguuucugaaccugagaacaaugucaguuauagauauuaauuauaacauuaauauuucaguuuuguagaugaguaaauuuuugcuuccagcuuuucuguggcaugaauuuuaccaugcugaacuucagugucuuaacaaaccauuacuauuauuaaauucuucuauggcucugacaccuaaaguauauuuacaguuguauguuauacuguauauaaauuugauauauaaauuucuaacuuauaaaacagguaagcuaggaggugauuaugauuauaaucauuuuccaaaugauucaggucaagauuccauucaucaauagccauuuuucuuuggcucauauaaaugaagucauuucauaucacguuagccaauggaugaugccagaaacacucuuuuucauuaggccacaguaucuucaguaucaggagagaaaaaacaaugcuuaaacuuucaaaguguuuuuuagcuuauauuuuaacuguuaucuguguucauauucauaugaaguugauauauaggccaaaaugaaguaaauaaaaauaagauuuuccauuugguuuuggaaaaacuauauguauauauuucaaauuuaucuuuuaaauuaugaauuucuuaauuucuuagcauaaacuaacuggccaggggugaacuagcccuagaaggauauaauaaaaggagagagaagauaaaguuagguaagaauuaaauaucuacuaugauuaaugcaaauaaaaagaauuccucagauuuauuuauucagucacuugggauucaacagcgcuuaaugauuacuuaccacaggauuauuauguaaugggguuuuuugggaaaggugggucaaagagauuuagaagcuguuacaggauuuggucggagacaugaagcacaaguaauugauuuaacaguuaauugaaaguuggcugaauuuugacuuguauguauuuauacauuaaaacauuuuuuaaacuuguguuuagcaguaccuauauauauacucaguaaauguuuauagaugaaaugaauagguacagaauuucaaaagcagguuaaaauugauguaacucaauuuuuaaaaugguuuaaauguuaaaauuguuuucaucaaguauuucccacuuuauuaauaaguaauuguggcaaugguauucuaacagggugaaaaaaucuggaguaguuacagagauaaugacuaaugagugguugugauagaaucuuugcucuagggagagccccagcuauagagccagacuucuuugguuugagucuuugccucaccacuuaaguaagugcaggguauaagccaaguuaugggacuuuuucuguccccauuucccaguguguaaaaugagauuacuguguuacccacucuuggguuuguugcaggaauaguuaaguuuauacauuuaaagcaugcagaacagugcuugucacuuaguaaacuaguauugucuaauauuugauuauuugaugaaacaucacagaaacaauaauaaguuaaugugugugcuuacuuuuuugcuggucuuuuuuucccuguucuugauguuauuuuuucauuaagcauaaauccuuccuuuuaaaaaugcaaacuauuaauuuuuagaugauagguaagcauguuugugaucuacucuucucuguacuugaaauauuguugucuuuuagccacaauagauuggaaaacauuuuuuaaaaaacugucauguaauuaacuuacgacuuaugcauuaccuuuauaauagcccuuuuaugacguuauuagaguugaucagcuaauuuuucaaauauuuuuaguguuacuaguuuauuagaagucugcuuuuuuccuuucucauacauuauuaaaguuuguguuuaaauuuuuacaugaugcaauuuuuauaaaaaauaguacauaaucccauuauuuuaauguuacuuuuauaguuuaauuugaaugaaagaaaaaaaucccuaaguacaauuauaucuuaagauuauucauuacuaaaauaauauauauauauguuuaaauuugcuguuauggaaaauaacagcuuuugauacucauaauacuuccuuuuaacaauucuccuuucugccaucuuaugcaauaccaugauuuuauucauucuaccaguugaaaccuguuuuuuccauuuccuuuggucccuuucucucaguauuguucaaagucuaucuuucuaacagugguguaggguggaaaaaauugugggaauuggagucacauuauccuggguuuaauugccuuuagguggauuuucacccgcuaaacuacaaugucuucaucgguaaaaucuaauuaauaauauacacuucauaggauuguuggauguauuuaugaaugaauguaaaaacaauauacagcuccagauacaauuaggaaggugcuuaaugcacauuugguuuuuguuccuuuuauuuccccuuuuucuccauuuccuuuuucccucuuuuuuuugucucuuccaccuuuuuccucccuccucugccuucucauuaaacacaauuagccaacuucuuuucuuuucuuuucuuuuuuuuugagauggagucucacucuguugcccaggcuggagugcaguggcgggaucucgguucacugaaaccucugccuccuggguucaagcaauucuugggcucagccuuccgaguagcugggauuacaggugcugccaccacacccagcuaauuuuuuuguauuuuugauagagacgggguuuuaucaucuuguucaggcuggucuugagcuccugacuuagggauccacccgccucggccucccaaagugcugggauuauaggagugagccccugggcccggccacaguuaaccaacuucuguaaguaucuagugccauggauguagauaaccuggaauaguagacagagucucugcacucuuagaucuacauucagcaagcagaaaauugcaauaaacaaaugauuaacaagaaaacaucagauagaacuaaguacucugaugaaauuaaucauuaauauuccuuaggcuucaguauuuaacacucagucuucaguuuguuuucuuuucuuuguauucagguaucaguggauuuuuuuuucuuuugucaugauuuagacaucaauugauugacacccaaauguacauuuucgagaaaauugagaguacuggaauaccacuccagauaaagacaaaaaaugaaagcagagagaaaguuaagugauuuaagcaaguucaugcagaaaagguuaaauguaguaaaacauuuuaguuuauugagaacaauuucauuauuauuuauauaccaauuagauuuucuuccuuugauuuucauuuuuagauuaacuguuuaccugauagagguaguauuaccuggcguucguuuuguguuaauuaaaaaacaaaaacuuuggacuaugaugauguagcuuaaugcggauauauuguuugagaaacugaacagaaauuuaauuaccggaaaaaggaauaaaagauauuuaaaugcauggcuaauuugcuguaauaacuguuaaaaaauuuuuuaaaaaccuuuuuccuucccuuacauugcuauaacgaaauaauagcuguuaagaaugaaauugcuaaagaaauuucuauucauagauuaauaguucuuuuuucugccuauacaauaguuuuugggugcucauuaaaaaauauuaauaaaucaaucaaaaguaauuacuuggcauauaaaccaucacauaacauguucaagucauuuuguuacgauuuuuaaaaauaauuucauuuucuucaaccugaaaaaagucauuccagccuauacaauuugguugcuaaucucucuauuaaacuguguaguauuuguuuuaaaauuuguauuugcugaggcaggagaaugcugugaacccgggaggcggagcuugcagugagccgagauggcgccauugcacucuagccugggcgagugagcgagacuccgucucaaaaaaaaaaaaaaaaaaaauuuauauuugaaggccaggugugguggcuggcucaugccuguaaucucuguacuuucagaggccaagguggguggaucgcuugagcucagaaguucuagacuagccugggccacauggagaaacccuguaucuacaaaaaguaaaaaauuagcugggugugguggcacgugccuguaguccucaggagacuaaggugggacgauggcuugagcccaggaggcagagguugcagugagccaagaugacaucacuguucuccagccugggcaacagaaccagacccuguguuagaaaacaaacaaaacaauuauguuugaagauguucuaucuggcggcuuaauuguggguagauuuuugacaauguauguagugaaggauuuauauguuuuugucuccaaaaucuugugucuugaauuuugauaauuauuuuaugacauuaauuucuuuaacugaaaguuuuuauaaagagaaugugugaauguuaugauuuauugcuucauuugguaccagaugaauuuuaaauccuuuuuuuuauuauaguauugugcagaaaguuguuucucauuauacauauuuaaaagcuuaaggauccacuguuaauuuuuuaaaucaucgguuuacuucgcaaaucacagaugaaggaugugaucugaaacuaaggaaagguuuucucuaucacaguguaucuagagaucuuugagaguagaggcuaaguuuucuugaaaauucucaagguuguguaaaaaaaucauuuguuccuuggaaggagaaacaacucauuccaaaguaucaguuacacuucuauucuauauuuaacuauaugguauauguugucagaggacuguaagaagaauauaaacaaauucagauguuuaaaucugucuucuuuuugaaacuugaauuaaugcugucauacuggugauguuagaaaaaaaacauuugaacagcuggaaggguaccacauaguuaagaaacaaucuucggacagacuaauagagaagaauacuucggugaaguaaacuccaauguauauguauuuauauauguaucauauauauacuuauauauaaauaaaauaauauuuugaggaaaacaaaacuuuuuauguuggauaaauaucaauuuugauuuuaaacuuaugcuacauaaagaggaaauuucagauguauuaaauacucaaauauuuuuaaaaagccacaaaacuacuagaagaaaauauuacugaacauuuuccuauguuggaaaauaaacugaauuaaaaugcaggauaaaaacugggaauaauauguacugcucuugugacaaaguauuaauguuuguaaauauauaaguagaucauccaaauugguuuagaaaaaaguaaugcaccaauuaaaaauggacaaagauuaugaauaagauauucauaauagauuaaauauaaauuuuuguaagauauuuaaaaacuuuucaagccacuaguaaugaaaauaaugauuaagaaaugcaauuagaaauuaaugaacuguuaaacuugucuaucaucaucuacaguggcuuccuucgaaccugcucucuacucuagccaaaguuaucuuuuaaaauuucacaucagccagucugguuauaguggucucaacaagaauggguacaguggcuuuuuaugacuuucaggugaaacaccaaauuucuugaccacacuuagcauaauuucccuauucuuuggaaggcuuuuacuuuuuuuaaaaaaaagguuuguuuaaaaauuuaauuccauuuuagauucaguagguauaugugcagguuuguuacaugaauauauuguauaauggugggguuugggcuucuaguauacccaucacccaaauagugaacauuguaccacauagguaauuuucaacccccuccgcuucucccacuucgcccuuuaggaguccccagugucuauuauuuucagcuuuauguccaauauacccauuauuuagccccugcuuauaagugagaacauacgguauuugauuuucuauuucugaguuuuuucacuuaggaugauggaucauggccuccagcuccaucuaguugcugcaaaggacauuauuucauuauuuuuuauggcugcauaguauuccauaggguauauauaccacauuuccuuuauccaaucaacuauugguggauauuuagguugauuccaugacuuugcuauugugaagaguauuacaauaaacauaugaguguaggugucuuuuugauauaauacccaguagugggauuacugggucaaauaguaguaguucuauuuuuaguucuuugaaaaauucuccauguuguuuuccauagaaguuuaacuaauuuacauucccaccaacagugcauaacauuuucuuuucaccacauccgcacuagcaucuguuguuuuuugacuuuuucaacauagccauucugacugacguaaaaugauaucucauugugguuuuaauuugcauuucucugaugauuagugauguugagguuuuuuucauauauuucuuggucauguguaugucuucuuuugagaaauguguguucaugucguuugcccacuuuuuaauggaguuguucauuuuuuucuuguguuguuucaguucccuauagauucuggauauuaguacuuuguuagagucauaacuugcaaauauuuucuccuauacuguagauuguguguuuguucuguugauuauuuauuuugauguauaaaaacuuucuaguuuaagucucauuuaucuauguuuguuuuuguugcauuugcuuuugggguuguugucauaaauucuucguguaggccaaugucuggaagaguguuucuuagguuuucuucuggaauuuuuauaguuucagguuuacguuugagucuuuaauccaucucgaguuaauuuuuguauauggugagagauaggggucuaguuuuauucuuuugcauauugcuagccaauuuucagagcaccauuuauuggauaggguagccuuuccucacuguuuauuuuugugaacuuugucaaaggucaguugguuguagguagauggcuuuauuucuggguucucuguucuguuucauugaucugugucuauauuuguacaaguaucaugcaguuuuaguuaugauaugguuuggcuguguccccacccaaaucucaucuugaauuguagcucccacaauucccacguguuguggcagguaccugguuggagauaauugaaucacgagggcaguuuuccccauacuguucuugugauagugaauaauuguuacaggaucugaugguuuuauaagggguuuccucuuuugcuuggcucucauucucucgucugcugccauguaagaagugccuuucgccuucugccuuccaccauaauugugaggccuccucagccacuuggaacugugaguaaagccucuuuuucuucauaaauuacccagucucagguaugucuuuauuagcagugugaaaacggacuaauacaaguuacuuuagccuuguaguauaauuuaaagucagguaauaugaugccuccagauuuguuguuuuugcuuaggauuaaacaacaaauuucuuuaagugaccugccuaaaggguuuaccuugucuggcuccuaccauggacuuuuuuuguuuuuucuugagacagagucucgcucuugucacccaggcuggagugcaguggcacaaucuuggcucacugcaaccucugucucccagguucaagagauucucaugccucagccucucaaguagcugggauuacaggugcccaccaccaagccuggcuaauuuuuguauuuuuaguagagacuggguuuugccauguuggccaggcugguuucgaacucugaccucaggugauccaccugccucgaccuucuaaagugcugagauugacuacaggugugagccacugugcguggcccuaugaacucuuacuaaucugaauggauacugguuguaaucacagacaugacgcuaugaaagaagagcaaaacaagaaaggaagauauaaggauugaaggccugggaaaaaaauuugggggguauuaccugggcugguuguaucaauucaguuaugaacaaguguaguuggaguaaguagcuaucaaguguggucugaaaucuuacaagugaagaaauucugacugguaaguuccaaguuaaaaaugguagaaugaguuacugaaguugagccuagaugaguacucuuggagaugaagccauccaaggaacuuugaggccuuggguauaagaaucauuuaugauauuguuggggguugagcuggaaagaaaauaaucuuaagcuacuugccaaauacaaauaccucaguaaaugaaagggagugucugagagguagaugagaguauugagaauguaaauauccacaaaugguuucauuuaugcuauuauuauaccuacugcaucucuuauaauuauuuucuauauaaacuuuuacugcuuaacacaguaccuggcaaagaguagguacucgauaaauuuuucuuugaacaugcuugauauugcaaaaugaaaccaucagcauuuagguugcaguuuuuaguuaaaugugugacucacucuacauauuccuuguauauaaauaccaaacaaaaacaaaacacuaagcuaauguauagggguaaauuagucuaguaucugugugauaaaguaauaaacucauaauucugacagaaaggaaaggaugcagagugauagucuugacuaacauagcuaucauuuauagauaggcaaaguagaaauuuggcauacuguguuauuuaagcagggccagaaugaacuauguccucuaaaauaucuuagccacaaccacuacuuuggaaagccuauugggcagugucuacuaaagaaggaaauguguacacccugugacucaguauaucugcuccuggauauauacucaauagaaauacauacauaugcucucaaaaaggcauguacaagaauauucacaggagcacaauuuauaaugaccccagcuagaaacuguccagaugucagucaacaguagaauacauaaauugugggauacuuacccaaugggauacuccgcaguaaugaaaaugaacagauuacaacuacaugcagcaguauggcugaaucuuacaaaaauaaugcuaagugaaaagacaccagacauuacauauucugugauuccauuuauauggagcucaaaaaaauguaaaaguaaucaaugacauucgauuuuagaauagugguuccccuugguaggguggguguagugacugaaaggggccacacaagacacuucuagaguauagacagugacuuguuucuugaucuguguucugguuacagggacuuuuucaaucugcaaaaauuuauaaccugcacacuuuugauuuguaaacuuugcuauauucaucuuguacuucaaugaaaaaauuuagaaaaaaauuguucuaacuuagcauaggaccaaaaugaaagcaugcuuaacuugucucucuguguguguguguguguguguguguguguguauguguuagauuguguguugagcuuucuauggcuaucuuuucagaauuaucugggagaaggaggagcuuuuuaaaccauauaugccauacuuacuuuucucuguuaccgacucucuaaccauuauuauuacguuucuucuauggacuauguaccucuuauucuuucucuuuuacugagaaacuauaguucgcuauuauuuuugauaacaaaguguuguauucuucagaucucuugugguugaaaaauaaugacuuuugggcaaaggauuuuugucuuaaagauccuuauuaaauucugaaugccucuuggagaaguagcauguuaagcaucaucagacauuaauauguaccucaauucaggggcuugaggaaugcaggagcggugaaaucagcauggaaguagauagcacaagcaugugaaaugauacuuugaaguagucuuuauucugauaggcaggcuagugaggggcauagugcuggaagggaaggugagaaguugcugaugauuaauuuagcccauuucacaaauuuguguaagccuagcucuucccuuuucaaaaguaauuuagguuaagauaaguauauaggaaaaaauaauuuagaauagaggagaaggcuugggaaaagcucuugaaauuuuggaaagaagaacucauuucuuuucugugguauagccaggaauggugguggcuacaggguuuagcaaggacaaggaggauauggguuaggcauguaacuuggaaggaguugaaguaaaguaggauauggauuaugaaagacaccugguuucagaagucagugaacaaaggacuaagaagguuagguagagauggaauccaguugguaagaaaaagcuuuaguugucuuuugagagauuugguuaaccuaagagucuccagaaccuuagucauuacaaauagcuacuuuuggcccggcccaguggcucaugccuguaaucccagcacuuugggaggcugaggcaguuggaucaccugaggucaggaguuugagaccagccuggccaauguggugaaaucccgucucuacuaaaaauacaaaaauuagccaggcgugguggugucaccuguaaucccagcuacucgagaggcugaggcaggagaaacgcuugaacccaggaggcagaggaugcaugagccgagauugccccaucaaucaaaauugacacuccaucucaaaacaaaaacaaaaacaaaaaacaaauaacuacuuucugaaacucugguaguuaaauggcucuuguuuguuucuuuauaauaaggcacaguuuuuauggagccugagcguuguucuuauuccacaaaggacuuuuuuuuuuuuggcaaggggauaaauuacucuguccuaauuaaaauuuaauuuugaugggaacucuuuucucucccccaguuuuuuguugcuaaggccauuaaggaagaauuaagaaagagggaaaaggagauaugugucaggagaaagguagcaaaagaaacaggugagggaaggaagaagaucaguaaagaaaggugaggaagaugaaagguaaagaacagaagagaaagaaaauacaggaaugagaggcagauaaaaggacaaacaaaaagggaguaggaaaaaggagaugaagaagagggucugagguaagaaaagcuuuucauucccucuucuuucacuuuucccauacuccccugcuugacacaggguacuaugauaugacccacuucccucuucucuccugcuuuacucuccagguuuccauuuuuauugacuacugacuugugaacuuuuccucuguuucuuuuuuaaacuggagcuguacaagguaagaauucauagacaaaaggcauugauuauauuugcauucucaaauuaaaaauauuuggaauuuaaaauaaaaauauuuauugaaccaaucuuaccuaaaggugucaaaacucuuccuuuauaguuuaauaaaaucuaacauauggauccaauuugugguucagauacuuaggaaaauucauuauuauacuugauucaaguuuuacaucaacagccuaguauaaaauuuuuagaaaauuuguuuaucuguacuuacuugauucauuccaaauuguugauucccaaaguuuuuauugggagguauuuaauaagauaaaaugaaaugggaaauuuagauguuuaccuuaauaauuuggguacccccccgacccccugccaaacagaaaucugaaauguaauuaauuguagcauuggaucgggaggggccuggaugaguauagacuugcguuauauauauaguuacuucaauuaucuauuaauuauguuguggguauuuagauauagcuuauguucacaguauuauauaauuauuacagauagcuguauuuuuugauauagugaaccuuuuccaauuuuauuacuuauaaaauauucauagucuuugcuauuuauuaggccccaguguagguguguuauuauaaaagaaaauugccagaaaacucuaucauguucgcucauggguuggauggcauaagaugaaauucaaauaaucaugaaaacucuuacugagauucguuuuuguucucccuuuguguauaauagaaucauauagacuuuuuggauaacugccaacaauuucauauuauauuugaucauguuuuccaggauuuaauuccuguauuaaaucuaauacaaauuaauugaacauaggauucuauauuuugaucaguuagcauuuucuagugugauacaguauucuguaucaucuuucauucauauaauugucuuuguguauuaaacauguauuuaaucagaaaauuucauugccagucuuuauaaaauaauaaugacaauccacgaggcuuucuucuauuccagagaacuaugauacaaagaugauauguagauacguugauuuugacuuuuuugcuagcuauuuaacucaacagaaauuaauaccuaugugcuuucuagcauuuagaggccucauuuuaacuuagugguugcucauuauaauuuuaaaauugugcugaggaauuaaaucauaauuguuucuauuuuuaagauaggccaugcuuuuaaggugauggaguaauuauuguaaacacuuaagauaauuugguauauggggaguaaaacaagcauggacuagucacacuagaccaaugaaacacuggucuuuuguucuccacaggaauaugaaagucuaauuuaacuuuuuuucagauaagucaguuuaaguagaaauaauuuaauuuuuguuugcucuuccuuauuguuuucuugggugauuuugggggauguugccucuuucccauuucccaaagucagagacagcuuugauuucuugcugaguagguguaugaugugacuugggauuauaacuaaaaaccaaagaacacaagggaagcuucuuguuugcuucuaauuuuccuuagagucaaacaaaugauuaacaggaaguaugaaaaaggugauacuuuaagcuucagcuuuaucaccucuaagaaagguagcucaguagaaugaccaugucugggagucugaagaugccaaggagcaugaugucaccaacucuugguaaucaggcuuuuguuuuaaauuguucagagauaagacugugcucccugaauaaguaaaccucacauugcagggcuuuuuauaaaagauuuacaugcuuguguucauuuacucauuuauuuauuuccugccuuacuccccagaguauuugagguagcuaaugacaacaacauucaggaaaauauaaauauaaaauaaaaugagaaccaggaacaauguaaguuguaacaggauaucaagacuauaguucauaggauguauguauaguuacuacccuagagcuacuauuuugucucuaagcuuuccaaaggccaaaaugaaaagggagauaaagucauauaacacucuuaaauaaaagaaagcaugucacauugcaggggaagcaaagcuuuucauuguauugagcccugauagaauuucuuacuggaggcuuucauucugacguucuuaguggcggugcccuugacaauaucacuaaagcuaauguaggaaggagacucauaagaccaucucuugcagaaucuagaauccaucagugaaaguggaggccaugacaucaaaaucauucuaugugggccuaagaaugcagcugucucuaaauugauuuuauccaauaauauaaucuagacuuagaauaauggguaguggacuggguguguguuuuuucuuuuuuuuuuuuuugagauggagucucgcucuguugcccaggcuggagugcaguggugcgaucucugcucacugcaagcuccgccucccggguucacaccauucuccugccucagccucccgaguagcugggacuacaggcccccgccaccacgccuggcuaauuuuuuuguauuuuuacuagagacgggguuucacuguguuagccaggauggucucgaucuccugaccucaugauccgcccgccucagccucccaaagugcugggauuacaggcgugagccaccgcgccccgccuuggacuggguguguuuuuaacaauccuuucuuagugucauuucucucagcuaaaguuuggauaugcaauggauaauuguauucuguguggaguucucaauuguauucugaggagaguucucgauugcagauauucuauacuuguuugaggcuagaucuguaaaauuaguaggauuuguuaguuaauucauuagcugaguuucaaaaauuuugaagcuguauuuuaaaacaauuagauaauuucuguguuaaaaauaauguuuauauuugugaaauuauaacucccacaaguuauugaaaucacuucccuuuuuaggauuaaaaaauauuacugaugauugaaggguaauuuucaauguuaaacuucaacuuuugcuuauaauuuucauguuacauuuuacucauugauaucuuacuauuucugcuuguuuuuuuuuuuuaaaucagaguuggaucuuguaauucuaguugguuauucuugauuucacuuuguagauuuuuuuuuauggcuuuauagaugaucaguauuucuauagguuuuagagaugaguaaagaguacagaaaauuuagcuauuguaugaaacauguccuauuuuggagggaggguuuuucuaaacaaguuuauuuaguagcuauuaaaauggaaaauuuuaaauuuuccaaaagauucuuugagagauacuuaauuugauucauugacauuugucaauaaggccucauaucuuaagucauuuuaaugugucauuuaacaaaacuuacuaaaagaacuaauccuuaauuacucuuuacugugugcuaaacaguaugcuagauauauaacauacuuuauuuacuacuggcaaacaguccugcaagggaguuauuccagccuuucagacaagaacauugaagcuugaagagauuaaggaacuuuaucagaaucgguguggcagauucaaacucaaauagaaacuucuugacaaugaaguuucuauuuuauacaaucaguguugcaugauuacuaagccaacagauguguaaucagagggacuuuaguucaaauccucugugcuauuaauguaucaccauaggcaaaaucacauaaccucucugagauaagauuccuuacugguuaaaaguggcaagucauagaaaccucauagaauugucuuaaaaguuacgugaaauaaugcuugcaaaaauguuuaguacagugccugguauauagcuaaguucaauaaaugguagcuauaaagaaguagaguuuuuaguauuuucauuucagagacuacaguccccuuauuauagauauuuuaguucuuuuuaguuauguaauaccugaagguaagaaauuaccagcagguggagcucaguaucagaaaaaacaaauuucugaaauugagguauuuuaucaccuuauguuuuaaaaauaaaauuaaaugcauauaguuuuaaaauuuacaugugaaggccuucuuuuuuaauccuaccuaccaaaaguuaucacccugcaacuugguuuuugaauauguagaaggaaugcuuuuguuauaauuauuuuaaauuguuugcuauaucuggugucauacauaagguaugacaguucauuugcaugaauaagacauuuuuaaugugaacuuaauuuauaaagauugucuucaaauuuggucacuucauacaauaaaguaauuacacugauaaucuuaaauuuaacuugucaaaacccucaaaucugccauucccacagucuucuuaggguauuuucagucaauugcuuaaguccaaaucuugggaaucacccuuguguucacuuucuuccaaauccuguuagcaaguugucuugauauuaccuccaaaauauauuccaaaucugaccucuugauaacauuuccauugugaucauccugguaaauucaccauaaauuaaggucugaacuacuucagccaguuuaccuguuuguucccuugcccuuuguaaauuuuauuuucuguauaauaacuugaguuaucguaauguauaaaugagauuuuauauuucuccugcuuaugacccuccauugguauuccuauauaaccagaaugaaauucuaauccucaccaugaacucaauuacauaaucucaucccugccuacuuccccucauuauuuccuaccaguccucauccaucacacuccagccauugaggucuuacuguccuuuggguacacuaagugucuucuuaucucugggacuuuauguuucaucucuuuuuaauacuuauuccccagaucuucguaugaccaacugccuucuuuugauaauuucaggucaaaugauacuucuuugagagaucucugacuacuucagcuguaauaggcccuaucagaccccugucaucauuauuuauccuauugccuuuuuccuuuucuugcaaagcacuuacuuuaguaucuuuacuauuucuacuauuacuacaauuauuacuauuuuguugguuagaauuuacucugugguagguuaguucuaaauauuuccaugcauuaaauacuaauauauguacuuugguauguaugaacucauuugauuaugguauguauguauguauguguguauguuuuuauuaucugucuucuauaaucccugcuuguuccuuaaacuguagcucucagaagguaggcacuuucauuauguuuacuacuauuuccucugccuuguacagugcuugcuauguaggggaggcuaaguaaauauuuuuugaauauugaacaagcucuuagaacucguaucaacaaguagaguuaucaaauauuuauguaaaauaaucuccuaggggauagggaacauaucaguggaagaaaucauaccugaccgauuauucuuagagucuuuuuuuaugaagguaauaggguauauaaaauaagcuacuucgauuuuagaaaagacguugacaauguuuuuuaccaaagguuacuaaauguuaagucacugcugaaaugggaaauaggcuuuuagaauggcccaacaacagguuuaaaaucagaaaucaaacaguaggaauagauguuuauuugacuagaaaaguauaaagagagugccccagcaauugaugaucacaucuguuaugguuugaauuaugugcccccaaaagauaucuuuaaguuguaauacuaaauaccuguguaugugaccuacuuuggaaauagggucuguaguuguaaacuaguuaauaugaaguuguuagggugagcucuaauccagugugacuggugcccuuauaagaagagaagagaggcugacauacagggaagacagccaugagaagacagaggcagauauuggaauuaugcuaucacaagcaaaggaaugccuggggcuaccagaagcuauaggaaguaaggaaggguuauccccuagaaauuuuggagggagcauggccuuggcuaacaccuugauuucagacuucuggccuccagaacuguaggagaguaaguuucuguuguuagaagucacccgauuucugguacuguguuacagcagcccuagggaauuaguacaacaucuguugugauuauugucuuuauaaaugaucugaaagaggagggucuuccuagugagguaucuagaugacauuaaagucuucuaguugugaagagcaaaaccagugaguacagaugaugaacaaagaaacaccaaaauuagcuucucucugugcuagaacaaguaacaaauccagcaucuuaagauuuuauauucuuugacuguaagcacugauuucaacacauuuaauguugaaaauugcuuccagauuuaauguuuuaugauuuuaugagccuggguaagugccuggcaccuaauuaaugcuuaaugaauauuuaaaaaauaaauaagugaaaccaaucagggaauaaaauauaggaaaauauaauuuuauuuuaaugaaaauauaaacuuauucugguauaaaauucaaauuaugguuacaguuagggaaaaaugagugcagggagugaauacugggaaacuauacgcauuguuuacugaauauaucaacacuuaaguagaaaaacaaaauuaauaaauuguuaauguaucuuuggagacucuuuuuuggcaaaagaauaccuuuggugaaauagagcagugacuuaaucuaagaaacaguauaguaguuaauugcauaguuucuggaacaaaguugcauaguuucuggauccacaguccuuggauuugaauauguggcaucagcuauuuuuuggcuauauaacuuugggcaaguuaaacuuucuguaccucaguuuucucaucuguaaacuaggguuuguaacagaaacuauuucauaggguuaauguggggaguuaaaugagauaauccaucuaaaaugccgagaaaaugcuuucuccuaagaaauucuuuacccuauauugucuuuuauuguuuauuaaauauaaaauuuuauaaaauuauucucaguguacaaaaugagauuuauuuugauggacgugauauaaagaaugguuguugcggacaauaaaauuuaaaaagugaguauccaaaaaagaaaacuagaggaaauuaugcaaaaaggcaagaaaauuaaaaaauuuuuuuuugauugcaucuaauuauaaagggagccaaagacuuuaaagaaggagauguuuaugucagaauugugacccagggaaguuuuacggaguaagacuuuugacucucuugcucuuuucuauuuuucuuauuugguuucauaaaguuucuugaacuuuggucccuuagaaagaauguucuguacaaugccugaauaugauaccuggcaucuaguaguuguaucuuuguuuaaaaaaaugaaugaauaaagcagggauuuauaaagcaauuaacaaaucauuauagaauagguuaucaaaaguggagccuuacuuuccgauuaaacauuuaugguuuugaguaucccacucuacuuccucucuagcccugacacuucauuuuguguuaaguguaguagguuuuuguggcaaggaaauuuaaaauuuuuauuucuguugagaccuuagagaucauuuacacauaauuuauauucuuuuccuuugaaugaagaauuauaaaguauuggagaguuauaccucaauaaaaaauaaaaaaaauuaaaacacauuggauuaagaaaagcuuuguagcacagcuaucugcaagguuuuguuucaagaagugcuugaaagugagguauauucucagagaccuugagauccaaaaccuaaaauaagaagacuucuauauguuucuuaggaauaaaaucagguauuuuauuuaucuaauuuaaaaaaucaaaggccaggugcaguaagcucacaccuguaaucccagcacuuugggaggccgaggcgggcggaucaccugaggucaggaguucgagacuagccuggccaacaugguaaaaccccgucucuacuaaaaauacaaaaaaauuuagccaggcacgguggugggcaccuguaaucccagcuacucaggagacucaggcaggauaaucacuugaacccgggaagcagagguugcagagagucaagagcaugccauugcacuccagccugggcgacaagagcgaaacucugucucaaaaaaaaaaaaaaaaaaaaaaucaaguagaacagagauuuauuucuuagauaguguuucuuuacuuaauguacaaggauuuuccguuuguugcucgaaaacgcaacauuuguuggcuguaucuguuccuuuaauccagaacugacuaguauacuuccaugccaacagggggagauaguaugaaauaggagauccagauuugcaccucucuucuaucuugcuuuugccucacacaggaagguuuguugguaaauugacuuccuugggcccacugucacuaucucuuagcuaaauuuugagauggagcagaaaaugaaauguccucauuguaaggaucagcuggagucugguuucggcucccaauccuguaaaacaugugcuuuaauguucagcucugagccuuccacaucagaaguccacagagaucagguaaggagaaguucugccacaggccuacuuuacccagggccccagacauuaucuaagaguccagcaggucaucuauuuuaugcggcugcuucaaaugggaaggauaauuucucuugacuucugaaucuggugguaaacaaaauucuuuugaacaaugcuaucacuuagaugcuaaaccaaagccacugaaaaaaaugaaaguggcuucuuuucacauuuguauuuuauuucauuuguuuccuuaauucaccucucaguuuugagaaaaauauguccuuuccaguauuucaauacauggaagguaaaagagagugcaguuuuauugaauauuugaggagaaacauggcucagauuuuaaacugagccauguuucuccucaaauauucaacaaagaugauauuaagauuucuauuuuucaaauuucaguuucuauucuggcuggugagcucaauuuagccuuguuauuuucaaugucugucaccaaaggaaacuaauaauguuuuucuugaacauagguauuuaauaguuggugaccauaacugguaaagcuuuucauuaugauauguagcuauauaguucaaugcuaauuuuguaaucaauguuuaugguuuaauuuaggaacuuggaauacacuaauuccuuacucuuuuaauguauaaaauauaauuucuguuacuaauaggaauauagcccuauuuuaaaucuguuguguuggugaagaauuauauuuauaugucauuuugcgacuuaauugccugcauucucuugagucccuuauuuaaugccucucuuuuuuaggcuuucuuuuuucagauucacuauauuaggaaaaccuaauucuggucuucaaauaagaauugucaaugccaaaaaaguuuauguauuuucuuuauuuugaagauaguugaaauacauacacgauucuugcuuuaauauuacuacauccaguguuuggguuaugguguuccaaauaugugucuuauauuauuggauaaguacuguuuguaaauauaaugaccauuacuugugugcauaaguuuugcuuaucugguuuauaaauuuauaaaaauauuagaggauauugaauccauugggaucaucuucuccaaauuaucauuuuauauauaauaaugucucugaagccugagguaauuaaugacucacauagcuagcuagugacuugcauaacuuaaauuuuuuuaacuuuaaaaaagucucgcuuucuuguuacccuucaaucucugauauauauucuuuuaugauccuucuuuaauauuuuucuuuuuuuuuauacacagucauugucuuuucaaaacauuuugugcuuuuuauuuauuuuugaaauuguucuuaauucucuuaaauuuuauuaacuuuuuucuuuuauauuagaaucuucaaucucugauauauauucuuuuauuauccuucuuuaauauuuuucuauguauuuuuuuauacauaccaucguugucuuuucaaaacaauuuugugcuuuuuauuuguuauuuuugaaauaguucuuaauccucuuaaauuuuauuaacuuuuuucuuuuauaguaguucuacuacauaucuucaaaguaaaguagaaaagauuacaguuuuauuauuuuucucauuuauguaaauucuguucagaguaaauagaauaagaauuuuugcuuugauggcuaucacccaccauccuuaggaaggcauuacauguaaggaugcacacugacucuugaaauuuuaaaacaauucaacaaguacauacuuaauugaacucucauaauuaugaacuucuacccauagccuugaugauuuaucuugguuauuaacuaauacugaccuaaguauaaugagaccucuugauaaaccuaaaaauauacuuuuaaguacuuuucauugucagucugcucagucagauguuaccacacucacuuggagacauacauauucagucacacauaccugaauugaucauaggaagccuuuguauucucauggagucacuauuuagccucuguguuuuauacagauguucuugacaucuuuuguuuuuauauucugguauuauuuaugauuuuuuuuucagugaauucuuaccaccauaaaguacauacugauucacgagaguauauuuuaggcagaaguuguccuuuuaucagaaacugacauuccucuggagaugagacuagucuagacauaguuuucugguaagccauagccccucaagcugcuuuucugggucaucuguucccuccaaguagugugucauauugauauuguauuaugugugguagauccauucuuuauuggaauuucacuucccucuccuauuauaauacacuuuuccaucuuguaagaauuuuuaaauuuggccuuugaaagcucauucugguaagcaaacuuccuguucaacagaagauugcucauucucccauaucccauguaauucagcauugagaaguggcucuuuuuuuuuuuuuuuuuuugagacggagucucgcucugucgcccaggccggacugcggacugcaguggcgcaaucuuggcucacugcaagcuccgcuucccggguucacgccauuguucugccucagccucccgaguagcugggacuacaggcgcccgccaccgcgcccggcuaauuuuuuguauuuuuaguagagacgggguucaccuuguuagccaggauggucuugaucuccugaccucaugauccaccugccucggccucccaaagugcugggauuacaggcgugagccaucgcgcccggcgagaaguggcucuuaaugugggcuuuauuauuccuuuacccucaugugaaagucuuuguguuuucaaggcuugugaaguuugguuguauugcauuuuaucccugcucauugucgaaaucuuuggaacuucuguucauuccuccuuauucaucaaugcaugugcucucugguuuagucucuuuuucuacuuuuggucauuuugggaugacguuagcagucacguggaagacccaccuaaaauuuaguuucuacauuuauugaucuaaaaauaguguugacugagggaugguagcugauaagcaaauuuaagucaagagacuuuuucuaagaaagacagaagaaggcucuuaggucuucuuguuucuguugaguaacuagcaccaacuccggacugcuuacuuuacuuaugaauuucauuucaugagagacauaaaaccuuauuuaucuagguuaauuuuagacauauuucugccacaguagcugaaagcaacccuaacugaaagaguagguaaaauguugacaaaaauagauaauauggcuuagcacaguaccgcuaguuugauugcuguaguuuguucguuccuuuuuuagaaggugcuugcucccaaaugcaggagcuucuuguggcacuaaguuuaugaagguagaagaauucuagugcaucaauuagauguuacgguggauuuuaaaaucuggccaucacaccuugcuuuuguaaauaucuauauuuugaaggccugguacuuacccuccugccagcuccauacuuucugauggaauucuuaggaaguuuuuacugcugccaauuggcaaucauaucacaaaauauuuuaaagcuauguauauauuucaguuuuuggugaugugacaauaguauuuaugaaaauaaauucgugaguucuugaaauguauuauagggcucaacuuuuuaauaagaauaaaauaaauauuguaaggaauugauuuuaauggcuauuaaauauauucagagaaaauaagguaauuguauuucacauugcccuuucugauuguuuaguuuuagguacugcuuuggauacucaguuucuaauuaauuucuagcaaaagguuuauucuagcuaugaacgguauaauuuuuauauagcaucucccuugaaagcauauacaugcauauauauauguauauaaacuguuuaauauauguacauauacauauauauaaagucuguauacauauaaacuguuuuugcucuuuucuuaaagaagagggugagagagaaugaggagcagagcaguagaaaguauggucaaaguuagaaaauaaaucaaaaggauaaugauaggugaaugcuuuaaucugugucuaauauuuuagccacauaagccuuggagucuuuauaguuuacuuuuuauuauauuuuucuauggauuuaaaaauguuuuguauacuuuauuuugaugaauaaauauaucuguagggauaugagaacauugaauauaugauaaaaauuuacccccagauauagacuguaaauaacccugaggggacugggaaagaggaaaaguaugaaauggguuuuagccuuuuuacucaaucacagcggguaagauguuucuauauuccuaaugucauaaagguauauauccugcaguaauuaguaaaaacagacuguuuguuuuguuugugauaguaaaaaaggguuggcugccuuaaagucucucuuugccaaucauuuuuuuuaauuaaagaagcacacaaaaauagauuccucuguuccagaauguguuacugcuaauccauuguaaguggugccagaacaaaguauaaauacuuuauuagaugaagcuacaucuuguaagucaauuccuaucucaccagauguugcuagcuggaaucuagacaucuaagguacuguuuacuagaaucacagaaauccuugguuauaugguuuaucuguugcauuauuucacccaaagcaauguuggcuuuuccuuugcauuuaaguuaacagaaauaagguacaugauccuuuuaaggaauugggcuuacaaagaaggaggugauuuuuuuuuuuuaaaggaagucauuaaaaaugucuggcuaucaagaaaugaauaacucucuagugauagguuuucugugaaugaagggaguaguaacagaauaagagggccuguugauuaaaaaauguuccagaaauaugaccuugucuccaaguuaaaaauacuuuaaaauaucaggggaaaaacguacaaaauacagauagaaguaauuacaaagcagagucucguagccuugagucaucaagagaaagucaaaccauguacauuuugaacuguuugaaaagacacaaauacauaauuugguuuuugaagauaaucuuuuuaaagauauggcugaaugaggcauuucauuagugccuuuuaguuccaagguaaguuauuguuuuaaaaauugugaauuucuaaaguuuuaagauaucuaauaauuagcuguuuguuuuuuguaccuuuacacccucaagauaauuuauggauacuuuguuugaaucuauguaugauucuuaagcagugaagcaauugcagauauuaacacauuaguaccuuuuuugucuuucuuuuuuguuuuacauuuuuuaacuuaaaaaaauguuuuguagagacacagucauguuuuguugcccaggcuggucucaaacuccuggcuucaagcagucuuccugaccaggccucccaaaguaaaaggauuacaggcauaagccuccgugccuggcccuacccauuaauucuuucuuauccccuccccuccccgccuccccucuccucuccccuccuuuccccuccccuccccuucuccuccucuccccuucuuuuuuccuccccucccccuccccguuuccuccccccuuccccuuuucuuacccuccccuucuccuccccucccuuuucccucuucuccucucccccucuucuccccuccccuccccuccccuucgugccccuucuccuccccuccccuccccuuccugccccuucucuuccccuccucugcccuccccuccuccucuccccuccuuuuuuccuucccucuccuuccuuuuugagacagggucucgcucugucucccaggcugguugugccaucuggguucacugcaaccucugucuccugaguucaaaugauucuccugccuuagcuuucugaguagcugggaguacaggugagcaacaguacacucuacugauuuuuguauuuuuaguagagacaggguuucaccauguugcccagacugggcucgaacuccuaaccucaagugauccaucugccuuggccucccaaaguguugagaucacacgcgugagccaacgccccuggcccaacucauuaguucuaugaauaauuuuguugcuccccuaucaguguagggaaggaagaaaacgauuugacuuaaauuacauuauagauuugauuauaagaauucuuauucugaguaagaacuuuuuauuauuaucuuuggaaaaguuauuuaaccacucuaggcuuuggcuuucuaaucuauaaaaugaggauaauaacaggaccugcuauauaguguucauagaagauuaaaaugggcgauggugcuuggcuuauaguuagugcugcugucaguguuugagaccuuuucuaagcagguuaguauucucuuuucaacagagacuucaaaugguauauugugacuauuaucuuuuauguagcccuuaaaacuucagcaauagugauuguuacucuguuuuuuccauguauuuuuuuuuccguguauuuuacaauaaaaaaaauuuggugucucacugagcuacacugagauuuaauaaacuuaugucacugaacgaaggauuucugaaauguagauccaaacuuuccuguguuuauauccaagggccucuccucuuaguguuuuaucuuuaaugaaaaaaguuugugaucauuuuaugucauuaauauugcauaguuuucauucaugucuaaauucucuuaucauuccaggccaaaaauggcucuuuucuugagaugugguauuaaaaauagugcaugccugaagucaggaguucgagaccagccuggccaacauggugaaaccccgucucuacuaaaaauagaaaaauuagcuaggcaugguggcggggaccuguaaucccagcuacuugggaggcugaagcaggagaaacgcuugaaccugggagguggagguugcagugagccaagaaugcaccauugcacuccacccuaggcgacaagaaugaaacuccaucucggggaaaaaaaauagugcauaauucuuagguauaaauuaaccaaguuuuauauauaauauuguccauuugaaugugguaauuguucaaauauaggagguagaggcccuccauccuuccaauaucuuaaauuuuguguguguguguguguguguuucauuuuuuaaaauuauacuugguuauaucacuugguuacauuuuuuuuuuauuauacuuuaaguucugggauacaugugcagaaugugcagguuuguacauagguauacacaugccauggugguuugcugcacccaucaacccaucaucuacauuagguauuucuccuaaugcuaucccucaccuagcccccuacccccugacaggcccugguguguaauauuccucucccuguguccauguguucucauuguucaacucccacuuaugagugagaacaugcgguguuugguuuucuguuccuguguuaguuugcugagaaugaugguuucccgcuucauccauguuccugcaaaagacaugaacucaucuuuuuuuauggcagcauaguauuccauggugugcaugugccacauuuucuuuauccagccuaucacugauggacauuuggguugguuccaagucuuugcuauugugaauagugcugcaguaaacauacauuugcaugugucuuuauaguagaaugauuuauaauccuuuggguauauagccaguaaugggauugcugggucaaaugguauuucuaguucuagauccuugaggaauugccacauugucuuccacaauaggugaacuaauuuacacucccaccaacaguggagaaacguguuccuguuucucuacauccucuccagcaucuguuguuuccugacuuuuuaaugauuaccauucuagcuggcaugagauuguaucucauugugguuuugauuugcauuucucuaaugaccagugaugaugagcuuuuuuuuguauguuuguuggcuacauaaaugucuucuuuugagaagugccuguucauauccuuugcccacuuuuuuuuuuuuuugaugggguuguuuguuuuuuucuuguaaauuuguuuaaguuccuuguagauucuggauauuagcccugggguuguucuuuucuuguaaauuuguuuaaguuccuuguagauucuggauauuagcccuuugucagauggauagauugcaaaaauuuucucccauuuuguagguugccuguucacucugaugauacuuucuuuugcugugcaaaagcuccuuaguuuaauuagaucccauuugucaauuuuggcuuuuguugccauugcuuuugguguuuuagucaugaaguguuugcccaugccuauguccugaaugguauugccuagguuuucuucuagaguuuuuaugauuuuaggucuuacguuuaagucuuuaaucuaucuugaguuaauuuuuuaauaaggugugaggaagggguccaguuuuaguuuucugcauauggcuagccaguuuucccaacacuguuuauuaaauagggaauccuuuccccauugcuuguuuuuguuagauuugucaaagauuagaugguuauagaugugugguguuauuucugaggccucuguucuguuucauuggucuauauauguguuuugguaccaguaccaugcuguuuugguuacuguagcuuuguaguauagguugaagucagguagcaugaugcuuccagcuuuauucuuuuugcuuaggauuaucuuggcuguauaggcucauuuuugguuccauaugaaauuuaaacuaguuuuuuuucuaauucuaugaagaaagucaaugguaacuugaugcggauagcauugaagcacugaaucuauaaacuacuuugggcaguaugaacauuuuuacgauauugauucuuccuacccaugagcauggaauuuuuuuccauuuguuuguguccucucugauuuccuugagcagugguuuguaguucuccuugaagagguccuuugcaucccuuguaaguuguauuccuagauauuuuauucucucuguagcaguuuugaaugggaguucacucauuauuuggcuguuugucuauuauugguguauaggaaugcuugugauuuuuguacacugauuuuguauccugagacugcugaaguucuuuaucagcuuaaggagauuuuggcugagacgauggcguuuucuaaaauuugacuuccucucuuccuguuugaauacccuuuauuucuuucucuugccugauugcccuggcgagaacuuucaauacuguguugaauaggaguggugagacagggcauccuugucuugguuuugaaugaaugacugaugcccagcguuugcuuggcuuucuguauguaaucuaggcaaccuggcuuacuacaaagagaguaagcaaagaguuacuuuguuaucuuuucugugccuuagugcaagucauuucacccccucugaccuucauuuucucauguauuaugaagugaaaaagcugaaauagaaaaucuuuaacacagaagguuccuucuaccacugauuguuuaagaccauuucauuauaugacagcguuguaaaaaaugugauagaauaaaaauuauggcccaguaauuuucacacuuauuuuuaauguuaaucuuuuuaguaaugcccuauuuacauaaacguauauugaccaacuuauuuuugucuugggaguucguugcuuuuuaaaauucuuucuuugcugauaucuaaucagcaacuauauuggacuccaaaauaugggaagaaacuucaaaccacaugugcuaauuacugugaaaagagaugcuagcgaagcaaauaaaaaguuagcuaguuuuccagcuacugcacuguaggugugugaauagccagagggagauuauccagugaccuugcuacugcugagcuguaaauguugcuguacaguuuccuggaauuaucagggcuuuaggcucuugcugagaaaaaauaucuuugggacuacagcuauauuucugacaguggauuuuggggcaaggugucgcuuuaguuagagauaauguucuaaaaacuggaugggaaaugaaagauuaacaaaugcauauaucuacagaaggaacaggauuggaaaaaaagaaaaaagcguauaugcacauuuuuauugcauagaaucuaugugaaucaugcaauucuuaacccauuuuccugauuaauauauuacauauaggggugauuuuucuuuucuuagacauuuaagguagcugcugcuuauaagguaaauaugcagugauucuuucucagcuauauauuaguugucuaggaccuccauaaaaaauuaccacaaauuugguggcugaaaacaacagaaauuucuucuuucacaguucgggaggccagaaguccaaagucaagguuuugccaggguugauuccuucaggagucucugaaugagaauuguucccugccucuauccuagcuucuuguggcugcuggagauccuaucauuccuugguucauaaacacaucacucuaaucugucuccuucuucacaucgccuucuguguuucuuccucuucuaagucucuuacgaggaaacuugucauuggauuuagggucccuggauaauccuguuugaucucauguugagacccuugacuuaauuaaaucugcaaaacuugcuuuuccaaauaagguuacauucauagguucuuaguggaaauaucuucugaguggggugcggggaggugguagucaccauccaacccaccuacaguuugugucuaucuucuguuuaauuaucaagaaaguucucaaaaauuaaaacuuugguugugggugaaaucuuuaacuugagagaagcugguucuuucugcccuuuuauucaaguaauuuuuugaguacuucucugugagucauaauauuucgggacuggaagauacuauaaaauauuuuucuuuugccagaagcacagauacuuuguuuaugguccaacucugaguuagagucaaagccaggccuagagcauagauucugaaucaaguguuuacgucuguauuaugagaccagaaaguccucuguuuauuacauuauuggagcaauuaaauauacauuuauugagcagacuucaaauagcauuacuuuuugaaugguuugggaaagaguccuugggaaauaugaggucugugucuugcaagaacuauuuauucaaggcagucaacauagcauaaugauuaauagcaaaaaauuuguauuaaagcugaauuuaaauuucggcugcuugaccacaugacguucagcaaaucacuuaguauuucuagggcucacaguccuggcucacacuauuuggaaaauaccuggggauucauugggagcaaagggauugaggggauuuucaaauucucaauauuuaaacuuuuuauucaaggaaaaugauucugcuuaauauaaaaaauacaauuuuaauaacaguggcuauuauuuuaccuuuaauaauuuugcuaaaccuuugauacaguuauuuggugaguacccauucuuaauuuuuagaugauaauuguaguuuggaugaugacucuuaaucagaugucuucaugguuauaagucugauguuuggaguuacacaauggcugcuuuaggccagugguuuauuauguuguuuauuucauauugauucuccuaugcuuauugccuguugacguaauaguuaaugaacuucugaaaauacccaguguacaacaauucucauggguacuuuauuaauucaagcagacuagagccuauuacauagaaauagagaccugguccuaagauuucuaacuuacauucauauugauaaaaauuaagcccuggagguguuauuuauaauauuugguaauugguaauguugggauuaaauaauacauuuuuauuucuagguauguacuaggccuuucuugaacuuguuuuauuaagaaguuaaauauucucuguauuaacacuuuuagcuauuuauaaguacagcaaacuaguuuucaaauuaaaauaauuagaaaaaucaaucuuuuugaaaaaugcaaaggaaaauaucuuuuaacucccaagauaguauuccucuguuguuuuugagaauuuccuacuauuuaaauagggauaacuacagauucuuaaaaucagucugaguuaaaaagauuaccuauaauuggaaugacuuggguuaaauuugaguacuuuaauuucauuuuuuucuuaugugucauuugagguuucuuagcacaaaacaauaguucaaguaaauauauucccuuuuauuuacuauuuaaaugaugucuaauagcuccugucuugcuuaacuucaucauuaauauguagcauuuauuuuaauauuuuaauaauuugaguuaagaaaccaauaaaucccccugccuucuuguagcuuagauuguauugugagugugugcuugggccucuagauaucuggcuuguauaacagagguaguaguaccauucauugaaaugggaaacugauaaaaggccagcuuugggaauuaugaguucaguaauauauugacuuuuaucuaccucuugcgacaucuaaauagaagucacacggauguuucaacauucaaguuuggagcucagugaaaaaaguuuaaguugcagauuuaaauuugugaguagacuugguucaggugguaauugaaguugagacauaaaagagauuaccuagggagaaaguacagagugagaaaagaagaaaccuggaaucaguagagccuagaaucacauuaccauuuaaugaccugguagaggagggugagccugcugaagaaacugagaauguguagucugagagguuggaggauagugugguaggggaauaaauguuucauguaggcauacauggucaauagaguggaauuguguugagacgucaaguaagagaaguggaaaaugugucuguuagauuggugaaauggagucuguugguuuccuaagaccaucugcuuugguguaguuauggggugacagccaaauaagagcagauugaggaaugagugagaguagagaaaauggagacagugagcauauauaacucuuuuaggaauuuuuuuuuauaaagggcaagcaguagcuggaacagaauauguggugaagggagagguucauccuucucuuucuucugcucuuuccuuccuuuauuuccuacucucuucccuccuuuuuuucccuaucucucucucacacacacacacacacacacacacacacacacacacacacacacguaaaaacugaagggcugaugggaaagaaccauuugagaagggaugguugacaguaccucagagauccauuagguucuuguaagguguaagguucuuaggaggucaggaagcaaugagauccaaaguuaaguagagugguaauccuaagaugggaguuaucugccucauguuucaaaaaaaggaaggagauuauaauagguagagaauuuuauagcuuugaaaaaacaaaaugaagagguuccuaccuuuguuaauucuaaagaagcuagaagguauggaaaaaaguuguuuuagacauagaaaaguaagaagaguuugaaaugguugacaaugagaguggaaaauaagaaaugaguuggccagauauuuagggcccauuugaaguuaguaaucaugugauacucgguaacaguguuuaguugcuugggugugaacucagagagagcagauaguuggauccauccagggcugaauuuugccacaagggagcaccuaagagacaggguagcaagggaauuuagaauauuggcaagaguaucauugaaaaugauguagcauggcaucuaaguuagauaaagagagaagagaagagaagaugauugauugggagaaagugggagacuacaagacuuaagaguuccagugagauugaaaaaugguuacagcagaacugguugaaagcaaacugaugggauaggagacuguggccagaaagaggggagcuugaauuuagagcuauuccaugugaugauaguguccaagacaaagccaugacugauguagaguggacaaaaauguuuccccuuccaccccuacagauugaaagcuuugugacagcaccuucugagguguauuuugcagaauauuuucucucccaaaagaugcaaauaguaauacauuauuaagacucugagacauauugcauuaaugaaucuguuuaaauuuguuuaacugugcauuucuaaaaucugugggacuacagaagcuuuuguacuaugacaucuauuaauggccauuuaaacuaggguuuuuccauacuuuugagcaguuguuuuauuuguuaugugcugaaacuguuaaauuaaugggaauaagugagaauaauuaucacaacauauguguuuaguuuauaaagaauuuaaucuacauuaauauauaucaauaucaaaagauuucuuuuccuauuaaaauuaaauguuucuaaaaccuaaaaauguaaguuaauauauuguuuuguuagugaucauugugacauuugaaguugcuuauugaaaaucuuuaauuaguaauugauauuccaggaaagccuacuauauuaguucuauacaauaguuacccaaguuggauuaguuaaaacaaagaagaguuuacccagucauguagcuggauauacacagaaguucaaaccaugucgucaaggauuuguuuucauuucgcagcucuaccuucuguuguauggacuucauucucaggcaggauguacugauguccuacagugugacaguuucucucagagaggcugaggaugggacaagcacuuagaaucugacugacuucuuucuaaaaugcaucuccugguuggauuuuauuagcugacaaaagaaguacaauauuauaaccaccaucuuucuuuauuuaaaaauuuuaauuuuucuauauuuuuauuaaaucuuaggauuuucguuuagguucuuaguuucugauuccauucuaauaaauaaaaucuugacugaggacuugaaacuccaaauguucccaguuacuaguugcaguaacaaaaggagcucugauaagaguauuauugaugcauguacaguacaagaauacuaaacauuaaaaccauucaggaacuuuuuagauaaaguuggaaacuuaaaacauuuacagaaaugaaauauguacuuaguaaucuuuauugcguccuugugagguccucugcaacaaauacaaaacccauaaaacuuauccucucuauccccugaaacucaucaauaaaggaaaacaaaacaaaaccaaaccaaaccccacaaaauaacacaucaaacuuuugagacauuuggccuuuaaccuguuaaauuauuuucugaggaauguagccuuuaacuguguaguaauugacugucauagaaaaugguagucaaaaucaaaucuguagcuuuugacaaauuaguggucuuuuugauggacauuuuagugaauaaccauaaaagauguuuuuauguuuuccugcuuuauaaauaaaggaaaguaaaaugaugacuaguguuaaacaaauuacuggccuuaaugaaaagcauaugaaauuuauauccagguuggauauggaaagucacaagagaccaucauuucuuccuaacaaccaaaauaagcuacaaaauaguaguuuuuagaaaccucaucagacagcuaaggacagaaguaaaccuaaaugaaccuacauccagaaagugacaggccuuuuacaggaaaaaauagacccaugauuacuuucauccucgguggaacuguaugagcagaucaauccucaaaaguuuuuaagagauuuguagcaucagguguaggccgaugugaaagauuagaaucuagaggagccuaacccacagagcgaagcacuaucuacccaucuacucuuacucaaguguuuucacugggugaagcaguagaucagagaaggagacuugagagauacuucagaugaaauccucaauacaucagaauggugguauguaggguguguuucugaugaggggugugggcguggggaggaguucaggcagaaaaacugaguacucuaggcuuucacuuacaaaagaauauaagagccccuucccaaacugauucucuguagggaauucugggucuucacauucuagggcaauggcccuucaaagacuaggcuggggaauggguauuagagcugaaaguugucuucuuagguacauaaaguagugggugagagcaaagagacuucucucucccacccgagaggcuguaaagcugggagagaucuccuguauuuccuaaagcugguggaucagcuuugaagcugagggaggaugcuagaaucucaucauggcucagcuuuauuucuagaugaaggaaaacugaucucucucaaaguauuugaaggcuguggcaauugauuuaaacuaaaacuguagcaaaggcuagaaccaacuuauuaacuacagcuccaacucuccagcagccugucaaaaaaaggaguggguauguccauuucuugaggaaaauauucuugaauucagacucuacuguucuuuuauacaaacugucuggccuacaaucaaagauuauaugacacaccaaaaagugagaaauuugacccauaggcaagaaaguagacccagaucuuggaauuaugagauauucguuaauauagccguuacaaaaaugcuuagggauguaauacuuucacucucauuauaagguauuccuugucucacaguuuauuaguuuaagucaaguagaaaaauuuacuguuguaucguuaugucccuaaauuguauuaaaagcagaaucuuaguuaagauaccuugauaaucuaauuuauaauaguuaugauuuuucauacaagcaaauuacacaguuguuuacugagcaaagucaaucagcucuuaaguuguaucagugagaugcucaucaggaagcugguuggugugcaucuuguaguacuggauaauuuacaaaaaacguauuuuggugaaggauggaugaauaggcagagcacagaggaucuuuaggacaguguuggcuacauguuguuaaacauuuguccaaacccauagaauguacagcaauaagagcaaacccuaaugaaaacuauggacucuugagugauaaugaucugucaaugaagguucucaacuguaacacaggcaacacgcuggagggagauguugauaaugguggaggcugugcaugugugggggcagaggacauaugagaaaauccauuccuuccuccugcuuaugcuaugaaccuaagacuguucuaaaaaguagucuuuaaaaaaauauguuuagccauuuuggucacacauuugggaaaagcaccauggaacgugaacuggcuauugaauaggacgggagcuaauuauagccuucuucuugggucuuauuucccuagagacaucuuauuuaagagauacagaauaaagaaagcaaaaagaaugauuuaugacauuuuacaaccuggaucucaccgaacucuauucuguuuuacucuagguuuccuuagcauuguuguuuuaaaacaagaucuuaauaaucauucagauguuuguuuugugcauuugguuucuaauuucauuauuucagaaaaugaauaugcuugauuuagcaaggggguuuucuuucuuuuaauaaauauucuuaauaugcaagcaucaaagagaaaagacagcaugacaaacugaguuacuagagagugaauacuucuaaaaugauuugccuuuagucagaaacccuguugcuaaaacaaaucauuuagaaacuguuuuaauacugaaauucuguauccugaugggaauagaagcuaucuaucuuucauugugcccagcaaaucagcauuuucaaaaccuuagguuacuuacuuauaaaugcauuuuuuuaaaaugaaggacauacugauauuuacaguauuucauuuacauuaugagcuguaauguagaauuuuuucagaagguagucuucucugggguuauaauuucccuguaguuauuucucacaaaaucccucugaauuuuaugccugcuuugcauaagaagccccuaagauauuuggcacucagccuggaguuugagcaugaauauuauauuuuucuugauucuuauugccuccugauuuuaauaaguagcuggcuguuccuacagagccaaauaaucacuuucauuguucuguccaagaauguuauuagauuggguuuauuuacauaagucugugagaaauaauauucaguuuuuguuuuaaagacccguuauuaacaacaacaguaaaggucuuccuuucacgauaguucagccuucucauugguucauauucaaaggguaccucaggcgaacugugacuaacugcuccaaggaaaguacucauugccagccugguaccaugaaacucuucucugggguuuucauuaaugaucagcguaacgcaaaugauggggaguuggacaaaagucacagaauuuuugagaugaaaauuuuaucuagccagugccuuucuuuuuucugauguggaaacugagagccaggguaguugaguaauuugcucagacucauacucuuuaucccuucugacuucaagaaccuuauuccuuugccuuagugccuccuuucagaaccucacuuugagaacuguuauaugcuuuuugguugucacuuucuacagcagccagauaggcagucauugguuagagcuuuugaucuuugucagagccacuccaaucagcagaaccuuaauucuugcccuuuauaucuuugugcuuuagugcgcagggaaugggggcacuaaauggaauauugcagugaaagagccuuuuucacugcaauuuucuaaugaaggauaauuucaaaacuugauagguaugauuuuacuuuaaguaauuuagguauuuuuuuaauagaguuuuucuguuuguuuguuuuuauuuuuuguuuguuuugagacagggucuugcucuguugcccaggcuggaguacagugguacagucuggccucacugcaaccucaaccucuugggcucaagccauccucucaccucagccuccugagcagcugggacuagaggcacacgcuaccaugucuggcuaauuuuuaaaaacuuuguagagauggggucucacuguguugccgaggcugguaucaaacuccuggguucgagcaauacuccccacuuggucacccaaagugcuggaauuacaggcaugaaccaccaagccuggcauagaguucuuuuuaacugauaauagauaaacuuguaauuauuaugaaccagucucuuaguuuuauguguauguguacacacacacacacacacacacacacacacacaaacacacacacugucucauuuaauuuuaaaauaaugaaaaacuauucuuaaaugagaugcgaaacugauacuguaccuagaacuuuucuuucaagccaagguaauaguuguacuuacagcacuuuuucugagcaucucaucagaauauuauuuuacaauuucagguauuauuuaauaacauugcuucucccuucaccccuucauuaguccccuacuaccuccauugugaggggccauccuuuugccagaacuaauuccuacaccuccuuuaucuggaaaauguaucuugccauuacuugaggugaguaaaaugagaguaucaccaccagcccugccaggccuaaaagcaaacuuaggcauuguauucauggcaguugaagggaaguuuuuuaauuuuaauuuuuaaaaguagccauuugauuguuugauguaaaaaucaaccugucaaugaauucagcacagucugauguguuauuagguagacuguaauuuaaagcugauacuagauguuacauagacaggaacuacaugacaaaugaguuucauguuuuauuuguagaaaucugggcaccaaaugaucuggcacugguuggcauguuuuauuaacccuauuugcauuuugauugcugcuauaugaaacuuaaggucucauuauuauuuuugauaauauguuuuuaggccaaccuaucuauaaagaaccuucauaugaaaagauguuuucacuaauuguauccugucuaacacacaauauguuaugcuuuguaacuuaauauaagggagcaauuuuuaaaguuuucuuuauccccuaacuggaccucuccauuagauaauucuaauccauuggguaauuuuaguauuacgcacuuagaaaauguuuuguuuugauauuaccaaaggguuuugggagaaagcauguggccaagaauauguacauuuacuguuacagagauauacccuagguauuggagacaaaagaaacaaaagauguuauuugugaccuacuuacuuguuuuccagaaguaaaauuuggcaucacuaaugcuggaagacauacggaauuagugugcuugacaaaaggaucucuuguucuuuugucugcugcugauuagcaguugaaauguagucgucauuggaaaauugaccaauacuuccauuacaaaaccacacgugcuuugcucuuggugcccuucuuauguccuaguuuugguuuuuuuuccuuuuucccucuuuuuuucugcccucuuaccuaccccauucacuuauguuuauaaaauggaucuaaagauuugaaauuuuaggaaaaguuuccuucauuaugguauaugauauucagaaauacacauuguguggcaaauagcaaucuggauuugguaggauuggugguagguaugucugccauuaccuucuuauuuuacuucauccuccucccacccgccuuucuccuccuuaucaucaggaucauuaugauggucaucaucaucaugugaaucuuugggaaacuuccuagguacugaagugaaauucaccuuuaaaaaauguguuccauauacuuuuauuccuguuuuuuuuugugauuauuuuuucuuauuugaauucccucccaacuauaguccuauccgaaauagucuguuaaauagguuccuuauagcuuguguucuuuuuugcauguguuaauacuugguuuucugugaauuuccuuugcauuucuuguuuucaucuguaugaauucuauaugaauugcuauaugaauuucuauuucuuucuuauuguuucccccaaaucaaaacauuuguugaggggucaguaaaguaaaaugcuauagaguuuauguguauuugguuauuuguuaucuugaaugucaggaaguuuauauuuuauuuaguuggaagacaugauggauaagcuguggauaaguaccuaaauacauaaaugucuauacauauuggauaguuuacuguugcugaaggcuuguuucuuaaucccuccaggaaagaaaggagaggcuauccaaauuugaaucuauucgucauucaauugcuggaauaauuaggucuccaaaaucugcacugggcucuucagcaguaaguaggauuaacucucugugcuacugaaaauggucauugucuagcuucuuucugaugcacuaaugaauauauauauauguguguguguguguauauauauguauauacauauauaaauuugcacuuacaaauggaaagauaagugcauaauuuaacuuuuugugugcauaugaaucugucuauauauguguauaguaaaaucccauguaacauugacauagggaagacagaaauaaacuugaauuauaggcuuccuuuacaauauacaaauaauuaugagaaacauuuuauguacuuugauucuuacuggaauaauaguguaaacaauucuuuucuagugaaacauaaccuuuuuacaguagggauuacuauauauauuuuaaaaauguauuuauguguauauuuauauuuuaaagaacauuuugauuauaaaauugaagucuguuugauagauuaaucauugaaauguggguuuggcauaucacaguagugcuagaguauuaguugucuuuaguaacagcaguuuggccaucucauacacaugaacaaacacacagaagaguuucucuaaagcauuaguucuauuuacuuggagaaggaguuuuuuuucccccucaaacacacaggcacuccaguguauacaccccuaacaaguacuagucuaauucugguccugauggauuuaccuacacuggauauuucacauaaauaaaaucauacaauaugugaccuuuugcauguaguuucuuccauuuauaauucuuccaagguucauccaugucauacaaugugacaguacuucauuccuuuuugugacugaauaauacuccauuguauauauuuaccacauauugucuaucuauucaccagcugauggacauuugguuguuucagcuuguuggcuauuauaaauaaugcugcuaugaacguucguuuucaaguguuuuucuguguauauguuuucaguucucuuggguguguacccaggaguagaauuucuggguuauaugguaauaauucucuauuuaagcuuuugaggaacugccaaacuguuuuucaugguaauuauaccauuuuacauucccauuagcaauauaugaauauuuugauuucuccacauucuugccaacaauuguuauuuuaaauguuuucauguuacaggcauucuagugggcgugaaguaguaucuuacuguaguuuuaauuuccauuuuccuaaugacuaaugauguugagcauuuuuucauguucuuauuggcagcuuauauguguucuuuggagauguguuuauuaauauucuuugcacauuuuaaaauugcuuauuuauuguugaguuguaagaguauauauucugaaaacaaacuccuuauacauauaaucuacaaauguuuuuucucacccuucggauuuuuuuucacuuucuuguuaauguccuuuaacacaccuaaguuuuuuauuuugaugaagagcaauuuauuuuuuccuugacugugugugcuuuugguugucaaaaaaaaaucgucuaauccaagauuaugcugauaauucaucuuuguuuguuuucuucuuagaguuuuauucuuccacuuauaucuuuguuuauuauugguuaauuuuuguauauggagugagguacagguucaaauuuuuauuuauuuauuuauuuaauuuauuuauuuuugagaugagguuucaaucuauuacccaggcugguguugaguuccugagcucaagugauccucccuccucggccccgcuaagaguucaaauucauucuuuugcauauggaagcauauuuaacuuaaaaucuuuaaaaugcaacaacuaugaaucacuguuuaugcaaauaaacauacaaaaauuagaauguuaaagcauaauuuuagauaaaguaaagcaaaugcauuauauauaggaaaaugaaauuagaauuaaucgcaaugguauuuuuacuggacgugacauaacgauuuaccucuguuuuuaacaguaucuuuaaaauguagagcucccuuuaaagacagucuaauggaacgcuuagaucaacagucuugauagaagaaagaacuuaagacuuuggcugauagcagaauuuguuuucaucugaauauuguauuugaugucaucagauguuuaauauuuuuuguuaugaucagaauaauauuuuaauauguuauaucagcuacaagcaugugcuuuccuuuccaguguaccaaagggguuaaaaucccuauuauuaguaucucagauuacugaggcuacaguuacaucuagcaucuuccuaucuuaaggagguuauaauuuugcauugagaacuauuuuucagagacugcuucugaagccaaggccuagagauguuagacaguauuaauuacauauuuuaaaagccuacuggcaaucaugaggguccauuccaauugaaagucuuucaaaccauauuauauuuaaugagaucuguuccagucaugucaagaauauugcccuuuuucuagggccaucuaucuacugcagaauuucuauaaugaguggcugagcaaaucgcuuguuccaucuuacagccacucaugaauacuaguuguaucacugauauauggagugaauaaugcccgucugauaguagcagucuuugaaaaauauucuuuaaaacaaaaauaaagcacauuuugguccaaaugguuuguucuuuauauagauaacagaagaauuauuaaauuauucaacagcagucuccuuaaaauucauauuuucuacacucuguugacaugggugcuauuucaauuuuagaauuacuuuguacuagaauuuagaaaaucaaaauauuagaaaauaaaaauugcuuccuucauauagaauaauauuguaaguaagauuugcuugcuugcuugcuuuuuagaaacaucauucaguuauguuaaguuguacaucaguuguaauauaguguuauaaugcuuggcuuccaccaguggcauaggggaauguagcuauuuucaugcaugaugugaacugcuuguauuuuuuaguguucuccuuugagucuagaaaagcggccuuguacuuucuuuaaucaaggcacguugucaaguucagguuaaauaguauacauuuuaaauauaucaguugucuucuguuauucuuaaggucuuaaguugcgcuuuccccccauuuauuaauauguaaaagagugauaaacaagggaaaauaaagauuuuuugcauuauaucacucucauacacuaaauucugucauguuuaggaaaauuaaguuuugaaucacuugcaguauuacauguaauuuuucuuaaaggacuuauugagauugauauuccauaauuuguacuguaauggaacaaaucuauuguuuauauguuugcugaaaugcuuaaaacagaugacagagaucaugucagacugauacuaaguuuauacaggcaaucccaacuugaugauaaauguuuacauuuacugaaauaugguugcguauugacauauugcaaugaucugguaguaguuuuaguugcaaugugugauaagauuuuagcauugaauauaguuaauugaugaaaauguguucuuacugauauuguggcacauuuuauauguaaaauauauggguuuaaggaaagaauauuugauacugaauaaaaugaaacuauagcaaaaauguguuaaaaugaugagagaggaugagugagagucacaggcacaaucguaaaaguaacuggguaaaaauaauaaagagagaaaagcauguuauuaccaauaaaugaugaguaagggaacaaaagaagccggcaaaaaagaagucggaggaaaccccaaagguacugaaggaagcagaauuguuagaaagaaagaaagguaaaauaaaauacauauuuugcuaaagauagugucccuuaucagagacccaagaagggguacaaaaaggccaggaaaugggaagcuguggagguaaccugauacuugaguuuggcuuaguugucuauuuuuguuuaauacaaguuuuagaaagaauuguguacuaaugcuuaucucugauuaacauguaauucuuuauaguuacuauccuagagaacaguuuuauuguuagcuaaaaaccaaacaaauucaaauucucaaauauuguaguacaaaaaauuguuaagaaauuuaugaauaaaaauuuuacagcuaguuucauuauagaauguaaauauuaggugaaguauuuuuuuuugguuaaugauaccagugcaugaaaaaacugccaauucagcuuuacugcuaaaaaaucagaauuuguagaauuaaagauagucauuuagugccaaagacagaaccacuauuuuaacuaauuuacauccuguuugucuauccugaacacaaaugauccugagguacaaauauucggaauaucuuauuuuucauuauuuuaagauuaauucaauagauucaaacgguaacuauuuagaaauuuuuaaaaaacuggaagggagaacauuauuuuuuguuuucauuuuauauuaaacauuuaguauaucuguacaaauaaaaaaauuauguucaacuaucaaacuagaaauggcauaaaauacacuuuccuaccuaugauuacauuucccuuucacugcaaauaauuuuuacuaccaccaggcacauucgguagacuaguguuucccaucuuuuguaaacaguugauuucucauccccucccaaaauuccuaaguaauacauagcuuuaaaauaaaagggguccuauggaauuaaaaaaaaaauaaauuuauagggccaggcaugguggcucacaccuguaaucucagcacuuugggaggcucgggcaggcggaucaugaggucaggacuuugagaccacacuggccaacauggugaaacccugucuccacuaaaaguacaaaaaauuaaccaggugggguggugcgcaaucccagcuacucgggaggcugaggcaggagaaucacuuggacccaggaggcagagguugcagugagcggagaugacgccauuggacuccagccugggugacagagcaagacuccaucucaaaaaaauaaaaauaaaaauaaauuucuagagauagggccucacuauguuguccaggcuggucuugaacuccugacuuaagcaguccucccaccuuggccucccaaagugcuguuacaggauacagccacugugcccggccaaaucuuaaucuagugccuuagaccacuuagccaugcuaccaguugagucuuaacggaauuuuugagaaauguuuaaaaucuuaugaauuacucuuugucacccuaguguauuacuaaacuagauuuggaauaacuuauuaauuagacuauuaaauuaauguuaauaacuaaauuuacaugagaauagaaaagauaauuaaaugucauuuucauguuaaaaauucagaauuuaaaaaaguuuguguugaaguuuuauuuagguuguucaagcucaguaaggguuuuacuuguauauuuuugaugcuguuuuauucuuguuuugcuuuuuucaaaaugguuuauuguguaauuaauuuuaauagaaucuagaccagauauuuuuaaaaaacauuuuuguuuuugccucccaaaaagaagcucaucuugcuacucaaaugcuugaguaaagguauacaaaucuucauuacauacuugagaauuagccuggaccaggguaaggagaaaaaaauaaucucuuuuucuuuccccaagaaaaaaauauuuucaagugcugccuccuuauugccuuuucauauaaaauaaucucuuuaauuucacuaauuccagcauauuuuugcuggacuauucuuuaggaacaagaucuagggaaaauaacuaauaagacagcuaacccaaucaaucaggaaaacuuauuaaauauaacuuauuaacuguacuguauuaacugaaacuuuuaaaaaggaggcuuugcuccuacccccauaucuuuggcaaaaaucucagauaacuuaccaacaaagaaaaacccugucuauugaggcugagaaagaugggauauuugagguagaaagcuuccuuucauuugugaugucauuauggugggcucuugggauguuacauuuuuuuugcugaugcauccuacauauauuacugucaaguuuguaaaauuguuugggauuucauugaaaucauauugauaaaaauauuccuuccagugcuucuagagaagucuuugaaagaccugauauacccaggcaggggauaugugugacuuuucccuguguauguguguauauacauguguauauacacacauacacugacaguaaguucagcuuauauuucauaacaguguuguauaggggauggggaauaacagaucuuugagcuucccuuccuaccuacaaaggaacuaagaagccuauagaauugaagugugaucuuuaugagauagcaauauaaguuccuuacuauuuaguuuuuuaaaaacaaaacucagauacuuuccccagaugacuuuuucccccauacauauucuucgucauauguuuaaauaaauuucuuggaaugcuggcugagcuuuuguacuuuuuuccaccuuaauuaguucaucgaacucuguucaucauucucucaguuggaaauaaaugcaaauuuggaaggauagauuggcuaggacaagaaaucaacagguagcauccuuguuugggaugcuuuccuguuacguugaccuuuuagagagacaaugauaaaaaguccuuuguaaagauguuacauugaauuucuuguauucaguaauaacuguugaauaaauaagcaguuuugcuauuggugagacagaaauauuucuauuauaguaaaaauuuuagaauuuacucuaauuagaugcacuaucauaaaauuuuaaaauaaaauuuuugauuauaaaaauagaaaacauuugauuauuuuuacuucuuuaauaauuguaaauuauuaguaucaguauauacaaaaaguuaauuuuguguagauuaugcguuuguuuuuaaaagcaauauucuuuuaccucauagucgugggugggucuuuagauaaaauugcucuuuaaaacaauuuuugggaauacauuaaaccauuuuuugaaauaaaauauauauguuaaauaugauacaauauuauuugucauaguuugcaugaaaauuaaaagacuuaguuuaccaaaacuuccauauauagucacaaacggaauauauuuuaaaaguuuaaaauguuauuuaauacaaguggaagaaguaagaaucagaauguagacuuuccuugaggucuguuugggacuuuucaaguuuuuuauuguuguuuuguuuuguucuuuuaaccaacagaaugaguuuggauaacaugaaauagaacuuugagcaguaaguuuugggucuccucagugguacgaaacaauaaaggcuauguuaaaaaccaguuuuuacuuacuacaaaauuaccauacuuuggcccuaccuagaauuuauaucagccuauaaaacuucauauaugaauauuugccuuucguuuauuauuaauucugauuuuuccaauuuauaaauuacuuucucaugaggcauugugcauauuguauuuugagaaccuuaaaaguuaguucagauuacuguaccuuaaccgcaaaguacucucucuaucuggagcaguuuaguuccugugugccauaaaaacaacaacaacaacaucaacaagauucuuacuuguaaucagaaaaugugugauuuaaucuacuaucagcacauuucaaggaaauacaaucaucucuuaaauuaucucugacuugguguuagcauuuggccucuuaaaauaacagagaauuugcuuucucuaccaugcucaugguuuauaaccacuccuuaucuuugccauguguuuguaauugcauguuggugguuuucagugaugcuauuucuccuagggcuuuaucuaccauugcuuuguagaagcagggccagccauguggcagagguaaugguuaaggaagucaggugagugaagauaaagacagaaaggcacagcagcaaggcagcaucaaauaaaaccugagauaguacuccuggaauguaugacacugcucagaaccucugugaucaagaguuaauuacauaaaaaagaaauaacucaacuuuucauuuacauaaaaauuaaguuauuuugugauacauuucuguuaauucccuccuuuucuucauaauuucucugguugauaauuuuaguauauagauuuauuuuaggacauggugaauaagauuaucagugcuaacucuaaaugcuaauauugugucuaccuuuguaugauagauaaaacaaaguguugaagcauauguauuugugguaaacuucagcaccaguacuucaaaagauauuuuagguuuauuguauaacuuuuaauuggucaauuaaagggaggaacauuuguaagaagccuuuauaguugcuaugaauuuuauuagaaaauaaucaguauuuucucuaauuuaguuuuuuuuuuuuaauauuuguuuaagcuuucugauaugaucuccaucagugagaagccuuuggcagaacaggacugguaccauggugcaauucccagaauagaagcucaagaacuguuaaaaaaacaaggagacuuuuuggugcgagagagucaugggaaaccuggugaauauguccuuucuguauauucugauggacagaggagacauuuuaucauacaauauguugauguacguuuccaguuuaguucauauguauauuuugauguaguucauugcgguacaauuauauuaaaauaacgaaugguuugugauaaaugccugcaacacuugaaauuuagcacuuaauuuuuuucugaauuucuuaaauacagugcuucaaaauguacuaacauuuaaauauguuuaaggaaacauguauuuaguaauauuuuaaauuaaaaauaauguuuauaaaaucaaaguauauagcuauuuaaaauauguuguuaaauuugaacauuaaagauauuuugaauuaaaacuaaaaacaaugugauuauuauaaauuuuuuucuagagaaacuuaaguuuaugaaacuuauacuuuugaaauuggagcuuggaauuguuuucagaauggugccaugaaagauuuuuaagaaauauuuuauucaauaguaauaauaaaauuucuuaaugaaugggaugaugguugaauugguuuuuauagauaagcucuuguuuauuggcauuaauaaugaauagaaauuaaugaagaauuaaaaaucuauuuacauugauuauucuaaugcuaauuuauuuuuugaaauuuauuuaaguauugcuaaacuacuuucuauguuuguuacauuucuuuauugagccuuaaacagaugaagaguaauuucaaaauuuagcuuuacccacuaaggaauuuuaauguuuuuggcauaugaaagaauugaugccucuguuuguuuuccauucccaucauuucaaauggccugcauuuucaagauugcuauccacaggauuucauuuuauguugagagacuagggugauacuaauugccuuacagaaauugaaccaugaucauuagaugaacuugagggcuuagauaacuuaguaacagguguauguacacagacaugcacaugugcacauacaucucuuaauaaguuuauauauauauaaaacguaucuuugagcugacauucacauaccauacaauuaaucauuuuaaaauguaggauucaguggcauuuaguacauuuacaucucguaguuauagcuaaaugaaaguagauaccauucaaauagguuaaaaggaauauauccauuaaaguauuuccacuaucauaauguucacacuauucguuaauuuuucguaguauucagaccucaacuugauaaucauauuugcccacauucauacaucuaaccuacuguuuuggaaacuauguuguuucuaauaaugugucauuuuuuauuuccuuggcaaacucuuuuguaauuuguauaugccuuuaaguuaugaauuuagauaaccuacccuauuacaauuugcgaccauauugccaauauuuauuacgugguaugagaauuguagaaggaaagauuguagguaaaguauaaacucguuaaccacaacuuguaugaauguuucauuuuauuuucuaagcucuaaaaguaacuauuuuugaaauauguauuauguaaaccugaaauauuugucuuauuaucacuucuaguuuaaauuguaacuauaaguauuuaaauuagcguucuuagaaacaaaaaggaaagggucagugugcaaauuuuugcuuguuuuuaauauugccauuuuaaguggcuaaaaugagcaauauaauauaugcuaaaaauaagagguuacgaguucacauuugauaguuuuaucugguuuccuucugucacugaaauuuuucaaauaucucuguuaaagaugagaacauuuauuuuucacuaaaugccucagguuuucugcugccuaauuuuauucuagugaguuuuugcuguauaguguugagcuccugaagcaguuguaaacaguuuaagaugauauagacaguuuuaauucuuuuucauuuugugcaggugaaucuuccaugagcuaaaauuauccuauuaauugccucauauaccuguugacuagaaggggucaauaaauggggaaauucauuaacagauauuuaaugagugccuacuguauucuaaugaaggaguuuauauuauacgagcuguaaguaaaugagucaacaaguguuccaauagaagagguuauaaaguaauacaagauuuuagaggaguuaaaaauauuaaauaguugaucaauaaaaagagcacugaauuuggaguuagaacacuuggcuuucaguccuagcucugucuuuacuuguucugugguuuaggaaauaaaggggguuaauaucuuaaagaguuuuugcgagaaucaaaucagugaauacauacuuugcaggacgugaaauuaaauaaaccaauaaggcagcauagaaaugaauacuggaaagcucauguacucaugcauucaugcauucaagacauugaauacaacauuuaauacaaaguauaaauagacauuucuccaaaaaguuguacaaauggccaguagguauuaugaaaaaaugcucaguaucacugaucaucagagaaguacaaaucaaaaccacaauaaaacaucauuuuaucccaguagaauggcuauuauuaaaaacacaaaaaaauaauaaaugcaggcaaggauguggagaaaagggaacucuuacacacuguugaugggaauguaaauuaguaaauucauuauggaaaucaguauggagauuucucaaaaagcuaugauagaacugccauaugaucuagcaaucccacuacuggguauuuauccaaaggaaaauaaaucaguauaccaaagggauaccuguacucccaugcuuauugcaguacuauucacaguagcaaagauaaggaaucaaucuguguccauuaacauuuauuauuugucuggugauuugacaauugaaugugugccaguacauguaccauauacuggguaaagugguuugcauguuaauaguuauucaacucuuuuacucugugaggagguacaaauauuaucucuguuucacuaaggaauaagcugagacacugagagaucuuucucaguguuuugcacaccuagaaacauauauuauuagaaauagguuaguaccuucagugugaaauauucuuaaggaucagugcuaauauaucauaggaggucugccuacuauguacaaaaguucuuuaggcagugaauuaacaacugcuuugaacugauucaaacacuaacugcccuugaguugauuuauucuccauaguuaaguguuaaaguaaacuaaugcguguuuguucauuacucaaugaaacaaauauucauuuaaaaaguuuuauauaaauuaaauuuugauacauucaaucuuuuuuauuuuauaguauggaaaaagagcuuugaguuuuuaaacuuucagcugggaaaguaaucuuccaguaaugcaaguaaugucagaauuuagucaguuucgaaaguucuuauuucuucacagcauuuucuuaaaauggggguacucccauaucuguauuuguauauaucuuccuggguaugagaacuagcaguuggaagcuuuuguuacauugcauugcaaugcuucuugcuuugaaaaauauggccaauaggguauuuuugauuugccagguuuauugcuaucaauuuauccauaugacaaccuacucauaggccaauuugaaauaugaaaacaagagaaaagcggucuuggaggaguuugaggaaaauugcaccuuaccuggugauaugcaauuaaaaaaugcuaagauuugagcguguugauaucuacaguuuugucacuguugcauuuuauuucuuuauccaagaugugugaaugaguguuuuugguaauuaauaauaaaugaauacuccacuacagaaagcaaacuaauacuguaucagcagauagaaaauaaaugaucagauguauuaaaauauuuaccaucagauuggauaucuuuccuuauauuuuugacauuuuugauauugaaaguuuuaucaaauggaacacauauguagacauauguaaacauguaucuuguccaguaacucagguguaucccaugcuuuguuuccuuugguuagcauuuuagcaaaaugcauuucaggucuguuuguuagauuuuuuauuuuucaacaauuugaauuagauuuaaacauugugaaaauugauuuaucugucacaagguagaauuuuaaaacaugucagaguuuuauuuaucuauuuauauuuuuaucaucuuaaccauuuuuaaggguauaguucaguaguguuaaguauauucacauuguugugcaauuauaguuuuuuuaagaaaggaaucuaauuuaucaaugaauguagauuuucuaaagcaaugucuucacauuuauucuaccuuauuguucucucuccagaacauguaucgauucgagggcacuggguuuucaaacauuccucaacuuauagaucaucacuauacaacaaaacaggucaucacuaagaaaucagguguaguucugcugaauccuauuccuaagguaggugcuuauauacuuuuuugucuguuuguuuuaaaagaauuuuuggugaguuaacauuuccaacaguaaauaaaauucuuagguuauaugcuaguaguucagaaaaaaaguuuuguuuuuguuuuucuagcuuuuauuacuaaugcaauugaaacaugaaacuuccuugauuuuauuaagaugagcugcuuucuuauucaguauuugcuaguauacagauggcuugguuuuuuuuccccuuuccuaguuuuucuucagacuugaggcuuuucuucacuuuauaagguucauacuuugaaagguucagguuauaacagauucuaaguuguauaagucaaagaaaaugucuagcaguuaggaauaaauuaggguuuuaauuugggauguuacauuuacaauguauuauaagauauuggaacuauuaaaaauuagucuacucuucacagaagcaguaaaucagaaacuuaucuauguggagcaaggugguuggauaagagauugucuuaggucauuuuuaccucuaugaucuaucacagaaaacacuacuuacaugugcuuuacaagauuuguucaauaaaguauggguauguggaaguuuuguguuuuaaagguaaaaucuuugggacuuaaacugaaguggaauaauggaacuggcuuaguuucugaucacuuuugauguuucaggaguuggguugguauuggcaagagcucuuuccuuucaggacugucuaauaugaagaacagcguagaaauaggaaagccacacaacuugguagauuaauauuuguugauaugacuuuuauacauuuagggauugcuuuuaauuugaaguaagugccaguuccaagaaugcugguaccuagucuggauuuagugauuuggaaauuuaaaaaacaaguauuuuauuuccuuuuguuaaucugggauauaauaucuauauuuguacuuuuauuguacuacugagucuucacugagagggugaccuuuaauauuucucucacagaagauuuuaacaguuguuuguuaaacauucuaauucucugguuaaggaacuggcuuucuugaacaguuuucuauaauuaugaaauuggcucauucuuuguuaaauuuuuuuauucauuuucuacccuuaauuaccaaaaccauaaaaaauucuucuucagccugaaauagguugucacauuuuuucuauagcaaaauauauauauauauaaaucuuucaauauuuccuccuucaucuguaaaugaaugcuguuauagaauucuaagauauuuucucuuuagucaaagcaaucuauucucauggcuuuauuuacuauuuauauaucaacaauuugcaaauuuauauuuauaacucagauuucuauuuuccaaaacugaaauuguucaaauuuccaccucaaacugugcuuaucaccuuuaacuucaaaauuuguuguuucuuuuuaaacaagugaugccaccaaauacccagcuucucaagucauaaauugaggggucuucuuugacaucucuuucuuuuacaucacugcccucccucuaacacucuagguuacaauuaaguauauaucucuuaaaaauacaaaaguuagcuggggguaguggcacaugccuguagucccagcuacuuggggggcugagaugggaggauugcuugagcccgggagguugagacuguagugagcugugauuguaccacugcacuccagccuaggcagcagagugagacccugucucuaaauaaaguguuuuguaugcuuaauuauucauguggaaguaugaacaucaauuccaguauauaucaguaugaauaaaauucagugcaggaagauauuuuuuauccagauuagguuaacaaaauauacaaauaggauuucagagauacugaugucccauuucacaagucaaccaaauguuugcauugucuacaggcuuagccaggucuaaauugggagaccaaaucuauaaaagaaagaaauaacaacgcagguaugaguuugacuaggaauacaaaauuucaaauaaagcuauaccccuuauaauauaaaauuugcuauaaaacuuugauaauagauuagauucucuggacuauuacaugguuaauuauuguuuuuccaacccccaacacuuuggaauugauuaucucaccaucugauagaacuagcuaugaaaauaaauauauacuggaugcuguagaaauuaaaucguuauaugugauuuuuuauaugagguagaaauuuaaaguuuaucuggguauuaaccuaaucuaaaguacugguauuugaaauaugcaaaucauuaucucaguuuguugcaaauauuauacacugauuuaaagguucauguugcucuuuuaaaagaaaaucacaaagcagaagcuuugaguuagauaauuuucaacuaugaguacauaacaaauugauauggauuuguuauggugguaguaucuguuacuuaucuuccuuugaauuauuuguacucuuauaacugaaucuauuucuugauuuaauuugugugaaaaguaaaugucuuugauuauauaaugugcuguaaaauauuuaauuucugucuugcuagacuucauuuuuagccuaaagaauuccacuuuaguucauuguaauuucuauuucccauuuauuucucuucccauuuaucucugcuccuacccauaaaaauauguuuaucaucauaaugccuaacuugaggacagaauggccaaaguaaucucuuccuuaccuucacauuuuuaugcacauucacucagagguaccgaaaacuagacaggauuaaauuguuuaacuuucucacuuuaugaaaacuagugggugccugagccacccaucccucucccugauuuuuccugcacugccuucagagcuuguguaaacauauggaagauggaagaaauuuuuguaaagagggguuauuaaucacccguuaucaucauucuuacauuagcaaacaaguuggacauguauaugaccuguucuuuacuuaauucaguuucuacucaaaugucacuucaucagggaggccuugucugacuaccauguauaaaauaacacaucaagcccuuuugcucccccuucuucugccuuuauuucucuuugucaugcuaacauuuaagugacauuauauuauaugauguauuuuuaaucauuugucucucccaaguaaaauaacuucaauagggucacaguuguauuuaacaauuaguguaguguauuuccagugucucgaagagugcugacccaggguaacauucaauaaauauuuguuagaggauugaauucacugagcaauggcuaggagcccagguaauugcugaccuuuuuauacacauuaucucauuuaaccucacauauuccuauaaaauauuaauaagaauuguuguuaaucucauauaauauuauuguugcuguuauugcuauaaaauauuaugaaugaagagcuaaagauuaaaaugguaaaugaauuccccaagaaaacagaacugguuaagaggcagaucuggaguuugagcccacauucuuaaccacuauauauuuuuccagauuguagagucuaaguuuuagaggcuaaaauaaacuguuuaauuaauaugaaugugaguuuaaggaagaggaaaucucuuucauucuauaaaauauuaacuugaacaagauuuuaauauaucaaaaacuauuuguuucuauaaaagaaaaauuacugaacagcaauauuggguagggaaagcuaggauuugagcuaaaauauagggauuggucaaauauauuuaagaaagacaucuaguuuaacauuuaaaugacacuuuuggaagauauuugcuuuguuaaguuuaauauuucuucauauuuagauguuuuuaaguaagaaaucgcuuucugaaucgaagguaaagcaaaaacauuuaugauuaaauguagauuaggccaagugcaguggcucgugccuguaaucccaggacuuugggaggcugaggugggcggauugcuugagguaaggaguucaagaccagccugacuaacaagugaaaccccgucucuacuaaaaauacaaaaauuagccaggugugguggcacacaccuauaaucccagcuacuuggggggcugaggcaggagaaucacuugaaucugggaggcagagguugcagugagcugagauugugccacugcacuccagccugggcaacagagugaaacuccaucucaaaaaacaaaacaaaacaaaaaacaaaauguacguuagauaggcagagggcaauuaauuugaaccuuagacaaccagcuuaaauuaaguaauuguaauuguagcuuuuuaccagaaugucauauagauugucagaauauuagaguuagauuugugagaggagaguaagucugugucugaaacuacugacuuguccuggggagacagguucauggcagcaacauucaugauuaucagacacugcaaaggacaguuuuuaagagaagaaacugcacuuuaagcgcuguuuacauuguuaguuuuagaugauguaaagaccauuuuaucuuacaucugauauagcuugccuuuuccaauauuacuguuuaguaauuuucauuuuauagaggcuuauaauauaguuuuugauauguugaugucuuaccaauucaucauuuuaugaaaucagucuuccuuuuccuuaagucuauauccauguucuucaauucauuaagagcuauuguguaauuuuuaaaauaauuuaauuuuuuaagaaaggaaugaaaaauauaugugauucaguauucauuuaguaaauauuuacuuaguacucacucugugcuauguucuuuauuauguuagagcgaauaaauguuaugaaaaugaaguaggguaaggagauaaugaaguucuagacuguguugaggacaguguuuagguaguguguguguaugugcauagagagggcuaauuuuuuaaauauuaucaaagaaagccuccuaaugaauuuuggacagagacguaaauggaaacagggaguuaucugugugguuguauaaagggguaauggugaaaguguucagcaguuaguacagcauguguaccaaccuaucagaacagaugccagcagcaaacaauucgaagagccguagagguguuuacugacugucuauucuccuuguguaccuggggaagaguguuugcuggugugauugaagaacuacagagguuaguauggcugaagcagaguggucaaaagggagagugaugggagaugagcgcagauuuggauuaauuuaauaauuaauacauaucaucuuaaaaggccaguuuuucuuuguauaauuuaagaaauucacaucauuugaguagaaauucagcauaaaauuuuacaaguuuucauagugggucucuugaaacaaaagauuuauguuuaauacugguagugaauuucaagggaguauauuuaguagaauaggccauccaaauaaauuacaguaaauuccauguuuuuauuucuaagaacuuuuuucccaguaacauuauuuuuggaggcaucuaguuagcugugcuuuugcaguuaaucauuuuaugcugucacuuguaugggcuuuucaaaaauugcugugugucgaacauuugaaaagacauaagagugaucuuuauuuuuagcucuuuaaaauuagauaauuaaauaucaaauuggauuuccaggcauggaaacucacaguuugaaaaaaacguucugaacuggaauacucacuguuaagguuucuauuuaauuggcuuuuuuaaaucaauuaauuaggucuauugagagugaagagcacaaaaaaauuacaaaauguucuuuuuaggaaauuuaucaggaauauauaaaucuccaugucggucuuggauuugagcacagagaauccauuuuuaaaucccaguuuucacuauuaucagccacaucuucuuaggcaagccagccuucuaacuucaucuguggccuacaauaaccucacuuguuauaaaaaucaugugugaaaaucucuguaguuauaugguggaaacugcaaaauagcguauaguuuuuguuugaaagcauuuuucgcaggacagauaaauaauuaacagaaggaaaauuuggagcauuuuaaauugugaaagaaggaaaaaaaacacuugaguacuguugagaauacucuaccucuauuauuuuauuaaaucuuuucaacaacugugaauuugauuauuaauauuauccccauuauuagguaaggaaacucagacauuauaauuuacccuaaaucaaauuuacuguaaguuucagaguuguuaccugaaagggauucuguucuauucaucaucuuuuaauuacaacuccagcuagcauaaaucauaaucucuacuaucugauuaaugucaauagcuuaacaaaaauuuuuucuauacuccaauauuuuagcaccaggauauaagugaacuuaacagcuauguccccaacccacaugaaagucuagcagagacuauaagcguguugugcuaagggaaauacagggugauauuugacuauauagucacuacuuaguauagucugcaaaguuaaauuaagauuggacuuuaggcuugaucuacuuaauaauauaaaagaacccuaccaugguacauauauuuaauaacacccagacugauuuuuaaaacucucauccucuaccagcagauauuuugaggaaaagcaaugcuaguaucaaaaaaguaauagacuuuagaaaccacugauguuccauaaaugauacuucaaaaguuucacauccauaagccuaccucagacuuucuuaaauaucauuauguuuuuagucagaagagccagguuuucaguaauuacuucuauacauuuuuuuugccuacuuuauaaauauuugaagggaaaugggcauaggcagguaaggucuauuaaaagaauaagucauuggaauuuuuuaaugcaaauugaaaggcaggauuugauauuuauagcacaaacauugccugauauucaccauuucaucauuuuaaaguauuuauuauacuuccuuuuucuuuucuuuuuuuuuuuuuuuuugagauggaguuuugcucuuuugcucaggcuggagugcaguggcaugaucucagcucacugcaaccuccaccuccuggguucaagcaauucuccugccucagccuccugaguagcugggauuacaggcacgugccaccacgccgggcuaacuuuuguguuuuuaguagagacgggguuucaucauguugcucaggcuggucucgaacucgugaccucaugauccacccaccucagccucccaaagugcugggauuacaggcgugagccacugcgccuggccaaguauuuauuauacuuucuauaugcauggacuuuggaaagcauuucuacaaauguacuuuuguagaaauguacaacaaaauguacaauauuucugauaugaacauggauguauaauguauaauucuccccucccccauuucuuguuggaagccauagaacaguaacaaagaguaacauacacaguaacauugaacaaacauagaacaaacaaagccauagaacaaaaacaacaaaaauuggaaaacucguaaacugcauuuuucaugaaacagggacuucagaguauaucauaaaguagcccaaagcaccuuaugacacaugauuuuucucagucacuuuguaagccacggaccuucagccagugaugcccccaccuaggccucacacagccacuuuacuugcugcaacagguggccugcucacuuggccugcccgggccaacccuggcuuaugcaccagcucagcccgccuguguuauaguugguaucacauucaacuguuuccaaguucuuguccugcguccaagaagaauaaggauacacugacaauugaagggugaugagggcagagaauaauuuuauugagcaacaaaacggcucucagcagagaggggacaugagaguggucagcuauccugagucagcugguuucucucccaguguggcuaagucugggacuucuaugggcucagaauaggggagugugugcugauugguuugugaguaugcagaaaagguuaaaagaaaggcaccacugaaaguugggcaugacagugugaaaaaccaauuaugacgccaggcacgguggcuuacaccuguaaucucagcaauuugggaggccgagguggaugaaucuccuaagaucaggagguugagaccagcuuggccaauauggugaaacccucucuacuaaaaauacaaaaauuagcugggugugguggugggcaccuguaaccccagcuaccuaggaggcuaaggcaggagaaucgcuugaacccgggagguggaggcuguagugagccaagauugugccacugcacucuggccugggcgacaaagcgagacuccgucucaaaaaaaaaaaaaaaaaaaaaaaacaauuaggaaaggguagguaugaguaaaacaggugaaagguggggaaagugugccaaaugggaagacaggcucucaauguaguccauaguuugacuuguggcuuggcuuucuggcuuuaaacugaaaaagccuggagguuuuggcuuggaguugggguuucacuggggaccugccccuaucugccuaggcguuugucugccucuugcugcuaucacauagauuguggagaaaucacauaauaauaaaguuaagagaagauauaaucagagaaacaagcugcaauguauuuuaccaccuccaacaaaaauuaccugcuaaaaguggccgggcacaguggcucaggccuguaaucccagcacuuugggaggcaaaggcagguaucacuugaggucaggaguucgagacaagccuggccaacauggcaaaaugcuuuuucuacuaaaaauacaaaaauuagcugggccugguggcgcaugccuguaaucccaacuauuuaggaggcugaggcaggacaauugcuugaaccugggaggcggagguugcagugagccaagaucaugccacugcccucuagccugggccacagagagaggagacuccaucucaaaaaaagaaaaaaaauuaccugcugaaugugaagaauguacccuuaaauucuaaggcuguauuccuugcuuacaaaaauggaugugagaaagggaugaaggaaauaaaaauuuaugugauauguuaauuaauauagccaaaacugcccuuggaggaaaauucagagccuuaaguacuuguauuaauaaaauaaaaagcaugaaauaaaugaguucaucaucucacccaaaacgaggaaaaucaaacccacaaucaaaucaaaggaauauggaagaauggaaguaauaaaacuaaaagcauaaaggaaugaauuagaaaagggaaaaauauaauauguauauaauaguugcuuuuagaaaauaauaaauaauuaaaauacuuguuaauauaaucaauacaaacucauaccacaaaagggugaaucucuucaauauacagugugcuacuagaaauggauaaggacaaccaaauaaaaauauuggcaauggauauggggcuacuuuagaaaauagaaauacaaaugauuuuaaauauauuaaaguugauuugccccauucucaguaaaauaaaggaaaaauaaaaauauauuuauucaccuauuagauuagcauaaauuuaaaauuuaauaacagugucuugacaaagauguggauaaaaaugcucuuugauacuuugcuguugaaaguauaaauucucaacaacaacaugaaaaaccacuauagaaggcauuuuggcagaaucugucaaaacuguaaaauguauauaucuuugauucagcaauaacacuuuuacaacuuauccuuuaguucuaugcauguaugaaguugugucauuccaagguuagucacugcagcauuguuuguaauauuaggaaacuggaaaucauugaaauuuucaccauuaggggcuaguuaaauaaauuauaguacccuauccaguggaguacugugaaugaggaaguucuauauguacugacuggggagagcuccaagagacauuguuaauacaaagaacuaagcugcaaacaguuuagguuauguuguuaccuuuuauauaaaaaggguaggaguaugauuauaagucugauuuugcuuuuaugugauaaagaaacuuaaaaauaauacaauaaacaauaacagauuacauguuuggggaggugguugaaauugaaagcagagguuuaggggaaacuuuuuacuuguuauauuuuacauuuuaauuuuuuugaacacugugaauguauuaccuauucaaaagguaagauuaagaaauauugaaaacauggcaccuguccucaagcaaauauaaauuuuuaggaugaugcuuuauugagaaauuauugauaagaagacaaaauauucaugcuauauauuguuaaaguaggaaaagcaguuuauaaaauagcauuaugguauuuaucugauuuuuauuaaauaaaguauagauauccaaauacauggaaaaaguuggaaggcuauauuccaggauauuaauuaugauuaccuuagaguggaguaguaaugggugauuuggggcaguuuaaaaacguuuuucauugaacauguuacuauguuuguaauaugaacauuuucuaaaauuauauuacaugcuaauguuuuguagaacacuauagagcaauguuuuaaaaacuauuuuucccauaauuuauaugaagaaaucgcauuguaguuuaagacucaggacacacaaacuugagaguauugauauuuaugugugugcguaacuaaaacaaguuuuccaaacacuguuuuaugcuuccuaaaugagcugcauuauauuuaauuuauuugauuuauuuauuuauuuuuauuuauuuauuuuugagacggagucucacucuguugcccaggcuggagugcaguggcgcaaucuuggcucacugcaagcucugccucucagguucacgccauucuccugccucagccucccaaguggcugggacuacaggcgucugccaccaugccuggcuaauuuuuuuuuuguauuuuuuaguagagacgggguuuugccguguuagccagcauggucuugaucuccugaccucaugauccaucagccucggccucccaaagugcugggauuacaggcgugagccacugcgcccagccuauacuuuauuuuuagaaguguuuacagccaauaaguugguuucuugaaccucaauuugaaaaguauuuauaugaaggauuuuuaaaaaucaacaaaagcuauuucuaaagucgcaguauguguuacgggaauucagaagagaggaaaaaauuggcugggaaugguuuaaaaaggaaaaugaacuugaaguaggucuugagaauaggcagaaggaggaggagggaaauuauuugauaagaggagaagcuaaacaugggaaauuucuaggccuguuuuaagucaggcaagaucaguuugacagaagcaggugauuuggaaaggugaauaaucugaaaaguuuagguuaaaaucagauuuuugaaggcccugaauaccagaauugugauggaaaaugccauucugguaaagguuuauaagcaaaggauggaugugauauaagcacaucuuaaauaugauggugauaccacauacuucauaccucauaugugagauauauacauaacucacuaaaauauugaaacuauuccgauuuuuaauugugggaagaaguuaaggaauucauuggcacacuuaacagaaaaaaaucaauguucauuuuaccauguuucaaauaguacuuguguagcuaaaaccaauuccuaguauaauaauguuaaaauaggaguagaaacacaauggccaggcucaguggcucacacuuguaaucccagcacuuugggaggcugagauggaggaucacuugaaccugucucaaaaaaaaaaaaaaaaaaaaaaaacccagaaagaaagaaagaaauucucaguacuggagaaaaauaaguaaugguaggaauucagaaauaguaaauaaaauacaggcuucuaauggccuauguauaauuuccuuguugagcuuaaaauuuagcuguaagcuuccuggaagcuguuacagaaaaggaguuagcuaauuucaugauuagaaaggaagaaggauuuuaauuuguuuaaagcaaaauuuuacugccaguaaguucuaagggaaauuucucucuugggauuuuagauaacaguguccucaacaauauuuuuguacaaguuuagaaacagaucucauagguuguugauuuuagcauccuuuaaauguagccaagguuauaauauuaaaacacagcuuaauaaagaacauucuacaucagcauuuucccccuauuuucaauuuuuccugaauagaauaguaaaauucuaggacuccagacuuaucaaaauauuaauaaaaauuagcauuaaauacauuaaaaaguuuaaacaacucagaauaucaaggguuauacauaugacauuuacaaauaucucaugauauuuauauaccugaacaguuuaauauuuagucagguucguagagaaugcacaugcugagugaaaacaaacauuaagauguaaugaauuguugaaguuuuuuuucccuuuaggcuuugcacuuuugaaaauauguuuccaauauuuuauuuuauuuuauaaauuaucaguucaaaauuacuuaauuuaauggagguucaccaucuucuuuaauguuuugcuuuuuagauuuugaacuuagacauugaggacacauuugauauucuauaaaccccaaaagaacagaggaacucugauacaaggauuauuaguguuuguacuucuauaguucaagcagaagaaaagugguuaucagaauggagggacagaugagaggugguaaggagugaguguggugagucugugagcaguaggagugugacagagagaagaggguaccuucucggccucugucuuggacuggucucuucaacccacauaaccccuuauucuuaguagucuccucccucugucccuaccugcagcucacauacacuucugaggcagaacaucucgcaugaugauauuuucauuauuccaucuucauuauuagucuccuuuaguugacauacauacucauaaagcaucucauaaaaagucuucuuccucagcuuacauugaucuuugaaguaguuauggcauuuaauuuauucagucuuguacuauguuaguuuuguauaucugacgugcccauuaaagguguuugagagcaauaaggauauuuuuacucacuuuuuuguaucucucagagucuuacguguaauauacauucaguaaauacuugauauuauuuuugaaaaaaucuagacaucuaagaagugcccaauauaacauuugaaaaauauaaacaagacucauauucuauuuucagaauaauguagaaauuuuggcuuuuaacgauuccagaguugggcuuuguuuacauuuauguguggcaucucuuuggaaauaagauauauccaguuucaauucuauuuguacaguaauuuacuuucuauuuuuaaauuauauuugaagugaguuuuccauguaguuacagugcucuucggaaacuucauaaauguuuuugaguacagauagaaaacauuucugguugcacucuuauucagcuuaucuguauuuuauacuacggcaaacuauaucuaauuguuuccauuaaauuuauuugacaccuugaugagauuucucucugauauuaaaguggugacacaaucuuguguaauauuuaauauuccuuauuugaaaauuaaagcccuguauuaacccauuugaaaagugagaaugauauacaagaacagacauacuuguuuucacuuuaaaaaacaccauuuaucuuuaucauauuaauuaaauuaguguucaccuucugcuaccuuguccuucaagggaacgauuuaauugugccacaaaaggcuugucccacauucuauuuuauguagacuaaguuugcaugcuaagaauuuuaaugacaucaaaauacuaggauuuaaguuagaaaaaccaaagacauuaaaaagauaucugcaagugauuuuuaaaaaacgagaaaccucauuguauguauuuauaagccuuacagaaaaaugaaacuucuuuuuguuuuuuuuuguuauuuauguaacaauuuguauauauuaaaacuacaccaaaaauggauuuuguagcaggaauacccauagagagaaauuacaaucuuguggacauccuugaacguugauugauaguuauuuaaauuaaugagaaauagaaucaaccucagcaaaaaucaguuacaauuucuuaugugucucuuaguaaucaaggauccucaucuucacaccauagcucucauuguuucauggucuuaccaugagggauacuuccuaaugguggccuauaagagguaugauuuucucacuacuuucuaguaaugcuguauucucuuuuaaauaauaaaucuauauccuuuuuugacucuagaaucacuucaguuggagaccuuaggaaucauuucuuaauguucauaauacuggaucaugagauagucaauaaaguuuucugagucuucucuagaaauaaguuugaaaagacuucuucacuucuauugcagucuugaauguggguuuucaggaagaucaucaauguucaucugaaauaaauaguagaaauuuucgaggaaucccacagcucuuaagcauuuuucugauuaucucuugaguuaacauucaauaaauacguauuuaguugcuuaguauaucauagaaauuauauuagguacugaggauacagugaugacuaugacaauauuugccucaaaagaaauuaagagucugguuggcaagauagauuagugagaauucauucaugauugaggugaugaaccccauuccagaggaauuuuaugguauuuuaggggacauaguauguuagacaguugaggaaaggacaaaaggugggcugaguugugaagaaugacuacaacugcacuggugaagggccugagacagcauaguuuuucagaggaggugcaucugaucuuggggugaaaaauucuguggcacauuugaagaacuauuugaaggauucuaucuuauacaccuggaguggagacuacauuagucaucagggaaagagaggaaaagaggcaugguagauagaauaauggcuccccaaauaugucuacacccuaauugcuggcaucugugaauagguuccauuacaaagcaaaaggaauuuugcagaugugacuauguuaaggauuuugugauggggagauaguucuggauuauccacauggaccucuuguacucacaaguauucuuaccuggaagaggaagguagaagucguagucagacaagaagauaugccuacaguaugacuacaaaacuaguuacauggccaagguccaaggaaugaugacagccucuagaaacuggaaaaggcaagaaauagauuauuuccuuauaaccugcaaaaagaacauagcucugcagacauuaugauuuuagccccaagagacucauucuggacuuuugaccuccagaacuguaaaauaauaaauuuguguuuacuauaaagacacaugcauauguguguuuauugcaauagcaaagacuuggaaccaacccaaaugcucaucaaugauagacuggauaaagaaaauguggcacauauauaccauggaauacuauggagccauaaaaaagaauaaguucaugucauuugcagggacauggaugaagcuggaaaccaucauucucagcaaacuaacacaggaacagaaaaccaaacacugcauguucucacucauaagugggaguugaacagugagaacacauggacaccgggaggggaacaucacacaccggggucugucggguugaggggcaagggagaggagagcauuaggauaaauagcuaaugcacgcggggcuuaaaacguagaugaugggucaauaggugcagcgaaccaccaugacacauguauaccuauguaacaaacaugcauguucuguacauguaucccagaacuuaaaauaaaauaaaaauaaauuugucuugcauuaagcuacuaaauauaugacaauuaguuacaguagcaguagaaaacuaauacaggaggugagguuggagaagggaaaaggugccaaauaauaacauuucauccuaaaggguuugaucuuugggggcaacaggaaauuuugaauggucuuauacuaggaaaagucaugaucagauuuguauuuucuacggauaauuauggcuucaucuuggaaaucacuuagugaguuguugacagguaagaaauagaagugacaaugagauguaaaaauguaaauuuggguuuuagagaaugauuagguauuuguggggguguugauugcuggauaaaauuacgaaucauuagcuuaguuaucugucagaaucacuaagacuuggcaaagaaguugaugggugaaagagagguuuuaaggauuaccuucagguuuauaauucagcagcuaggugaugaugucauggacugagaugcuauaggaagccagguuaaggagaaaauugggggcaugcuaaguuuuacauauaugugacauuuccaaauagaugugaccuguaggccgauggauauguauaucuggaauuuagaagcaaccucagggccacagauauagauaugggagucaccaauauguagagaaaauaccugaagguuuggaguaaaugagaaaauauuuagcaugcgacaagggccuaugacagauaauucagggauggcagaagaggaggcuccauuggucucucucacuuauuucuuccuuucacucauguugcugccuuauuuauacaggcuuucaucacuuuaaaccuagauugcugauaacucaucuacuucucuuuccuuuaggaucuuuuccucccucuucucacuagaauuauccuucuaaaauaacauuuuauccuaucagauugcuacuuuuaaaacuuaugauacuucuuuugcuuuugugaagcaaugcaggccucuuugucucaucaagguuuucuaaggugggauccuaguucaccugcccaauuuagccccuucuuccuuuguucccuuuccuuuagccacccuguuagaaugcauauacaguugacccccugaacaaucugggggugacgggugcugacccccugcauagucaaaaaucugcauaugacuuuugacuucccagaaacaacuacuaauagccuacuguugaccagaagccuuacugauaacauauuuaacacauauuuuguaugcuauaugucuauacuguauucuuacaauaaggcagagaaaagaaaauauuacuuuaaaaauuauaaggaagagauacuacauuuauaguauuguacuguauuuauugauaccguaaguuuguaucaucuguuuacaagaugaaugaucucucugacauggugggcaucuauagcuucagaccucaaucuauggugcauaucaagcaauucaacuuuaucuuguaauauuaugacuuuucucugcugggaacauuuccagcaucacuaguggcacuuuaugugggucccaugguguuauucaagguuuaugguauugcauaaaacaugaugaaaaauucacaagaaccacaagagaucacuuuuuacugugauagaguuuaguacagagacaaacugcucacacagagaugauuagcaucacacagcauuuuaagcagauauuugcaacacuugagcucaccacaauagcagugagagguagcuacaaaauuauuacaguaguaauguauguacuacaguuaauuuuaugcaguugugauuuaauacugcauuuuuauguucauauuuuucugagcuauaaauggcaccauguauggucuguuuguguauaaauucugauaaauuuuaacuuuuuauaauagguuuauguauauuuuaugguaguaaauaagauagacuaauaguuagauguauuuuauggauucaugacauaccuuuuucuuauuuuuucucaauauuucuaggcuaggcaauucaucugcuuuuccaaguugucucaaauuuccaaaaauauuuuccaauguauuuaauuuaaaaaguccauguauaagugaauccacacaguucaaaccuauguaguucaagggucaacuguauaauaauauagaaccucaaacucagcauuuauaagcaugaacucauuauguugauuuacuucuauguuccccacugccccuacuuuucaguuuuggucuuuguuaacacuauccauucuauuauaaaaacauauuuggaauguuuauauacucccuuuuccucauccuucacauuuaauaagucaugaauuccuguaacuuaaaccucauaauggcuuucagauuuguuaccugcucuauuuccuugcugcggcuaucucagcugaggccuucagcaaugugggucagacacuugugaagcgacuccuguuucucucuucucucucuuuuguuuagauggagucucacuaugucacccagcuggagugcagugguacgaucuuggcucacugcagccccugccuccugggcccaagcgauccuccugccucagccucccgagguagcugggaccacugaugcaugccaccacgauuggcuaauauuuguauuuuuaguagagaugggguuucaccgcauugcccaggcuggucuugaacuccugagcucaagcgucugcccgccuuggucuccuaaagugcugguauuacaggcaugagccaucgugccuagcuaacuccuguuucucuuguuugccuuugucauguuuagauguuuggaauaucuaaaauaaugaccgauuauguucuuuaaaugcuuaaaauacccuaaugaaucuacauuacucauugaucagguugauacauucuaacauacaaaaauccuuuauagauuuuuucaguuuuuccaguuguuucuccugacaauccuuugcaugucugaagcugcaauuuaccaaaaucccuuucacucccagaauguggucuguuauuucauaccuuucuaucuuuguaacgcugcgcucuuucuuggaaauauauuuugggcaucaauucuguuuaaagucuuucuuaacucuaccaguucauauuaaguccuccuuucccugugcuugcauacaauucacaagcaugauuacauuauuuauuguguaguauugaaauuauuuuuuaaaaauacuucuguuguggauuugugaaguccgggaguauauuaauucaucuuugucuuccuugauccauuguggcacauaaaagguacucaauaaauaugcguugagagaauguuuuaaagaacagaacacuauauauacucauagaugcaaacuguguacaugaagcccaaaacgaucuaggcauuaauaggaauauuauaauuaauaagucagagacaauagucugguucuuacucaaggacgugaguggcacuuacaucccuuagauuauaauucuaguagucaccuucaagaaagagccaaugaaacuaaaaaauauucagauuggagaaauuauugggauuacaaacuuggaaguguuaugcaacuaccuguagguaaggaaauaauuauuguuuaaugauucagugauuucuugugugugucauuccuguagagcuuauuuguauuauucucaauaucauagauauugugaaucaaacuauuuuuuuagauauuuggagaggccugaguuaccacuuugauuguuggcaaauugcauuuccauuauuuacccuuagaaauccuagcuugugguuauagacaauuaaagcaauauucuuuccuguaaaguucuuccugauuauuuccuggaagaaaucuggcaggaaagccuguucagaagucgauucagcuugacaccuucucuaccagcuguaucuuugcuagauuauuuguuuuuccugugagacauuggacaauaugcuuaaucucuuucccugaauuucauuuucuguaccuacuucacaguguuguuggaagggcaaaguggugaaagcauuaacuccaaaauaaagaaauuaagaagucaguauuuauaaguuacaguuugaacaguagauguauuaagcauuuaaauauuaagucagagucaagaguucaaaaaauauuacacggcauuacuuuaaguauagagaaaggcuuaauuaaaaaauuaaaaaguaauucuuauuaaaauauccauuugcuaaguauaucauuaaauguggcauaagaucauucuaaucuuguucauacuugauauaauacaauagaaguuucucucuguuacuagugaaaaauaauucaucuugugagccaauuuuucuauguugacuaagggccaugaggcauugucuccuguuguguccuuuuuuucuuauaaaaauuuauuuuagaagaaauacuuuuagugugacauugccuuuuuauaugaauacaaguugaauaauuacccucagauaguaguguucaguguuuagauaugugcgggucaucugcacuguuugugaguuguggagguucuaggaccauuacaaugggauuaggauccagugaauaugggauggggcaccaagaucugcauuuucaaaaagauaccagguaauuaucauuaaagugaucugugguuugagaagcacuguucuaaauuacaaaacuuuuguuuuuuuucuguucagcccauacugaguaaucaauuguuucaaugaggaugaggaacagaaacaaauccuugaaacaaaacaaacaacauaaaaaacaaaaucaaauuuuuuucuuucugugagugagaucaaaaggaugaaguuacaaaugacugauucagggaaaaucuuacugugaaugacauucauuucagccauguaccaugccucuauguauaaauuuauacugguaggccaggagagaguaaaaaagcaagaagcauugggauccuugaggucuaaaaucuuagaaaaagaggaaggccauagagaagaguaaagaccaagaaaauuuacaaaggucuaaaauuuuugcauaaauugaauauucaguauucaucuauacaggagagcgucucuuguuuugauaaacuccuguaauuguuuugauucuucuuucuaacagaaauauuccaagccaaaauagcacuuacuauuucuucaaugccauuucaccugauguauauagaaaugugaaauuucauccucaauucccaugucacagacuaaucuguuugaaauugguugguuuuucaggcccuuugcaagaucaaaggaagcauuuagaagucauaaugaagaaacaguguuuauagguuuagaccgauaacagagugaauuuccaaacacccuucagaagacugagcauuuucauuauugucaccugauugucauaguccaugagugauuguugaauauccucugugggucugacccuauuacugaauuauuugaagaagcaaaagaaacaaguguuuuguuggacagauauaacauucaacuuauaauucagauuucuugucauuugauaaaauuuuaguaaaaacugaaaaacauguuuuuguuaaaggggaaaagaauaacuuuugguaggguuuuuuagagaagaagugagcacacgcuguuggaaaaugacaucaauagacuugauugacccacgguugccaaaccuucaauuuguaagaaauaucuacaaaucacaguaaagugaagcacaauaaaauaagguaugcuuguauuauagcucauuauuguguaaaagguaauacacaaucgcugaaguuuuuuuuuuaguucauaauugaagcuuaauaauguguuuuaguuuacuuccauuguuuaaugacuguaguauuuaaacauaggaaaaagucagagcauauuuaugggggucauugauuuauauaucuugcuuaauuccccuaaaggauuaggagacauuugcaaagcuauguuaaaucaaacaggcuaaaagugaggggauguugaaacuggagagaagagaaaaaaagcauauauacauauuuaaggaggguauaaauacauauucccuccuuauauaagguaaauauuauacagaaauguuuaucaagguuccucuaaagucgauauaggcuacacauucaguucugaguggguaaacaauaaaaguguaaaauaaaggaaggugcugaagagaacagcugugcauaguccugagaccuuagagauagcuuuuguaaggcuuuaaucagaagacuagcauuuauuuaauaaacauuuauauguaauauaaaucagacauuguucuaagugcuuuacucauuaaauuuuuguaaaaaucuuacgagguggauauuauuuuccuaguuuuauggaugaggaaauugaggcacagagaaguuacauaauuuguucaagacugcauaacuauuaaguggcagagcuuggauuccaacccagacauuuugacuugaggguauuuugucuucaacauuaugccaugcugccucuccaaguggcaucuaagaggagagugccuguaauuucauguucauaguaagaguuuauugaauuuuugugccuguuucuuauaaccaucaaugaugcuaauuaaggaccacugacacugggaaacaugaguacuuucccacuuuuacuuauagaccucccuguggcucacuucuuagaccagagguuuugaaagcgcaggcucuggaccaguaaagucaacaucaccugggaacuuguuagaaaugcaaauuuucugacuccaccccacaccuacagaaucagaaacucugaaaguagggcccagcuuucugcguuuuaaugacacuucuaggugauuuggauguucccuaaaguuugagaaccuguaacauaaaguaaucuagauggaaagaaaaaaaggguaucuggagccuguaaguuauuguuaugaccuuaucuuuguaauuuagauggagaauauaguaggaguuuguaguaaaagcacgugcauucuaccuuugguaauaagagaaaaaauugcauuuaucagggacuaggcugguaauuauuugagguauaagcaaugaccucuuuaaacuuuaaucaucuccaagcauccuaaugaucaagaaucaguggugcagaaauaccuauuuuauggcuuuuuggagaaguugauguuccaaaauugauuuuugcagucuuauagaacucaaaagaaagguauccgaaauaauauucugcauuaacacuauuuuuucgguauuccucuuaugaacuauucacugcaaucauucugaagugauuugaaacaguaaauaguaaaguucaucuuuguaagaauuauaauucuuaaaccuauguuuggucugucauauuuuagguugagucaagaaagcuacuaugaagauuauuucuucagaaauauguccccaacuccuaggcaauuaucagauauucccuacacacuuuaguuuuccuucucaacauuuuucucuuuuuuuuguaauuaugcauuuauuagcauuuaccuacuuaagccucauuuucucauccauaaaauggugauaauuuuaccucauugguucuguugucuuaaauggcaugcauacuaaauauguuaaccguuucuguuauuuauuacuacuacuaauauacuaauaccacuacacaguaaaccccaugauggcaaagaugguauauauuuugugccauuguguucccuagcaccuaguauguauucaguaaauauuuguugaaugagugaauugauaaauugaauaauucuaaucuugaugagaugcuaugacaauauggaaauauguacggggucaggaacaauuuuggacauaauugagcaucauauugaacauuucuguucaaugugacuucugaaaaaggaauuacuagcacaaaauuacaaaaccaauagcaucucugacuaagauuuauacuuagaccauaauuuaacacuuuuucccagucugagcucuuuacugcuuccucaaaaccccuauucuuuuacuuuacuguaugcuuccuuaaaaugccuuugugcuuuugguuuaaaccaaguugaaaucuaauuauauuuuaaaauugaguagauuuugggcagaaauauggacagcugauucauaguauucuucuagguaugaaauauauguaaaguaguaaauuaauuuuuguccucugaugacagugaaguuuuugacauuacagucauccuuaguaguuucaucaacacauuaagcagaugaguaguauuucuaagccauauggaauuccuaaguugagagcagagggaacacuggaguuacucaucugaagucugugggugaaauuugacuuuaagcgguuuacaauuuuaauggcagaaucaaggucauagaggagcaagagacauauggugauuuaaacagcuccugauuucaaguccuucuaggucagcuaaaaugcacuacccagauucuucuuccaaaaaugcauagaauuaugagacaucucaaauagcuacugaaagcaagcuaacacaccgguauacuugugcucacgcuuucauucucccuuugcucuaucauccucucucucuuucucucugcuuucuugguuucuuucaugcagucagcaaauauuuauugagcaccugcuuugccucuggugcuggcaauacaguaaaaaaacaaaacagacacggugccuacucuucuugaaauguauacucuggggacucauuuaauuuuucaaaaauauuauuuuaggucaaguucuacuagcaguuuucuguccuuuccuuugcuugucuuaccuuuuauucuuccaaaaguaaaagaucccuaaaaguuuucccagaauccugucuuaccauucuuauuucuuaaaauucucuuuauggggaguuaaaguuacuguaggcaaagaucuagaggaauauagaaaaaggaauugagaauguguucaccagauguacagaaacaauucuauuagucaaguuaauaauagcucagaagauauaaauauaaaaauuguauaaaauguccuacgaaaucccaguuauuauauauacaaguuuaaauauccuuagggaauaaagcugaagaguauaagauuuguuugaaggaucaucaaagcauauuugaaaauacuauagaagaaaacuaacugggaacugaaauuauucuuaucccaaacaugauguuggagaauaaguaaaugccacgauaguuuuuuuuuuuuacauucuguauuauucauugaguuauauuucauugaauauaauacaguacuuaauauuuauugaguauuaugcucaugucuuuuuauuacacugaaaaacacacaaauaugacaaauugucauuuaucuaaaaguacguggggaaacuguaacaaaggcuauaucaaaaaucaauuggaaagggaauuuucucucaauccgugguggugagauaaacugguagcaauuugguaaggcaacaguuuagacauugcuuuucacaguauuauacuuuuaaaaugaauuagaauuacauauaaaaucaaguuguaagaaagaauaaaauauaacuuaauauuuauaaacuuuuggacauggagauaagacauuuagagguuagaaaacccacagaaaauaaaaaagguuaauguuagcaauuuugaguaucuaauaauauucuaaucuaaaauauuaaaagaauaauuccaagauaauaagacaaauuacgaauuaaaacuagugcuuaucauacaaauaacucauaaaaauagggagaaacauacuacaaauucaggguuuaaauggagaguggacaugggcugacaggucacaugagagugacuaaaauuguuuuuaaaaauaaauguaaaguaugacaauucaauguaaccauauguacaaauauagcucugaauagauuuuauuuuuugaaacauuuuuagcaaaauuuaaaaagcuggaccauaacgggaugauaucuuuacaguaaauaguaauauaaauuguucuacucuuugaccuuuuaauauuuuuguuuuuucgugcauuuaaccugauagucacuauuuguuucuuuccacuuuuuaaaaguuuuuuuuucucucuuucuuuuuaaauagguuucuggggagcaggugguguuugcuuacaugaguaaguucuuuauggagguugugauuucugagauuauggugcacccauuacccgagcaguauacgcuguacccaguguguagucuuauaucccugauucccucccaccauuucccacgaguccccaaaguccauuguaucauucuuaugccuuugcauccucauagcuuagcucccacucaugagugagaacauacgauguuugguuuuucauuccucuguuacuucacuuagaauaaugguccccaguugcauccagguggcugcaaaugccauuauuuuauucuguuuuauggcugaauaguguuauaugguauauauacaccacaauuucuuuauccacucauugauugaugggcauuuggguugguuucauauuuuugcaauugcaaauugugcuccuguagacauguguaugcaaauaccuuuuucguacaaugacuucuuuuccucuggauagauacccaauggugggauugcuggaucaaaugguaguucuacuuuuacuucuuuaaggaaucuccacauuguuuuccauagugguuauacuuguuuauauucccaccagcaguguagaaguguucccuuuucaccacaucuaugccaacauguauuauuuuuuguuuuuuuuauuauggccacucuuguaggaguaaggugguaucacauugugguuuugauuugcauuucccuaaucauuaaugauguugagcauuucaucaaauauuuguuggcuaauuguauaucuucuguugagaauugucuauucaugucguuagcccacuuuuugcuggguuuuuuucuucucuuuuuuuuuuuuccugauuuguuugacuucauuguagauucuggauauuaguccuuuuucagauguauagauugugaagauuuucuuccacucuauguguugucuguuugcucugcugauuguuucuuuuucugugcagaagcuuuuucauuuaauuaagucucauauauuuaucuuuguuuuuguugcauuugcuuuuggguucuugguuaugaagucuuugccuaauccagugucuagaaguguuuuucugauguuaucuuuuaguauuuuuauaguuucagaucuuaaauuuaaguccuugauccaucuugaguugauuuugguauaaggugagaaaugaggauccaauuucauucuucuacaugugacuuuccaauuauuccagcaacauuuguugaauaggguguacuuuacccacuuuauguuuuuguuugcuuuguugaagaucaguugacuguaaguauuuggguuuauuucuggguucucuauucuguuccauuggucuaugccuacuuuuauaucgguaccgugcuguuuuggugacuguggcuuuauagcauaauuuggagucagguaaugugaugccuccagauuuguucuuuuuguuuacucuuguuuugucaaugacgguucuuuuuugcuuccaugugaguuuuaggauuuuuuuuuucuaguucugucaagaaugauggugguauuuugaugggaauugcauugaauuuguagauugcucuugguaauauggucauucucauaauauugauucuaccccauccauaagcuugagauguguuuccauuuguuuguuuuuucugugauuucuuucagcaguguuuuaguguuuuguaguuuuaaaaccuuguagaggcugggugcaauggcucacaccuguaaucccagcacuuugggaagccaagguaggcagaucacaugaggucaggauuucgagaccagccuggccaacauggcgaaaccccaucucuacuaaaaauacaaaaauuagccgggcaugguggugggcaccuguaaucccagcuacuugggaggcuaaggcaggagaaucgcuugaaccugggagguggagguugcagugagaugagaucacgcccuuguacuccagccugggcaacaagagcaaaacuccaucucaaaaaaaagaaaacaaaaaaaucgaaaaccaaaaucuuguagaggucuuucaccucagugguuagguauauuccuaaauuuuauuuuauuuuauuuuauuugcagcuauuguaaaggaauuugaguucuuaauuugauucucagcuugguugcuguugguguguggaagagcuacugauuuguguacauuaauuuuguauccugaaacuuugccaaauucauuuaccaguucuacaagcuuuuuggaggagucuuuaggguuuucuagguauacaaucauaucauuagcaaacagcaacaguuuaauauccucuuuaccaauuuggaugcccuuuauuuuuuuucucuugucugauugcucuggcuaggacuuccaguacuauguugaauggaaguggugagaaugggcguccuugucucauuccacuucucagagggaaugcuuucaacuuuuucccauucaauauuauguuggcuguggguuugucauagauggcuuuuauuacguuaagguauaucccuucucugccaguauugcugaggguguuaaucacaaacggaugcugaauuuugucaaaugcuuuuucugcguuucuugagaugaugugauuucuguuuuugauucuguuuaugugguguauuacguuuauugacuuguguauguugaaccaucccugcaucccugguaugaaacccacuuggucaugguggauuguccuuuugauauucuguuggauucgguuagcuuguauuucuuaaggauuuuugcaucuauauucaucaggaauguuggucuguaguuuuucuuuuuuugcucuguccuuuucugauuuugauauuaggaugauauuggcuucauagaaugauuuagggaguauuuucucuuuaucuuggagaauagugucacuaggauugguaccaauucuucuuugaaugucugauagaauucagcugugaauccaucugguccuggacuuuuuuguuggcaaguuuuuauuaccauuucaaucucacugcuuauuacugaucugcucagaguuucuguuucuucuugguuuaaucuaggaggguccuuuauuuccaggaauuuguccguuuucucuagguuuucuaauuuagguacguaaagguguucauaguagccuucaaugaucuuuuguauuuccgugguaucaguuguaauaucucccauuucaauuauaauugagcuuauuuggaucuucuuucuuauuuucuggguuaaugcugcuaaugaucuaucaauuuuaucuaucuuuucaaagaaccagcuuuuugcuucauuuaucuuuguuguuguugguuuugguguuauuuguuucaguuucauuuaguuuggcucugaucuuuguuguuucuuuucuugugauagguuuggguuugguuucuucuuguuucuuuaggugugaccuuagauugucuauuuguacucuuucagacuuuuugauguagacauuuaaggaacuuuccucuuagcacuaccuuugcuguaucccaaagguuuugauacauugugucauuguuauuguucguucaaagaauuuuuuaauuuccaucuugauuucauuugcaacggucauucacgagcagguuauuuaauuucuacuuauuugcaugguuuugagguuccuuuuggaguugauuuccaauuuuauuuuacuguugaccuuuuaaucuuauuaccaggagucaguccuacugaaauaaucuucaaauguguaaaaucuggaugcugaguguuacucgucuuguuuuuauuauaauagaaaaaaaucagaacuagucauuaugagaaaacgauuaugggagugcaugaagauggauaaugcugaucuguuggucuuucaggauuucuuaaaaagaccaacaaccuuugccaaacugcauucugcaauauucuucaguugcuuuacauuacaaauaaucaaaugaaaauaauuaagaaauaaauauuaagaaauauuaagaaucauuaagaaauacuaaguuccaaaaaauauuuuauuaugaauccaaugaaauauuggccuguuuaugagcuuccuggauacuuuaaaaaauccuaggucauuuagcauauuccuuucuuucugagugugaaauauuauccaucuuuccauuuuuguuuuaacagaugaacuuaacuaauauuacauauguguauuuuuucuuuauuugauuacauuaggauuuucuaaacauuuuuguaucucuuauuuauaacuauuucucucccauugcaucuugaugauuaguauuagcuuugaaaaaugcccaagaaagcaauuaaaauagucauuauuuuaguaguauuuccuuuauaaaaaucguaugugguguaagcaugagaauacauuaauacaaaauaguauaauaugauauagcuagacauuuaaugcauuuauuuuaauuugaagaagauaguuuguacuauauucaccaauguuuguuuuaguuauuguaagcagucacauuuuucccucuagucagucucaggucaaggaguaugucauaauacuuuuugugucccccuagugccuuguacuuacuagauacucaguaaauuucuaaagaauugauuaggugauuugggacaugugacacauacaaucuauuuaauuuuuucugucacagucauauaaaaguaagcagcuucuuaacauuaguguauauuaauacaagcaaaaacaaauuuuaaauuagcuuagucauugaauuaaaaugcugaugaaacugaaaggaagcuaguauuuacauaguauuagaaggaaacaugauuuugcuagcuuguuuuaacuuggugguuuucauuugaauucuccuguagauagauauuuaaucaaacuuuaaaaaauaugguugauaauaaguuucaauauacuagacuuagaguuuucuaaaaauauuguauauuacauauugauuuauguauaucaauauuucagcuuagaaaauuagauacaacuuguaucucuauugguguaugcauguguauguauguagauacauuucauccuaacugcccacuuaauacauuucaaagaaauauaaauguaaagguaaguauacuugcaaaaaaauuacaggugaagagaaaaugaaggaaauugaugagaggauaacagaaaguauuauaauaauguauaaauauuugggaaguauuaauaggaaugcuauauuugggaguugaaagagauuaaauggucuuaagagagagagacacagaaaauacaucuuuauaaagccagaaaugagugagaaaaugaagaguaauuauucagugaaauagaugagucaucuuuauuaacaucuuuaaaaugaaggaagcuuaaauaaaaucaagcaauacagagauucucuacccaaauauaguacagaaaugaaauauguuucuagauuuacauccaugauuuuucacacugauacugcuaaaauaccuaguacucuacuuuuaauauuaaaauauguacauaacuuaugaagcaagaaauaaggcuuuguugagaauuagaaugaauauguauuugcauauugugcuucugaguuugacauaaauauuuaauauuuagauauauaguauauguauauauacacacauauauacaaauauauaucuuaaacagggguacuuuuauuuguaauaagacagaaaauaagaaaauuauuaaguauaaaggagaaaguuucaauauugaaauuaaauaccaauauuagcauagcaugucugucucauuuuguauauguguauauacgcacauguauauauggguguguguguauuucagcuggcuucuggauucuggauaaugcaauuaauugaauuauaacauaguuuaauuacucuaauuauuguuaaggcaaaggaaaaaaguauaggcauauuuuauaaucuuaagugauuauagacaaugaagugucacggcccccccaaaaacagacaaauuuuuaacacucaaauuacugaaaauuauuaauuuguuuauccauauguaagguuuuauaauuuaaugaaaagauguaucauuaaaagaaauuagcagcuuuucagaucguauacuuugauauuuuauuuuuuuaagaguucaacauuuauuccaggauugucauuuauaucacauuugugcagaauuuauaaucacaagcagauaaacuuuuuuuucuguauuucaauaucuccuuccuuauucauuuguuauucauucauuuguuuauucaguaagguuuuaaguuuauucaguaagguuuuuuuuagcacuugcuauuuuacucaggaaaaauuuucuguuauaaccacuuuaaagcucucaagauauaacuuagccacagaaauauauuaaauuauuucaaagcuuucucuuccuuuggcugaguaauucuauuuccuuuucuuuguauuuucuuuuuuuuuuuuaaauuaauuaauuuauuuuuauugaucauucuuggguguuucucgcagagggggauuuggcagggucauaggacaauaguggagggaaggucaacagauaaacaagugaacaaaggucucugguuuuccuaggcagaggacccugcggccuuccgcaguguuugugucccuggguacuugagguuagggaguggugaugacucuuaacgagcaugcugccuucaagcaucuguuuaacaaagcacaucuugcaccgcccuuaauccauuuaacccugaguggacacagcacauguuucagagagcacaggguuggggguaaggucacagaucuacaggaucccaaggcagaagaauuuuucuaguacagaacaaaaugaaaagucucccaugucuacuucuuccuacacagacacggcaaucauccgauuucucaaucuuuuccccaccuuuacccccuuucuauucuacaaaaccgccauugucaucauggcccguucucaaugagcuguuggguacaccucccagacggggugguggccaggcagaggggcuccucacuucccaguaggggcggcagggcagaggcgccccucaccucccggacgggguggcuggccgggcggggggcugaccccccaccucccucccggacggggcagcuggccgggcagaggggcuccucacuucccaguagggguggcugggcagaggcgccccuuaccucccagauggggcggcuggccgggcggggggcugaccaccccaccucccucccggacggggcggcuggccuggcgggggcugacccccaccucccucccggaugggguggcugcugggcggagacgcuccucacuucccagacgggguggcugccgggcggaggggcuccucacuucucagacggggcgguugccaggcagagggucuccucacuucucagacagggcggccgggcagagacacuccucaccucccagacggggucgcggccaggcagaggcgcuccucacaucccagacggggcggcggggcagagacgcuucccacaucuccgacgaugggcggccgggcagagacgcuccucacuuccuagaugggauggcggccgggaagaggcgcuccucacuuccuagaugggauggcggccgggcagagacgcuccucacuuuccagacugggcagccaggcagaggggcuccucaccucccagacgaugggcggccaagcagagaggcuccucacuucccagacgggguggcggccgggcagaggcugcaaucucagcacuuugggaggccaaggcaggcggcugggagguggagguuguggcgagcugagaucacgccacugcacucuagccugggcaccauugagcacugagugaacgagacucugucugcaaucccggcaccucgggaggccgaggcuggcggaucacucgcgguuaggagcuagagaccagcccggccaacacagcgaaaccccgucuccaccaaaaaaauacgaaaaccagucaggcguggccgcgcgcgccugcaaucgcaggcacucgccaggcugaggcaggagaaucaggcagggaggaugcagugagccgagauggcagcaguacaguccagcuucggcucggcaucagagggagacuguggaaagagagggagagggagacuguggggagagggagaccguggggagagggagagggagagggagagggcgagggcgagggagagggcaagggcgagggcgagggugagggcgagggcgagggcgagggcgagggugagggagagggagagggcuguauuuucaaauacaaguugaggaugguucuucugauguuaaucacuugggugauucccaccaacaguguaaaagcaucccuguuucuccauagccuugccagcaucuguugugucuuaacuuuugauaguugcccuucugacuggugugagaugguaucuuugugguuuugauuugcauuucucuaaugaucagugauguugagcuuuuuuuucauguuuauuagccccuuaaaugucuucuuuucagaagugucuguucaugcccuuugcccacuuuuuaaugguguuguuuucuucuuguaaauuuauuuaaguuccuuguagguucuagauauuaauacuuugucagauggauagauugcaaaauuuuucucccauucuguaggucgucuguucacucugaugauaguuccuuuugcuguucagaagcucuuuaguuuaauuagaucccauaugucaguuuuugcucuuguugcaauugcuuuugauauauuaaucaugaaaucuuugcccaugccuaugccccacauuuucugcuagaguuuuuauaguuuuggguuuuguauuucagucuuuaauccaucuugaguuaauuuuuguauaagguauaaggaagggguccaguuccaauuuucuccauauggcuagccaguucucccagcaccauuuauuaaauagggaaucuuuuccccauugcuuguuuuugccagguuugucgaagaucagaugguuguagaugugcagucauaguucugagaucucaauucuguuccauuggucuuugugucuguuucuguaccaguaccaugcuguuuugguuaguguagucuuguaguauaguuugaaguuggguaguaugauuccuccagcuuuguucuuuuugcuuaugauuaucuuggcuauuuggggucuuuuuugguucuauaugaauuuuaaaguaguuuuuucuaauucugugaagaauaucagugguaguuucaugugaauagcauugaauuuauaaauugcuuugggcaguauggccuuuuuuaugauacugauuauuccuauccacgagcauggaauguuuuuccauuuguuuguuuccucucuuauuuccuugagcagugguuuguaguucuccuugaagagguccuucacuucccuuguuagcuguaugccuagguauuuuauucucuuuguagcaauugugaaugggacuucauucauaauuuggugcuuugcuugucuauuguugguauauaggaaugcuugugauuuuugcacauugauuuuguauccugagacuuugcugagguuacuuaccagcuuaaggagauuuggggcugagacuauuggguuuucuagauguaggaucucgucaucugcaaacagagguaguuugacuuccucucuuccuauuuguauacccucuauuucuuucucuuaccugauugcccuggccagaacuucuaauacuguguugaaaaggaguggugagagagggcauccuugucuuguacaguuuuaaggggaaugcuucuagcuuuugcccauucaguaugguauugacuguuguuuugucauaaauggcuuuucuuuucuuuuuuuaauuauuauacuuuaaguucugggguacaugugcagaacaugcagguuuguuacauagguauacacgugucauggugguuuacugcacccaucaaccugucaucuacauuagguauuucuccuaaugcuaucccucuacuagccccccaccccccaacaggccccagugugugauguuccccuuccuauguacauguguucucauuguucagcucccacuuaugaaugagaacaugugguguuugguuuucuguucuuguguuaguuugcugagaauuauaguuuucagcuucauccaugucccugcaaaaacaugaacucauccuuuuuuauggcuacuuaguauuccaugguguauaugugccauguuuucuuuauccagucuaucauugaugggcauuuggguugguuccaagucuuugcuauugugaacagugcugcaauaaaacauacgugugcaugugucuuuauaguagaaugauuuauaauccuuuggguagauagccaguaaugggauugcugggucaaaugguauuucugauucuagauccuugaggaaucaccacacugucuuccacaauggcugaacuaauuuacacucccaccaacaguguaaaauguuccuauuuuuccacauccucuccagcaucuguuguuuccugacuucuuaaugaucaccauucuaacuggugugagaugguaucucuuugugguuuugauuugcauuucucuaaugaccagugauaaugagcuuuucuucguauguuuguuggccgcauaaaugucuuuuuuugagaaaugucuguucauaucccuugcccacuuuuugaaggaguuguuuuuuucuuguaaauuuguuuaauucauuguagauucuggauauuagcccuuugucagauggagagauugcaaaaauuuucucccauucuguagguugcguguucacucugaugauaguuucuuuugcuguguggaagcucucuaguuuaauuugaucccauuugucaacuuuggauuuuguugccauugcuuuugguguuuuaguccugaagucuuugcccaugcccauguccugaaugguaaugccuagguuuucuucuaggguuuuuauuguuuuaggucuuacauuuaaguauuuaauccaucuugaguuuauuuuuguauaagguguaaggaagggguccaguuucaguuuucugcauaaggcuagccaguuuucccaacacaauuauuaaauagggaauccuuuccucauuucuuguuuuugucagguuugucaaagauaagaugguuguaggugugugguguuauuucugaggccucuauucuguuccguuggucuguauaucuguuuuaauaccaguaccaugcuguuuugguuacuguagccuugugguauaguuugaagucagguagcaugaugccuccagcauuguucuuuuuugcuaggauugucuuggcugugugggcucuuuuuuuguuuccauaugcaauuuaaaguaguuuuuuccaacuuugugaagaaagucaguggucacuugauggggauagcauuuaaucuauacauuacuuugggcaauauggcccuuuucacgauauugauucuucuuauccaugagcauggaauguuuuuucauuuauuuguguccucuuuuacuuccuuguacagugguuuguaguucuccuuaaagacguccuucacauuccuuguaaguuggauuccuagguauuuuauucccuuuguagcaauugugaaugggaguucacucaugauuuggcucucugucuguuauugguguuuaggaaugcuugugaaauuugcacauugauuuuguauccugagacuuugcuaaaguugcuuaucagcuuaaggagauuuugggcugaggggaggccgaggcaggcagaucacaaggucaggagaucgagaccauccuggcuaacacggugaaaccccgucucuacuaaaaaaaaaaaaaaaauacaaaaaaaauuagccgggcuugguggugggcgccuguagucccagcuacucgggaggcugaggcaggagaauggcgugaacccaggaggcagagcuugcagugagcgagagcaugccacugcacuccagccugggugguggagcgagacccugucucaaaaaaaaaaaaaaaaagagauuuugggcugagacgaugggguuuuccaaauauacacucaugucaucugcaaguagagaaaauuugacuuucucuuuuccuaauugaauacccuuuauuucugucucuugccugauugcccuggccagacuucuaauacuauguucaauaggagugaugagagacggggucagggacccacuugaggaggcagucuuacccuuagcagagcuccggugcugugcugggagauccgcugcucucuucagagccaucaggcagggacgguuaugucugcugaagcugcucccacagcugccucuuuccccaggugcucuguuucaugaagauggggguuuuaucuauaaguuccugacuguggcugcugccuuuuuuucagagaugcccugcccagagaggaggaaucuagaggggcagucuggccacaguggccuugcugagcugugugugguaggcuccucccaguucgaaauucccuguggcuuuguuuacacugugaggguaaaaccaccuacucaagcuucagcaaugguggacaccuuaccccauaccaagcuccagcaucccaggucgaccucaacugcugugcuggcagugagaauuuuaugccaguggaucuuagcuugccaggcuccgugggugugggaccugccguaccagaccacuuggcucccuggcuucaucucccuuuccccgggggaugaacgguucugucuugcuggcguuccaggcaccaccgggguaugaaaaaaaaaaaaaaaaaaaaaacucuugcagcuagcuagguacugcccaaacggccgcccagucuugugguugaaacucagggcccucguugccuagccaccugagggaaucuccuggucugcggauugugaagacugggaaaagcacaguaucugggccagagugcaguguuccucacagcacagucccucaugacuucccuuggccaggggagggaaauucgcuaacaccccuugugcuuccugggugaggcgacaucccauccuucuucggcucgcccuccauuggccgcacccacuguccaaccagucccagugagaugaaccggauaccucaguuacaaaugcagaaauccccugccuucucccugggagcugcagacuggagcuguuccuauuuggccaucuuggcgcauuaauggcucuuauuaauuugagguauguuccaucaauaccuaguuuauugagaguuuuuaacaugaagggauguugcauuuuaucgaaggccuuuucugggucuguugagauaaacaugugguuuuugucuuuaguucuguuuaugugaugaauuacauuuauugauuuguguauguugaaccagccuugcaucacagggugaaccugacuugauugugguggauaagcuuucuggugugcugcuggauuccguuugccaauauuuuacugaggauuuuugccucgauguuaaagugauuuauauauguuguauuuuagaaaagguucuagagaacucuuuguagguuguuuuuauuacuuugauacauaauaugaauuguuucaaacaugaaaaaauacagagacuaaacuaguaaauacccauauaugaacuaacuuuuaauuuuuuucuaacauuugacuguucuugcuuuaguuuuuuuaaaaguaagaauugaaacauuaugcauaaacuuguagccuuccuugauucuauguuuuuuccaguuaguguuaucuauaauacuucucugauuucuccuuccuugaauuuuauacuguuacuucacugugcuauuuguacuagccauacacaauaugucuuugcauguuuaucauuuguuacguuuuaaauuuuuuauacaauuuuacuauucuguaacccaguucuuaguacugaacauuuaaaaaauuauauucaccuguauggauaguguggcucugguucauuuguuucaacuguuuuuaauuuuuaaauagauuuuuaaaauuuauggauguaacacaauucauacauuuuucuuuaaauggauauuuuuauuuguuuugcuuuuaauuuucacugacacaaacagaacauacagaagauucuucuagagaugugacguaugugugagaguuucuuuuauuuuguauaccuagaaguagaguaccaagaagaaagggucugcaugucguuaauuuuauuagauguugcuaaggugcuucccaauauguuuguaccaauuuauacuccuaucaguauggcaaaagaguuuucauuuauguacaccuuuaccauucuuacuauuuuuuuuuuuugccauccugguagguaugguuucaauuauguuacuagauuagauuauauuuuuugauuacuagaugauuuaacaucuuuuccuguguguauuagcucuucuguuuuccacuucuauguauuacuguuuaaauuugcuucaaugugggauuauggauugauuuuuagucucuuuuaauaaguaggaggaaagcccuuuacuauaacugucuaauuucacuacauagcacacaguaguacagcugauuuggggcauuaacucugcaucucucuucucugaaaguauuuauuuuguuucugaguccagcaguuuuuuugauucuuucucuuuauauuuuucugcauugcuauguguuggacgcuggcauagucuuuuaauguauauauuuacugguuaauguugaccuuuuuuucauaaagaugauauauaauauauauauaaguuuauuugagacuaaauugacuuaggaaaaagacacaaauggaagaaccauaguuuauauuaaaauguaaaacguguuuaucaaaaagcaucauaaacagaauuuuaaaauuauuugccacauauuuaagcagacauuaauuuauuuaauauauagaguacauuuguucuaagaaaaacaaacucucuaguaaaaaaaaaugaguaaagaaagagaacaauucaugaagcaaaacaaauggauagaaaacauauuuuaaaaauauuuaucgcuaaagauguucuuugaaaccaacgagaaaaaagacacaacauuccagaaucucucggacacauucaaagcaggguguagagggaaauuuauagcaugaaaugcccacaagagaaagcaggaaagaucuaaaauugacacccuaacaucacaauuaaaagaacuagagaagcaagagcaaacacauucaaaagcuagcagaaggcaagaaauaacuaagaucagagcagaacugaaggaaauagagacacaaaaaacccuucaaaaacucagugaauccaggagccgguuuuuuuaaaagaucaacaaaauugauagaccgcuagcaagacuaauaaagaagaaaagagagaggaaucaaauagacacaauaaaaaaugacaaaagggauaucaccaccugucccacagaaauacaaacuaccaucauagaauacuauaaacaccucuacgcaaauaaacuagaaaaucuagaagaaauggauaaauuccuggacacauacacucucccaagacuaaaccaggaagaaguugaaucucugaauagaccaauaacaggagcugaaauuguggcaauaaucaauagcuuaccaaccaaaaagaguccaggaccagauggauucacagcugaauucuaccagagguacaaggaggagcugguaccauuccuucugaaacuagaauccucccuaacucauuuuauaaggccagcaucauccugauaccaaagccuggcagagacacaacaaaaaaagagaauuuuagaccaauacccuugaugaacauuugaugggaaaauucucaauacaauacuggcaaacugaauccagcagcacaucaaaaagcuuauccaccaugaucaagugggcuucuucccugggaugcaaggcugguucaacauacgaaaaucaauaaacguaauccagcguauaaacagaaccaaagacaaaaaccacaugauuaucucaauagaugcagaaaaggccuuugacaaaauucaacaaccauucaugcuaaaaacucucaaucaauuagguauugaugggacauaucucaaaguaauaagagcuaucuaugacaaacccacugccaauaucauacugaauguacaaaaacuggaagcauucccuuugaaaacuggcacaagacagggaugcccucucucaccacuccuauucaacauaguguuggaaguuuuggccagggcaauuaugcaggagaaggaaauaaagggcauucaauuaggaaaagaggaagucaaauugucccuguuugcagaugacaugauuguauaucuagaaaaccccaucgucuuagcccaaaaucuccuuaagcuaauaggcaacuucagcaaagucucaggauagaauaucaaugugcaaaaaucacaagcauucuuauacaccaauaacagacaaacagagagccaaaucaugagugaacucccauucacaauugcuucaaagagaacaaaauaccuaggaauccaacuuacaagggaugugaaggagaacuacaaaccacugcucaaugaaauaaaagaggauacaaacaaauggaagaacauuccaugcucauggguaggaagaaucaauaucgugaaaauggccauacugcccaagguaauuuauagauucaaugccauccccaucaagcuaccaaugacuuucuucacagaauuggaaaaaacuacuuuaaaguucauauggaaccaaaaaagagcccgcauugccaagucacuccuaagccaaaagaacaaagcuggaggcaucacgcuaccugacuucaaacuauacuacaaggcuacaguaaccaaaacagcaugggacugguaccaaagcggagauauagaccaauggaacagaacagagcccucagaaauaacgccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuauaccuuauacaaaaauuaauucaagauggauuaaagacuuaaacguuagaccuaaaaccauaaaaacccuagaagaaaaccuaggcauuaccauucaggacauaggcaugggcaaggacuucaugucuagaacagcaaaagcaauggcaacaaaagccaaaauugacaaaugggaucuaaugaaacuaaaaacuucugcacagcaaaagaaacuacuaucagagugaacaggcaaccuacaaaaugggagaaaauuuucacaaccuacucaucugacaaagggcuaauauccagaaucuacaaugaacucaaauuuacaagaaaaaaacaaccgcaucaaaaagggggcgaaggauaugaacagacacuucucaaaagaagacauuuuuguauccaaaaaauacaugaaaaaaugcucaucaucacuggccaucagagaaaugcaaaucaaaaccacaaugagauaccaucucauaccaguuagaauggcgaucauuaaaaagucaggaaacaacaggugcuggagaggauguggagaaauaggaacacuuuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacguauguuuauugaagcacuauucacaauagcaaagacuuggaaccaacccaaauguccaacaaugauagacuggauuaagaaaauguggcacauauacaccauguaauacuaugcagcuauaaaaaaugaugaguucauguccuuugagggacauggaugaagauggaaaccaucauucucagcagacuaucacaaggacaaaaaaccaaacaccgcauguucucacucauaggugggaauugaacaaugagaacacauggacacaggaaggggaacaucacacucuggggccuguuguggguugggaggagcggggagggauagcaauuggagauauaccuaaugcuaaaugacgaguuuaugagugcagcacaccagcauggcacauguauacauauguaacaaaccugcacguagugcacauguauccuaaaacuuaaaguauaauaauaauaaaauuaaaaaaauaaaaauaaaaauauuuaucccaagcauucaaaaauuuaaauuuaaaaaauuaaaaaauuauagccaggcaugguuucucuuacauguaaucccagcacuuugggagcuagaggugggagaauugcuuggaccuagaauuucaagaucagccuaggcaucauagagagaccccaucucuacaaaaaaaauuaaaauuugcugggcaugguggcgcacaccuguaguccaagcuacuugggaugccaaggugggaggaucacuuaagcccaggggguugaggcuguagugagcugugaucaugccacugcacuucagccugggcgacgguguaagaccgggucucaagaaacaaaaccaaacaacaaaccaauuguacaaucuuuuuuuuugucaaauugacaaauauuagaaaacaauaaaugucauugcuaauaaugguaugaggaagugagcacucucauacucugcugaugcaaauguaaaucccuacaacuuuucugaaugacaguugggcaguaagaaucuagagcuauccuaugcucuaaaugaccacuagauacauuggcuacuuaaacauuuauguccucaguuucaguaaccacauuuuaagcccucaucagccuccacguggccuguggcuacauauugcauacaucagagauaacauuucccuaaucacagaauaguuuauuggcuaucacucaguaguuucaaaauauucauauccuuuuucaaauacugcuauuucuaggaauguauuauaaauaaauauuagccauuuaaggauccuaaccaaaacauugaaaacaacagcaaaaaugggaaaaaauccaaauguccacaacaaggagcuguaaaugacuauaaauuuauaugaaaggauauuaugcagccuauuaaaaauaaguguuuggauuaaugucaugguaauaugcuuacaaaauauccuucuaauugaacagacaggccacaaaacagcaugaccacaaauuuaccauaugauuacaaauuuauuuuaaaauauuuuaaaauuuacauuacagagcauuauaguguuggugguuuuuuauaguguuuucuauuauaauguacuacuguuauaguaacaaaaaagucaaaaguauguugguuuggaaccugguuuugcaccuuaugaaacauuagugauuguguucauuuuagguuguuuguuucauuugaaauuuuguggugguugacaaauuuauauauuuauuaauaaguaucauauuaccaaaugguucaaaugaagaguuguuuuuuuuauguuuguuuuguuuuguuuuuuaauaaaaagaacuacugauaaaagcacuccaggauuaaggaacaaacugacuagggauggcugauuucucggaaacuagccacaguaggaacuuauuacuauccaucccuagggauaaagggacaagaggcagaaauaguuaccagaauccagugugugccagaacuuugcaaauggggcugcccaugacgagaugaugcagcugcccuaaacacagcaagaggaaaggagugggaaagaaaucagaccucuuuucuuccaccuuuggaucucaugcuggaaucuaacuggagguccaucaacaagacaguccucaagugaagucugaggagucagccuccuggggcauguaauagauccaagcaggagagaggauagaagguguuagagggugaggcagguuggcaaauggaaaaaaacuaucccguguguguguguguguguguauuucucuguauguguuuauucaaacauacuuauguaacacauacauaugcgguuaaugguugguauuauauuuacaugaguugugauguauauauguauaagcaugugucaucuauuuguggaagauuccaacguuugugcauacucccagacacauacaaacauaugcacauauacaagauauuuaaauucuaguaaauauagaaaacaauggaacuaguuggaaaagaauucugguuuagacagaggaguuccaaaaaauagcuagggaaccuuuagguaacacuuguuuuagauacacaugcucuugcacaccaaugaaagcauacugaacacacaagaguuuaaauuucccuucaguugaaguuccuuagcagcaaggaccauguguucugccuuccugugcuuuguaaacucuuguacagugcuucacacccaggaagugucucacuguuguaagaaugaaugaauuaaucauuccauuuaaauauuguuuucacucaaccagaguauaacuuaagacaaauuuguauucgcuuggagaccacuuuuagaacaauuaauugaaugaaaaggaauuguacauuuuuaaaauauuuauuguuuuuaaccaguauugauuaacucagauauacuauaggaacauaucaugauuuuguuuaugguacugcacaaagcuacuuauaugcuuuuuguaacaaccugaugauguagagagaagcagcauuaagacuauuuuguaaaugaugacuuugaaucuuggggagguuaaacaauuuuccuuuuuccuuuuacccuucuguaaugagauagugaaaugaagaaagcugugaggaguuuucauugagcaguuauauugagcuacuugaauuguagcugccauaauucccaccuguugugggagguaucuggcggagguaaugaaucaugggggcgagucuuuccugugcuguucuugugagaguaagucucacgagagcuggucguuuuauaaacgggaguuccucugcaaguguucucuugccuaccgccaugugagacaagccuuugcuucuucuuugccuuccaccaugauugugaggccuccccagcuauguggaacugugagugcauuaagccucuuuccuuuauaaauuacccagucuuugguaagucuuuauuagcagugugagaauagaguaauacaagcaguaagcaagguuuugcuuuuuguguuuaacauauaccugugaugaaauuagcucucuuagcuuuuuggcuuuuuguuuuuaaaacuauaacaaaaauaggaaggguggggggagaauuguuauuuacaugugauuucuaaagaugaguaaaaaauuguaaucuaaguuuuugaacaaaccuguuuucauuuuaccacaaauguccucuaaaauuagccuaaagugaaugugaugcucauaugguggggggaaaaaaaaucuuaccugccucaccuccacuuaauuaagauuauuaaagcaauauauugauacuaagagcacaauucuggaggaaaacuuugauagagguugucuucaguucuuugcuucaaaaguuuacuuaacuuugguauugaauaagauuaacaugcuaugggaccugugcuuuuuauauucugauguuguucagagguuuuuauuaguuggguuauucagaaaauugaggcauuauuuuuuagauggguuauucagaaaauugagaaauuauuuaugauuuaaaaaguuuuaauuacauugucuauugauauuggccaaaugcaguuucgaaguaauagcucauauucugagauacaugagguauuaacauuauaucaguauagugaucauguugucuuuuaacccaaaguaggagacaucagucuuuacaguguccuuucauuuugaaaaggcacuucacauuguuuuagucagacuuauuaagggauacauuuuacauagagaagugaaaauuaauucuuuuuagcauauaguucugauaaguuuagacaaauucauauaguuguuuaccaccacagucaaauuauagaacaauugcaucagcucccaaaauuauucuaugccccuuucuagucaacccagcuacuuacccuuuggaaagugagaaugucauauacaaggaaucguacaguaugugcucuuuucaauuugacuucuuuuauuuggcaaaguacaauugggauucaucuguauuguugcacaaaucaguaauuuccuccuuuuauugugaauaacauuuccuugugauguaccaccauuuguuuauucauuccucaguugaaagaguuuuugaguuuuuaacaauuaugaauaaaacuauaaacauucauuuaaagcguuuuaugucaacauuaacuuuucauuuaucgaguauauacuuaugaaugagauuggugguuugucuaguaaguguuccuuuaaguuuauaagaaacugccaaauuauuuucuaaaguggcucugcuauuuugcauuccuaccaacugcgugagaauuccagugacuccacauuuuuacuagcuuuuaguuuuuucaguuuaaaauaaauaaauuagauaauuacuuuuagcuacucucauagguauauauaaugguaucucacuguaguuuuaauuuguauuucccuaaugacuaaagauguugagcaucauuucaugugguuauuugugaucuguaugucuucuuugugggcacuuuugacaaccacagaaagacaaacuaguggauuaaaauuauaaucuuguacucacggaggaaauaaaguguaucucucuuuaaccuuauauuauugaguuuauuaguacauaaaauugacaaaaaucauuuuauugucuauuuaaaugacauaaugguaauuauucuuccugacuacaacuaucauuaaagauguuuaccauguuccuaauaguucucaugucuaauugauuccucuccccauuucccacagcuauuuccaaccuuuaccauuuuuucucaaguucuuaaacugucuguaguuucuucaguauuagucagggacuugcuuccuucuuuuacuaagaaccugaagaagaaacacuugcacacuccaccagcaguuauuuucaccuguccuaauuuucucuguguuaucgcagcuccucucaccucacccaggucuuugauucuucauuuuucucuaguuaacucaucuaucuugucccuucucuucucaccuucccuaggccuuucauguaucauuuucucugcuuuaaaaaaauauuuugcguauuuccuuacagucuuuuuccucagccacuccauccuuaucuuaaacaauaauagcaggccgggcacaguggcucacgccuguaaucccagccuuuugggaggccgaggcgggcagaucaggaguuugagaccagccugaccaacauggagaaacccugucucuacuaaaaauacaaaauuaaccaggcaugguggcgcaugccuguaaucccagcugcucgggagggugaggcaggagaauugcuugaaccugggaggcagagguugcagugagccaagaucgugccguugcacucuagccugggcaacaagagcgaaacuccaucucaaaacaacaacaacaacaacaacaaaacaauagccaaagcuuucauuucacuagucuagucuuccucuucagucuuuuuuuuuuuuuuuuuuuuugaaacggagucucacucuguugucuaggcuggaaugcacuggcgugaucucggcucccugcaacugccgccucccggguuuaagcuauucuccugccuuagucucccaaguaggugcacaccaccaugccuggcuaauuuuuauauuuuuaguagagacgggguuucaccauguuggccaggcuggucuugaacuccugaccucaagugaacugcccaccucagccucccaaaguggugggauuacaggugagccaccgugcccggcccucuuccaucuuuuuaauaggucaugacuccuuucuuaugaaguaacuuauaagcauaauauaucuuacuuuguugauguuucucaucagcgaccuauuagaaacccaccaaaagccucuaccccugaccaccuuacuuaaauuuaacucucaaauguuggagacaacucauuacuagcauuaaucaucucuucucagcccucagccuguuugaaaugucugcuauuuuuggaagagucucacuacucuuauagaaucuaccuucucccuuugcguuuugcuucuuucaagacacaauuccguuuguccuuguugcaguuacuuauuccuguauaagccaccacccaaaaauauagugucuuaaaaaauaauguuuuauguuucucaugauucuuuggguugacuggguggagguucugcugacuuagccuggauuuacucauguauuugcauucagcugacagguugauuaagggauggguucaguugagacagcugaaauggcuagucuuuuaagcccagguuuaacagugucaugaucuguuaaacacggguaguguuuuaagacagugaagauggaaacaucaaggccucuucaggucuaaauuuuguaauuuccacagugucacuucugccacaaucuguuggucaaaguaaguaacaagacuaacucagagucaaaaugagaaagagacacuaccucuggacaggagaaacagcaagaucacauuucaaagagguaccuguacuugggugggaaagguguggauauuaaacagucuacuauauuucuuauuuugugacucuuaguuaucucuucuuaguuuucuuuuuuauccuucuuuuuuuugagacagccugucgcccaggcuagagugcaguggcacaaucucggcccacugcaagcuccgccuccuggguuaaugccauucuccugccucagccuccccaguagcugagacuacaggcgcccgccaccacgccuggcuaauuuuuuguauuuuuaguagagacgggguuugaccguguuagccaggauggugucgaucuccugaccucgugauccgcccgccucggccucucaaagcauuggaauuacagccgugagccaccgugcccagccuuuuuuauccuucuuuaaauguuuuguguuccuguucucuuaccaguuucauaagguuuucaccaauauuuauaaucgucuccaaggaucaacaccuggaucuccugugggugauccaaauuaagauaguccaaaagagaauucauaaucccuauuucucaccccacaucuucucuucccuuccuggauuuauaucuugauccccgguccauggcauuaucuguaguuaugcaaacuagauuauuuuuguaccuuuucuuaccucccauauucaguugcugauaaaguccugcugacuauaaauuuggaacaucugcccucucguuuucuaccucagagccauuauucagguuuccauuauucuuuguauuuuaauacuaguauuugaguaauuuacaguguuuuugaguuuugaauauuuuuggcaaaagugaaaugaaaucaguuuauuuugugaaguaaaaaagugaaaugaguuuauuuugaaaaagugaggaacauacauauggaaaaauguaaaaggaauuaaaaauuacccaugagccucacucagauguacacaguauuaagcuuucuguguacauucuuuuagguuuuuaaauaugcauaucuaauguccaaauacauuuacauuuaaaaaacauuuuaagcauguuuuuuaaauguguuaaugcuauagguauuguuuuuaucuguuuuuuucaaauuauauaaucagcuucuuuugaugcauaguauuagaaauucuucuaagacuuaaaaagugggacaaagaacagaauucagugagauauugagaagauguaaauaucaggcuaaaaaucagcaucucuaaaaauuagagauggauacagcaaaauguaugcacaacggaggaccucuaauguuuaacaucagaggagaaauguaauuuuagacaaagaauuagugagauaagguacuuucugguuugucuuuguuuucaguacauuaacuggaauuuguuucuugucucgcucaguuaccuuucuaccucaccucuuuuuuaaauuaucccuuuguuguuauuagcaugccauuuguaauauuuccuuuaacuucuuggacuuaaugagcuagccucuuugaguuuuccccuaaccucccaugguuauccuucucucacaaggcauuguuuucuccuuuuuugcauguuuauguuuuuagcagggcuuuaucuugcuuuuauuuuuuugaauauaaguuugccugcaugcguucagggcuauuuuaucuuuuugcucucauucaaauuaaaucaaacccaauaaaucuacagaccugugcagauucagggcugcuuccucuuuuauuuuuucuuugggacaaaagaccuccaaaacaauagcgagcugauacaauuuucuuugauuguggaaaucuaauguaacuaguuuaccuaauuccaauugauccuuucuuuagccucuguuucugacagccacuaugaacacucaugcgucaguuacuuugcucaugcuguuuucuuuaccuggaguauugccuucuugugcuucccuuuucuccccagcagagccuacuucucuacugugcagccaucuuuagcccucaguccuugaucaaaguaaccaucucuucucugcauucgccgcacucuuuggugcuccgcacuuaguucuuuccuuauuuuuacuuauugugaagagguguuugauuguaaccuucuuggagguagacuguguauucacguaugccagccauguuauagguuugcuuaaaaugcuuagcaaauuuaguaaagaucaugauuacacuaagauaauguucacauagauaaauacaacucagccgguuuagugauuaaauguagagcagcuguuguggagaauuggugaguugcuuauuuaguauguuuuucaugggagggauagcaacauugccuucaauugauggcaaguuucacgugucacaauuaaaguuuuauguacguauuuugaggcuaaauaugaaauuccaauacugauuuagucaucuuuaagaggcauuuauucuugccucccucccacuuuuuauugauuuguuucaaaguaaaagcuuuuauuuuuaaaucaauaacauucagguaauaugauuccauaaagccuuuccaaaaauuugagaccugugugguaucauugcgauggcacuacaucagcaguaucuguagaacuugauauuggagaguuuuguucaaagaaauacuuugucuugauaggacauuaagugaauguagagguauggcucagcauaacugcuaauuacaguuucuuuuaaauuaugaagugccuuuuuuccuuuuggcuuuugccaaaauggaaaagagaaaaaaaaaucaaugacuauaaauacuggaaaacucuaugacaauaugaugaauaaugaaauaaaaauuaaaaacuaccaaagucauacuugauagacuuaaaaugacaaaagcaagggacauuggaaguaaagauucucauugaauauuuaacucacuuauuucucccuuggcugaacguguggagcggaauuaccuguuacuagaauggugaugaaguguuaaaugcauuuuggcuuuaguguuaucauugcuuuugcuuuuuuuuuuuuaauuuaauuuaauuuuauuauuauuauacuuuaaguuuuaggguacaugugcacaauguacagguuaguuacauauguauacaugugccaugcuggugugcugaacccaguaacucaucauuuagcauuagguauaucuccuaaugcuaucccuccccccuccccccaccccacaacaguccccgaagugugauguaccccuuccuguguccauguguucucauuguucaauucccaccuaugagugagaacuugcgguguuugguuuuuuguccuugcgauaguuuacugagaaugaugauuuccaauuucauccaugucccuacagaggacaugaacucaucaauuuuuauagcugcauaguauuccacgguguauaugugccacauuuucuuaauccagucuaucauuguuggacauuuggguugguuccaagucuuugcuauugugaauaaugccgcaauaaacauacgugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaaaguguuccuauuucuccacauccucuccagcaccuguuguuuccugacuuuuuaaugauugccauucuaacuggugugagaugguaucucauugugguuuugauuugcauuucucugauggccagugauggugagcauuuuuucauguguuuuuuggcugcauaaaugucuucuuuugagaaaugucuguucauguccuucucccacuuuuugaugggguugguucuuuuuuucuuguaaauuuguuugaguucauuguagauucuggauauuagcccuuugucagaugaguagguugcaaaaauuuucucccauuuuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguaaugccuagguuuucuucuaggguuuuuaugguuuuaggucuaacguuuaagucuuuaauccaucuugaauuaauuuuuguaugaggugucaggaagggauccaguuucagcuuucuacauauggcuagccaguuuucccagcaccauuuauuaaauagggaauccuuuccccauuguuguuuuugucagguuugucaaagaucagauaguuguagauauacggccuuauuucugagggcucuguucuguuccauugaucuauaucucuguuuugguaccagcaccaugcuguuuugguuacuguagccuuguaguauaguuugaagucagguagcgugaugccuccagcuuuguucuuuuggcuuaggauugacuuggcgaugugggcucuuuuuugguuccauaugaacuuugaaguaguuuuuuccaauucugugaagaaagucauugguagcuugauggggauggcauugaaucuauaaauuaccuugggcaguauggccauuuucaugauauugauucuuccuacccaugaacauggaauauucuuccauuuguuuguauccucuuuuauuucauugagcagugguuuguaguucuccuugaagagguccaucacgucccuuguaaguuggauuccuagguauuuuauucuaaaaauauggaaugcuuaaugaauuugcgugucauccuugcgcaggggccaugcuaaucuucccuguaucguuccaauuuuaguauaugugcugcugaagcgagcacuauguuugcuuuuaaaguuaucuucuuaauguugauuuuuuuuaaagacuguuuuguucuaaaugucucuguaggugguaauuugaaaguauggaauuggugucuucagaaauaauuucagacucaaucuaguuauagaaaaaaguuguuuuuguguuugacaguuaacauacaucuugauuuuuuuguauauguaugauuugauaagccccuuguuucuagcacauaguaauauggcuuuuuuauuaaagcaacaugugcuagccccuuugcaguuaucacaguagugucguuccauuuugauuuugcuguucagcacuuuuuaaaacugcuguaucgguuucuuuuguaguaaaacuugaaauaccaguucuuggcgucaaauaauacuuucuuuuaaaauugacuuuuagauaaauuaaaaaugguuaagauguagauagagaagcaaacgugugacuuuuuuuuuuaaguaguaguuggagggagcauauauucauuccuucuuucaugccacauuaacugaaugcccauuaugugacagcuucuugauacacucuggagcuauacuggugacugagacauagccuuuucccucaaagagcuucuaucugccaguggagacugacagguaaauagaucaguauaauccaagcugacaggugacauaagcaugaacagaacuguggaagcacuagagcaggaucagcacaucaugccucggggaagcaggagacagcauuauauaugguaauucaaaauuaaauggaaucaugagcaacccuauauuuuaaagcagaaauaugauuuucuuaguguaaauuaagccuuuuuucaacuuaaauuuuaguuuugaaugaguugcugucauucagaaauuggcuuuuuucuguguugucagcaucgugugccuuuuuccaccuccucauuccccuccauacuccgaagaaugucuuuaauguuugaaccacuaugucacauugcaucucagauuuaccuucucuggcuuuggaugcuccugaaugggggugauuauuugcauuuccuuugcuccucuuggaggacugggucacauuuaguuuaaggguuacuauuagugagcaaagagaacaaaggcaccaggagcugagaaugcccuuuucuaggugacuuuuucccucuauaucugaccuaaguugugcacuucuucaguaaucagagacuauaauuacaugcuaauguuauagcccugucaguaucuguuucuacaagaucuuuauguauuccaaggcauccuguguagggaagcauacaauauauuguuaauuuuggacaacuuaauccaucccaauucuauaggcugaugauaagcuugaagaugacaaggccaggugacagaauacuggaggauuaguuucugaguaguucaagauugucuuuguugauuaaaacuucacuguguaucagccacucugauuuggacuuuuguugaauaugaauaaagauaagaggauugagcaacuccuauaaagcaaagugaaauugcaagcagugugugaagaaaacugguuucacuuuaaccaaggacaacaggaaacaauacacacuuguguacuuuuuugugucucugaugauaucagaccagcuuucucuuaucacugauaaagccaugaccacagauguaaaucaaaugacuuaauuguaggucgcuugucaaacaaaaagcuuuuguugcaaagcaauagcaaaacuuugaaauguguauguguauacuuagucaauguuuagaaucuauucuuuauuugaauauauacauauuuuccacauuauuauuauaguuuuuuauuaugugcuaugcacagaauuaaguuccucucagauucauauguugaaccaccaacaugucuuuauagguagggcuuuuaggagguaauuaagguuaaauaagguuauaagaauggccuccuaauucaauagguuuuguggucuuauaagaggaagagagaccuaucucuaccugugaauaugccuaggaaaggccaugugaggacacagugggaagaaggcagucugcaauccagugagaaagcccucagcagauucuguuguuuaagccacccagucuaugauacuuuguuauggcagccuaagcugaccaauacaccauguaaugaacgugcuguuuucuuauuucuauugcauaguuauuuuaggaauuuuaauauuacaggcuuuuuacugaaaugagacaguuauuuuauguugccuuuugaaaugugagcuugagaggauugcagggcuaaugaggggcuaggaaagaaaaauaucccuagauuuauucaaauuuuucaaaaagauauguuauauauuuugcaaaucaaaaauuauuagaaaagacaagauaguuauuauagaauuuaaaguauuuuauuucauacauuacaaauacaaaacauauuguuuuaagaauugcuuuggauuguuuugaagcaaaauguuggaugugauguccucugcucaugauugcugcagaaauacccaaaugacauaguaagauuuucaugccuuauaaauaagucuuguauauucacagucuuucuguuauucauuguugaaccuuugucuugaaauaauguaauucauaagaaaagagauaacuuauuugcauaucauaaauuuuaguucuuuuagcuuggguccaaaucaaaauaaaauucauuuugcuuuuauuuuguugacuaguuuuggaggauauauaucaucauugcucuuaaauguuauuauaguuauuuaauuuguuuauuugcuuuaagauaaaauauaagucuuaucagagaccaaauccaacaacucagguuagaaaugugaauacuuaaaugaccauuauccaagaaauucacaaaaccuacuuguuuucccucaauuaugagaacuaaugcauuguagagagucacuacccuuuucuuucccugacaaccuccaucuguggucacauauaugauuguugggacuucuauaguaacaaacccuuuguuuucauuuucucuauagauucucuuuuuaaaaacccuauuuucuaacaucuuacuuuguaauaguagggaaagaaagcaucauguauguauggucaaccuauugucuccugucuguuuuaguuagaaugccuagucaaaugacuuaauacuuuggauuuuuuacuucuacuuaguacauuuucauugaauuggagacauaagaaggaaaaaaugagacugagacaaacaggcugaaauaauuuuaaaaguccacaaauuuuccaugaaaauugcuuaacacugacuagaaaguaucaguaucagugauagucauugagugguuuugcuuuauccugcccacuuagaaauagauugucuucugauaauugauuauauaaagauuugcgacugauaacugaucaauaauucaauauggcuuuaagaugaaguuaaaauaauugauaucuuaccauugggacuacacauguagagaaccuuagauaagcaagguuuuuacacccuuauuuucauuuuaauuuaccuuuucacaauuuucugugugguuugguggugaagaauacagauuuuagaaucaaagacuugucccacaauaguggauguguagaaugguuaaauuacuuuaucagucugagcuuccauuuccuuaucuguaaauugugguugugugguagguuuguguagauguuaauggaaucauguaauccuuugaaucguauauauguaaacauuacaguggcauauaaaaaccauuuaaaauggcauagauauaauaauuauuucccacaacauuguuaagaauucaucaaguucuguaagcaaaauaugaaccuuuagaagggacuuaaguaguagaguuggauuucacccacaucguuuucuggauauuuuuucccaagcccuuguuuggacaaauaguagagggaaauguaaaauagaacaggaaaccuugauuacuguggguaguacugcuguugagccauaugacuuugagaauucacuuagguaacaaaacagauugaauugucaaagcugauucauaugaaucauagguauuaucuaacaccauaauauccuaauaauucaaaagauacaagcagaaaccaggcacaaguguaauauuuuuuuccagagggguuugaauguaucauagacagcuucaaaaaaugucccuuuauccacauuugauuagauuuugguuuuggauuaagagaugggcuccaguguaugcuauuuugguuuuggaacucuucaguuuuauacuccauuaauuucauuaaaagaaaaauucuuaugugauuaugucauauucucuagccaugcccucauaaaauuuuaaauuauagguuuauuuacaauagcagucuagaagacacuaauauauccugcucaaaacauuuuauauaauagauagguccuuccuaguaacuuucucucaaguaaaugcaaaaguaucauuguuaguauugucaaaguguggucauuauuaguaucauuauuaguacugucaaaguaugauuaccaaaccaguaucugguuaaaguaucauuauuaauauugucaaagugugaucgccagaccaguagcaucaauaucauaagggaacuuauuaaaaauacaaauuauugguuccuaugccaggccuacugauucagaaauuuugaggaugagacaucagucauguuuuacaagcucuccaguugauucugaugcaggcuaaaguuugaaaaacaauuguaauaacuuuauaaagagaucugguggaggucauucauuucuucuagcauucuucccugcaaucccagggaagaagugaguuacacaccugacaauaaccuuuuacuuuccaaacuuaaccuauuucuuuauaugucuguagauauauuuauauauaaaaaauguuuuacgacugauuuuaaaaugcugaugguaacaauauaaacauuaucaccaaaaucaccuuguagaaaaaaauuguagcagugcugcuuuuuccuaauguacuuugcaauuuguuucuuuuagaauuuacuucaagguaacuuuuaauccaaaauaaaaugugucuuacugcuuugcagugcaacuguuuuucaccaaguuugaccucuuaacacgcccaccagauuugacucuuaaugauuggcuuucugaaaauuaauuguauguacauugcuaaucuacagacauuagaaauauucuuaaauugcuuaaagguaguuuuaaguaugaauuuccaauuuccugcauuuggaaauuaauuuuaaaaucagucuuaaaacaucuugccuugagcaagaucagcauuuuuagaauaagcuuacuuugaaauuacacuuuuaaaaaaucaguaauauuacuuuauagucauauauaauaaagcauaaauuuggcccaucucacuggucucuaccacaguucuagaaauaagaccaaaauuucucuuuuuuaaagaaucuucuaaaacucaacuuagaacugaacaaauaacauccuuuucauucuuuguuauuuaauaaaaagaaauauuccuucagaucauuaacuuguaagauugaggaagaaaauaagccacauuuagaucucaguuuccuucuauaugacuuggaauuuuuugguuacuaaaauuggcuugcuggaaaucuucccuaauuagagaaauugauggaugacaaagauuaauuauguuuuauccagcuauuauauauccccuugugaacuuuuggcacacacuucgcggccgagcuuugccuuaugacuuuguuuuguauccagaagcacucugccuuuuaugaacacuguaaaaagaccucaaaauugguuuucagccaccuugccaaacuaaaggccuuguacugaugaaccucuuuuguuuauuuuaauuauugaagaacuguagagaaauaauuaucucaaucguuuugaaauuuucuaaaugguccuguuugauuugggucugauuugaaugaaauguuuguuuuuaacacucagaacauaaagauagcauguuguugguaugcuuguaaccaggaguuaaggaaccauuuuaccuuuauucuccuuuaaauucaaguuauuuuaaguguuuugcuucauauuaaguagaauaauuuuaguguagcuacuuuauacaucuuuuaucagaaaugccaaaauacugcacacccaccucaugaucagauccaaaaaggugaauauauauaauacguauauuugcuguacucaguguuauccuacuaccauuuuaauuaauaaauuuagauuuuagccggugugcuuacuaacgguaggucuguuaagauuuauuugaccuuaauaagagugagaacagggacuauaauguugacuucccugugugaagucuuucuggaugcuucuuuuaguguugaaaucaacaaacuucuauguacauuauuuuuaaaaaugcauaugcauaauauaaggguauacuuaacauaauuaucaagucauuuaauggauuguagacucacaagugggaauugcuuuuuucauuuuuaguauucuaacaacauuugcuagagggauacucugaauacuagaaucuauuagaauaaaaguguuuuuccuaaaaguaagcuuucuucaccaauuuuuucuuagcuacuagcuuuuaguuuauaaugaaggauucuuagugcuuaucuuaguacuuuauaacauuacugaagcuuuaggauaaacaacauauaucccaucucauuacuauaaaguaauuaauuuucuacuaaacuguaugucuucuaugaauaagauuaauugaaaagcaaaaaaacaagcuuucuuagauuugauagauauuuaugaaacaugacguugugaaaugugugcauuuuguuccuaaaaguuguuguuuuuucauguugcauuacuacaagaaguaaaauccaaaaaauaccuaccgcauguuaagcauugcaagacagauaaagccccuguagguaugcagcuuaccuuuuagagggagaagauagagaaagguaaacaaauaauuuauaagauaauuauagguucaucaugcuaaaaaggaaacaagcaaaguaauaauguccuuagauccaaaaggagggcuacuucucuggcuccauuuuggcagucuaccaguuacacccucccuacaguugaggaguuuaaaguaccuagaauaugugcccauauacaguccaugcuuucuaccucagagucuguagaucuucauauuuccuguuccagcaacccugagcccacuuccaugcccugcccaagcuaaugacugaagucuauugucucaagggaaguccauugucucaaggguggaccacaggaaggguggccaauauauuugaggaacacauggaugcagcuuggaauauacaggaaggagagucuagagauaccacauacuaggcuacaugaggagcauaaaggaaccaggaaugggaagagagacaaguaggcuugcaguacaggaccuggggagacuucuccuauacugccauguucuagugcagaagucuugaagugaauauuugacuuuccagguuauuagggagguauauuugucaaaguaauggaaaagaagaugucacauuuaaugauuuguugacuugauauguaaguuuuacauauuuagacaugugacauugggccccacaaaggcuaaugacauaauauauagaaauauuaccuugugagggucacuuuaguuaggaugaucagauaaaguuucucugaggagacacgauucaagucaagaccuggaacaugaacuuguagaggaaaacaaauaaguuuuaacuggaggguauuccagcuaggguaacuaugucauacaaauguauagaggaucaaaaucaacaauaaccagaugcuucaucugcauaaagaaucaaaagaggaccucagaggaaggaaugaaauaacauaaggauagagaucugcagggacuagauuaugcccuauuaugcuauagauaauagcuugguuuuuaaucuaagagcaauggggcauuacuggagggauuuaaugagagaauagcagguucuuaauuacaucuuuuuaaagaaaccacaucuuuuuucuuauguguaaaauguauguaaagggaggauggaagcaugaaaucagguuaaaagacuauuauagugaccuguggaaggaaaugauguuugcuuggucuuaacugguaggaguagagauagacagaaaguguaugugucgagugauguuuugcaaguagaccuaacauuuucccugaugcauuguauguggagaaugaggcagggaaaauaaucaagaaugauuaagauuuuugguuugagaaccuggaugaauaguaguuacauuuacugaaauagagaaugcuaugagagaaacacaguuuuuuagggagauaggaauugagaguucuauugugaacaugguuagucugagguacuauuagacaaucaaguggagauuucaaguaggcacuuggauacguccaaguugaacucaggggaacaauguggacucuccuuuuguuuugugaacauaccacaugcuucuuaugucucagagccuuaguuccaguugugccuuuugucggcaguauucuuuccuaccuuugccugcuuucagucucagcuuaaaugccaaucuaucuaaaugguucccuuauguccauuuuuauucucuaucucaguauuguuuguguuuugggguuuuuuuguaacuuuuuuuuuuuaauuugcaaacauuuucacuuuuucuucucuucaugaagagggacauuguuucacucacccuaucuagccaaugccuagcacagugccugucacuugauagauauucaguaaauacuuguugauugaaugaaugaaugagcaguugugguuugcuuaaaaggaaagacaaggugcuaggaguagaacaguaugagagaugauggacuccccuuucccccaaagauuugaggguucuugaguaagaggaagaaugguuaauguuuauuaagcacuuauuauauguuaggcacugacugaguacuuuauuaagaucucauuuaauauuuagaaccacccuauauaguagcuucucuuuuuaucuuuauuuugcagauaaggaagcugagacugaaagaggccauguugcugaaaguuacacagcuagugcaggacagccauauuucaagcucaagcaguuucgcuccauagccuagucucuuaacaaauacauagaacagaagacuauuucugcagugcuguagaucauuguaguuuccuuagccuuugaugcuauugaagaggauucugauaaacucaguggaauaguacauaauacuccucagaugccucuucccagugucagguuccaacagcccaacaaaaugacaccacuguguauuccuugaagccuggacaagguucacuccuugcauaucucuucuucauaagacuaccacccuaugcagaguggaauggaaagaaaacgaaagaaagcaguggagagagguccuugggagcaagauccugauucacuucaacucacaggcaggucuccuuuuuucugguagccacuggggacagugccaagcccaucugauagagaccccuucuucauaauggccagagugugugagcuacggaggacgguggguagauaccaaagaaugaaaggaaaaagccaggagucucaucuuuuuugcucuuugaagauaaagguaccgucuaaucccccuuucuuuuucauauugucacuggauaagaaacuccugagagcagaaacuauauuuugcuuucauuuugaugagccccugugccuuucacaucauguuuaagucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagauaguuguagauauacggccuuauuucugagggcucuguucuguuccauugaucuauaucucuguuuugguaccaguaccaugcuguuuugguuacuguagcuuuguaguauaguuugaagucagguagcgugaugccuccagcuuuguucuuuuggcuuaggauugacuuggcgaugugggcucuguuuugguuccauaugaacuuuaaaguaguuuuuuccaauucugugaagaaagucauugguagcuugauggggauggcauugaaucuauaaauuaccuugggcaguauggccauuuucaugauauugauucuuccuacccaugaacauggaauguucuuccauuuguuuguauccucuuuuauuuccuugagcagugguuuguaguucuccuugaagagguccaucacgucccuuguaaguuggauuccuagguauuuuauucucuuuggagcaauugugaaugggaguucacucaugauuuggcucucuguuugucuguuguugguguauaagaaugcuugugauuuuugcacauugauuuuguauccugagacuuugcugaaguugccuaucagcuuaaggagauuuugggcugagacaaugggguuuucuagauauacaaucaugucgucugcaaacagggacaauuugacuuccucuuuuccuaauugaauacccuuuauuuccuucuccugccuaauugcccuggccagaacuuccaacacuauguugaauaggaguggugagagagggcaucccugucuugugccaguuuucaaagggaaugcuucuaguuuuugcccauucaguaugauauuggcuguggguuugucauagauagcucuuauuauuuugaaauacaucccaucaauaccuaauuuauugagaguuuuuagcaugaaggguuguugaauuuugucaaaggccuuuuugaacguacauauuuuucuagcuggcuauuuuuagccacucaguugccagaaccugaaaagggucuguaucagcauuuuuucacuuauuaucaccugcauugcuuccuuuggagggcauaacuguuggcucugagaguuuuuuagucaagaaaaaugagacauucuaaaguugagaugaaugaaaaugaguuagaaaauauucauauguguacagaaaauuauacagccuuuuguucaguuaauacuauccuauaauaaacaaguuuauuuuauaaguagggaaauuacauagacauacauuaaaaauaagaaccaauuaaaauccuuucuagaaugauaggauaaaauaaauuauacacauacaagaacuauuuuauguagcuugcaaauauaaugaaauauuuucuaagguaauaauguguguguuuccuaaauaagaaccauuugggaagaaaguacuuuuggauuauuuagaaugaauuuauagaacauuuaaacaaauacucgguuacuaaaagcuucucagauagauuccagaugggcaacuacuuugcauacuuuucaauaaguuuuuuuuuuuccucuaaagcaacccugauaacuuuaaugacaaagcugaucaaauucugaauaauucuuggauuauaaaaagguucuauggcugagacuuugaguggaauaaaugugcugagccagcuagggagauaaugaagcaggcugacugaaaaauuguauauaaaagaaaaauagagauagcaaauauuucucaguaugaguaguagaaaaaucucugagaaucaucuuauguauugugacauuuuguuaauuauucuuucuuuuuuguuguuguuguuguugccugagcuggaguacaguggcccaaucuuggcucacugcaacuuccgccucccggguucaaggaauucuccugucucagccucccgaguagcugggauuacaggcgcccgccaccaugcguggcuaauuuuuuuguauuuuuaguagaaacgggguuuuaccauguuggccaggcuggucucaaauuccugaccuugugaacugcccaccucggccucccaaagugcugggauuacaggcgugagccaccacacccggcuaauuauucuuucuaaggauuauauguuggucuuugugcauuagcuccaaaauaccauguugucaauauguuuagaaauucaucugcuacagguauuaaaucuuuguagugagauaauauuuuuuuuuaauucugauuuaaauuuugccuuuuuucuuucuuucuuucaaacuauuacacuggaugauuaccacuaucccuuugaccaggggcuggacaaagcuuguauuuccaguauuuuuuguaauuaaguccucauguugaaccugcaauacauuggcucuugcugaggaauagauuguauuacuguauuagugaauuggccuguauuuaagguagaauuauuuaucaaaaacaaugauuuaaaaaugaaaauguugaauuaaaaauauaacuucagucacauggaagcaagaacuucuauuucaguuuugaauguuggggagauauauaggaauagaauaagguuguucuuuacuauuagcaguauuuucuuuuggugggcauucuucuuggagaacugugaaucaaagggaaguguuaauuuaagucacacuucuaaucacucugacuuaccuacuugagaucgaauuucaaauaugucccugugccccauaaagcccuuuaaagggauaacuuuaggaagaaauggcacaaccauccaaagagauuuggcagcgguugauugacauaauaaauaaugaccaucuguacccuguagcaguccaccaagaagcacaguuagucccugcagccugggcagacugcugguugucuucagcaggugaacaaaggagacguugcuuauuugauaguuguucacuuuauuuaaaaugacuacauuugugaggcaaaauucuaagauuuagguuuuagcauuuuaaaacuaauuagauuuuauuuucaguuauuuuuauagcuuuugcuuauuacuguaucuacuuguauaaagaugugggauuuacauaguguuuucauuaaaaguacuauauuaaugacaauuuuguugaaaccuuauuuuuaagugauuuuauauuuuauagaaaauuuggaacagaguuauugugggaaaauggaauauuugucauuuaucuaguggaaauaagugguauagagaccgaaguugagucauuauuuuuuuagguuacagauuacauaaagauuauacaaaauugacucauaacucugccaguuauauugacauacuugauuacaacuguaaagcuuuuugugauuucauuuuuuggcacaaaaacugugaaugugcaaaaugcaaagcuuuagauuauaaucuaaugaaugcaguagaugaagagcaaucuauaauucauuugcauagaaauaauuucaaacaaaguauguaaaucauaaguuaaaaaaucuguuaggaauagaacuugaaacuuaaaauagaauuuauaacccauuguguuucaauuaauuaaaauugauugcaucauuaucucugaacuugaaagagucauaugcauugcuuuaaauaaauuacucuauuuuggguaacaguauaauuuguuagaaaggacauaagcuucagagucagacauauauggguucaaacauuguuucugccauuugcugucagaguagccugucucucagaaccucagaguccuggcuugauggugucacuaacacccccaaguucagugauccacuagaaaggcucacauaaguuaacauuaaguuauauucaaggcuaggauuuauugucgcaaaagacugacucauguaggaacagcaaaagcuaggucaaaagaggcuuucuugcccuauuuauagcaggaauuguauggcuaagucuuucugucuacaaacugcaaggccaugugugauaccauuacucaggaaaucccauuugaguuuuggaguccaaaguucuuaccaggggcugaucacauaccuguuaacaugaccagccaugugaggaccccaaaccaggcaccaugugcauagaauggauauuuauguuuacuuuaagcaugcuaacaaccuaguucuucuugaccugccacuucagucauuauggacuaauauuacucaguaacuuuugaacauucugguaguuuaguucucauuuucaccaaagguggucaagaguauagagauaagcagaaacugaaugaaacagaccuacuuuguuaaacuuuccucacagaguuauugugaaaguuaagguagagcucuguuuaguuuugguuuuaccuacguccuuuuaggcuuucuuuuuuuuuuuuuuuucuucuuaccuuuuuuuuuuuauuauuauacuuuaaguuuuaggguacaugugcacaaugugcagguuaguuacauauguauacaugugccaugcuggugugcugcacccacuaacucgucaucuagcauuagguauaucucccaaggcuuucuuuaucugaaaaugucuuuauuuucuauucauuguucuuuuuuuuuuuuuuuuuuuuuuuuuaauuagagaaagagucccacuuuguuucccaagcugguuuagaucucuuggccugaagcaauccuccugccucggcuucccaaagugcuagggugagccacugugcccagccuuguuuuccauucauucuugaaagaugguuuuaccacauuuacuauuuacaguugacaguuauuuucuuucaacacuggaaggauacugugcuacuuuuguccaaacugugugguuucagaagagaagucugcuuucugugaauugguauacccuguagguaaagucauuucucucuggcugcuuucaagacuccuugucuuuccuugucggaaguuugauuaugaugaaucuuggcuugaauuuauuuguguuuauccuauuucagguccugucagcuucuuguuuguagauuugugucuuucgccaaauuugagaaguuucagucauuauuucuuuaaguacucuuucagcccuacucuuucuccucuccuuuuaucucagauuauacaaaugugggauugcuugccuuacagguuccuaagguucuguucauuuuuuuucacccaaucuauuuucucuuuguuguucaaauuggguaaucuauugaucuguccucaaguucaaugauuagccucucuuaucuucacuuuacuauugagcccauucagugaguuuuuaaaauuugcuuuguaauuuuuaguuauauacuuuuuauuugguucuuuuuuuaauaacuucuguuucuauggcugagauaaucuauguguuuucauauuuuucaagggaauuuguaagugauuguugugcauuuuucuggcagcuuuaaaauccucgucagguaauuccaacaucagauccaucccacuguugguugacugucuuuucucauucagauugugauuuucuuggcucuugauaugauggaugauuuuuaauuguacccuagacauauaaucuauuauguuaggacaucuugggucccauuuaaaucuuucauuuuugcagguaguuaccuuguuuagguuuagcagguagggccuggccugcuuuaaaugguuucaaugacagugcaauuuuuagagcuuuuuugguguuauuuuguuuuguugguuuaucuggugccacugggcuuccuucuaacuuguucauuuuaaugcugccucuaggaguagagggaauuccccaagucugggcugccagguguuucacugaggaagggcaucuuaggccuaugggauuguuugguagacuucuccugccucugaggaacagaguacuuccugggcugggaccuuauuguggugggauucuuucucccguuaggcacacugcccugucaucucuggcaagggagauaggagucucagugcauggagacaaagagacuucccaggauaggucuuuuuuuuguggcaguacuucucuugccaaugcaacugagcugccuuguuauuucucaguugggaagugagauaacaggcccacagaaacaaagaggccucuuaggcuuggucgcucauuugucugggaucuaucuuccuguuacuugugggccaucccaguauuucuugguggggcaaagcagucuuaggccagcugggaaagggagucuucccuuagcugcuuauuguuaguuggaucuccagucaauccccuugaaggugguacugggcucauuuggucauuuugaggacucuuauauaauccaggggaggaauaggccuaacugagccgccuucuauggcuauguugggagucaaacugccuucuguuguggcgguaggauggaagacauccugccacuauucuguucucccauuccaggagucccaaaccaauucacccuucucauaccaucuuucagaguuccuuguuugccucuugaauuauguccaggguuuauagcuauaauacuuuccuguggaaaggagcagggagaauuaugcuucuagaacuuguccaaugaccauaguauuuuaauuguuuguuuggaugcuggauaauauacauucuauauuuguauaguagaacaaaugcucacauuuuuaaaaaaaaauuaaaggguuacacaauaaagaguauuuggagacuucuggucuauaagauuaagugaauacuugauuccuuguuuaagcucuccauggccugguuagaaaguacauuucuaguuuuucacugaacauuacuccccuuuaagaagucuuugccuucacucuucuuguguauucacucuaucuagaagauuucuacuucuuucuaugcuuuugccaaaguuauuuucuccuuuuagcauaucaaucauauccauguucaagacuuaucucaaauacuaccuguuuuuugagacuucuucugacuuuucuagcacaauauggcuuccuuuuccucugaaauccuuugucaucacuuacauuacucaugugacacuugaaaugacauuuugaacagaguguaaucuaaguuuaucuuuaacucaucuguuuggagaugaacuuuccuagagaagcagugcuagcaaugcuuaaguauauccauaacauaugcaauguauggagcauaacuaccauuuuacaugagucuaauggaauauauccuuauauacugacaguucuaucuuaaaauuccagguucauauuccuagacuuacaccccuucucuaccagcguaguuaauacugagucccauaggagugguggcuucugugggcuaugccagagagacugcugcauggcagacugagagaaaguuuguuggcagcgaaguagaaaaauaaacucuuuagagauguuagagagaagagagcuaauguuggugggacugugacaaccacuaaucauagguuagaaaagaaacuauguuucuuuuacacagguauucuugcccaacuccuacccuucacugaacacacuuacauuuccucccugugccucauuuuuucacucaacagguaauagcuuaccuuauugguugcccccaguuuccuguauuacaucucuuuuuccuucuguuccuugugcuucucaaauuaacuacuacuugcauuugaauccuugucucagggucugcuucugagagaacccaaacuaagacagggacagucagcuaccucacauccacaaguuauuagaacuagauucaguagcaucagccaacuccccagaagggcaguuaauccaucucauucauuucuucuuuucucagugucacucacgaaucaauuaauaaaaauaaguauuauuugcuuaggcaauuagaagguacacugugauuucauggguuuauaaggccaccaaaaucuuuauauguagcccauaucuuacagugauuaccaaagugcauaauuuauaucuccagaaucucucuaaaauaagagaauugauaaauaggaaaaguggauauuuuucuuuuaccguaaucaugauauauuaauacucaggaauuaacauaaagaauagaauccaaauauuaacaagucaggagucuaagucaaucuguuguagcuucaagaucagggaaauuuaaccauuaguuuugaacacaggucuguagauuuuucuguauggucacagaucacuugcaagcaaaugaaauguuaaauauaacucugucaacucuauucauuccuauuguaauacaucuuuuaugucuuugccuuguuucuauugaugguuuauacuuaauuacaacuuuuauuuucauucauuaaccuguggacugauaaagcuacuauuccuauuucuuggaagagacuaagaggcagucugcuuccauuuuuucuguuuuuucucuauauuugagaagguugcaaaaagucugcuugucccuuuacaaaaaacagagcaaagauagagaccagaaauauguaguauaaucacuuuaggagaaaccagcucuggagcaguuguuaaggagcaagcugcagcugucuuuggccauaucuucugagugugacuuuucuuuccuuuggauagaaggggagaaggagaaaagucaguaaaaauaaaagcaaaugcagaguuccaggcuucuucagcaacuccccauucuccaacucugcguuacucaauguccauguucccuaauuuacuuuugacuugcccucugaaaccauuucagaggcguaaguaaagcuuuagcaucaucauauaacugaaauugaaugucuuucucagccacuuagcagccuucuuaggaauauuccauuuaauaccuaagggggagaggguugguaguucuaccccaucuuuauccaauuuaacggauugggaguuugccucucuaucaacacuucugcagacuauccacaaauucugaucaaaauagucacugaauucuccuggggcauuuaucccugccucuuacaggcugagucacaugucuuuuuuuauuauuuaaauuuuuacuuuuaauuaacaaauaauaauuguauauauuuauggguaugaguacaaugugauguuuugauauauguauauauuguggaaugauuauaucaagcuaacuaacauauccaucacuucacauaacuuauuuuugguagugagaucauuuaaaaucuggagcuuuuuguagcaauuuugaaguagaaauacauuauuauuaaccauggucacuuugcugugcaauagaucuuggaaacuuacuccucccaucuaacugagacuuuguaccauuuggucaacuuaucuccauuccucaaccccucacaccuccuguuucugcugaccaacauucuguucucuacuguucuuuuguuuuuuucugucuauaacuuagacuggauaauuucuguagaucuauugaucaauuaucuaaggacacugaaauucaacuuugauaugacaggcagugagccgguuuggucugcagacuuagucugccaaucccuaauuugguucaauccaugauggacauguuuagaagguaggcuuacuucuuuucauuucgagguuacuuuuucuaccacagugugguauguuugggguuuauuaaaagccugggguauuuuaucagagccucuucugcuugcaggcccugaacucucucuguauuuuuuaaccuauuggcuucugcuuucacaaugaccaugugcauucaaggguaaaaguagcccauaaauccuugacauggcuucuuuucuuaaccuagcuuuagucugucaauacuucacuauuuuacuagcucuccagugccuuuaaauggauguuuagggguuuucuuuguuugguuguuuuuucuuuuuguguuuuuguuucuacauuucaaccuauuuuuucagugguuugcacuacaaggauugggcucaacugccuagguuaucauugucuaaaguggaaaagcuguccaagaaucaguuugcaacuuuaaaauaacuuuccugacugccagauggcacucuuagaagaauaacauuugcuuauauauaggguuugggguggagaauuaaaccccagaacugcuaaucaaauggaaaguacagcucuuuuauuuuuuauuaaaaaaugaacuuuauggauguguaauuuauauaaaauaaaauuuuccacagguuuuaaauauauaguucaaugaaacaccaagaaauugaacuuuuuuuuuuuuuuuuuuuuuuacugagucucgcucugucaucaggcuggagugcaguggcgcaaucuuggcucacugcaaccucugcuucccggguucaagcgauucuccugccucagcuucccaaauagguaggacugcaagugugcgccaccacacccagcuaauuuuuguauuuuaguagagaugggguuucaccauuuuggccaggaguugaacauuuuuauaaccccccgcaaaguugcuucuuucccuuuugcagucagucuuucucaacuccuaccccaagcaaccacuucucugauaccuagcauuauagauuguccuucucuagaauuuuauguaaauggaauuaguaucuauguauguaaaguuugucuagauuuauuaacucagcaaagugauuugcaagugcucuguuguaugcaucuguaguaaguuccuuuuuauugccgaauagucaguucccugaauguaccaaaauguguuuaucaguuuucuuuuugauggacauaugaguuguuucuaguuuuuggcuauuacaaauagagcugcuuccagcauuuuuugaugaaucuuuuuguggauauguuuucauuuaucuuugguuaauuccuaggagagcaauuugagucauaggauguguauguuuaacuuuaugagaaacuuccaaauuauuuucccaaacgcaaaaaugcuuuuucugcguugggaaaaaaaugcuuuugcauuuucaccagcgauacauaaggauuacaguugcuccacacccucacaaucucuugauuuguuaaucuuuuuaauuuuaguaucuuaauggguacgaaguaaugaaguaucgucuuauugugauuuguauuuguauaucacuggugacuaaugauguuaagugucucugauguucuuacuggcuauuuguucaucaucuuuucugaacuuguuuuacacaauuucuugagcuggguucuuuguuuuguuguugagauacgaguuuuguauauguucuucauacaaaugcuuuaucagauagaaauucaguauugcaaaaauguucucccagguuguaguuugucuuuucauuuuuuaagugaugcuuuugaauaaauguuuucaauuuugaugagguccaauuuucauuucuuuuuuauaguuaguguuuuuuugugcuucucuaagaaaccuucacuuacccacuugaucaugacguuauccuccuaaguuuucuuccaggaucuuuauagcauuaacuuuauauuuaggugaaaaaacuaugcauaaaaacuauugcauuuuaaaaaucaguguugucccuuuguugaccuaacagagaguguugguugaguguuugccacaugguauuucagaagguaaagcacuucaaauaacuguccaggacauuuuaaagucauaguuagggugaauuuuuacuucaagaugucugauuacuuguuacaacucauagaucaucauuacauuuccaucugucuuuguaaugaggggaaaacuacacucuaacauuaauaagaaaccuaacucauaaauaaaauauaucaaccaggauacucuuccuccaacucuuccuuccuacuccccuccuuuuuuucuucccuuccucucuuucuuuccuuuuuauuccucccuuccuuuucucuuacuuuuuuccuuuuuccuuucuucauuaaaaaccauauuuuuucuuacauuaugguauugugggauuucauaguugagccuuuuuuagaugauaaaauauccucuaguaaucaguucuugagaucagauaaugggaugcucucuuucaaugauauguuugcaucacuggccuuaugcacccuagugauauuguaauugguguuuguugcuuuauuauaccacaggagauuacuugggaaagauaugggacuauaugaagugucauagacagcuauaacucauggcccauuuauauguggaaaaauuagcucuuaguaauaugauuugaguagaaaaacaauuucuaagauuaaaugagaacugaaaauuuuacauuguaaaaucaaacucccucauguauuuaugacagcuuuuugaaaugacaaauaauagcauaacauaaacuuuaugguugguggaaaguacaugcugugcucuaauuacagagauacuaucauuucgaaggcugagauuucugauagaauuuggcuguaauguagacuuuaauguccuauuguguaguaccguuucuuaaauuuguuuuacagcaucuugggguuauaacuucucagugugcuguugauugaauggucugaaugaaauaucccuuuaggucgacuuuccacuggcucaaaugcaacuucaagaaguguacccuugcuuguacuaaacaacuguucuuauucuuugcuguaggacaagaaauggauucucagucaugaagaugucauauugggagaauuacugggcaagguauguaaucaacugagcuaaauaaccagaagucucuauauugauugugaagacugcagauuuuuucauuuuccucaaagcuuuucuuauauugccacaaggcacauuacacauuaacuagaacacaaugcuauaucuucucaauauugugaugcucacugaaauagaugugugaaagucuuugaaagauuuaaggaugauucuuaacauuuaagaauauuauauguguguuuuccccuggaaggacuaaaaaucauaaugauuuuacuucagugugcaguaaagucaaaacuagugaacugagauuugaaaagaaacagugagauaauaaaaguuuaaauaaauaccuaauagucuuguucuuuuuguuucugguuacaugugauaguuuagaaaaaaaugaaauacugccucuugggauuucaggauuguauauagaauuacaguauguaacaacacugggcauauuucaaucuaaaaauguggacaagacacuuguuucaauauaaauauuaauuuuauaacuaguucuauuaaucagaaaaagcaacuauauauaauaaaagucccuuuucuuccaauguaguuggaaguuucuuugaacucauaggccguagucaaguauauguuauuuaacaauaauggcagauacuugagaauuaaccaaauggacuauuugaaaauuuauuaauaacuuuuauuuauaauugaguuccaaugaauaaguauucacuuuuuugucagugacuuaauuagugauuauuuccauuaauauauaaaaaugugaauucauuuuagcuuauggugugauacaaaaaauaguuuaaaaucuauauauuuaggaaaagcuaacauacauaugagugaucaguacugaacuuaauuaaggcucagcauuuuagaugaagaaaugauuacucauuacuuuuuugauucaaauguaaacuugaugaauugacuauuuuccccuauuuuuaaaaaaucucugagaaaguaaaucucuguugaaauaacauaguuugcaggauucuuaucauuuaugauuuuaaaauacuuuucccaaagcaucgaauuguuauuggaaagcagauuuuuauuggcauauuuaguaagugaauucuaaagaaccucaagcuaaaagcagugacucauauguuauuuccucuggguuuauuuccucauccuuaaggaaauauuucuucuuucccuugcucuagguaacucaguagcagugacugggccaaaaaauauuacaaagauuaauuuccaugauacaauuaaauaauaaauuauaaaacuaaagcauuuacugaaauaaaggcagaauauguuuagaaggacagacuuuuuaguacuacgaaaaaaauauuuuuaguuaaagagaaauauuucuauuuuuguguuuaguuuaugcuauaaaguauuaggaggaauuuaucuccuuagacuauuucaaagaauaauuuuuuucucaacgacaaguaauaugucagucuuaaugaauuuauuuuaaauagaagacugugacuuugaggcaguguguagcuuaauuucauccaguaguuuuaaguacaagaaaaugguuauuuaacauuuuucacugccuauuuuaaauaaucauuuacaguauacugcuuaagaguacauggcuaauuaagacaauuagccaugauuccuauuguuagagacuuuggaguuaaguuauaauauaagguaauggcaggaacgcugaggguuuuuuuuuuuguauucagcacuauauuuuuaguagacuguacuugauauacaguaucagaugcagcuauagucgauaguugguauucaacaaauauucagucauccaguguuuuuugaaugccuacuaugugcaaggcacucuucuaggcauguuuuacaguuucaaugagcaaguagccagaaauccuuucucuuacggagcuuaauauucuuucuaggaggagaagauaaacaauaagcauaauaaauagguaaauuuuauaauguuagagggugcuaaguccugugaacaauagagggauuggaagcguuacuaguuguaguugcuguuuuuaguaggaaauccagauaaaccuuauuauguuuacuuuugaauaaagacuugaaggaggugggaaauauagccacauggacaucugagggaagaggggucuaugcagaguaaacagccaaugcaaaauuuguuugaagagcaaaggaagcauuuucauuguaacaguaagcaagagggaaugugauaggagaggaagucuguuaggugaugaggguauaaauuacauugaccuuuuaagucauuguauaacuuuggcuuugaucaugaaugaaauggcgagcuggugggcaauuuugagaggaggaauggcaugaucuuuuuuaaaaaguuacuccgggaguugugaaaauaggcugacaacuuggaagguuaggaggcaguugaacuuaccugacuaaaagaugaugcuagguuaagaugauagcaguggugguggugugaaguagugaguucuggauguacuuuugaaauugaaccaauugaauauccugauggacucuguaugugggguauuagagaaagauuucaguccuaaguguaaaagauuucagggaacgagaagagguguucaguuuuggauguauugaguuuuucuaugaaacuuccaaguggggaugauggaaacuauuggguauuaagucuggaguuggagaaaagaggucugagucaaaaguacaaaucugguaguuguuaguauauagcugguacuuaccacaauuagguggauucaacaguggagugagucuagaugaagaagagaagaggaucaaggauugagccuugcccacucgaacauuaagagguggagauaagagaagcaauccccaaagaagguugaaaagagcagccaaguaggaggcagaaaaccaggagauaugaugccuuggaagacaagaagagaaaguauauaccaaggaagagagugaucaguggugucagaugaugcugaaaagccaaacaagaugggauuuagcaaugagaggaucacugaugacuuggcugagcaguuuccuuggaaugcuuuaggugaaagccaguuuggaauggauuugagaggaacgggaggagagaauuagcgauagcaaagauguaauucuuugaaguuuugcugcaaaagaaaucagagauguggggugauaguuucaagagaaugauuugugcuuugucacuguuacuguuuaacuugagaaaaauaauagcauacuaguuugcaguugggaaugaucuagugaaaauucaucauuuaagagagagggaugaacauugcuagagcgucauccuugagcagguaagaggggaugcaauuuaguucacaauggaggauugacuuuaauagaaacacaguaguucacuuuuuauaacagcgaggaaaauugguaggugggucaauauagggacaagagcccagaguucucuuuauauugcuucaauucuugaaaugaaguaggaaacaaaagcaucagcuaagaaugaggaugggagauuugagaagagaauagaagagaagcagucauccagaaaacugggagugugaauggucuaaagaaauauaauaugauuauugaguagcauuaagggcccccuaaggguuuguguucaugaauuuaaaguuaaaucagucagcaugauuaugguuuuucuccagccauauuagcuuuauaggugcagaauaggcagaguuuuggauuuaaucagacuuguagauuugcuaagggaguuuuacagauuaacagaggagcaaauaaacugagaguguaugggaaggcaguuauaauuauugaccauggaauuuaagguggaacacagaaggaggagaauauaauaaaagaaugacguaaaaagugauagaaccgaaagauuggcaguuccuauaaagucaaaggacuuuugaagucuggauaaguauucaaaaaaaaaaagaggaaguaagcuagaaagauagaagccaaccggaaguugaaaugaaugagauagauguuauacaacauuugcauuauugguauggcagaguuuaaaguaugacccuagaaaauagcuuggagugcaagguaauuggaggagagauguucaagaaacugagaguuugaauuguuggaagguccuuuaaaugucuauugaaauuacaaagaauuaggacacuggguagacugacaguuacccaacagcucaaauugccaauaaacaaaauauuuucaaauucaguaaaugacagcuggagugaggaauaguggguaauauaauugagugacaaauuuucaaagcugagaguuucaggaaugugggagagauaaugguuuaaagccagugauaaguagguaauagaacacuguguucuaucugcagggcauuaguaggauuauauguggggaaaauaagucaucacuuaaguuuagauggcaaaaggaaguucauccaccauuugggucuucucaagugagagccaggauuuuguuagaacaggaaguuaaaggaaaugaucaaagaauagauugaaaauauaauuuugaugaugaugggccaugaauuccagaaggcacuaugcaagucggagauagaugagaaagaaggaucaaauagaaguaugcugaaucugagggggcuggagagggagaaaugaagauuaaccgaggaccagggucaucuuacauugacugacauaaacacagucaaggggcauaagauuuguccucagggacugaagggcagcagcagagaugaagucaugcuucaugacuuuuugucucaccccuugcaucuuagaaagguuacccugauucagaaucucaauucugucaccuaagcugaucuuauauucagucccucaccuccccuuuaaagcaaagguuugcguugaaugaugauugaaugauacagagugaugaguguccugagcuuccuccucaccucuuuggauagagaagagguggucugggaaagcauagucauuucucagugucugaagacugucccccugaccaccguugauaaaguugacauucucuggauagugguugcuaaauuaauguuuaaauuuuucaaaugccuaguacaugccaguaccucuuaaaauagggcagaaaccauuagaaagacacaaagggcaauggggauaauauguauucagggacaggaaaaucaauuuugggaaaaucaagaaagucuucaugaacaaggggcauaagaaauggauuuaaagacgaaguaucagcuucugauuggaggugggcguuuuccacagagggaaaaauguagaaaaggcaugacacguauuuagggaucacuauguauuugaguucagaguacauguaacaguuggggguuauaauguggagcuauauagaggccaagaaagugauaguaauugaaggauggauauugagcaaagcaguaguauaaucaaaguuuucucuaggaaagauuaauuuggcagugcuguuguagguggauuggagaagugagggacugaagaugagaucagcuuagguaauagaauugaggucaugaaucaggguaaccuuucugagaugcaaggaauaagacaaaaaguauuauggagguagggucugaaugcuuacaaggcaaaugaugguucuaguaaccgaaaaaaguaauauagccaggaagaaucuuuugauuaauaaaacaguaaguuuuagacaagcugaaucguaagugcuuuagguaaguggaggcccagcaguaaucauguaaauuaauaucuucucucagcucuaccucugauguaauaaauaaucugacaauuguggguaaaagacaaucucuugagaauaacagaugugaagcucaaauuuuccuuuuuuaaauuuaucacgaauguuuacuguuuaaguauauuuuuuaugaaaacaugauugaucauuguuuuauaaauauuugaguugacuauuagauuaaaugguaaaaauugaauauaagacuuguuaaaaauauuuuaagguauuuuaauaauuuuauuuauuaauaagccguaguucaagguacaaauuuuaacuugugaacuucaaauauuaagaguuacauucaucuuagugcucuaaaacucaguaagcaaaguaggcuucuaguuuaguuacuucuugcucaacaauagcauuaaaguuuauuauaaaauguuugcauaugccaggugugguggcucacaccuauaaucccagcauuuuggaaggccaaggcaggcggaucacgaggucaagagaucgagaccauccuggccaacaugcugaaaccccaucucuacuaaaaauacaaaaauuagcugggugugguggugugcgccuguagucccagcuacucgggaggcugagacaggagaauugcuugaaccugggaggcggagguugcagugagccgagauugugcugcugcacuccagacuggcaacagagugagacucugucucagaaaaaaaaagaaaaaaaaguuugcauaauaugauuauagcuauguaaaaaauacauaugcaguguaaaaaaaccuaagagaauacucaagaauagcuguugugcuaguguguuagucuuguuuaucuucucgguaauguuuuggauuuaauuuuaaaaaauagauuucaaaaugucaucucuucuaaaauaaauacacuauaaaucaggccuuuuuuuuuuuuuggagacagagucuugcucuguugcccaggcuggagugcaguggcgcaaucucuguucacugcaagcccugccucccggguucaugccauucuccugccucagccucccaaguagcugggacuacaggcgcccgccaccaugcucagcuaauuuuuugguauuuuuuuaguagagacgggguuucacuguguuagcaaggauggucucgaucuccugaccucgugaucugcccaccucagccucccaaagugcugggauuacaggcaugagccaccacgccuggccaaaugaggcauuuuauaccacaauauguccuagccauagaguaaaguuagaaguucguaugucugauagaaauuaguucaucacuggugauauugacauguagguaagcaccuccuccucuuugguaccuuuccuuguauuuggcaaagauauacaugcugucauuuaccccagacaaugaauguauuucuauuuucagggaaauuuuggugaaguauauaagggcacauuaaaggauaaaacuucuguugcuguuaaaacauguaaagaagaucuuccucaggaauugaaaauaaaauuuuuacaagaagccaagugaguuauuuaaaguaaucaaaauauguauuuauuauguaaauuauuuauuaaaauguaaguuugaagacaucuuaaauugugauuuacugaaauaguagggguaagcacuuuuacaguauggaauccaaaaauuugugcuuuugugauauucugcagaucaauucagcaaucauagucaaaccagguguuaaaaagcaguauuauucaaguucuuaaaauguuaagauauuuugcuuucaucacacauacauauacauauauguauauaugcaauacugugcuuaugauaaaaauauuaauguauuauauacauauacuguacagcucacauauacauuuaaguagauaauuacaucuguccuacccuccuuagauaguacugcuugcuucuguuuucucagcuguuagguuucauuucugagaaccucagauuucuucuucaacuguauaacuuacauauacauuuaaguauauacauuuaaguauauacauuauauacauuauauauauacauuauauaccuuuuuauagcuauccuugguuuaguuguacauguacaaaacaugcauaaauuuuuuaucuuucuccaaaguuaccuuuuucauucucuuaggaaaguauacagcaguuuucaaagaugagugaauuuauaacuguugauaagauaauaaagaauaagauuugguaauagaaauaauugggacagacaggcauuugagguaaucuaguuuauuuuuaguucauguuuagaguccuauaggugagugcauuaucaaguagaaggggcucacugcccaaugugcuagaagccaauacugugacaccaggucuuugagaaaagaaaagcuuacuauuaaacgucaacucuuaaugauuucaaagcaauaguuuuauuagaaaagguugaggggguagauucugaaauuacuaagugauugguggaaggggaaaugggaggccuggaaaguccuuggccacacacaguuaucucuucaugcaaucucaugguucauaugugcaaauccagggggaguuagucugaaccaugcaguggaaauucaggcugugauguuagcaagcuuguuucugcacagaugccagucagcccuauuuguucuaaccaauuucagccaguucuuuuauaaacaacgggaguuucagugauuaagcaaguuguuucuuuuuuuacgugcuauccugcaaacucaagaauuuuuguugguuauuacuguguugagguuuuuuuucuuaacucuuuagggacaugguuucaagucuauccuacuuucauagcccucugaugaaauuuugccuuuauccaaacaaagucuacucugcuucagcugaagucucuguugaaacuccauuauucaauuauccauuugccaacuuucucagaacuuuuguuucuaccauuuugaaauugacccugaucaagaaaguauuuaacuauuacaaaauccaaugaaaugguuacccuguagcauuugccaguauaaaaugauuuccuauuuuauguauuuuaaaaucaagugcguguguuaaaaaauauauauauauauaugcgcuacccuagcagcuuacaauuuuuggcccacuaauacuuuucagcuauacuuuugugguaguggcuaaaaccagauauuauaauuugaagggaguuguacauguuuuagauuaacuaguuuuuaacaugguuguuaaucauucagaguagauaauaauuuuuaaaagaauauuaaauuaaggagaauugacucauuugcauccacauuauguugccaauauguaucaguaugguugggccucugucuccauggguucuguaucuguggauuugaucagccacagaacaaaaauauuagugggggaaaauguugaugauugcaucuguacagaacauguacagaauuuuuuuucuuauuauucccuaaacaauacaguauaacaacuauuuauauaacauuuacauuauauuaggucuuauaaguaaucuggagaugguuuaaaguauauaagagggugcguguagguuguaugcaaauauugcaccauuuuguguaagagacuuuaacaugcauagauuucuguauccacggggguccuggaaccagucuccuacagauacugagggaaggcuuuacucguuuguauacauccaauuuaucauaauuuggggucauacugaaauuuuaaaaauugaauuaugauucaagaguauucuaguuguaaacccuauuugugaucacaaauuaaugcuuuauuauucaaaugauaacuauucguauauuuucaucucaucuagaauucucaagcaauaugaucaucccaauauugucaaacuuauaggaguuugcacacaaagacagccugucuacaucauuauggaacugguuucagguaaugugaucugagaauuuuugcaugaugacauuuuaaugucauguuuuauuguuuuuauauguucgaucucuuugauuucuccucguaaagucuccaaggauuuuguuuaacauuuccagauaacaaaagagucuguaccuauagucaguauuuuuauaggcuguaacacuuuacuauuuucuagaaaaugucaacugcuuuuuuaaaaggcagauuuauuauuagaauauaguuacacauggaauucaguuauacaucuuuaugugcaaaacacuauuuagaaaaaggcaguguacuuagacuuucuaacagugauaguacuaucuuauauuuaguucacuguauaucauuuuccaaguacaucuccacacaaccucucuucuaaauguuuaaauuaauuuuuaauuuuuuuuuguagaaauggagucucacuauauugcucaggcuggucuugaacuucugggcucaugugauucuccugccuuggccucccaaagugcugggauuacagacaugagccgcagcacccugcaaaaccucuuuuuugaugguuauauauaauaaucucacaaugcuuugaaucacuuucgaauuaugaacuucuuucauauguggacaaacaaaaaggugaucagucuaugaauaugucuugguauuuauuucuggugacuuucaacaccuuuauguuaacaacuuuugacaacaaagaaaacuuugaagugcuguauuaauaguauguuuuaaaguuuuuuucguuguccaacuuccuguuguagaagauacauucagaaguaaaauuugaucucauaagcuuuacaaauagaguauuuaauaagugaaagggauuugcuuuacuuuuaacaauuauuuacucauuuuaggagaaauuuaaagaaauauguaaaacguuucuaauuuuaauuaaaauauauuaaguaaacauaauauuguagacugcucauuaauuucuguuuacagaaauuaauuuuucaugauuuauaauuauugguccuguuuuguuauacugcuuugcuugcuauugaaauauuucucaauauuaccauguaacugcagaauaccuagaucauuaucaucuuuauccucauuaagauggcauugucuguguuaaguacauuguauguuuuaaugguuuaaauguguaaauauuauaaaaauacauauuaacauuuacauggguacaaaugaagccccugaauaauaaggaacgccacugaaaaacucagauuugggaggugggaugaacuugaggaaaggugauucuggucuuacuguaauuguuaaaggaccacagaugcaaauaccagaugacaaguccuaguuaaauaaaacaaaagaagauagcuuuguagaggagccaagcaaguguuuaucuagacucugacuaguaaccuguuuauauuuuuuaaaugaauaagaauaauaaacuucauuagaaaauugaaaauauaauaaaagguagaaaauugaaaaugaaaccuucuacucaacagucuaauuauaucucaaagcuaauugcugcuugcaguuuuuaaauuuuuuuccagaaaaauguuuaaugcagaugcuuuaaauuuaauuaugaaacaaauuauacuccaccacuguuucagaucuugcuuuuuuuuucuuauuacuauaaugugugaugguuuuacuguuuugcaguuaucuauacaauucuacuuuuuuugguaauggcuacagaauauuccauuuuguggauuuacauaauuuauucaaccgcaacuuuauuuguggauaguuuggucauuuuuauuuuuauuauuuguuuuuacaaacaguguucaaugaauauccuuggacucacuguaagaaucauuuggaagugugucuguagguaaaaauucaguagugagauuguuggauccgaguuucuguguauuuugauuuauguaaauguauuagcuuuugauugcugcacaaguaauuaucacaaccugagggcuuaaagugacacccauuuuuuaccugacagggucuguagguuagaauuccuggcagccuugacuguguuccgugcucagggucucacaaagccaaaaucaggaugucaggcugagcuguuaucuggaggcucuggggaagaaucugcuaccaagcucauucaguugcuggcagaaucaugucccuugcagcuauaugucuaaaguuccuguuucuuugccuucugucugccaggggcaucucuuagcuccuugagguugccugcaucccuuuucacaucgucuuucuaucuucaaagucagcacgggccugcuaaauccuucaaguauuuugaauuuuucuaacuuucucuuacguuacuagcuaaagaauacucucuacuuuuuuuuuuaaaaugcuaaauuaaaacuauugaauaaagaacacucuccagaacacaugaucugauggacaaggucuacauuacaugcagugaagcugaacaugaccauaguuuaacauggaaugucaaacaaauuaguaauuuucauuguacaaaacuguuuauguagcugacaugcaaguagaaaagugucauacucagcauuuucaccagucgucugugaugaguuuuaaaaaaggcauuuggagaaacugguagaugucuucagcauauaguucaaauaaauuaguuauauguguacuacugaauccucuuucaaccucucuugcauuccaaaugaaaucuuagugcaaacaucaaaguugcuggucacuccaaaagacuguuaaacucagaauacaaguucugaauuacuguguauuaaguagggcaaacccaagaauaccaguuacugcaaaauucauuuaggcacguuuaauaguccacuccacucuaagcauuuuuucuaagucucucacauuaaugacuaaagccuguuuacaguacuaaaauucugucauucaagcaucagugauuacauuucagagaaaggaaauucauuucaguaauagcauuacugcuauauccuaaaaaaaagagagaaaauaaagaaucauaauuaacaaaacuaguauccguaauaggauacacggggaaaaacauuuuaggagaaaaaaaaaaguguguuuuacuugccacagcaggaauuauauaauguaaacaccguauuggcccacaccacaaaaauccaugagaaagguucaaauuugaacacuguaugugcauuauuuucaaaucuguguuugugaguuuguacuguaucugcuuguaccaauacaugacaaacaaaacaaacuuccacacacauacaagugacuguuaaauauuaagcauggcuugauucccugacucuagcucaaaagaaaaaaaauguuaagugacaucccaacugucuuaaaaauguuuacagaaaccauuaaaugaaugugaguaguagcugaggaaugaugaaaaagugaugguaaugauauggugcaaguggauggaaaaaauauauguauaaugcugagauuuucaaaugcauggaaaaucuuauucugugggccuugucugaauuuuaaacugauaccaagaauaaaaaaauauaguagcacaaguccauugacaccuggagggucaggccuagaaagcuaaccuucaaagugcaaauuuuaacaauggaauguuuuagcagggacuuaaggacaauccucugucuuuuucuuguugaaaagaccuaagauguucaggaaguauuuauuccuggccagaauuauuucaguuucuugguaaaacaaaaauauuuagccacaauuaccacccacucauucacauacccagaaccauucuuagggguguuugcugggagaaaaagcccuaaucuauguaucauguaauggaacucuuauuuauaaucuaaguuuuuugaauccacuacuuuaaauaccaauaugcaccucucuuauccccucccucuccacccaucuaccccauacacccccagugaaccuagguauucuaaugucuuuguguuuucuaagccucaugaauaagacuguugaauaccaccuccaccggaucaaaauuaacaccuggugcacuuucuacagcaccuuuuuucuucuccacaagugagaggaaucuugauacuuucaagccuguaucuagaucuccaggucaucaggcugaggccugcugcuggcacgacugcuggcucugcuugaagguugcugguccacaauggcuaguggcuguaguucauguccagcagcuaguuuuuuagaauucugguuaucaucggggaaaucaaaaggcugugcgugggaguuagagauggugcuucccgccugccccauucgauuuuguucugcacuguaauuagcccaguuuugcucacuugcuugcuugucguaauugcggcaagaagaauuguuucugucgccauuaaccagcuuguacccaggaagagacauaggcgagaggggagcaguuggugaggagcagccauugaaauaagcauauuuuugagacccacagucuuuggcggggcucagcgggccaguggucgcaugguaagggucgcucuuucccuuaacccaauccuuaacgcccuugaagaaaacguagaagaguucaaugauauucaaggccagggacaccaaggacaccaccagcaugaagaugaugaagaugguuuucuccauggggcaagagaggaagcaguccaccugaugugggcagggaucucuuuugcaagugugaacagcacucaagcugaauccauagauguaccacuggaucagcaaggucaccucaaagauagacuugaagaggauacugaugauguagguucgcagcaaccccccuugcauuuucaccuuaccaugcucuucaauaccauacuugaacuucuuuaucucaaucugcuucaagugcaucuccacauugacaccaucaguuugggcaaccuugaguuccuccucuuucuuguucaguuucucuuccuuuugcaucacauagaacacaugagccagguacaagaguauggguacagacacaaauaugaucugcaggacccagaagcgcacaugagagauugggaaagacuugucauagcagacauuuucacaaccagguugcugaguguuacaacgaaaggcagacugcucaucuccccaggcugacucaaccacugucuucagcagcaggauuuggaaaaugaaaaguacugacagccacaccuucccuccagcaguuaaguaggcuugaaccuugucaaggaguuugccuaaagugcuccagucacgcauguugccugggcaccacucuuuugcuuaaaagaagugaagucacgccaggugauugaacuccuuggaggaugaaguaaaaugaaaaggcaaauucaggcacucagaccugucuauuuaaaguuuaaaacuccgcugcuguuuguuacuuuccucacaccuucccccaaugaaagaaaagugcugauaccucguaaaagcugcuacucucuacuuuuaaaagggcuuguaugauuagaucaggcacaccuggauaaucuuauuuuaaggucaacuguacaugauagaacauauuaugaguaguacuuacacucauagggauccagguauuagaguaggacaucuuugggaggccauauucaaauucugucuaccacaguagauuuugcuaaauuuuccuaaaggcuguuugcaguguggaaucucaaaucuuauuagugaacuuuucauauucaguuacauuaaguucauugguugaucuugcaguuugaaugccucuuuuacccaugcaugauuuuauagcaucaugcuucagucauuuggaaaauaucagaucaccaagucaugcagguauuucaaauaaugauauaauucauuauguaauaucacacauuuauuaaugucacaagucucagaaaaguaauggaggcggccgggaacaguggcucacgccuguaauccuaucacuuuggaggccaggguggguggaucaugaggucaggcauucgggaccagccuggccaacauagcgaaaccccaucucuacuaaaaauaaaauuagccaagugugguggugcaugccuguguaaucucagcuacuugggaggcugagggaggagaaucgcuugaacccagaaggcagagguugcagugagccaagaucaugccacugcacuccagccucagcgaaagagugagacuccgucucaaaaaaaaaaaaaaaaaaaaguaauggaggcugugaagcucauuguggcagauacauguuuugaacaaaucuguagcaccuaaauuuacucaugccucuuuguaauuccuuucuucuaccuuuuacuacccugucacagccaaccacuaaggugcuuucugucacuagguauuagcauuucucagaacucuuaaaaauagaaucaugcaguaagcacuuuuuuuuccacuaaguauaauuauuuuaagauuaauccauauuguaauguguaucaauagguuauucuuuuuauugcugaguggaguucuauuuuuuuuuuuuuuuuuuugagacggaaucucgcucucgcccaggcuggagugcaguggugcgaucuuggcucacugcaagcuccgccuccuggguucacgccauucuccugccucagccucccgaguagcugggacuacaggcaccuguuaccaugcccggcuaauuuuuuuguauuuuuaguacugacgggguuucaccauguuagccaggauggucucgaucuccugaccucgugauccgcccgccucggccucccaaagugcuaggauuacagacgugagccacugcgcccggccuggaguucuauuuaaugaauauacugcaguuuauccauucaacuguugauagacuuuuggaugauuuccaguuuggggcuacucuaaaugaaguugcuguaaacauuccuguacaagccuucaucuggacaaaugcuuucauucucuugggaaacugccuaguaguggaaugaaucgaucaucuggcauuugcauguuaaauuuuuuaagaaacuaccaaauuacuuucuaaaguuuuuguucuaguuuacauucccaacagcagucuaugauaguuucaguuccuccccaucgucgucagcacuuacuuggccugguuaguuguuagccuuucuaauacuucuauaccuuauugugauuuuaauuugcccuuucccauugaauaaugaugucaugcauguuuucauuugcuuauuugacguuuguauaucuucacuggucaaguguccaaaucgucuugccuauuuuaaaaauuggguugguuguuuucuuguaauuaagucuugguucuuuacauauucuggauacaaauccuuuuucucucagucugugucuugucuuuucauucucuuaacagugucuuuugaaaaacaucuuuauuuugauaaaguuuaauuaaucaauuuuuuucuuuuauggaucauacuuuuuugaugguauaucuaagaaaacuguugaacccaagguccuaaaaguuguuucuuaaguuuacuuuuagaaguuuaaaauuuauauuugaguguaggacccauuucaaguuaauuuuuguauauagugugggaaaugguuagaaguuuauauuuuuggcauguggauauccaguuuuuccagcaccacuuguuuuaaaugacuauucuuucucucuugacuuaacuuuuuaccuucauauuaaauucaguuuuucauacuuauaugugucucuauuuuuggacucuguucuuuucugucaauccuuuugucuccaugccaauaccacaaugucuugaugacaguagcuuuauaauaagucuugacucagaaauaaauccaaacauauacagucaacuaauuuuugacaagaagacacaaaggggaaagaauagucugccugacagauggugcugggaaaacugcauuuucacauacaaaagaaugaaaugggacccuuauuuauaccauacacaaaaaucaucucaaauuggaugaaagaccuaaauauaaaaccagaaacaauaaaauuccuagaagagaacaugggggaaaacucugggacauuggccuuggugaugauuuuuuggauauuacagcaaaaacucaggccacaaaaacaaaaauaaauaaauaggacuauaucaaacugaaaagcuucugcacagcaaaggaaacaaucagcaaaaugaagcaguagccuacagauugugaaaacuacuugcaaaucauauaccugauaagggguuaauauccaaaauguauaaagaacucauacaacucaauaguagaaaagcaaauaacucaguuuaaagaugggcagaggaggcuggaugcaguggcucauuccuguaaucccagcacuuugggaggcugaggcaggaggacuguuggauccaggaguucagaccagccugggcaacguagugagauccugucucuaugacuuuuuuuuuuaaauuaaccagacauggugacgugugccuguagucccagcuacucaggaggcugagauggaaguauuauuuaagccagggagguugagucugcagugagcugugaucaugccacugaucacaacagaugugccacaacagagugaaaccuugucucaaaaaaaaaaaaaaaaaaucacauacaacugauguaccaaaagagagcaaaacauugucucaaaaaaaaaaaaaaacccaaaaaacaaaaacaaaacaacaaagaacuguuuuuaaaaaugggcaaaggccuaaauagacguuucuccaaagaaaacauaaaaauggccgacagauauacgauaggugcucaacauuauuaaucaucaggaaaaugcaaaugaaaaccacugugagauagcaccuuacuccaauuaggauggcuauuuuuaaaaagggaaaagauaacaaauauuggcagggguauggagaaauccuguacacugucgguaggaaugaagauugguacagccauuauggcaaacaguaugaagguuccuaaaggaauuaaaaauagagcuaccauguaccucagcaaucccucuucuggguauaugcccaaagcaaauuuaaucaccgcuuguaaagauaugugcacuccuauauguauugcaguguuacucacgauagccaagauacggaaaaaaacuaaauguuugucagcagagaaauggauaaagaaaauguguuacauauguucaguagaauauucuucagccguaaaaaggagcaagaucugaccauuugucaaaacacagaugagccugggggacauuaugcugagugaaauaagccagacacagaaaugaaaauauuacauauuauauauggaaucuuaaaaaaaagucagauauacagagauagagaaugaaacgggucacuagggcagagggcaggaacagaggaaaugggaagauguaggucagaggauacaaaguaggaaauauguagaaugaucaagucuagagauguaauuuacaacaugugaacuauagguaauaaaauuguucuguguaugggauucaugcuaaaugaguagaguuuagcuguucuugucacacaaaaaaauggguaacuauguaagaugauggauauguuaauuugcuucacuauaauauucuuuuuaccaucaauauguauuccauaacauguaccuuuaauauacacaauaauaguucuuuaaaaagucuuaaaaucagguaguauuaguccgguuuauucuucuuuuucagauucuuuuagaaguccuuugcauuuccauauuaauuuuaguauuaguuuuucaguuucuauagaaaggcuugguagaauuuagagugagauuuuauuuuaucaauauaucaauuuggggaaaauagacuuccuagcaauauuaagcuuucugauccauggacauaguauaucucuguaguuacauagguugucugcaauuucucuaagcaagguucuuuacuuuagcauaugggacucuucaucuuuugucagauuuaucacugauguaccacuaaaagaagaaaggacucaaaguaacaaccucagcuucuagcuuaagaaauuagaauaagagcaaauuaaaccaaaauaaguagaagaaaagaaacaauauagauagcagcagaaaucaauggaauggaaaauacaaaaacagggaauagugauaaaacuaaaagcuaguccuuugagaagauuaguaaaauugaugaacgucuucccagacuuaucagaaaaagacugaaauuacuaauaugaagagagaggugauaucaccacagaauauucagauauuagaaggauaaugaauguuaugaauaacuuuauacaaauuuuauuuuauuuuuagagacagggucucacucugucaccugcuggaauacaguagugugaucauagcucacuguagccuugcuccuggcacaagcaguccuccugccucagccucccggaauuugguaacuuagauaaaauggacaaauuuccuuaaagauacgaacuaccuaaucucauucaugaagauauaaagaaccugcauaguaccauaucuuuuaagaauugaauuucucauuuaaauaaccauuccucaaagaaaacuccaggccuagauggcuuuucuggugaauuauaccaaacuuuuaagaagaaaauguuaccaauucuauacaacccacugaaaaaguugaaauugaagaauauuucuaaacucauuauuugaggccagcauuacccugauucuaaaaugagacagaaacauuacaggaaaagaaaacugcagaccaauaucauucaugaucauagauuuaaaaauucuaagcacaauuuuaacaaagcaaauuuaacaauauauaagaauucaugaucaagugggauuuaucccaggacugaaagcugauuuaacuuucauaaaucaauauaauuaaucauauagauaaaauagaaauuauaugauuauuuaaaugcagaaaaaaacauuuggcaaaauccagcacccuuuccugauuuaauaaaauucucuguaaacaggaauagaaaacuuccucauuaugauaaagggcuucuaagagaaacccauagcuaacauuauauuuaaugaaugaaugacaaaugacuaaauguuuucccccuuuauaucagaaauaagauagauaugcuggcacucacaacuucucuuauuguacuggguguucuaguuggugcaauaaagaagaaaaaaguaaaaggcaucuuuuaauuguuugaauauguuuucuuugcucccauauuuauuugccaguauuuaaaauuaaaaugguaagauacuguaguauuauaagauuaugugguauuaauucuacaaaacuuaaaauuaauugauuuuuuuuuaaacuuuuuggauuuaugguugaccaguuauguuuucuuaucuccagugauguccucuuuagacauggcuuugaauccucuagucuuauacaaguuauauauaacuuucuaauauuaucaugaaaauagggccaaaauaacaauuugaaaaaugauauaauuuugugcuaucuucuuuuucuuuuucuuucuuucuuucuuuuuuuuuuuuuuuuuuuuuuuuuugagacggagucuagcucugucucccagccgggagugcaacugugcgaucucagcucacugcaaccuccgccuucuggguucaagagauucuccugccucagccucccgaguagcugggauuauaggagcccaccaccaugcccggcuaauuuuuguauuuuuuaguuucaccaaaaacaggguuucaccauguuggucaggcuggucucgaacuccugaccucagguaauacacccaccucagccucccuaaguggugggauuacaggcgugagccaccaugcccggccaauuuuaugcuauuuucaaguuaaaccuugguaacaaccucuucccaccuucuacuuacuucucucaauauauugcuguuuaacaucuacuauaccacuuuuuguucucaucaaagagcagauguacaucucagaauuuguaaagauaaaucagcagaaaagcaaaaagucccuugaaugaauuuccacuacaaaaucaaaaccuuauaaauacaugguuaugaaaagcacuggagaaacuaaauagacuugguuagcuuuuaagaauuaugggauuucucaagaccauccuggccaacauggugaaacccugccucuacuaaaaaaaaaaaaaaaaaauuagcugggugugguggcgcacgccuguagucccagcuacuugggaagcugaggcaggagaaucgcuugaacccgggaggcggagguugcagugagcugagaucgugccacugcccuccagccuggcgacagagugagacuccaucucaaaaaaacccagaacaaaaaacaauuaugggaucucugucuccuucccuuauuucuuugcuuaguuccucucucccucuuauuucaacauguaaugacaaacguacagaguuauugaaaggcaguagagguuaguggugaagaguggagcucuaauaaguggugauaaaaauaugaggaaaccagaacauucauacguuacugguagaauguaaaaugauggucacuuuggaagagaauuucaagucuucccaaaacguuaaauaaaaaucuuucauaugaccuaagaauuccacuacuaggcaucuacauaagagaaauaaaaaccucuguccgugcaaauacuuguauguaaaugauuauagaagcaucauuuauaauugcccaaaaguagaacccaaauguccaucagcugaugaaugaauaaccaauauuuaguauauccauacaguaaauaacuauuaaacaaugaagaaaaaugagcuacuaauauaugcuacaacauggaugaaccucaaaaacuaucccaagugaagucaaaagacuacacguuauaugauuccauuuauaugaaauacccagaaaagacaaaucuauagaaaaagaaagauuguauuuuccuggggcugggguguagauggggauagacaauagacaggcaugaggguucuuuuuggagugaugaaauuauucuaaauuugucaaaacucauugaauuguacaauaagcuggguagaauuuacauauauaaacuaagcuucaauauacuucuuaagaaaaacaaaacaacaaacucaagagccaggcagucuuagcugaaagcuuacuuagcucagucucuuuuaaguuguaugaacuuacucaacuuacuuuuaaccucucugugccuuaguuuccuuaucuguaaaauaauacuuugggaggcugaggcgggcggaucaugaggucaagagaucaagacgauccaggccaacauggugaaacccugucuccacugaaaaugcaaaaauuagcugggcgugguggugugugccuguagucucagcuacucagaaggcugaggcagaagaauugcuugaacccgggaggcggagguugcagugagcugagauugcaucacugcacucuggccuggugacagagugagacucugucuccaaaaaagaaauaaaaaaaauuaaaaaauaagauuguuauuaaauguacugugauugugugugugugcguaugugugguguguguguguguauauauauauauauacacaccaaacacacauauguaaacaucuacauaaauaucuuagagugcuugacacauaaucacuauguguuugugcucaucaucaucaucaguaucauuauacuucauaauugucugagaggaaaaaaauggcuaauuaaaaugccugcuauaauccagccagaacuuuaacucagacugaaccugcuccugccccugcuucuaacucuauucuaaccugauacuuguguagucaagaaugaccuaaaaacaaauugggaagcacaguuugucuucaguucuucccuuuuaccaucauuugugauuguauguuguaauguuuagccuuuauacgugucauuuucuucauaugugaaacugaagugauuggauuacaugaccucuaaauuuuagcuauaaccuugaauuguuucauuguuaugaaauuuuuuugaaaauuugaaaccucugauaaacuuuaagaccacuucaaaauuauuugucuuuucucuuuauaaaagacauaauagggaaauaaccagcuaguuuuuuuauuauaaaacuaguacaauaauauauaguaucuuacauuuacauaauauuuuacaguugucaaagcacuuuaacauuaugucaguuauucuacuagaaguuauuauuuccauuuacaaagaaacuauuaaauaagugagguacagagagcuugaagugaccugucaacaucaguuaaauagaaaguaggcuaauaguacucuauuucuacuauuguguaauuagauuuuuaugugggucaaaauauauaauccuuuuaugaaaugaaaauucaagcaaaaugucugugcaagauacucuguggaugaaaacaugaaucccuauuucauaauuucucaaccuugugcauagauaaauaaauagcucguuucaguaaacaggaaaauuucuguuugaguuucuuuuuucucuacugggaauaaagcuguggagggaagauuuagaaaacuguuagguuaaaagcaagaauuuaauaacuuccuagugucuaauaugcaaaucauuucuaaaauguauuaugcagagauuuaauaugcuccuguucuugucagauaacugagcccuuuuggaaucauaaauccaaaauauguuuuaaccagaguaauguuugagaagauuauaagcauuugagaauucaaguuuagagugaguaguccaagaugauucugucuuuguuugaaucaucucuugaauuaugaauacuuugcuugcuugcuugcuugcuugcuugcuuaugaguugcuggauaaguaaaaucaaacaaaagucagcucuaaauggcaauggguaauaugaaaaaaaaacccuaauaugcuaaaagaugaccccuuacuuuauagacaaguuauuacuuagaaauucaaauuaagagaggacuuuuaaaagugacaagcuaugaguuaaaagaauauuucuaguccuggcugggcguaguggcucacgccuguaaucccagcacuuugggcagccaagguggggucgaucacucgaggccgggaguucaagaccagccugcccaacaaagcaaaaaccccauuucuacuaaaaaugcaaaaaauuagcugggcauggugguguacaccuguaaucucaguuacuugggaggcugaggcagcaggaucgcuugaaccugggaggcagagguuacagugaaccaggaucacaucacugcacuucagucugggugacagagugagaaucugucucaaaagaaaaaaaaauauauauaacaauauauauuauguuauauguaaaauauguagucuagacagcugucauuuguuuucauauaugugauuaaauuaagacugcaaugaaagaugccgugaugaauaggagacuuagcaccuuaaccuccaaguacaauaacaccugugcugacucugggaaagcugguuaauuuuagaaagccugaaaaaaaaugucagucucaacuuuuucuuucccuagggauuaguaacuacucccuucuuucugaccugaauguucuuuuugaguucagaacuuccuggaacuaauuaaauguuauauuaucugguacaauucucagcucacacagacucauggcccuuggcaauccucaaacucaucguaauuuuaaaaugacuuaugacuuuggaacuuuuagaauuuuugaagaguuuucaccaggcuuaagacauugucagaauuuaucucaccucuguaacaugacauuuuauuuaugguuuaaaaaaaguaauugaguucauuugguuuauuuuaggcuuagaaauuuuaggcuuagaaaucuagacaugauuauuuauauuguucucauaaaugucuuuaagauuuccauauaaaucuuucaauugucaaaauucguuuucuuuuaauuuuucauuugcauuuguaauuucuauaguacauuucacuaauuuuugccaaaaaguuaaauucuuuuaaaaaauaaacauuucauccuucccauuuauugugaaauuuuauauuuuuacaggauuuuaacagucaguuucaguuaugugacuucacagcucuggaagguuacuaugguaguuaacuggcaaugacaguuucagcugcuuugguaacaaaucccagcauuuggagucuagauacuugccuggcauuugugucuuucacuugugauaaauguagaaaggauaaauugagccaacaaaggauuaaggaaugugacuccugccucauacucacuaaaagagaauccucaaagucugaacuggugccuuuccuaacauaguuuaacccauugccaauuauauuacaauuuuacuucacaguaaucaguuuugaggccgauuaaaagaacaacauaguaauucucgaauuaauauuucauucaaaaaauuuuaagauauagcaacucaguggcugaauuuuuuaacguugcaaacggauuacuaaagaaaacccaauacuguggaguuuauuauuuuguguuguuugaagaugaugguagaauauuccuuuaaaacaacuuugauaugagccuaaaugcaugcaauuauagauuagugcacaguaaguuucaauuugggagaaugaguacuuuuuuucuuuuuuauguuaacugauguuauaucuaaaccuagacauucccauuuuuauuguauaauucaagaacauuacauuacugaaagucaaaauauuaugcucuugguugucauuuuacaucaugcguaauauguuugauauaauguauuuucaaaacaacauuuagaaagauagcaauuuuaaauugauauuucuuucugaccccagugauaccuuggauugcuuuaguauuucacuugcugcuuaauaucccaaagcaaauacagauggaauaguuuaaacuggccauuccugcagauacuaaagucaguaauauccuuguaaauuggaguuacuuuauuuaauuuacaugugacauaaguugguaaccuauuggcauuccacaugugugguauugaccuuuuuuccuaauguuuuuuagauauacucucuuaguaggccacuguuuuuuuuaguaggcaucuauucuaguaguguauauucuuucccagagguugagcuaaaugauaaagacauuaacccagaagaagaauauaagaaauaaaaauauaacuauuucaguuaauaggaucacuccuguaaagaaaauauaucuauaacuauuacucugucaccucuuugagugguuuuaaagagugccaagggauuuuuuucuauuaaugaggaaauguugguauguuguaagaaacauuaaguuuucaugguacauuugagccauagaugcauuauguaugucugaguaguauuacucguaggcuuuuuauguucugagcuucgauggcauuuauaccuaugaguaaguaccuccagcaaagaggcagguggcauggugagcaggacaaagcauguucugaaccacucuugcucuuagauucuguuuuuuaaaugacuuucuguuauuugaaguuccuucacaauugaaaguguaggaguuaugaauacauauguauccuuccacaugaaugaacauuucuuuaaagguacugugaguuucacuguuggcuuuguaggugauaauuuuuauauuuuuguuacuauacauggaaaagucuuaaaauuccaaaagaugaacaaaguuuaauguaauauuuuaaauaauaagaaaauuuauuauuggcagucuacuuauauuugaugcaaauguuagaggugugagcaggacuaguguaacuggugaauucaauugaaauaaaaaacaaauuuuacguaaaauggcuuguuuuuacaaauagguuuucaccaauaaccuauccaauauauaugaaacuaacagugaguaucaguaugaaauuuucauuuuaucagaauuguaaggaaaacuauaauuucauuaaaacaguuuggagcccauacuguuuuuccaagauuaaaagacaacugaaaauccuuugaaucaaaauuuuaaaaaaacauuuauugaauccaaguuaaaagugaauauucuguuuuauuuuuuccugcuugcacugauguaccauauauauucagauucuauuauguagaaaccaaauaaaagccaugaucuggucagcauuagccaaagauauuguaaugcuacucuuuuauuuguaaauuuuaugccuuuuuaauuguaaguuagccucuguauucagaaaugaugacgauacaaaguaucuggacucuucucaaguuuguggaagcgaugaagcuuaugcauuaauauuaaggaagguaaaucagcugagcuugguggcucaucccguaauccuagcacuuugggagccuaagggugguggagcacgugagcccagggguucacaaauucauuaugaaggauuacauauuauauuaagcauuguauagccucuugucagugaaaugugaaaauaauauuagaaauugucauaacaagguuuuguacauguggaacuuuuuaauucuuuauuugcuuucauuuguccuuuccuguaaaacuagauugucauuaguaccuguuuauaaguguguauuucaauuccagagagaauaugauugagagccuaauaaauguaccuacaaaauguaaccuuuguuugaaagaguaaauuugccuaaauuauucugggucaaacuugagaaaacaugaucacauuugauaauauccgcauucaaaaugaaagauuuuguauagcaaagugaaggugauuaaagaggugacuuucuauagcgucuuuaacuuuuuauuguaagagauuacauauauuaaauauuuucagguuagaaucuguuuuuuuaagaccuuuuucuucuucuguguuugucugcguuaguuucaggaaccuuuaccagaucauugauaaagacuucaaaaugaauauaucucauaagaugauaccugcuaccagcaagugguugaaucucuguauuuucuaucuugggugcuauaaauuaaggaauaaacccuuccuguaguuaacaccuaucaugauuucaugccauuuguugaauaggaugagagacucaaauaucuauuguuuuacaauuuuuuacaucuuuauaugugcuuuuuuaaaauaaaagauuuuguacauagguaauuacauagcacaaaauuuauaaauauuacaucauugaaauuauuugcuuuuaagaaucaaauuuauacuucuaaauucuuuuuaaguuaaguaggauuucuaaacuaaugaggcuauaauuugauggagcuuuauuauuucaaaaauaguugaaacccgucaguucugauaaaaauaaacccaggagaugcaacgauuaauuuauuuuuuguuggagacaaaugugucauccuguauuuaagugacugaaaccuagaaauacaccuguuuuucuuuaagacuuucuauucuuuauaaaccuguuaugagauuuggauuaauuacacuauuuguuaaauacuuauugggcaccagcuuuguuccauacaaaauacgcuggugaaaaauacaucagugaucucuuuucucaaagaagucacacuguaaugggagaaacauauguuuaacaauaaucacaaauuuauuucaaauuuugauaugaaaaaaagugaucagagggaugguagcagguggaaucuauuuuguuuuaggggccuuaggaaacaucaucuggaggugacauuuguguuaagaucugaaagacaaaaauaaccuugcaaagggguaggaaaaggcucagauaauagcaaaugcaaaaaccuguggugggagaaggcuuuuguguuuggggaacagaaggguagagugacugcggcucagugagccuuagagagacugacauaagauuggaaagguaggaccuuacaggucaggguaagcaacuggauuuuauuugccauacagucagucguguguuagggaguggagugacugguuuguuguuguuguuguuguuguuguuguuguuguugcuguugcugcugcugcugcuguuuuuaauuuucagagauuacauaggggacaccaaaaccgucuuucuguccaugaccccuauucuccuuaguuucucuucuugaagauagcuccucuuacuuuuugugggauuuuuauuguuguuauuuuuguuuguuuaguucuguuuuuauccuuccagagcuuuuuuaugcaaauggagacacaugcauauacaucuuuuuauuuuuuaucacaaaugauagcuuauacacuguucugcccucuuuauuuuuuuuaauuugauaaaauaucuuggaguuauuuacaucaguauauguagauuuaaucuauucuuuuagcuugguaguaucuguuccuccuugauaauuaguuuucuaaucaucugcuacuauaguaauacagagugcuucagucaaaauuuuguacaucuaugauuucuuucuuguagauauauauuuuggguuaaauucuacucucuugaauaucuaaauagauaugguauaggaaagauucaugaacauucccaaaaauuuauaccucuagauccacaguucagguagcauucgauuugaacucaagagauuucuagaaaauauaguggcucccgguggagucugugcuuccagaagccuuuauaauauuuuauauaaaagcagguauguauaggagaugaguuuacaaauagucaagcaagccgcacaucuagccguaaucauagaaggaauuuuacucuuuaugaauaagaaugucagaaaguauuuuuuuucugauaccucuauauaauuuccccucagaccaaauuuauuguauuccagaauacucgauuauggagucagaauuucuuuagaaaacugagaaagcccagugggaaacauaccugcucccaaagcauuuagguccacucagucaucucuuuuuuuuuuuucauuuuuuugagacggagucuuacucuauggcccaggcuggaguguagcggcacagaguccgcucacugcacccucugccuuccggguucaagcaauucuccugccucagccucccgaguagcuggggcuauaggcgcccgccuccacacccggcuaauuuuuguguuuuuuguagagaugggguuucaccauauuggccaggcugguaucgaacuccugaccuugugaucugccugccucagccucccaaagugcugggauuacaagugugagccaccgugcccguugcucuguuauuacucacuuuaacacuuauaaaaagaaaugcucagugggaugcaaaaugcacuguaauucuuauuuagaugcuguuauaccuggaagugacuuuugccaggcuaaacaugaccacuguggcuuuggaaccauaugugguuuuaaauuauugcucuacuaucauuugugugacuuuaagcaugcuacuugaucucuuuaagccucaacauuuuuacuuauaaaaugggaaaagaauauaaugcucaaaggguuaaaugaaauaauauauguaaagaauguggcucauuucuuaacucauucugaguucuuaguaaauauuaccugcugguaaauuaaucugggcugagaaguaacauuauguauagauggaauuuucaguucaaugagcuaucauauucuuguaaugccuaaauauuucagaauaaaugauauccaaccuuuugaaaacucaguaauuucacagcaguaguagucgcccauuuuggcuuaguccaaauguuaacuaacuaauuaaaaaauuaaucugggggccuucauuuuuuuuucuuccuacuagacuauuaccaaacaaauuuuaauuucagagaaagaaugcuauuaauguguagaucaguaaacuuuuucuugauauuugcaaauauuaaaccuuuagauucuagggaaaaaucauacaaauacaauacaauuacaaauagcagcuuucaguagaccaaacauuuucuaaaagucagccauaaauguagaaaggaauguguuucugaggugagauauaaaaaaugcuuauuuguaauaggcaagaguuuggaaggcaguuuggcuaagcaaaaucacaagcucagagauaauaagagauaggcaaaucaaaguuagacgacacauggauaguuaguagguggcuuagaggacaagagaucuuuagagaguuuaaaaacugucagagauggauacgaaugaauagaagaacacuuucugaaaugugcugagacacauaggaaaccagaguauguaagacaggguuaaaugauaaaauaaguuggcugcauugucucuacccccugaguauauugaagauagauuuaugaagaguuuaauuuuaauaauugaggugggaaaugacugugguaugaagaguagguuuugaguccaagugaggauagguucugguaguauuccagagcaaaugacaagguuguugccaaaagaagaaaagauguugaugucaaagauuguucaaaauguccuauuuccaauccaucauugacgucccuguguuauuuacuucagaaggaugagccauagaauuuuuuuucuguuugaacucuaaguggcuaaggaaauaaaaaccuuaaauguaauggaugaugaguaaaauauuuggucuguuuuacuucauuuguuauugguuuguaauucuuaguguugaauggacaauaaaguuguuuuauauaaucugcagccacacauaagcuuagacuauugaacaauucuaagauuguacuuuuauaacuuuuuacaguagcaaucuuaaacguugagauuugccuauucuccucauuaaguguaaaucaaacucauuggcaguccauuuaugugguuuuuuggaguaauuauuacaugauaaccuuuuuaauaauaaagguugauuuuuuuuuuucaucuccgcaaccauaugucccugcaaguccagaaauagcuuuuaaauaaagcugggaaaagauuauugaaaacauggagagaaaaggagauaaaaacauguuucacuuggucauauaaaugaaagagcauaagacaugccacauguuuuuagacuuaaggucuauccaguucaguauaauauguuggggaaugauacucuuacagacugauuugaggaaacaguauauuuugaaaaggaguauuuuaaacaucaccauguuuggugaugaguauaccuaccuuuccuuagaagauaaucgacuuuggaaauacuaaugaaagaaaaaacugugaaauuuagguguucccugugacgagcaagauaauaacauaacaguagcuccauaauaauauaacacuuauuguaugccauuuuacugauggaaaaauaugcauugagagguuaagugaauugcgagguggaccuguuguuaaauuguagaaaaagaauuuaacucuuggcucuagucaguaugauuuagacucaauacuugggaaaagaaaguagagaagaaaauaagucuguuaaaaauaagucacaguauagguaaggcuuuucuauauuauuuagaaaaaaggacaaauuuagaaaugcgaauaacauaauucagaaacauuucaggauuauuugcaaugaaauagaggcaauuugauuauaauuaaugcagucauuuuguaauacaaacaugauuauuucauguaucuuuugcugaaaauggacauuuuuuaaaaauaaaugauucaucuaucuuucaaccaacagguacauaucaaguaucuaucguauggcagcuuugcuguggauaauauauaccaugaauucuauauuguauuuucuauaauugugaauguuccaaauucguguaugucuaucuucuauuaaugagaauaucaguaaaaacauuucuuaagcgaaacauuacacuauaauuaaauuucacugguuuuucuguaaugcccucuuucgcuuccagguuacaauagaaggcauuauguugcauuuaguugucauaucuccucaguauccucuagucugugagaguuucucagucuauccuuguuuuucaucaucuuugacagucuuugagaauauuagcuagauguccauggaaauguuuugcugaucggaguuugucugaauuuuuucucuucauaauuagacugaccuuauggauuuuggaaaaauaucacacaggcaaaaugcccuucucauuauaucacagcaggggguacaucauauccacaugacaucacuggugauagaaaccuacaucacuugaguaaaccauuuuauagugacaaauaaaugccuuguaauuuuaucucuauauguaucaucuuuuucauauauuguuccuauuaugcuugaaaauauacaaagaucauagacaauuccuuuuaagauauaguguucccacaaaucagucuauaacaguauacagucuuaucuuuagaaagcuaacaaaauuuuggguuuuuuuuuccuuguuccaauucaaaaaaguaguauaugagaagaggacacggggaauuuuuauuauguuucauugguagugcaaaauaauuuuagaaaacauauaauugacaaucuggacaucauguguccagaaauuuuuaacuaacauucuuauuaagcaacaaauuaaugaguggagaaacuggaaaaaagccauuaacugugaaaagcuuuacauggcaauguuuauauaguucuaucgucaugagggaauuuuucuuccugaauauuugcuagugauauauaacauuuuuugacgauggucucgguggauaucuaauuuugagugugcguuauguuacgaaccuaauucuucauacagaaauauaaaucagaaagauauuuuagguucacauuuuucucauauaaauaagaccaagauuguauauacauuguacuguuugauauaaauaauuuggauauaacuaacuagaucuuuuaagaaaauuguuuacccuuaugacauuucugcuuucaggcaggcuugauuuuuuucugugcuaccugagugcaauuaaaaacaugacagaaaaaaaaccucuuucuauucuaugcucgcaaaugaaaacuguaaaugaugugaguuggcauguauuucaaaagauagucuaucuaauguauuagguuggugcagaaguaaucacacuuguugccaugaaaaguaaugauaaaaacuuuuaauggcaacaaccgcgauuacuucugcaccaaccuaauauuuuucagagucauuaaucccucuggguuuguucccaggacuuugaaaacucagauugugcgguauuuucuguuguuguuacaacgaaaaauaaaugaaaucuuaugccuuaaucaagugaucccagaaaaacaguaggccagugaugucguguuucccuuuaauccguuuuuuagugauagugacuuaaagcuauguuucucuuuccacauccagcuaucggacucaaaggaaauauaaggucuauaaugaaaucugcucgaagaugagcaugguauacucuguauugguuugauaggacugaaguaacaaaauaucacaaacuaugugauuuaaaacaacagaaauuuauucucucacaacucugaaaguuagaaaguucaaaaucaaggugucaccagggccaugcucccuccaaaagcucuggggaguaauuuauuccugcuucuuccuagcuuuucuggcaauucccagcaauccuugguguuucuuaauuugcagguauaucauucaguuucugucucugcaaucacauagccuucuucccucugugugucuucgugucucuauauucaaaucucuguuuucuuuguuuuauaaagacacuagucauugguuuaagagcccacccuaauaugaucacauaaugaguaauuacaucugcagaaaucuuauucccaaauaauguaauauucugaagucccagguagacauaaauuuuggggggacaauguucaaccugguacacacuguuaguuguuuuaauuaauagaucuguguguuuuauuggguuauguuauauugaaagacaguuacaaaacaguaguuuauguucugcuaaauccaugauacaucugauuauuugagauacuugaggagcuacacuguccaaucucagcuuucaacaagacucaaacaccuugaauuugguuaguggucagagcauugaugaccaucucuguccucauggcucgugccauauaguccgucauaauuuauuuaaggauaauaugagcucugaggcuaguguuaggcugugaaucauuuauaccguaauugauccuagcuaaggggccgguaucugcaccuuagcaugucuuuguuuugugugguuuauaucucaccauuauauaaauaucuaauggggaaaacuauguauaguaaagaguuugugaauuuaaggaacuugugaacuuuagcacauagccuuuaugaaugugauacuuucauauccaaauaaugauuacacuuuucccuucguaaaucaauccuccuccccuuccacauauuccaaaauucaugcauacucagguucugcagugggcccugcagaacccacuuacaugaaaagucagccuuugaaaaaaauccacauauaaguggaccugcacaguucaaacucaaguuguucaagggucaacuauauuacacuacauuuaggaaggaaaaguaacaaauuguuaaacucuuaauaauaaaaaaauacauuauuaauuuguguuuacuuggauaaagcuuuaaauauugaguaaaagaaucauuaccuaaaaauuuuacacuuuucuuucguaucuuauaaacacuuauccugucuuacucaaaaauguauuugaaacuugagguuggcuaaaaugcaaagaaaauagaaaucacagugaaggaaaaauaaaaagcuggcagggcaaaaugauaucuagaguaugcuuugugcaaaacacuguuuuaagcacuuaacauguagaacuucuuugauaucaccauaguucuuuaaaauauuauuauccucaguuuacaaauaaggaaacugaagcaaagagagacuaaguaauuagcuguccaagauuccacacuuuucaguugcuacuugucaggauucacaucuagccagaauccagugccaguucucugaaucacagcccuauagugaaaccagaguagagcuguuauaucaaaagauacauuguaauaucaugcaggauugcuagaguugggucucaaauuaauuucuaacaucuuuagaaguaagucaaagauagaaacucaauaaacucuaccacauucguagugacuacaaaauuuaauuuaaauuuucccuggacccauagcuguccuuggcccuaaagccuggaauuccauauacuuggaguuccacucugcaguacuauuaauacaguaaugaauuuuacagcuaucucuuggagcacagcucaaaguaaauuaaagagggcggucaggaaaccugauuucauaaaagcaucaaaguaccauuuagaaucuucauggaaauugaagaguuguacagguauguuuuggaaccagggcuuugcucgcuuuugcgaaagcagaguuugggucauauaccuuggcaugaaucauuuuucagauacaguguguuuugcaguaagugacgugaaaaccuaaguaaauguuaguuugcugugcuaaguauucauaauacuaacauacaacgugauuaaagaacaaaugauucuuuggaaauauaaacagaaacaauacuaaugaauuggugacauguucauaguauucuguguaucaguauggaauauaucaaauuuaaguuauaucuaaaccagguauugcuaauuuaauaaaaucaguuuuuaagcaucaaaauucuguguguauauaucuuagcuuucuaacuuuuccugugucccuucuguacacuuccccuugcaaauccuucaacccuucucucaucucuuguuuacgcugcugucucuuuucuuguucuuuuuuaaagaguaauuccaaagauucugacuaguuaagacuuagaaaaaaauuaauguaaaaaaauguaguuauuccauuaauaccauugcuugccacuuuucuguuguuaucuaagcaugguauguuaauuacaucuaguuguaaaacugaucuguaaaucaauagcaaauauaugaaagcauauaacuuugaauauuauuuucuagauuguuucuuggcuaaaaauaucuuuggaauggcuuuugcuuagcauuuuuuuuuuuuuuuuuuugaggcagagucucgcucugucacccgggcuggagggcgcaaucucgacucacugcaagcuccgccucccagguucacaccauucuccugccucagccuccugaguagcugggacuacaggugccugccaccacacccggauaauuuuuuguauuuuuaguagagacgggguuucaccguguuagccaggauggucucaaucuccugaccucgugauccacccuccuuggccucccaaagugcugggauuacaugcgugaaccaccaugcccagcccgcuuagcauuuuuaauauguaccugucuaccacuuaaaaacauaccgaaauuaaucgugguuggaagcuaaucauaguuagagcuugcaauaaauauauuuuguaaaaaggaauauuaucuuuuuucaguuugaaauguuucuucccuucuaaaaacuaauuaucugggauucuccacauaggaguggcaugcauauccauaaucauaauaaaguauauaaacacuaauuauuuuuauaauguaucuucagaaaagaaaaaugaaaaaaaaaauuagaagcuauuucagggaacacauacucuuuuaacauuaucucuuaguuuuuaucagucuauauuuuuccgauuggagcuuuauaacacccaccuacauuuuuauauuaauuauguguagcauuuuuauggcuauucuuucuaagaauuuauaucaaaaaaauuauauauaaggagaaagauagcgaaaucaguaaaauuuagaaccaagacauucaaaguuaucuucuaucauguaacaaaacagugacagaaacuauuauguagcaacauuacuaauauuaggcuaaaagaaaacuuuauuacuaugcuuucauugaaguaaauuuuacccuguuuuuauuuucucuuaguggucauuuugaaugacuuccuugcccacuggauaauuagcagauucauguacuuuuuuauagcauucugcuguaauuucuuuuguuuuuuguguuuugagacacggucuugcucugucgccaggcuuggagugcagugguguaaucauggcacacugcaaccucucccucccuggcucaagugauccuccauucuucccaccucagccucucaaguaguugugacuacaggggcaugccaccacaccugccuaauuuuuguauuuuuuauagagaugggauuucgcuuuguugcccaagcuggucucgaacuccugggcucaugugauucaccugccuugaccucccaaaguguugggauuacagaugugagacacuguaccuggccuguaagguuguuucaaacuggaagucuggguuagguucccuguaauagcaauaacaacauauaguaacaacagcaacaguaaaagcaacuauaucuugaguuuuuagcuuucuguauuucagacacugguaaucacuuuugaaucuucacuucagcccugugaugugguuauuuucaugccgucauuauggaugaugauaagccugaggcccuauggccagagccaauacacagagcuaacuuauuuaucacagagagccucugaaucaggccagucuucuucacaucucuuacacuugucugccuuuuauauaccaucauaaaugucagcuaccuugacugccuuuuauacacugucuuuaauaucagcuauauuauuaaaagcaauaaugaaacugcguagugucgaauuuuaacaauauugcuaaaaugaaaaauguugaggcacuguggggcaaaaaugugaaucacucuuucagacagugaggagucaucaagagcuauuccaagagaaauccuauuuagaguacaugagcaaccguaaugaaacuuucuuagauuuuuacaucaaucuugauuuuuaccuuauuauaugaauuaacugcuaaaucaagucuugucuggacaauuaaccaaaaagccuuuaaaaaauaccuuaagguaacauaauuguuaauaaauaucaauaauuucuacauucagaaucaucuuuuaaaauaauauacauaucuuauuaaugaaaauuacuacaaaaugaagacuauggaauuuagcuuuuaaaauugauucuucccaguuaccauucauuuuaaagcauaguaucaauuuguuaugguccauuugcauugcagggucuuuguaaacucugucauuaaaccuaacagaaguagaacauguacuugagaccauccaucagggcaauauuccuuguuuccugcccuguugacuuuccuuuuuccauagcugguaaccacuauguguaucauuugucucacuaauaacagccaaccauauuaaggaacaaugaaaaagcaguggauaucacacaauuaauauuauugcugguuuuuuaaaauguuuuuaaauuggacaaagcauuauaaagaacuuucaaacccauauaauuaguuuuuuuguaaucauaaauaauuugauuuguuucaucuuauauaguacuuaaguauuauuauaauuuccacuuuacacaggaggaaauuauggaucaaaaagauuauuuauuguaaacuugcagaucaaaaaaguuuuugaaauaaacuaauaucaaguaguacuagugucagcaaucaccaguauacucaagggacuguaaaaguccaaggcugggcccaagaaguauccaggagugcuucagaauaguucagcaacaucugugugaagaacaccuauaguguaagaauacaaaaggagcaaaaugaaagacauaugugccacuagugacaucccucuauacucccuauauacagcaguuaaaggcucaaggauacguccauggaaucuacaaacugucacaccagugguaaucuuaaaaauaaugcuguggagaaucagguaguuuauuaguuuauuacuagccagaaauauuuuuuauccacugacaagauuauuaaaaucugcguggcuaauuuaauauugcauuauuuagguagcuccaugucugggugaugucucuacaucugucauaaaacuaggagacauuccaguuucuuuuucuuucucagucaaccuggauagaucuggagaauugagccagcuguacuaauguucuuuuuucucuugaguuuaccucaagaaagaggaauaugccucugauugggucuguuuacugacucucccucuuucacaucauccacacaaugagaaguugaucaacuguuuuagaauagacaacuguuguaaaaacuaguuacacauuuaguaaauauugaccaaguuacucaaaugauggguguagucacacauuaggaauauaaaagacuguaaacccugugggaguuuguaucuugaaaaauuugccaacagauuacauagaacaucuccacuauuuucucauauuuugaauacugucagaguugguccccuuaugacuuaauaaguccauaagagaggaucacuaguaauuggguuuuaauauauagcuuaccagguaaaucuuuuugccaaaauucuuaccugaucucuuggauggaaagaagagaacguaugacauugcauucacuucuauuuguucucguguaucugcagaccauauuugagauccucagucuuaccacaaccauacccacauaguugaauaucagauugagugaguuaugggagacauuuaaagaugaauuuguauacauucuccuuguuuauuuuuuucuagugguaauguuccaagacugagacaaacagauauuuaccagaccuauuuuaucuuauuaguugaaaagaaaaacccuguuaaaaucaacuuuauaagaugcugugauuauggaaauguccuaaccacugcuccaccuggggcaaaggguacagagaagaaacuguccaugaagguggagaaaaaacuuucacaagggacgauguuuauugggagggguggggaaaacaccuuccucucuguuggaaagugggagauacugggaagcaauugaaggcuuguuugacaucgguaacuccagauuggugcucugaaguguggacugaauugauucuuucaucauaagucugacugucuuauggugccauauuagaccauauuuacugagugaaugaauuauaaaacauaauaauuuuagcuuuccucauuuuuuuccuagcauuaauaaaauaucuuccccuguaugcacaguuggaaaucauacuaauguuguucugguuuuagaaagaacacaugucaguguagaugccagaaccccuaaguaaaauucuggcuugaaggcuaaggaaaugauacccaggaaagguuaugguuaccucaaagaaaucuguucagcacagaaaauaucacauuagauuagauucugcagauuuuuagaccuuucccugcuuaaacugcccugcaauguagcugucagacaucauagccaagccaaugccaaccccacaguucucuccuaauccugaccccauuucuagacuuaaugcuacaugcuuuucuagcaguuucugauaauuuauuaauuacagaaaguaguuuuuguuugccagccuguugaguggauggugauuucacuaugcucuacauuuaagcuuauaggcuugguaguuuaauaaaacugcuacuuuuuugauaaauacauuuuuccucccaugguuaaaugaauaaaguguaucuagagugaaaaagaaaucccaauuauacauagcauuuuucuaucugcuugcucauuaaacuuauaugcaugucauaacauaaaaauaacacccuguaagaaauaaucugugauaacuugaaaggaaugccuguguaaucuaaauucuuuugaugcugucucuggcauuuaaccugucauuuuaaugaaacaauuuuaauugcuuauuugcacauaguguugugcaaaguggcuuacuagucugugcuuucugggaagugaugaaagaccuggguuggaauacuccaugugagugaauguggaaaggucacauagauaauaaauuaauuaaaaauuuaguuaauuaaauauuuacuguuuuaaaaaauaaaguuauaugaguuguaaagaaauaaacaaugcauuacccauuuugauuuucagguaucggugaaagucaucuuuuguugaaucaaggaguugauucuuacaaauuuuaggucugaauaaugggaguaaguucucuggcaaucuguaaggcaguauuuccauuuaucugaguucaagauguguaaagaaaguucuugugaguucaaaaguaaauggauauggacuugggccaaaaacagugacaguaaaguuuaaaugauaggagcaaggaaaaagauuguacauuguacauauagaauaaacuaugauaaugaguaaaacauuauucucagauugcuugaauuguagaucagagaugauuauaagauuggaucgagaguugagaauggagaaggauugcacaggaguuccagcuuuucaacaggucacguaugcacaguuaacagggccacagucuugaaguaaagagggacaaugcuggguagcgaggauggaagacuuuuacaaauaauaaaauaugauuucaugcaaaguguucaaaguagagcauauuaaaacagggaacccagagauggugguuaaauagucuccacagucccacuuccuuauugggcugagcuuccuggucuagaauggacuuuagacagcauucuaaccucaucucuuuauguaaucaaugaaauccagaaaaauugggcaaguugucugagcuccuacaacuaauugcuuguaaaguugaagugagaaaagacgaucugcaaguuuauguaguaaaacucaacaaaguuaaucuuaaacgaauauagaauggguccuuuucuuuuaaauaacuaaaauuuuauugugugcaugacucuuaucucuuuccugaaguacuuguccuaagaaaaacauuugaaacaaguuacuuuaaucuuaucuuuuuccccaacuuagauaugagaaaauuaaguguaaucgggaaccucuuucauuacgaucugaauuaggagaaauaucuguuuauggccaaacauuuuucugcuucuagaggccuagaguuguuucuaguacagacuuaaauucuaauagaaaaucuccaaauaaggcauuaauauuuauuucauacccugaaugauaucuaaggaaaaggauauucucaguauuauauugaaaccgauuuagcuuuuucuccuaagcaguuacuuaggaggaaacuuaaauaguugucagugguaguacugacuuagcacagacauuucagcaacaggaaaauacaaauaaaagagaaauguaagucuuagaaccuaguucuauggaugcuuaauucucaagaacuuuuucuuuguuuugauuuaauacauccccuuuaaaaucaauacuccuaaaguauuuauuacuuuauccuaaagcaauauuuauuaauuuauuacuuuuuccuaaaguacuuuaaagguacuuguuuccucccagugaaggaagaaugcuccauucuuaaccuguucucuggaucccucuccuaccccuucagaauccauugaagguuucugaaccauuauaacauauuacuugugugucuguguagccauuauuuuacuauaucuuauuauaguuuauguaugaaauuugaacgggggacagggaauguacuuuaaugauaaguuagaaggccuuuggcacuuugccugaaauaagcaccuauauuuuuugucuuauuuuuuucuacucuaaaguccuuugagcguuauucuuucuuuguucauuucuagauaggacucccuacucuugcccaaugugucacaggagacauuuugugagauggcuagcugaagagcuuacugugugaccugaguggcugcaccacccugcacccaguacucucuuuuguggaagaucuguuccucacugucauaugugccucaccugacaaaugucaaaugcauguccuuucagaacacagucacugcucuauaccuggaaaacugcuauaguccauaaaauucugcugucuagauaaaauacauggauuugagacccagcccaggcccugacuuauaguacguuguugggaaagucaauuaauacuuacauuauuauuaagagagcucaaugagauaaugccuaugacagcacguguaaacuauuaaacauacgaaagacaaacuuuuuauauuaaacuccuacugagaguuuuaccucuuagagaaagggauuuuuuuuuuguccugauuuucauuaaaaccccaaguguuugugggcuaaguacuacuuguaaucagauacuaccaaaauaauuccauguacuguacuauuagaaugucaacaguuuuauauguuuuccuuugagagaucaaguuaagaauugccuugaaaugucauccauccuaggaaauuuuaguaccucuaaauucuuuauccaagaugagaaaucaucuuuuuauuauugacuguucaucauguggaaaucugucagaccuaucaaaagaacccccuuuacacuuuucuauucuaaaugcuaagcaagauagcuuucuguucugaaccccccaaaaaaagaaaaaaaggcagaggcaguuuaaauucuccugaagcaaauauuugaaagugaaaagauagguguuaaaucuauauuugaagauuuccuuuaguguucuugaagaaauaauuaaugauaugcugcccuaguauguguaaaaauauaaacugugcuugaaaccugauguuauauaggaaauaaucaaguucuuacuucacuugagaaagcucuucauuuauugaaagcggcuuugauaucuauccaaauauuuuuaauauuuccaggacaugacaauuaauuuuacuuauauuuuucauucuguguguaacaugccuuguaggucuucauccaguucuuaaugaaaauauugaaaagaagauuaagcaugcagucccacaucauaccacuaauaacauuaugacagaucuccaucaaaccuuaaaucaauauuccauggcuauuauuguucagccuacaaauccacuuaacuguaauucuauccaucucacuuuaucuccauuuuaacccaaagauuguaaugauagcucaaauggcugggcugaaaucuuguugcauuuuauuugcgacauuccucuaaucuaauuuuuuugaaguauaaaaauaucuaguaaacuuuuuguuggaaaaugugaagagauacuuuuccacagaucacuugcaugucugcacaucuuacuggguauauuaagaaugcaagaccgucacugaucuugacccaggccauuucucagggauguaucuuuagugagcaacucugaaagaugaaauaaugccucccuguaugacagagaguaggcuugcuuacugccugcuguaaaauggcaggcaucccagacucaaagaugacaaccuauucugugugcagguauccaucuaggcucauccccaauaccaccaugcuaugcuaugaauaauaaaguccuuugucucugaccugugaguaucaugccuucugccagcauccaugaaaaaauaauaggcuagcuuauuaacuuauaaacaagguaaaauccuagaccuaacaaaguauaauacacagcagagaacacaagucuuaaguauagagcuugaauuaucacaaaguguuuacagucauguuacuuccagccugauugagaaauaggacaugacuauugaauccucucucauacaccuuccuggucacucccacccauuccuaaccaccuucgucaccagggguaagcacuuuguugacuuuuaaaagagauuaauuuugccuauuuuugaacuuuaugugaaugauacugaacucucuuuacauauucuuauugccacacauacaucuucuuuuugaaguuccuuuugcccauuuuuauuguguugcuuaccuauuuguuacugaauuguaggaguguuuuauaaaacuugaauaaaagccaguucugaaaguucuggagauccauugcacaacagugugaauguaccuaacacuacugaaugguacacuuaaaaaugauaaaaaugacaaauucuguuaugugggguuauuuuaccacaauuaaaaauaaaaaaaaauuuaaaaaauagccaauuguaugguuuacuuauacuuauuuguguaaugauauauuuugauaagcaaaaguucuuuaaaaaaauauuuuuggaugaagucccauuaucuucccccuaccccucuuuugugugguuacugcuuuugaguccuaagaaaucuuuacauacuccaagaucacaaauauauuuucuuguguuuucuuuuaggagccuuauacuuuagaucuauaaaucauuugaaacuaauuucaccuaugauguuaccgaggggguugaaauuauauuuuccccauacaguuauauguaguucuuucaacuaucaauucuuuaaaagacuucccuuuccucauugaguugcuucggugucuauguuauaaaugaauugugggucauuucuggacuuugucuguuccauugaucuauguaauuauccugaaaccaaaaaccguacuuucuugauugaaacuuuguaguaauucuuaaaauuggauagucaaacuccucacaguuuguucuucugcaacguuuuuucuauuguagaucuuuuauaguucuauggaaaaauuuagaagcagcuugucaaauucaacaaaaaagccuccugggaauuugguugagauuguauuaauucuguaaaucaauaugggggaaauuuacaauauuaagccuuccaauuuauggacuugauacauuguuccauuuauuuugcucuccuuucacuucucuuagagauauuuuguacuuaucaguauaaagguuuaaaacauccuucuuuaaaauuucuccaaaguauuuuguuauuugugguuauaaaggauguuuuucuaauuuacuuuucaaguauuuuuuucuggcauauagagauauaauugauauuuugauaauugaguuuguauucugugaccuucauaaauucacuguucugccaaaucugguggauuuuuuuuuuuuguagauuuuuuuucuuauuuucuguguacucauaauuuucugcaaagagauuuuacuucuuucuuauuuuuccauuuuuuucugaauuauagcacugggauagauauucaguaaaaugauaaaugguaaguaguaagugcaggcauccuugccuugguccugauucugagagauaaguguucaauauuuuaccauuaaguauggugauagauguagguucuccauagguguuccuuuuaggaccuaggaaguucuauucuuucccuaguuugcggagagauuuuuaaaaaucauuaguagauacugaauuuguuuaaugcuuuccuguaucuauugauacgauuacaugauuuuucuccuuuuccccuuaugauguugaauugcuguagauugauuuuuaauguuaaacauuuacugggauaaaaccuacuucaucauguuguguuaccuuuucaaaguauugcugcauucuauuaaugauauauauugugcuuauaaaauuugucaaaugacauuguuuuauaauuuccuuuucuuauaauauccuuguaagguuuuaguaucaagguuauacaggacucauaaaaacaguuagaaauauuuucuucuccuuuucuaagaaaauuuguauaugauugauucuauuuuuuucuuaaguauuuuauagaauuuaccaaugaagccaucuggaccuagaguuuucuuuauaggaaguguuuuagcuacaaauuuaguguucuucacaauaugggcuauuuaaauuuuuuuauuuuaucuuguguucacuuuaguugucuuucaagguaucgguccuuacauccauuugucaaguguaugccauaagguuauuuaucauauccccuaauuauucuuuucccaucuguagggccuguaaagauguuucaucuuucaauucugauauuuguaaauuguguuuucuccccuuuuuugguggguugugggaauggcggagaacagucuuccuagguguuuauccauuuuauuuaaucuauuaaacaacuuuuagcuuuuuuuuauaauuuguuucucauuguugauugcugcccuuuauuauuuccuucuuccuacuuucguuuaaauuugccuuuuccugccuugcuuugucauuuagaaauguauguagauuaauuuucauuccuauccuuuucugacauaagcauugaaagcuguaaauuucccuccuagcacuguuuagcuauauacaauaaauucugauuauacuucaguuugaaucauguucuaauuuuucuugugguuucuuucauucuugucuuuucuuuccaugauauauuaguuugcuagagcuuccauacaaaguaccaagugacuuaacaaaaauuuuuuucccauaauuuuagaagcuacaaauuuaaaaugucagcagaguugguuucuucugaggccucucuucuuagcuuguguauggucaucuucucugugugucuucacaugaucuucccuuugucugugucuaaucuccuccucuuauaaggauaccagucauacuagauuagggcuuacccuggggacuucauuuuaccugaauucucucuuuaaagaaccuauuuccaauuauaauuacauucugagguacugaggguuaggacuuaaauauaauaauuuuggagagacaaauuucagcccauaacauauuuguuauuuaaaaguguguugcucaauguuugaauauuuggacauuuucuugaaaccucuuuguuauuaauuuuaacugaauuaauuugaggucauauguucuguaugacuuuuauucuuuaaaauuuauucagacuuguuuaauugccaugcacaugguccuuuuuggugaauauuuagugcacacuugaaaugaaugugccuuuuguaguuguugaguguagaauucuauguucaauuauauugaguugguugauaacauacuaaaaucuucuaaaucuuuauuucccuuugcucuacuuauucuauuaauuauugagaaaaaguuuguuuaaauauccaacacugauuauauguuugucuuuuuaucuuaauuuuauuaauuuuucuucauuuauuucuagaaguuuaggcuaucauuuuauauuuaccucugcuuguguguguuuuuuuaaucucugaacauauucuuggagguauaaugggguugucauuguaauccucauuggaaaaaaaguuuccaauccucggugcacuuuuuuuuugguuuuuguuuugguagugggaggagauuuauuugcuuauuuugccucaauguauggacuuuaaauauuaaucagccucaaaaauuucaugcaacauguuguauguauguguaagcauuugaguagaauaucuauaauuuuuaucacauucuuaaagauguucaugauuuuacagaauauaguaauuauuaccugaauuucugucccagggacagucccugaauguuucaaaaucuaauuuuauaaaguauuauaacaauguuuuuuaguaauuggcucaugacccauuaauagguaauggaaugaauuuagugguuuucauaugcauuuacaaaucaaacacaguaggagacauaagaauauauuggccauaguaaaucuuucuuuauuaauauuucuucaguuuuauacacacaggaguauuugcacuugggaucauagugaaaaauguauuacauauuacgggucauggccacagaucuagagagaaagcauuugauucugaauugguagguucccauuugcauuguuucuucuuuuguuuuuaaaaccuaggcugaacuuaacaguuauaucuccuaggcuuaucauuuggaccaggcaguaaguugcuaaucuaauuuucuuguuugcuuuuugguuccacaguaguuuucucugucuuuguauuuaagguacuaaauuauuuaaucauuuuuuaaaaagauggaauguuauuucugauaaucaauaaugggaaauauuuaagcaggcauuuuccucccucucagguacaaauagaaucaucuaaguagcaucagaaaauuuuuaggugaacaguauuccagaaaugugguuugguugagcauugggguugaggugagaaaaggaagagaauuaucugcugauugcaaagauacaaagaugaaaaguauuauuuuucuuacauagccaguaauugaggaagucaaaguuuuauuguucuaagauuauuaaugcucuuccauaugcauaaaucauuaagcuaaauaaauccuuuuauaaaauuaagaguaaguuauauaaagggcuaauuuguuuauuucuggauuaccuacuagguaguacccuaucccuugagucagccaguaucauucaaggggaauuauagacaauucauauaaccccagauggaugaaguuaucaagaccuccuuaaaaaaagaacagccucuuauagagaaaacuauuaaaugaagauaccugcacugagacaugugguucaucuaaagaaaaagguauuaaggauagugacucacaaaguuaagagagauucugcaauaggcuacccuagauuucugaggagugauuuucaaauguguauaauauaaucccuaaagagugaaaauggcaguuuguauuuggcauggaaauagggagacagucagacuuuguugcuuuaguugcagacagugggcuguguauaggguggguggcagaucuaugaucucacuguauguauguauuugucuauaaauguaucagcuucaucacauuuuuuagaaauuggugaagccaccuuuccagcuuucucuuugagaauuuuuuuaaaauaguacuguugaacccugguagagaaaacacauagugaaaagugaaauaccacuaagauggaauuguuaccccuuucacauuuuuugaagcauuguaaacaaaugcugaaguacaaagggcugacuaaugguuuuuaccacugacuuuaaggagggcagcaucucaguaagaaaugugaaaaugaugaagugcuagugccuuguagcauacuggccaacauuuuguaagucaaaagugagaaaggagaaggugaaaucagcaagauggcagaauagaaagucucaguccuugauccucuacugagacacugacuuaauagcaauguauggauuaaaauacuuuaugagaacuccagaaaccagauaagaaguugcaguacacugggcaaguacaaagccaagaauagccaucuugaaaugagugaaaaaagcaguuugacuuuacuaagccagcauagcuuagugccaggagcauauuucucagcuugcaauuucuccuggguuugaggaagagaaugaaauguuuagccaguauuccaccuuuucagagaucuccccagagaacugguuucugucucaccugaccccaaacacugaugaaacaagcauagauuagaugccugaauccauugaaaacaagggagaguagaaguggcuuccugugguaccaaaggaccuacugugcugcugagaaagucuggcuuggcuuagugccuuucggaggaagcacccaacuugugguuucuucuucaggagggaagaagaugaguggagugugcauccaguauucugguuuuuuggaggucugucugaaggacugguaucuguguugccuacucaccacugcugaggagccaauggccuuuggaucacugggggcacugagaaccaaggagagcagagugacuugcuguggcaaugccacagaaccugcgguaguacagcagacagcaaauggagugagagauuacaagcucuuaaaaaagacaacugcaaacuucucuaggugggaaauuacaugcacaaucucaagucacauccccccaaaaagaguucagagauuccccaaauaucuagcuggacuaaaugguguauauauuccucuguaugaagccaauccauaaagauuuguagugguggcuguuuuuguaaauguacaaacuuagcaaaaaaucacaagacacaugaagaaacagggaaacauggcccaaucaaaggagcaaaauaaauuuacaggccaacccccaaagaaacagggauuuauuaauuaccugacaaauaauucaauauaaaguucagugcuuugcaugggaacacagacaauuaaacaaaaaaaucaggaaaacaaugaaugaacaaaaugagaauacucacagagagggaaacuauaaaaaagaauuaagcagaaguucuggagugaaagaauaccauaacugaauaguaaaauuuaguaguggaauucagcaacagccuugauuaaguauaggaaagaaucauuaaacucaaagauaugucauuugaaauuacaaaauccaaggaguaaaaagaaaaacaaauggaggaaaagugaagaaaaccuaagggacuuaugggacaccaucacauggaccaauauacacauuaggggauuuucaaaggauaaaaguaagagaaggggacagagagcuuggagugcuauauugcuucucuugaaugcuucuaggaaaaugugagaagacagauacagauuaaagaugaaauuuguaaucaaaaggggaacagagcauaaagauuuggaaaauugucagccuuaccauguuguaaaagaaugggagaaaccacugaaggugugguugaaccaauuuaauaaggaaauuagucuggauggaaggaagacagaggcuauucaucaaaacaaugcauuuuggagaucuuagaggcugccacucccaucauaggcccauauuaucaggaccuugagggcaguacacuuuuaagggggcuggggaacccauuggaccuuggaggguguuuuccagggaugcuucaaguuucuaauccuugcauccugguguaguguuccuuggucaccccagauauggcuccugugggcccaggugcuguccucuggaaaguacaagccauaaaccuuggugguguccauauggugcuaacugcagguaugcagugugcacaucugugaaagcauggaugccuccacccagauuccacggagacccucagagccuugacagauaacugccgcgggcaaagagccaccacagagagccccgacuagagcaaugccuagcagucaggggcucagugcuacuccuaaaaccccagaccuguagagccaccaacauggaaagccagcuugagagagcugcaggcacccagccucaacccuugagagcggcaauguacacugcacauagccaagccaugaguguagggcuacccaaggucuuuggggcaaauaccccacccuggugugucaugaacuuucaggggccaggagacaaaugcugugguuugaaucaacauccucccugacccccuggacacacacacuucuuaccuaagacucaaugugauaauauuaagagguggggccuucagaggugaauaaauaaagagggaagagcuuuauuauuuauuaagaaauuuauuuauuaagaaauacuauuaugauguagaguagugacuuuauaaaaaggcuggaagggacuagcuagggguccuuuuuugcccuucuaucccuucuauaaugugaggacacaguguauguccucuccagaggacacggcuuucaagguaccagcuuggaaucaaagaucaggcccucaccagacaccaagccugcugacaccuuuaucuuggaguugccuaaaaugaccuaaauguaagaucugaaaguauaaaacugcuagaagaaaacauggauauuugauuggacaaugauauuuggauaugacaccaaaagccuaggcaacuaaugcaaaaauagacagggagaguacaucaaucuuaaaaaccuuaugauggcaaaaaaaaaaaaaaaaaaaaaaaaaaacaucagagggaaaaagcaaccuaaagaaugagagaaaaguuuacaaaccacauaucugauaaagguuuaauauccagaauaaauaaagaauuccugcaacucaacaacaaaaaguaaaaaacccaauuaaaaaaugagcaaaggacuuagacauuuucuccaaggaagauauacacauagauaagcaaauugaaagauuuucuguauaacuaaguaucaggacaaugcaaucaaaaccacaauaagguauuacuuuacaucuguuaggauggccacuauaaaaaaaguagaagauaaaaaauuuuggagaggauguggagaaaacagaauccugugcauugccguuauaaucgugaaaaaguaaaacugugauggcaaacaguauggagcuuccucaaaaaauuaaaacuggaacuaccauauaaucuagccaucccauuucuggauauauauucaaaagaauugaaaacaagauuuugaaaagauacgguuacacuuguguucauuucggugugauucacaacaaccaagaaguagaggcaguguaauauccacggacagaugaauggauaaagaaaaugggguauauauauaaaauggaauauuauucagccuuaaagaagaaaauugugccaaaugcuacaacauagauaaaccuugaaaacauugugcuaagugaaauaaaacagccacagaaagacaaauacugcauaauuccacuuauaugggauaucugaaguagucaaacuuacagaaacaaaguagaaugaugguuaccagggauugcaaggaagggaaaacaguguuguuguucaaugaguguagaguuucaaucaaguaaaaccaaaaguucuagagauguguuguacaacaauauguaauauguuaagauuggacuguacauuuaaaaauuguuaauacaguaaauuuauuguguaaauuuaugugguuuuuaccacaauaaaaaagugagaaagaagauucuuguuuauucagacuuguuuuaauacagacauucccaacucuugcugcaauguguucuuuacaaguauuauuucaauauaauauuucuguaaucugauagaaguaguuuuauaauuggugaauguauuucugaucaaaaucuuuacguuguguaaauucugacuacgaccaacacauucucauaaauaugaaaauuuauguuuuuaauuauuuaaauaguaagauuguaugacauuuucuguuuuuaauuauuuaauaagauuguaugacauccacugauaucauuguuuuggggaucuuaauaucccuaaaauaucuggguuaugauacauucaauuucagaaaauauuguugacauuuguaaauauuuuacccuuuuuaaauuuaaauguauuuguggaugucauuuuaucucacaucucuuuuaaaaauguaaggaagcuugaauugaugccuucuuuuuuucucugcagguuuuacuguagcagauagguaucaaaauguaguauuccauugauuuuucuuuuuguuuaaaaaaauaccauuguagcauuuaaguauuugaaggguauccugggggguuucgagccaacauauuauacaucugacuuuccuuuuuuuucauucuugcuuuuacacugucuaucagaggcaacuuugagagggauaagaagccaaaaauauaaaaugaguaguuuagcaucaaaguagggagagaggcagacagucgaacuucuuugccuugguggcaaacaguggguugugaauggggaggguggcagaggacuuauggucucaaugugcauguguauuuguguguaaauuuguguaucagccuccagacauaaaaaauuaauugauaaauccaccuuuccagcuuuuuuuuuuuuugagaauuaagaaauaacaguacuauugaacucuggugcuacaaaaacagagugaaaaguaaaauauugguugaaaauagacaaaacaaucauaagcauuauuucagugaaaggagcuccagcuauauggaauaauugaguaauacagauugagcaucccaaauccgaaauucaaaaugcuccuuaaaaucuaaaucuuuuugagggccaacaugauacucaaaggaaaugcccacuggaacauuucagauuuucagauuuggaaugcucgaccaaucuguaaugcaaauauuccaaaaucugaaacacuucugguccaagucauuucauauaagagauacuacucuaucuguaccuuagaacagugguugacaaauuuuuuuuauaacgggccagauaauaaaauguuaagguuuugugggccauacagacucugcaggccaucacaacucugucauuauagcaugaaagcagcaauagacaauauguaaagaaauuagugugguuguuuuccaauaaaacuuuauucacagaaacaggcaauaggcuggauugggcucaaggccaugguuugcagacacuuagccuuagaauuucaguaauaucaccaaaaucaccgccuuaaaaauguaagucaaauaaauuuaguucccucaucgguaauaugaaaaggcugaauuagauuaucuccaaagucccuucuaaugcaaacauucugaguguuugucaaaguugacuauggcaucucuccucgcaguuugcaucaugucuggcaagaguauagcuguuguuucuugaacaagcaacuuaaaaauacagugaaauguacucuuuuauuuuacagaacuguuaucauaacugcuauugguuauauucucaaaaaucaccugccaaggaaaaaugcaaaagguucgugcuauucuaguguuagcagaacaugaccaucgaugaaccucaucugaaaagacugaugauauuuauuagaccaaauuaggaaacccacacauucagcucugcauuuggucuagcugaagucuguuacuuggguagcaagcuguucaggaaguacuuuuuuaaagaaggaaaaggaaucaggaaagccaguauguuuuuggagucauuuucuguuuuuuaguauuuaaucuuccucaucuugccccacaaaccgacccaauucuagcuuauuacugagucuuuucagaccuaauguuucaguuuguuucuaugguuuguucaugcuacaagccaucaucaccccacucagcaacuagagcccucuccuggcuaaucucccuuucugugcagcccaucucucauaaauauacccuauauguagcagccaguauccucugcuuuaguguuugcaucgguccucuccucuucaggaacuuguuuggguuuauauccuauuguaugaaaucuauucuguguuucauggggugcaguuuacaucagcauucauugucguuuauauuugucauaucgauuuuuccccgucauuucugaugggcuggcuaacagccauaauucucaucacugcugguuaaaaagcaaaacauuuuaaaaauaagaauucugaauaaugacauaaauggacccccaaaauaguucucuaugauuuaguauuugccuugauuacuagccuauuuuuuaacaaauaauugaauguagcuaaaccaaacuucucaggaaacaaauugguauccuaaaaacaaggguaauuaauuauacauuuuauacaucacugggaaacugauauaucuuaauugaauaaacucugaaguuuguugaagauaaauuaagaucccuaugauucaaugacaagaagucauuaguggcauugcccugaugaucucuucucuccaauuacaaauuauaaauuaauauucuuguugcauaauaaucucacugaguuuauguuuagugugaucgguuccucugagccccauuaauacugaaagaacaggugagaucaaauuuucacagcacagaguagcagaaaucuuugagaaacaguuguugaaaauaauagccaccuaucaucucauuaaaaguuggcugcaaacaauaauaaacacuucuacuuguuucagauauuuaauauauauauuuaauccucaaagugaccuucugauacagauauuaucuuauccguuagauaucuucaaauugcuaauacagaagauguauaaaaaacucuauaggcuuuauucaguuaauugaaaaacuuagaggcaagucacacuacaggcaguauguaauuugguggcucaggcgugucaccaauggcuaguaucuucacucuuuucugcuuuccgugaaugcaucuuaggaugcuuucauccuaaggcugccaaucuucacgauauuaugugaugucauguuuaugucugguuguacuucuuuccuggcacuucucucaaaaaauaguuucuuucacucuucaagcaucuuugccucucaguguuaucuaaucuucuuaagauuugugccuauuccugaaccaaucacuugggcaggggaagagauuucauugauugggcuaagccagucuaggaccacccuuauuacugagggucagguuaagucagguuaauacccuccaaaaugguagaggggcagucucaugaaggaaauugggaugaaucagggaaaauagauguuauacagcaaacaccaagucccuacuacaacccuuucucauuuguuuuuuacaaaauaacaacaacaauaauaguaauaguauaaauaguaaauaguauuuguaacaguauauaaauauauaauaaauauauaaauauaaauauauaauuauauaaaguauaauaguauaauaaauaguaauaguauuuauuguguguacugugugcuaggcacaugcuugauacuuuaaauacauuuuagucuucaaagccgucuugagaaauaaaugguauuaaaugucuguuuuccagaaguuuagaaagauuaaacaguuacccaaagccgcaugguuaaucagaccuaggucagucugacuuaaauguccaugucuuuucaccaagucaugcuaucucccuaguaaaccauaagcugacuauuaagaacauuguaaguauugucuuagaaauuuaucauuauuauagaauucuaggaaauaaccuaucccauuuugguuuaaugugcaacauacccauacagaaaaaagucuugauaagcagaauuacaaaaggggugugaguuaucuuuuuuuugccuacuuugagcaccaagauccuuauugcaauggucagguaggauacuguaugcuauauguauccauaugcauauauaccugugugcugcauguaugaauauugcauauaucacaaauucuaagagagguuuuuguauuggcacuuaaugaaaaugacaaaagaacaaguugaaaaggacaggcucugccuucuaaaauaacuuuacagugaacacuaaagacuaugucaucugauaucagccuucaguuugucacuuaguggugauaaucgaguauuguggcuaagggaauaucucuggcccagucugaguuauuuucuggguguccuaacuuuagucccauauucugccuccuggggaguuuauuucuugcuucaggguucuuaauacuuguacuugcggaaggcuugggcuuucaauaaugauucauaauuauuuaauuuuuauugagguccuugcuucccucuaguuuucuacaaaaagcugacuaggcuuguggaaugguggaauuguguuccuuuacuuaguauuuguauaucuguggcuuaaauaacuauaaauuggaaauaaauuuaaaauuuacuuuccuagauuuaaugacucgaagcaagaaauuguucuaaggcagaaauauuguuggauuaacuacagaacaaucagaaaccccuuguguaucuuugacuauguuacaguauuuggaaagaguugucuauagcucugcuuuccuaguacuuuauuuucuggacaucacuuuucauucauuauuuaaugcuauuuaaguguaguguuuuucuuuguuuauuaauauauuauguacuauuaaacaauauuugguaauuuguugaauaauaguuuauuuguuaaauaauuuguugaauaacaaauguguguugggaguacaaaguauuauaucaagaaguaaauuuuuaaaaggcaggaggcagaugauaaagugcuaacuggaaaaaaaguaucaggauucuacagaacaacacugggguuaugucauaugcugcuuuuaaaucaaauugcagaaaagaucauuucauuuaaaaguuagucuguagcucagacagaauacuaugugguuucaaaagcagaaggguacacguuuucuaaagcaguuacauauaucuaacaaaagaauuaauaugugaauauugguucaaguaauagcuugaacuaaauauuaauuucaagucuauuuuaauaggcauuuuaguaccuauuaaaguugauaaauuaguggaauuuuacuuuucacuauugaaaucagguuuuguuccgauuuuuaaguaaagcuugauagaaacuauuucagucaucauccugguaauuuaauauauuugguauucucuuaaaaauaacaggaaaaaauugacaccguuaaguuuauguuuaaagcauauagcuuauuugauuuuguuaauggcucaccuaaauuuguauaauacuuaaucugugaauaagagaaaagguuagaaaagaagaggauauuuaaaggagaguuaggcagauguuuauuuucuagguauucucauuaaggaaaaagccacuaagucuucaccucuauagcuuuucuacuuaagaaagcauagaucccuggugaagaaaguaaaagaaaaaaauagucuagaaauggcaaauaaaaugcuaaucucucuuuuaaaauucuggcuuaauaucugggggccuaauagagaaagugggaaagauuguuuuuagagaacguauauuuuaauauacuuuaacucuuuuuuuaauagugcaauaaacuauaaaguaacuaaaaagaaaaauaagccaaagcuuugaauguuaagagugaaugcaaaguuuaugguugcauuagucaguaugguagucacugaccauaugaggcucuugagcucuuaaaauguggcuagugcuucuaaaaaacugaauuuuaauuucauuucauuuuaauugauuuaaauuaaaauacugauauugauucaguaauuggaaaauuuuaagcauauuuggaacaucuuggguaugugaaucuacuuuucagcuguaaauuuaaugaaaucuaaauauagaucagauauuucagaugaaauuuacaucuaaauugagauguaucauaaauguagaguaaauauauuucaaagagugugauuuuaaaauguaaaauaucucaacuaaaauuuucauauugacauauguugauauguuuuggauauguuagauucaagaaaacuauauuauuaaaauaaauugcacgguuuaaaaaaacuuuuuaaauauuuuuaaaaauuuuuuaaaaauguggcuacuaguaaacuucaaauuacuacuuagcucauguuauguaugucuuggaccauaaagguuuaagaagguuuucuaagacuucacuggaauuuauuugauacauaaaaauacauucugggucagugaguaaaucaggccaaaaucauagcauuuuucuuuuucucucuguccggacacugcuaucaguuauguuggugugaauagucuaauuuuuuaagcaaucacugaaucuaauagcuaauccauauaauuuacuuuuuuguaauuagcuuuuauaauuuacuuuuuacauacucauauuugacucauaauaauauaguuuucaugugguauuagagaaaagcaaauucuauagauuuuagugaagcaaauugguaaaaacagugauaaaggaaaaaguaugauuuuuguauauuauuaugaccuggauaauguacaauaugaaacacuuaaaguacuuaaacgguaucuagaagagauuauggugucuguuuucuaauauguuguguucuuuucauguuuucuguuauccucacgucaaacaaauugggcaaaaagcauggccaaauguguaaugcauuuugcucugucaaauauuccuaauagauccaaauagaugauaaaugugacuuucaucauaacuuugucucauuguucaucuaucaauuccucuaggaggugauuuccucaccuuucugagaaggaagaaggaugaacuaaaacucaaacaguuagugaaauuuucauuagacgcugcugcugguauguuguaucucgagaguaaaaacuguauacacagguaaggagaacauuuuuaaagcaauuuuugguuuuauuaauagaaugcuggaaaacugauguauuugcuacaauagaagucauuuucuuucaugaaacaugucuuuucuuguuuucuguauuuugugugaaaguguccucugcuaguuguuuauauaguuuauacaaacacuccuuuuuccucuuacuugaagugaguaccuaauuagacagucauuugccuacuaguuagaauuuguuuuauuauaaucaugaacaacggugacauggaauguacuacaauuuaguaauauaagaaacuacagccuuauaaucagauaagauuguuucauguguugucuauucucauuuuccaaagaaauuacauaugaagucauggaaaagcauaauaguaaaacagcaauucauaacagugaauuuggucaaggguaaaagauuuucagacucauuuaaugcucuuuuggacaaauuaauuuuucuuucauuuuaguaccucacuaauucauggcaucguauugagaaaauaaauacuaguuauuucaaaggagauuuuaugaaacuuguucugauuguauguagugaccuggucuuaaugcuuuauacauugugguuuuaguugcuuguagcgggaauuguuuuuuagugcuaaaugucaguacaauuuaugaucuguugcagaauucaugucagauccuaaauauggcuaaguauaaauaagcacaaugaaguggagaacugaugcaguuuuuaugcaccagaaacugugcauaauacuguuuaauguggagcaagguucauugcuagagugagcuguuguacacuuuaucuaacugguuuuguuacugaaguauacuuuucucugaggggaaucauuguccaggcuuugcuuuaacacucuagugagguuguauaauauauaauuaaaggaaaacaaaguuaccaucaccuuaacuauacauuuauuugaucucaauagauauuuuugacuuaauuuccccaugcucaccccaaauuuuacucaguguucagcuuuauucugaaacuauaauuaugaccuguauuuuaaauaugguucaacaauugcauauauuuuaaaauucauuucuauggagauauuucuuuuggaaauuaacuaaaaauaagacauuaucauugcauuucuguuuuacuuucuaugacuguagauugaaucacaugauaagaauugacuuaaaaagcauuugauucuggauaaaaauuguacuaccauuaauuucauuaguggucaacacuguguuaaaauuaaccauaaagguuuugcucuucauuuggagaaaaucuguaauuuugguugccgagguauugaggugcuucaaauucucucugguaauuacuccuuuugucucugauuuauuucauaccauuagaccgccugugggcuuuaaacuguaauaaauacacauuauugaaacuuuuuuuaauuugucaguuaccaugacucuucuuuaauuucugggacauugcauuugagaggaccauuguuucaaucucuugcuacuuuuuguagugauuauuuucuuaaaaaaugggucacuguauaaaugccuaugucaugagaauugaaacuauucuacauuguagauggcaguuagcuuuuuugaauucauuucccucucuaaaucauaauauuaucugcuguaauguuguuuuucccacuuugcuuuuuaagaauuuucaugccuucacaaauuuuugaaaguuaacccuuucuugaccacauauccuagcagguugugcauagaccuaugccauuugccuacugggaagguuucccaguugaacaucuugaacaaugucagugagagcggguuugacaaauagguuucaacacuagcgccaacuuuuagugaaugguaguggcucucccuguauauguugagaagaauucuaggaacagccauaaagaguccagugaucaauuagucacaucugccaggguacucacgaguauuaacacacacgccccaaauuugucauccuuggcauagaauaucuucuuuuuguuuuuauucucauaaauacuuuucugacauuuaaaaauguuuguuaugacuuuuccuuacuagcaacaauauaauguuuuucuuuaaucacuuucauuuaauucuucuaaacuaucugguuucuuauuuccuuuguuaaucuugagugcuagaugaauuuuaugauaucucccaacuagugguccuuuguuccucuucagacucauuaaaugcucuuuuggauacauuguuuuuuucauuuuaguacuucaccaauucauacuauuguauugauaaaauaaauuauucuuuguguugaguuuuuuuauaguagugaauugugcuguagaacccuguuccuaugugccagccuacauaguucuuucuuuggaaauaguaguugcaauagaauuuuacuugauguagaguuaagacauagauuauguguuuuugcuccuaagaaauaugaaagaaaaaaaauauaggauuuacuacagugaacaguuuuuuccucacugaaaaaauuuuuaaugaauuaaaauaauguaaaacaugauugaaaguucccuuuaguuuuucagguaaugaggaaagguucuaagucucauuuuuauaugccaaaacauaacaaaaauaaaugcaugucuaugaauuacaaagccaagcuuuguguccagcaaauucuagcaaaaauuuuaaaucuucuuuaaauuuuauaugaauuuacaaauuuuauccuguucacugacgggaggucacuagaacucaguauauaguugaaaauauuuccaauugucucuucccaaaauaguguuuuuaacuuuuaaggacacauauucuuucuuuagcuuuguuuuauuguuuugauaugagaagagcaguguuucauuauaggaaaacaauuaugacaacuauaaaauggaaagagguuacugcauuaagaaaugaccugcauuuggaaguguucuuguuguaauuuccauuuaacuuccagaagaguucucuugcuacaaguuucuaguggaaacuauuucuguuuacagcuugaggauugcuguauaguuggaauuuuggguuaguuuuaaucaacggcauuuuauuuaaaacuauucuguaggccagugugaaauuuucuuuccuacuuguacuuuaugaacuguuugaaauacacugauaaacuuugugguguguguauguuuacuuacaaagguauguuacuagauuguuagaugucaucuguaaagaauacucugauuuugaaguuaaggggagucaggauugacauacuugauauuaaugguaauggcauucauuuaugguuuuauucuugaugaauccuacugccaaauuuguuuuuauucagguuuauuucuaaaaguuggcuuugugccauuguucuuugauaucuucagaaaguaaaaggaggacacacuuuuuauugccauauacuugagugaaagcccacaauuuauggggaguuuggggaacauuucuuaauuucguaugucauugucaauaucagaaaagauauauuuuggagggguuagguagaauaugauuucuuuuucuaauuuucaacucuauacugauucucuucauguuugguugcucuaacacagugauuuuuguuuaucauggaguaagcuaacaacuuuacaaauuaaaguauauuagaccacauuuauuuuauuaaucagucagaguuuugcuuaugcauugaagacauugauauuuccaguguuucacaaaugugggcaguugacuacucuaugccaggggcuaccaaaaugaagauuauagucacugcccucagauggauagaacaaaaguuaacaauaaugcaaagagauagucaauuuugugauaaaaucuacagaauucuuugggaguaauaucaagagagucuaauaugaccugucaguauggggacgaugaugggaauaaucagggaaacuuugcagaggauacccucugagugagacuugguggaugggugugucacugaauagaaggaguaagaagauuccaacugaaggaaaauugaaagcaaaguuacaaugcuuuguaagagagagcuugacuuaauuguggacauuuuguugaacgaauaugaauuuuaacugaaaaaagaaaacuaauuugaacaaaauuuacaaaacccuaaaaaauguauaaucucaugaaaauguauaugagaccaauauuuuuuuuucuuuuuuuugaaacggagucucacucugucgcccaggcuggagugcaguggcgccaucucggcucacugcaagcucugccucccagguucacgccauucuccuaccucagccucaugaguagcugggacuacaggugcccgccaccacgcccggcuaauuuuuuuguguuuuuaguagagacaggguuucaccauguuagccaggauggucucaaucuccugaccucgugauccgccugccuuggccucccaaagugcugggauuacaagcaugagccaccgcgcccggccaagacuaauauuauucuuaagcuucauugggaaaacuaauuuaggaaggcuaagauugccaggaagagaguaauauuauauuucauuuauauauucuagaagagauugccuuguccagugauuucuaauaaggauuaccuauguguacuuuuuuaguuaaauguaagauacugcuuccagcuuauauuuguguguguguguguguguguguguguguguguguguguguguguguguuuugagacuucauauuuuauuaaguaaaagauuugguaugcuucugaccauuuacauuuuucccgaugaucuuugaggauuuauuucucuauuuuuguacugaaaaugauuaccuagugucugagcuuuuccuaaacugugaguauacugaaaaaguauuuuguccuuggugcaccuucaaaucauuuaaaugguaaaauaaagacaaaauaaauaaaaauaaaauaaaauguuuucugugacguuuugaacccuucaucauuucugucacucgugaucuaccauauacucaauugaaggcacuguaagaccacuuuaaguaacugagacccagagagauuaaaggaaggucaccuaaacaauuaguggcugggccacugcuagguccuaaaugugcugacuccauucugacacauuuccuguaauuccagugccaguguuuugcucugucucauucaaguauuaguaacccuaacagcuggcauuuauuaagggcucacugaguacuagacacaguucuucuaagugcuuuagaugcaaugucugagaaugucagcuuccugagaucagugauuuuuauucauaucguucacuaauggauuccaaaagccuggaacagugccuagcaauugaagcuaaaugaaugaaccuucaaaacaauagcgguacuauuguuuaagcccguuuuacacaugaggaaacucacaguuagggaguuugaguaucgugcccaagaucauauuaaaaacaagugguaguuucaggaugugaaucucagcacucugguucuaaggccacacacugaaucuacucuacugccuuguacaacagagguaucuucugauuaccuaggaaagucaaggcagaaggccgaaugguauuugaugugaugacuaagcuuauauuuaacaucugcacucuguaaugaucaugagcaaaaacagaagaggguucugaaggcugugaaacauaauuuuagaaagacaaaccaagauguuuuuaucauuuaaugaacaguugcugaaaugcaggagcauuuuguuguugcuucucuauuuaauaagaguuugaauuuuuuuucauuuuuauauacuguuguuuagaaugcccccuuaugcuuuaucuguuaauuaaacacacaggauuaacauagagaugugauaaucucaguuaguugacuaagcauuuaugacugauuuucuuguucugacauuugauuuacaauuuugaauauauuaagcuguauuuuuauuuuuagcuuugaaaccaauuuugcuauaauacagagaggacugcucaauaauuuuaaauguauuaagaauauauaguccuucuuuaacccuuuuuuccuguuacaaauugguauuuguauaugcagugcaauuaucauacaaagauaauguaagugaacaccuuuauaaaaauuuuuuauccuacugcuuuauucaggguaaaaauuucccaccacuaguuucacucauuuuaauuaaggacuuuucccuaaagacacauguguaauauguuuccaggaaugaaaaaagagaccuuccuuuauguuagccaauuaacaucuuggcuuggguuaauguaccagcauaucuagcugcuacuuuagaaaacaaaaaugagagauuuggaguaaagggucagaggacaguaguuaacuauuuaugguuacugguaggaaagaugcaguauaugcagagacuguugaggacuuaagggcaguccauugagcacacugaaaguccuugagagugagaggagaaggaaugaagggaauaguaguacauuaaggcuauuucaugguuuaguuagggcuagccauguccuguguuacacagauaagauagaagagaaaauuggcugaugucucauauucuuccucauuucugacuuuuuuccagucaauuacaauaaguacauuuuggauucagaaugucaaaaaagugaucuuuuacauuaaacaauuacaaaugguuacaguuaccauuuuucuuuuagggaauauuugauuacaaggaacagaaacuaagccauaggaguuuuucuuuuaacuuuuauuuuaggcucaggggguacaugugaagguuuguuauacagguaaacucaucucacaggggguuguuguacagauuguuucauuauccacguauuaagccuaguacccaguaguuucuuuuucugcuccucucccucccuccacccucuacccucaaguagaccccagugucuguuguuccauucuuaauauuuauaaguucucaucauuuagcucacacuuauaagugagaauaugcaauauuugguuguuccuguguuaguuuccuuuaucauaaggaaaguuaugggguuaucucacagaacucaaggacugaaaguucagccaggcuuuggaguucuugaaacuaguaaccgggaagcagucagggaccaaggcaggaucucuuuuugucuuucccuguguguucauuuggaguuucauuaaugcuuuuuaacguguugcugcucauuuucccuuucaccuugaagacuacauuccuccacuccucuugcaaagggcccucaaaugacauuuaggcuaauauaaccugccaggcccagcaucugcagguaauuaauuagucuuugagcucaaauuucaaauuauggacacaaauaauuggcccagcuuauauuaaaugucuaucccaauuuuaauaacauggcuagacagaaaagagugugcagggucacuguuaccuagagcuagaggagccaaucucuugugugcaaggggauaguucucagaugauggggcauguacuaaaaggcuucaaaagauggcuaucguacacucauggagagcucacuguuugccaaguacauucauaugcucauuuaaccuuauauuucuaugagauugguacuauuuaaucuacauuucauaauggaauagauugagccacaaaagaguaaguaacuuuucuaaugucacacagcuaguaagaggaagauucaggccuauucugagcugaugauaaaaccugugaaguaaagcaaaagaauuaaacuauguauuagauauauuuaucauuuucuucccuuuugugaagaugaucagccauauggauaucccucuuaugaagcaaacuuaaaacuaauaaaugcugauuuagagaaagccuuguuguagggagaagagaaucuuuuauagauccuaucucuguauuuuccugggaugauucauucccucacauuucaugucacagggacugccaguugguccauucagucuccuuaaauccuaugucauaccaaguccauccaacaggcaggagaucaaucucaguacaguggaauuggguucaugauuaucuccaaaacuuggcugaccauugguucaagcauugauuugagaauucauguucucaagucaaaccugauuuaugauaaaguaacucacuuuuucuaguuagucuugaucaaauucuggggaauucaucagaacauagaugacgcagaaacaaguuugaccuucuggcuugcaaauuaucuccuacuuucuggccuccaaggcaggauuggagcaaucaacauacagaacuagagaacucuagcuggacauugacucucaauuuuaaaaauuacuggguucuuugcccaauuauuguuuuaaaauauuguucaucauuuuauuaaauacaaaagcacuacaagaaauccuuuucagucccaggcuucucuuuuaaaguguucugugccagucuggacuguuuccauccacauugccaacucugauaucuauuaaguguaagcauuugcagagcaguuagcagcuucagcaucguggcuaagaccaccgauuugaaacuggaaugcucugugcaugaauccuagguuuucaacaaauuagcugugugauuuuagaccuccccuccuccccaccugggaauucccuguaacccauaaccuguuuuauuuuuugugauaguccuuacuaucaccuguuuauuuuauuuauauaaacauacacauguaugugcauauauucacauguauauaugcuuaugcauguauuuauauagacacauauguaaaauaacugguuuccuuuuuauugcuuaucucccccaacucccccucaaguuccaugaggacauugacuuuauuuuguccauuacuuaguacucaauacagagcuucuagucauugcucaucaaaaauuuguugaaugagugaaugaaguuacuuacuaugcuucauuucuuccaguauaaaaucaggaugauaauauucacuccaguacacugauucagguuagagaaggcaaggcuacuuaaguagcaaaggaguaucugaaggcuuuccacuccccacagcaucucagggggaccacaacuuaagaagaaaccacacacgcccauaccauuuuaagauuagauuaaguugucuguuuagcugaagauacagaaauguuccagaaaaagauagccacauaaagcaagagcaaaugcacgauauuucaauucaccuuaccaugguccccagaguuucuaauagugacacuaucuaaaaaggguagggccuuguugaaucugagaugcucauuuucuugcuaauuauacucccauucaggguguacuuauacaucuauguagguuuguugaauguaaaguuuuaaacauagggcuauacugguuuuugugccaaauccgguguuaacaagguugaauccuuacucugggaaaaaugcaaaguuaaaggcgggcugucucuaggcacuguaucucugacuccacucauaucuccauagucugcuacuucacuuucauuaccccuuuagcuaaguguuaccaauacugaguauguuuuggccaagcauucuucaagauucucuggcuacagugaugaaugaaacaaagcucuacccuuagggaacuuuaguaauuggggaaaguggauaauaaacauauuuuuaaaaaauaauaaucaaauauaaaauaguccauguguuaaaaagugauauagaggauaauaggacaaaagagaaagggaugguggagaugggcaccauuuuauauaggguguuaagagaagacccaaaggagauaaaagagugagccaugugaauaucagugagaagagccuuccuggcaaugagcauuggaacugcaagauagaacagagacaggggcaugcuaggugugucaaaguaagccagcaaggucagaaaauuaggugaguuguuacauggccagaucauaaaguucuuguaagccauugaaaggacuguggcuuuuaguccacaugagguggggguaauugauggcaauuugaucuguuccagguuuaugaagaaucaguggaauucuuuuuuauauauuuuuuaauuuuauuauuauuauacuuuaaguuuuaggguacaugugcacaaugugcagguuuguuacauauguauacaugugccauguuugugugcugcacccauuaacucgucauuuaacauuagguauaucuccuaaugcuauuuuguaauucuaacaauuuuaacguauuacuccaucaaacuguaaugagccaaaugaaagaaaaacauaacucauagcuucuuuucuacugggacgcuacuauaugcugacugcugugcuacuggugauacaaucaugagcaagauggacagaguaccauuccuccuggcauuguuuuaucacacuauguaauucuuguaauggaagaaaaaugaagaccuugaaauuaauggcacucagagucuuagcuacaguuuuuuauauuuaaauuggacauauguuucccaaauaaguucuagaucuuuagaaguauacuuuguuaauaguauccuaguucauagacccauugauuuugagagauaaguaaaauuaaauauguguauaauuuauagaggguuauauuuuccaucuggggucucugguuuuaugacuuguaaaugaacacagguaauuauuauuuaccuaagugaauaaccguguuguugcuaguuaacaaaaacaacagaucauggcuaauuuuuggagaaucaauguuaucuauagaacuaaggugacaugaaagagaagaugucauuuauuugcuauuauguuugguauaaaaaaaggccauucccuucuaaagaaagauuauguacucuaaagcaaaaugaacucuauuguauagauuggugcaaaaguaauugcaguuuuugccauuggaaauaauggcaaaaaucacaauugcuuuugcaucaaccuuauaauaaaaaauucugcuucauuaguucauucucacacugcuauaaagaacuuccugagacugauaauuuaugaagaagagagguuuaacugacucacaguuccacaggcuuaacaggaagcaugacugggaggucucaggaaacuuacaaucauggcagaaggcgaagagggaguaagcacuuucuucacauagcagcaggagagagagagacuuuuaaaccaucaaaucucauaagaacucacuaucaugagaacagcauggggaaaaccacccccaugauccaaucaccucccaucagguccucccccaacauugggaauuauguaauucaacaugagauuaggguggggaaacauagcgacaccauaagaaauucuugcauaaaauaacuuagaaugguuacuguuuguggucuggugugccuauuuuuacuucuuauggacacauauuuuuauuauagaacaaaaacaccugcuuauuaugcucuuaaauuaaccuuuuaaugcugaacuucuuuuauuacacaguuuuauuugcuuuuuguggggaaagaaguaaugcaaauuuaaaagaggguuauaauguuaaccuaccucacagucacuguuuguuuguuuuuuuuuagguuaaauuaaaauaagacauagauaaguuuugagaaaacuaaauggcaguucaaauuauaguaguauuaaauuauuauccaguuguagaugaagagggaguuagauaccaagguauauuagaaaaugaaaagaaaacaaagauagcugaaggaauaaauagguugaagaaggugcaaguuaaaaaagguuugaaugggauaaauguagauggugaucauuauucuaauuaagaaugcagccucucuauguauccacuauaaagggacccugugucaacuauaauguagcugaaguaaaacuuacuauuggcauccagugcuggucaucucagugggccuucccuggugugggccacugcuucaaagcaggcucugagagagaucacuaugcccggagguuuuggcugcaccucucucacucucucuuucuuuuucauauuuccaucuuuaacauuuuauuuacuuggaagaaaaauacugcaacauuaagaaaguuuuagcugguguguuucgaccuuaguuuucuugucuuuaugaggagagaggggaauuagcuuuuuucccauuaucuuuauuaaaucacuguuuuagaguuuauuugaacccauauuuugaaacauuugaaaacugcuuaaaaaugaaugucuaaugcagaagggucacugcaguuuccagcagugcaucuuauaacuuccuauucuugaugcuguuagucugcauccuacugaagaagaguagacagcuuucugaucugauauaucaaauauacagccucuucucaguaguaugaaaccuuugacauuuucauagauauccaugcccucucgagucaucugucuuuccuaauccaucuaccugucaagcugucuuuuccaaugcaagaaaaaguggucaugaucuaaaauccucuagguuuugagaaaagauaagaauaggcuuccaucacugcugaaacuagaaccaaccugaugaugucagaauaauacagaguucaucuuccacaauugcucaguuaauaguaacagguuaauaauaugaggagggcuuguuaagucuuugcugaagugaaaacuggguuuuuccugccugaucuugaucuguccuaggaacuucugcuuacauaucuaugacuugaggacaucaggagucccacauuaagcagcgggaaaagauacagaaaagguguagacuauauauaccuacucaaauauauuucuuuuucuaauuuuuuaaacaguaagaagcaaaggaaacaggauauuucaggaauuauuuuauauuacuggaugaaaaugucugagaaccacuacuuuuaagcaguaucuguggaaggaaagacauucucuuuucacuucuuggggcaacagaaauuuacuuacauuuuucauaggaaacucuucaagcuacugaguucuucugaaguuguuuaaauauuguugcuuuauguguccaugcauacacagcgcaagccgggaaccucuugaaggguggaacuauauucauguugagguauuaucccccuugccuagcacuaugccuggcgcauaguauggcugaguaauucauggacaaaagaauuaaagguagguuaaguguuaagaaaucuuaacuuuuugcagcacaaaguauguuuuaccuuuauaaaugcuuacucauggauaaugauauuuaguggaaaaaguaaauuucccuaauuugcuccaaagagcauauacugaaaacauuaucuaauguuaaaucauuuaauauguaagggaaaagccaugggaaauaggcaacagaugaaacaagauuaaaaaaauagaaaacuauauauaaucaaggccuuaagaauggcuuuucuaagcuauugcccuuacgcuuucuaaguaaaugugauaaugaugauuggugcuaaagugacauucuuagaauugaaagucuguguguccacucagugaacuguauauuggaagugauggguacuuacuuccccacucacuguacuaaucccucacucuaauguaaaaggacuugauuaauuucauuuauaagccaugucuuuuguaacuacucuauaggcaaauggugauuguagcauacccaggacuaaauuuaauaugaguaauuuauuucccaguagcuaucaauuauuaauuuuucauuuaucacuuuugaauugugaaacccugcagauguuugaguagaaagaaguaaacuuuauucaaauaauaauauuuaauaaagauauuaaagucaauggugcuguucuuuucauuuuuauaugcuaauaucaagaccucauugcuuaugaagcuaucuauaaucaugcaggguuuuaacuuggaacuuuugaggauaauaaauggaugagaaaaaaaaugauugaacccuugcucuguaaccuuuucuucagggccaaauacuguacugaauauuuuaggcuuucuaggucauaugguuuccaucacaacuacucaacucucccauucugaaagaaguuacagaaaauauguaaaaggaacaugucuucguuucaauaaaauuuuauuuaccaaaaaaauaaagcagacuggauuuggaucaugggccauguuuuuacagacccauacuccaaaaugagaacaaaagcaucccucuucucagcauaucuaucuuuaauuuuccuuugagacugugauucaaaucauuuccacucccccucucaucagcuuccccucauucucucugucccuauuguuuguauuauauccuguuaucuucuaaaaugaaggucuuguuuuaccaacuacuuuuguuagccauucgaguauauagauugccuucuuccuucuuucccuccucucuucccuccauucuaccaucccucccuccuccacauugguucuuaauggagaagccaguagauauuuuguugcuaauaaugaauuuauuuuaauucuugacuguuaucuuaggagauauuauaaaaguaauuauuuuauuuaaauuucucaagcccuaacauaguagucguuaaaugcuuguugcuaaugaagaguuuaacauuuuuaucaugaaaauuuguaaacauguaagaccagagagaccuguuaggcaaaagaugagaaaggccuaaacuauaguagugauaggaaaaagauauaaaauuaaagacuauuuaggaaguagaaucaacaugauuuauugauagguuggcgauggugggugaaggugacuccuagguuucucagauccaaauugaaaccagguauuuuccaaguaauacugccauaccuauucaccagccuaggcaguucuaaguggaaaaggauuugcauggagauagcaaaguaagugguaucuuaucuuaacuaauuaucucuacaccuaggagaauuuuuauguucguuuauaauaauuguuaucuuauccucaaguuauucaaccuaaaauuauguaaauaguucaaguuauuuuuagacaucucuguaaguaaguuuccugcuaguaaguuuccagacagauuuugugcaguuuuuguuuguuuguuuguuuguuuguuuguuuggcacgacuccucuguucuuucagaaaaaucagaauuuucagcuuccaauuguuuugugguuuuugguauuuuuauuuauaaacuugguaguuagaugcuuucuguuuauaauucaaaauuauaaaaaaucacuuacacaaauacuacuguaaacucuuuccuuuucuucuuaccccucuccuccuuuucucaagccuuggucuacucugugguaggcguaguguuaguucuaacagagaauucuauaauaaauaaaaauuuauuuuccaucaggagguuuuucauauaaaagaagaugugagacauacacauucaaccagaauauauaauaacaugaaaugaugagauaccaaagaaauuaaaguggcuugaauuggggaaauauuucuuucaacagauuggauacaugaacucaaagggagugugcugggggccuuuucugaguuacggucucuaugcucccuuggccaccuugcucuaaugguagcagugucccgaagaggucgccaugcuuccaaaaaucuguaaccuauacugggagauggaaaccugugaaaugauguuugccaguuuucuuuaccgauagauguugaaaagcaauguaguaguacugacucuagacuucaguuauaaaagaauuauuuuaucuauagucuuuguuuaaaacuuguuucuguugcuucauagauuuucucuuuucccuuuuuauggagaaugcucugucagauuauuccccccgccaaaaaaaaaaaaaaaugaaaaaaaauaacagugucaauguauugcuucauuucuguuugaaaguauauuuugacaauguguaugucaucuaaaauguuaaggaaucaaugauucuuucaguucuaaagcccaccuggugaauuaaaccaaaucugcaucaaguuauucauuuaaaauguugcuauuuugccuuauucucuuuacauguugcuugugcugaugucauugauuauaggcugccaccauauuucgagauaauuguuacugaugcagccugucuuccuacacauaaaacauuugcauugcauuuugccuucaggaugucacucuuuguaaguaaagacaaacauaguuugaagacaaauggcauuuuuaaacauaaugucauuuuccacuuuuuguaugaaugaaaauuaucagcaguucagaguaaggacuaaagugaaaugaauaauaaauacguauuuuugugauuaugcuuuuuaaaaaggccaaagaacagaauaugaauagaauuuuuaaguuuaugauuuugcuauuuucugucauaugugucagaauuuuggaagggaaccuuucgugagacaauuuguccaggcuuuuagcuuuccauuucaucuuucauaugagauuuuaccuuuauuuuaagggacuuuguuggcacuacuuauucuuucucagauauaauauguuaacuccauuauacuuaaaauguuacaauucagaaagguucuuuuucuuucaggaauacauucuagaauggcaaaccagaaagauuuaauuaucuuuaccauuaaauguuuagucuacuuaagucuauuucucuguacauuggaugaaaucauuguauaagauucugugggucagaagaaauagugacuacagaacaauaauucauguguugguaauucucuacacccuauaauuccacuauuucaugugaaacagggaaauaucaaggucuuauaaaccauaaggacauugucguguacuucuaucauuuugugauaaacucauaucauucuuauguaaaauaaggcuucuggaaauaagauuuguaugccuaaauuuuuauaauaauuugcuguauauuauuuugaucucuucccuggauagugaaagucauugguagcuugauggggauggcauugaaucuauaaauuaccuuggacaguauggccauuuucacgauauugauucuuccuacccaugagcauggaauguucuuccauuuguuuguauccucuuuuauuuccuugagcagugguuuguaguucuccuugaagagguccuucacaucccuuguaaguuggauuccuagguauuuuauucucuuugaagcaauugugaaugggaguucacucaugauuuggcucucuguuugucuguuauugguguauaagaaugcuugugauuuuugcacauugauuuuguauccugagacuuugcugaaguugccuaucagcuuaagaagauuuuggggugagacgaugggguuuucuagauauacaaucaugucaucugcaaauagggacaauuugacuuccucuuuuccuaauugaaugcccuuuauuuccuucuccugccugauugcccuggccagaacuuccaacacuauguugaauaggaguggugagagagggcauccgugucuugugccaauuuucaaagggaaugcuuccaguuuuugcccauucaguaugauauuggcuguggguuugucauagauagcucuuauuuugagauacgucccaucaauaccuaauucauugagaguuuuuagcaugaagcguuguugaauuuugucaaaggccuuuucuucaucuauugagauaaucauaugguuuuugucguugguucuguuuauaugcuggauuauauuuauugauuuucguauguugaaccagccuugcaucccagggaugaagcccacuugaucaugguggauaagcuuuuugaugugcugcuggauucggcuugccagcauuuuauugaggauuuuugcaucaauguucaucauggauauuggucuaaaauucucuuuuuuuguugugucucugccaggcuuugguaucaggaugaugcuggccucauaaaaugaguuagggaggauucccucuuuuucuauugauuggaauaguuucagaaggaaugguaccaguuccuccuuguaucucugguagaacucagcugugaauccaucugguccuggacuuuuuuugguugguaggcuauuaauuauugccucaauuucagagccuguuauuggucuauucagggauucaguuucuuccuuguuuagucuuggaaggguguauguguccaggaauuguccauuucuucuagauuuucuaguuuauuugcauagagguguuuauaguauucucugaugguaguuuguauuucugugggaucaguggugauauccccuuuaucauuuuuuauugcaucuauuugauucuucugucuuuucuuuauuagucuugcuagcggucuaucaauuuuguugaucuuuugaaaaaaaaaaaccagcugcuggauucauugauuuuuuugaaggguuuuuugugucucuaucuccuucaguucugcucugaucuuaguuauuucuugccuucugcuagcuuuugaauguguuugcucuuguuucucuaguucuuuuaauugugauguuagggugucaauuuuagaucuuuccugcuuucucuugugggcauuuagugcuauaaauuucccucuacacacugcuuugaaugugucucagagauucugguauguuguguguuuguucucauugguuucaaagaacaucuuuauuucugccuucauuuuguuauguacccaguagucauucaggagcagguuguucaguuuccauguaguugagugguuuugagugaguuucuuaauccugaguucuaguuuguuugcacuguggucugagagacaguuuguuguaauuucuguucuuuuacauuugcugaggagagcuuuacuuccaacuauguggucaauuuuggaauaagugcaguguggugcuaaaaagaauguauauucuguugauuugggguggagaguucuguagaugucuguuaggucuucuuggugcagagcugaguucaauuccuggauauccuuguuaacuuucugucucguugaucugucugauguugacagugggguguuaaagucuccuauuauuauugugugggagucuaagucucuuuguaggucucuaaggacuugcuuuaugaaucugggugcuccuguauugggugcauaguguuuguauuaauuuacauuccuacagauaguguaccaagaguuccuuuuucuccacaucuucaccagcauuugugauugccugucuuuuagauagaaaucauuucaacugggguaaaaugacaucucauuuuagcuuugauuugcauuucucugauggucagugauguugagcaccuuuucauaugccuauuugccauuuuuaugucuucuuuugagaaaugccuauuuagaucuuuugccuauuuuuaaaguggaucauuagauuuuucuuuccuauagaguugucugagcuccuucuguauucuaguuauuaaccccuucucagaaggauaguuagcaaguauuuucuucuguauuaucucuucacuuuauuuucuuugcugugcagaagcuuuuuaacuucauuugaucacauuuguccauguuugcuuugguugccuaugcuugugagguauuacugaagaaucagcccaauguccuggagaguuuccccaauguuuucuuuuagcgguuucacagacuaaagucuuagaauuaagucuuuaaucggcuuugauuuuauuuuuguauauggcaagagauauggguuuaguuucauucuucugcacauggaucuccaguuuucucagcaccauuuauugaagagacuguccuuucccuaauguaugcucucucugucaaaaguguguucacuguagauguauggauuuguuucuauguucucuauuuuguuaacaauggucuuugugucuauuuuuauugccaguaccauucuguuuuggguacuauagcucuguaguauauuuuauagucagguaauguguuuccuccaauucuguucuuuuugcuuaggaaagcauugacuauucugggucuuuugugguuccaucuaaauuuuagcuuuguuuuuuucuguuucugugaagaaugccguugguauuuagauaggaauugcaauuaguuuguugauugcuuuggguuguauggacuuuuuaacaauauugauuccuucaauucaugaacauggaauauuuuuucauuuuucguguucaauuuauuucaccaauguuuuauaguuuucauuauagacaucuuuugcuuauuugauuaguugauucuuagcuauuuaauuuuaucuguagcuguuguaaaugaaacuacuuucuugauuucuuuuucaacuuguuugcuguuggcauauggaaaugcuacuaauuuguguauguugauuuuguaucccauaacuuuacugaauguauuuuguuaguucucauaguuuuugguggagucuuuagguauuuucaaauauaagaguauaucaucuucacacaaggauaauuugacuuuuucuuuuccaguuuggaugcucuuuauuucuuucucuugucugauugcucuagcuaggaauuccauacuauguugaguaacacuaaugaaagugggcauccuugucauguucuagaucuuagaggaaaggcuuucaguuuuuccccauucaguauuauacuagcagugggucugucauguauggcuuuuaauauguugagguauguuucuucuguaccaaguuuucagaggguuuuuaucaugaaaacauguugaauuuugucaaaugcaauuucaacaucaauugaaaugauaauaugguuuuuguccuccauucuguugaugugauaugucacauugaucgaguugcauguauguuggaccaucuuuucaccuugggauaaaucccacuuggucgugaugaaugaucuuuuuaaugugucauugaauucaguuuauucuuacuuugaggauuuuugcaucaauguucaucagggauauugaccuguaguuuucuuuuuuugaugugucuuuauccgguuuuaguaucagguuaauaguggccucauggaaugaguugggaaguauuccuucuuccuguauuuuuggggggcaggaauaguuucaguaggauuaauauuuuucuuuaaauguuugguaaaauucagcagugaagccaucagguccuaggauuuucuuugcugggcgauuuuuuauaauggcuuuaaucucauuacuuguuauuggucuguucagaauuuggauuucuucaugguucaaucuugauagguuuuaugugucuaggaauuuauccaucucuucuaaguuuuuaaauguauuggcuuauaguuccucauaguagccgcuaaugauccuuuguauuuuggcaguaucaguuauaauguuuccuuuuucauuuucaauuuuauuugugucuucucuuuuuuucuuagucuggcuaaagguuuauccauuuuaucuuuuaaaaaaaacaacuuuuguuuuguuagccuuuuguauuuucuuuauuucaauuucauuuaucuucccuugaccauuaauauuucuucuuauuuugguuuaguuuguucuuacuuuucuaguucuuucagauacaucauuaaguuguuuauuugaaauuuuuccacuuuguugauauaggcccuuacagcucuaaacuucccucuuaguacugcuuuugcuguaucuuacagguuuuaguauguuguguuuccauaucaauuguagcaggacauuuuuuaauuuccuucuuaauuucuucauugauucacuggucauuugggagcauauuguuuaauuuccguguguuuguauaguuuccaaaauucuucuuguuuuugauuucuaguuuuauucaauuguugucagagaagauguacuuuauuucaauuuuuaauccuguuuuuagacuuauuuugcuuccuaauuuauggucuguccuugagaaugauccaugugcugagaaaaaaaaaaaaggcauguucugcagccuuuggugaaacguucuguaaauaucuauuagguccaauugguauauagugccgauuaaguucaaugugucuuuguucauuuucuguauggaugguauguccaaugcggaaagugggguguugacagcucuggcuguuguuguauuggggucucuuucuuuagcccuaauaauauuugcuuuauauaucugggugcucaaguguugggugcauacauauuuauaauuguuauauaucuugcugaauugaccccuuuuucauuauauaaugaccuucuuugucucuuuuuuaguuuuugucuugaaagcuauuuguugugauguaaguauagcuaccuuugcucguuuuugguuucuguuugcacggaauaucuuuuuucauccuuuuauuuucaggauaugugugucuuuauggaugaaguguuuuucuuguaggcaauagaucauugggucuuuuuuuuauuaauccauucagccacucuauacguuuugauuggagaguuuaguccauuuauauucaauguuauuguuaaguaaggacuuacuccugccauuuuguuauuuucugguuguuuugugguccccucuuauuuccuuccuuccugucuuguuuuuuuuuuuuuuuugagacggagucucacucugucgcccaggcuguagugcaguggugcaaucucggcucacugcaagcuccgccucccggguucacgccauucuccugccucagccuccugaguagcugggucuacaggcacccgccaccgugcccagcuaauuuuuuuguauuuuuauuagagacaggguuucaccguguuagccgggauggucucgaucuccuggccucaugauccgcccaccucagccuccaaagugcugggauuacaggugugagccacaucacccagccuuguuuuuuuguugguuuuuuuuuagugaaggugacuuuuuucuggugcuauauuuuaauuucuugcuuuuuauuuuuuuguauaucucuuguauguuuuuaaauuugagguuaugaggcuuccaaauaacaucuuauaacaaauuauuuuauuuaaacugaugucaauuuaucacugguuauauaaacaaacuaacaagcaaagagaaaacuaauaaagauucuauacuuuaauuccauucuccugcuuucuaacuuauuauuucuaucuucuuauauuaucgaucagacugaaauuuaauucuauaaucagugacugcugggcaaaagaaggugaauuuacauuuugaucauugcuccuuuugucuggagaacauuuuaaccuguuauugaacaucuuaguaucuaguuacacugugggcuuauguuguucuauguuuacauuuguauguuuacauuauguuuacauagauaaugcaagaaauauuaaaagagcauggcgcaguggcucaugccuguaaucccagcacuuugggagaccgagguagaucacugaguccaggaguuugagucuaaccugagcaacauggcaaaaccugaucucuacaaaaaauacaaaaaaaaaauagcagggcaugauggugugugucuguaaucccagcuacaaaaggcugaggugggaaaauugacagaaccugggaagucgaggcugcagugugccaugauugugccacugcaccccagccugggcaacagagcaagacccugucucaaaaaagacauauuaaaagggacaaaaaacuaggugcuuggcaguuuucuuuaccuuuguuauaauaagcaauuggaaggaaggcuuucauuaacuaaaugcugugggaaauuauuagcaauauuuccauuaaguggcuugugcuuagacuguugguucuuaaggcuuaugaacucuucguguacuugugagauggaagaaguuauucauuaaaccccuucguaaauugcccagaauggcuuuguggagccuccucucuuccucuguauucagaaaaguaucaguuguucuuugaagcauaauaucugccagcuuuauaauuguuugucauuucuuagaagacagacauuuuuuaauaguuuuguuguuguuguuguuguuguuguuguuguuguuuugcuccccuuccugauugacagcagccuuaaaucaagaucucaaaacugugacucugggccaguuauuuaggaagaaaaacauuuaaaaggaagaaaauacaagauuagaaacauaaacauuccuuuuaagauagaaguugggccgggcgcgguggcucacgccuguaaucccagcacuuugggaggccgagacagguggaucacgaggucaggagauccagaccauucuggcuaacacggugaaaccccgucuccacuaaaaauacaaaaaauuagccaggcguaguggcgggcaccuguagucccagcuacucgggaggcugaggcaggagaauggcgugaacccaggaggcagagcuugcagugagccgagauugcaccacugcacuccagccugggcgacagagugagacucugucucaaaaaaaaaaaaaaaaaaagaagaaagauagaaguugacugcuaaucaguaggaaaagucuuaaaacaaaugacuuuauucuuucacuaaacuugcuguucucaagauucuaauaccccaugaauuaaauauuuagaauuauuaucuguuuuuuuuccuuuuauauacauacauuagaacucuuuacauacuaugguaaguuccaacauuuuugugaaguauuacauacuauggugaguuccaacaguuuugugaaguauuauuuggauaauuccauaaccauaaaaucauaaucauugugaaaauuaauugugauuuaaauauuuuaucuauuuauguaagugguuuuacauaaauaaguuuacuaaauuuuucuuaaaagugucuuauauucaaaccuguaaacaucugugacuaaguucacugucucuuccuacugcagucauauuuuuaaaauaauacaauuucagaccaucuuucccucgccaaacucacauauaacacagucuaugaaauuaggauaauaauagcacuuauagaagauuggugaagauucaguguaaaguguuuggcacagugcuuagaacauuuuaaucauucuguaaaugugagcuggucuuaguaguagcaguauuguuucugaaauguuaagguaacagaacuggauuuuuucucucucucuucauauaguccuucuaaaaaccugauauucccaaguguuuuauuuuguaaaucaucucauguaagacuuuugagaaauaguuuuagaauaagaacauucccagguuguuccuaauauccuuuuuccuaaacuggaaauucuuuuuaggcaucaccugacuguuucgggacucuuuguucuucuccuuugucagaaagaaugaaacggugaaggcuaaaacugcuacauccacagauggcugauucauuucuuagugcucagaacuucauaucuauagcuguuuuuuuuuuccuuuucugauacagccaguaauuggcugaguuccagaaaccauacuuucugucagacucccugaucuuuuuuggauuaucuguggauaaucagaauuaugugcuuggaaauaauuguaguucuuagcuguaaaacacgaaaaaagacgcuaaacauucacaguguagggugagauagcugcuuaggcacuuccuuucccccuuccuugcaccuguucaucuagucccuuggccccauuuuaagugcacacggaguuaagaacccugcgguuugcaugcuugcuauaucuuuaagcacucuagccuucauuccucuuagaagggcuagagcaacaggagcaauacucuuuugcuuuuauccucuguuuacauauucaccuuauccauuauacauggagccacuacacagaaaguucuuggaagaaaaagaauuuaggaucuugauuucagggcuaggcccgucuaaauccaagcaugguuacaagaaaauuuuguaaauuaaaaaaauaauuuuuaauuuucaagaaagggauugauuaaugaauaauaauuuauugcugauucugucucucaugggugugaacuuacagugaauagagacaagccuucucaggucugaucucuuuuuucauucaguuagcagauaccggauuguuuauuuugugccaaguaucacacuagguacugguugaauugcuccuugucauuauguaacucaucuuaggcaagagaggcagauaaaaagcagguauagaaacaaauaauaagguauacacuagcuuugauaaaugcugugauagaaccaaacaagguaaaguguaaagaauaaacuauauggaaguauaggaagucaggaaagacuucugaggagucuacauuuugaugagcacugagggaguuagcgaugugaagauuagggagaacaaauuuccaggcuguguuacaaagguuauucaggauuuaccaaccagcagaaaaggcuauaauaagcucuaucuuagccuuucaugaaaucacguauuuccaauacaaagaaaucuaacugcuacauucuuguguugggaacguuccaagauuauuucucacauguuauaaauauguauuggcauuuauuguaugcacuuccaucuaaccauggauuaucuuucaauauagaguuacucugggggcuuugucauauaucuguauugaauaccaauacaaaaauccauuauuuuaaaacuguccaccuuuggggauuauuuacacuauuucauuagaacauauaguaaagaguucagagugugucucuguguguauuguaugucuuuauuaccucaaauaacuauauuaauguucauauaauaugugccucaacuguguuuccauuuuuauuuuuuauuuuuacuuuuauuuguauuuuuuugagacagagucucgcucuguugccaggcuggagugcagugacgugaucucggcucacugcaaucuccaccucccagguucaagggguucuccugccucagccugcugaguagcugggauuacaggcacgcgccaccacaucagcuaauuuuuuuuuguauuuuuauuagagacgggguuucaccauguuggccaggaugaucucgaucuccugagcucaugauccaccggccauggccucccaaagugcugggauuacagcgugagccaccgugcuuggccuccauuuuuauuuuuaaagauuagaaaaauauuacuaauuaacuauauuaggagucauuaaaaaugaaaauauuuuuauguucaaacuuaauuuuuacauuuuacuagggacccagaaucagccauauguucagaaguaggcuccugaaaaucaauguauguguucuguaauuaaaaguuauuuuucauaauauugaaauucuaauuuauguucuugcuaguuuugguaguauaaacacuguuuauagaccaacuauuuuaucuuguuuuuacaguacugcuuuauccauauuugauuuuaacuuuuaccaguucuguugaaaaccguuaaucagaaauuuuauaagucuuugauuuagcguuuaaauugagauguggaauguaaaaguggugcugagcagcuacaguguugaagguuaaauuuauccuagccaugaaaaagaaauauauuuuccuacccucuccuuccuuacccagugauugaucacacaagucaguagcaucauaccuuugugagauauacaaguuuuuuuuuuuuaaugagagacauacugagaacuauuucuuaaucaugaaauaguauucuuucaguucccagauucucacauuuguaaguguaauaaugaguuuuggcauacuauaaauauuuaugacaacuuucaauuguaaguuuugggaaccuaaaauaagucuucuaaguaagucauucacaauaaacacuuuuacuaucaauaugugauuuuagacaguugccuuuagucucaguaaugugaugauauuucuaauucauacuugggaguuaccuaauaaaaaucagugaaaaggaggacagcuugucaucauucugguguuuacucucuuguagcaugcacuucucaucauguguuuaagccccaguguagcaaugcagaauggggauuguauuaagauguucacacuacuauucagcaauacccauagguuaaccaagcauaaauuucuauaguauguaggugucaauguaccuaaaauaauaaauacacauauuauguaaauuuaaaugaguuauuauuuuaauauauggagcauacauuuaauauauuuucaaaacuuaaaguuuuuguuggaaaacuucacaaaaugauucuaaagugugucuggaaaaauaugucacaaaaauugagaaaacauuguaaaauaaagaaggaugaaaaagaacuuucccauguauauguuaaaacauuuuauaaagcuauaguaauuaaagcaacaguggguagacauggauauauguaaaaaugagaacuauuuuuaguguauguggaaauaguauauuguuaagaaauagacuaauauauagauaaagauuuagaauacaguaaaaaugauauuuuaaaucaguggauuacuuuaaauuauuguacauaaaugguguuggaacaauuauguaacuauuggugguagagcuggggugguggcagaggaauaaagucagauacucauaccuuaucuuauaacaaaaugaauuccggguggagaaucuuaauaaaugauucuacuuuuucagcaguuuguucuguuugaauaauaguuauuggagaauauggaaaauuuguuacaguuuaagaguuucgugucacaaacauacaucuuaauuuucccauuaauuauucuaaaacuuuucauaucuauguauacuuguuuaccuuuaacuuguucugaauccuaaaaugguauauugaaguccuguaucauauaguaauuuuauuaaaaccuccucgaauuuccaagacucuuuguacuuuuauuucacugcuuucuacuuccauauaacaaucaaccagucacuguuaaaugaugaccuagaaaccuggauaaaaggguuugaaacauauucgauaaacuaaauuuuaauauuucaugauauaaaaagcucuuacaaaacaaaauaaaacaaauauaaaaaugagcaaagaacacgaacaguaaguucauuuagaacauacucugauaugcucuaggcagauguauaaauugguacaagguuuucguauaggaauuauugaaaugugucaaacgucuuuaaaaaugcauacccuuuuacacagcaauucaacuccuaagaguuugucuuaaggcaauaaucaaaacaucaaauauguguguuuuuaguugcccaucauauuguuguuuauaaugacaaauuuuugggaaaauccuacaucucacauauaugagauccuacuuuuacuauugagaaauaauaacaauaccaaauaauaguuguaguaugcuguaauuuuauaaaaauaaauuugcauuuucauauuuauacaugaauaguuuagaaggacaauguauuaauacuugugcguagguuuuuuuuuacauuuauacuuaugcuuccuuucauagugauucagaguagaaauaccuuuauaguuuuacaaaaccuaucccauuuuuaaaaaaugauuuaaaagaugauuagagauuuuuaucccauaguaaauauuauagugaaaauacaucugauuaauggaaaauuuggcauuuaauaugugacauauaauaauuugaguuuuaauugauuuuuuucucacauuuugauguuuaagagaaaccaguuuuccccugagaaggcuuuucuguauuuuccuucucuguuguacuacacuaucauaacacuuauuaaagaugccauaguguauauaguccucuguuaauuugucuguacuuccuauuggccuuguccaagauauguaguaugaacuacauauguaauuuuaaaauuuuuaguagccacauuaaaaauauaaacagaaacaaaauaaaaugauauaaaaauaaacagaugaaauuaguuuaaauaauaacucaauacagauacaugaaaaauuuaucauuuuaacaugcaauuagugugaaauuuguuaaugagguauuuuacguuuuuuuuucugaccaccugcugccuguugauaaauuuuacguuguuuugucauagaaauuuucaaaaucugguguguauuuuuuacuuaugcacaucucaguuggacuagcuauguuucagcuguucagcaaucauauguggcuaguggcugccauaccaaacagcacagccuuagacuguaagcucugugaggacaagggaauccuuuuuacuccagugccuaauacagugccuggaauuuaauaaacauuuuaauauuugaauuugcuuccccaaacaaguuuauuugcaguuucuaacugugauaucacuugcuguuuuauacuucauacuuuucauuuauauacucaucucuuaaauugugugcucuucaacauaguaaccauguuuuauucagcuuuauaucucugacauagaagacacucaauauauguuugucgcaaggaaguuagagaagagagaaacugauuuuuuacuucaaagaacuuuuuucugguaaaucaucucuugagauauuucacauuaagucucacaaguucaaaauuguaggauuauuuagcauuuagcaguagaaauugaaagaccucaacuguucauuuauuugagcuuuagauuaagccaucgaauauggcugauugcugauuuuauuuuuaaagaucucuaaggauuagagauuuaucagccuuccuuaauacaaccuuguucuuuguugaauaaauuuuacagcuguugaguucuucccugucaaucuuaauaauccuuugcuguagcauaagauuuuuuccccugugaucuucaguggagacagacaauaguugguuaauauuaaucauauaaugagcuuuagcauuaauaauauuaguuaugauaauuaccuuaagcuuucuuuaucuaaaauguagaacauuaauuuuaacauuuacauuauuucaauuuuucuuuuaauauuucaauuuuucuucuaauaggaaagaugagaucaguaauguauuuauuuuuugggugugugagauaucuuuuccccacauaacugauguuauaaauaaugcugaugagugcuuuuaguuugucaguaauaguaacugagcagccaucauaugccauuaugguauuuguugcuaagaacagaaaauaauccauauuuguuuucugaugugcucuuagcuaauaguuuuguuauuagguuaagggccuaggaaucauuguuuagccauguuaguaucaugcauacuccuuguuacaguagccagacauguaaauuaaaaccgcuuugcugucagacagauccaguuaaaauucaggcuuugcuacuuguccagcaucuucucaaucucaucuauauguuacccaucucauaaaguuguugcaagaauuauaugagauaaauguaccuaaaguaugugucuacaguaaauaugcaacaagcaguuacuuuuauuaucaucaauauuauuaucuuuucuaaagaaacaaccaaauacuuuguugucggcauugggaucuaaaugcugggcaucuucacaaacuuaaaaauuacccaauucccaaaaauaaaaccaaaauaggcaaccgguacuaagccaaauaucacaucugauauuaugggcugugauuucucaaucuuuuuccauaagaaaaauauaagaaagaggaaauuccugaaaaggggcaacuaaaauuaaaauacagcuaaggcauucaguuuauuuauucauuuaaucuauugagugcuuacuauguggcaggagcuauucuaggaacuugggaugcaucagugaacaaaacaaaaauuccuucauuauagucuuucuagugaaauuuagacuuagaacuucaaccccagcagguucugcugugaggaugggagaagagugugcuagaaacagguggaggcagggaaggaaggucugcucuacuuugacuguuaaaaggccuagaucccaggacaggagaccaucaggccaaaaucuaaugccuagugucugaggaaacagguacccuuuaguccaguucaaguucauguugauguccaagaggccucagacaaucuauggggaauacagaucucuggguagagguuuggaggaugggugguauacugacugaaaaagaaugcugacaauuuggaauauagcccagauggcagcaccuggugaaaagggacugucacaucaucugagcccaaaccaacugaugggaauugaggauagacuucaggcuccucuuaguagagaacugaaauaaagaacaaaucaggagcagagacugaauguacagcaguugagagaagagcugugggcagauagaaagggugcuguguggagggaagccuguugcugcauaaccaaagcauguguccucauauguaguuuccaaaaugauuccuaacauguauaagucauuguagaagauguucauaguauuuaaguugggauuuuugucauacuguaacuuucgguuuuauuggaaaguaaauguuaguauguucuugggcagaggguuaucuagcuugauaaagugcauaucauaaauugauaaguuugaaagugacuguaggagauaagucagucaauaaguuccuggcuuucauuucagaaaguguuccuuuuagaggagagaaacacuaucaugaagauaugcaaacaaugcuagaaaauuugauaaugugacuuacagaaaaacagaaaaguuuugucugaacuauuaaaauucaacuugcagcagcagcaaaaacaaguaaaguaacagccaaaauuacucuguuagcuauuucaggacuuauuucuaaauauuuauaaaugauaauaguaugaugaauuuggcugguuuccuugaaaaauuuaaaaagguuaguaaaggcaauauuuuuaaaaauauuuguuuauucacaguuuuaaauggcagaaauuuuauaaggcacugcauaauuaucaagguuuuaaaaacaguuaccuguaucucugggauaaaaaagaaagcacauuugacuauuugaaaaauugaaaguugaagcaagaccaugucaagaaaaauuuguuaucuguaucuucuccauuuaugugauaauuguucccuaaauccaaauuuauguaacaaaacuauauucuauguauuucccaugagucaacuaguuucucuuuagugucugccauuuccagcauucuuuuaaagccuauaaacaaaauuugguguaaaagauugcaucaaauguugcugauaguuauuaaaaauauauuucaacuccaaaauuuguucuuaaagacuagcauuuuaaucacagauguuauuuuuuaccucugauuaauaauuguauccuuaauuauugacgauagcugaaggguuugacuaagacaucaggaauaauuuuucucucuuccuaaguugugaugauagauaaauaauuuuucuauuuuuaaagaaauacauuaguuccuaaguaucuuauuucucuuacuugaaaggauaaaagaauguuuccuguauugauuucauuuuccugugaaguugaagcaugaaaaaguaaaugaauauuaaaaauauuccauuguguugguauaauaaaagcucgaauacccaaagaaaaguuccauacuauguaauauuuugugacuugauuagucugcugugcuuuaaaaacuaaacacagaacaggaaauaucccagucaauguuagaguuuuauauaaaacauaaaguuucaaauuuuaaagauaaauuuaauuuccuuuacaguauuuaucaaaauuaaaagggugaaauagaaauguaacaucaagagguuuuauaaucuuaagguuuuucuuugucauuuauuaaaaauuauuuuuaaauagcauacugauaugauuauacuccuuccaccccagcugcuuuagaggccuguccuaaacaagcaauuaaaacuagauuuuguucuuuuaaguuugaaagguggcucccacacagauuuaacuuggguaauugguuggccacuacaaccagcuagugacugauugugcuuccauuaagagcaguucggccaaggaacucugcucgacacuaaaaccacugagaagagggauauauagucucucuccuggaugaguucacaaucugcuuuggaagcaggaacagcauguaaaugcauaauugaaacaagugcacucauacuauaaaaguauguuccuagaaacaugauuaauacauaggaagaaugauucacucugccuaggauagcuuuguaggggacauggcuaaggcaaagagucuuuguccaaaugaguaguaaccaacagucuuuaaacagcagaugugucucccaugagauugugaucuucguaagggcagaaaccguguauauuuuguucaccaauauuucuuuaaaaccuaguauaauaaucaauauucaagaaaagcauugcugaaugacccagguaaagaaagauaggaaggagcauacuaagcagaaauggaauuaucuacauuagauguucaagaaaugauacauuguugauaccuguggaacacaaagucaagacagguggggaaaugguuggagauaaagcuggagggaugauaauaaugguagguaacauuuauucagcauuuacuguaccacacaguuuuaggcaccuuauguauauucguucacuuaauccucacaaaauccuugaaggauguacaauuauuauucuuccauuuuuacagaugaggaaacugaaguacagagagguuaagugauuuucuccagaucauauaagugacuuagggcagaaccagcuuuugaacccaggcagucuggcuccaaguuuacgcucuuaauaguguggggcuuuuuguauuuaauuagacauauguaacugacauuuuugcaagucgcaaugguuacauauugguaauuucaaaugguucaaccuaaugucaugcagaagaauuuggguauuauaaauacagauggaacccuggaaaggguuugaacaagggaaacaagacuuuugggggcaauagacuauagccuccccaacucaccaaaacucucuaaaaacaaggaccacuauuauccaguaauccaggacucccacucuaagccugucuuauucccauuucuuuguaaauuggccugauuccuuacccuuugaccuuauuccuuugacuuuaccaguccaguugccuuuggcugacacuucucuguuucuggugauuucugcuacuauaaggugaaguucuaauaaccagcgcucaaaaacagaaaagaaagcaaaagcaacucuuuguaaagcuuuucuguaugaccuuacuuccuucugcuuggcccgggccaucccaggucuacccauaaagcauauacugcuauaagauugagccaggcacaguggcucaugccuguaaucccagcacuuugggaggccaaggcaguugguuaacuugaggucuggaguuugagaccagccugggcaacauggcgaaacccuguuuuuacuaaaaauacaaaaaguagucgagcguaguggcacucaccuguaaucccagcuacuugggagucugaggugagagaaucacuugaacccuacuugggaggcugaggugggagaaucacuugaagccaggaggcagagguugcaaugagcugagaucacgccacuguacuccagccugggugacagaacuagaccccgucuaaaaauaaaaaauaaaaauaaaauaaaaacaauaaaaaaaggauugaacaggagauaacuuaaagcauaagagaauuuuuaaauaguuagaauacauauauaaaaaaucguguuuuaauugaguccuuucugguuuuauguuuuagaaaugucuccaaguauggguagcacauaaauaucauauaaaaguaauuucauauuucucacaguuauucuuuaaucuguacugcuuagaaagacaaucuugagaauaaugauaggaacuacauuuuuuuagcuaguuauagcuuacaaauuauuuucauauacagauuuucauuugaucuucacaguagccuagugagguaauuaucaccauuuuauagauuaaagaacauagauuuagugaagauacauguguuuucagagcuucauucaagguuuucuaccuucagaucuaggcuuuuuuuuucacuaccaugcaaaaccucuucacauuuauaaauucuaugaaucaaaaucuuauuaauacuagcuaauacuggagacacaugagucucuaguccaagcuuuaaccacuauggcauuuguauaaaacaaguaaauucccaacucugugauaauuacucagguaaccugaaguauuuuuuauugguguaaaagcaauuuugauaucaucaauuugaagcaaagaagccuuauccuaauguaacauucagauaauacaggcuauacaacuugucuguauaaacuagugcugugcguuaaaauagcauuucccaaagucucuuaguuuacuuaagaaauauuuuucguugugucuugaugucaguggcuuuuauaaacugguuaccucaucuguucauuaggcucugugaaggaaagggggagaugaaggaaacauccaaccuaggguaagucaugaaaggauuuuuuucuacacagcaaaaucuuagauccuacuguaagacuuuacccuugguuuccagaagaaaaaaggauggacaagaggcugcucugucucuucuucaacuauguaccaaucagaggguccacauaccaugcagucauugacucucccuuaggguuuacuaaagcuguauaguucugccauguuuguuccuaaccagcuuucccgacaggccuguuuuucucuauucacauaucaccaaagacugugcuaaggcacuaaccuuggucuggauuuuagaaacuuggggaacuauaagaaguagggcaagacuggcuuccaauuguagagaauaaaguccuaggggggaacucaagauaguauccaaggggaaaucuagcucauaaauuacaaagugaucuaacaagcucccaugcacagguaccagaaagagaaagaacucaugucugauggaaaggagccacaaacgaagguagaaagauaggcggguugguguuaguaagagacugaaucuggcaaaaggcccauaaaugauggauaccuuuuuguaguaccccuguggcuucaacccagugagaaaaggagcaauaaaggacaucaaaaccaauuuucagucccacuccaaucuucagagcuugagguuucugccaugguuaauucuaaucuuuuucuuauggacuuacccagacccauuagcuagugucuugauuuaacuugggaaugcuauccuggccuauuuucucccgcaagauguacugggccuacucucuagcucuagucuuuaacuaaugcacugguuuggucuucccaguuuccugcauugcagcucaagccugaagucuuucugucauaucggaacuaaagagacucaugcuucaggaacuauaggagagaaugccauauguagggcuggaacaaagcauguacaggaaaaggagggugggagaaagaggaugaagaauuacucucuccauucagcaaaaaaggaaaauguuucuucagauuaccaagggauacuugccaguguucaggauguuucauaauucauauuauuaucuuauuuuuuuuguagugggaauuaucaaagacaguaaaaagauguuagaagagaaauucagggguaggggaaaugggaauauguuagucaaaggacacaaacuuugaguuauaagaugaacaguuucugggaauccaagguacagcauggguggugauauguguguuaauuugugauaaucauuauguaguauauacauauauccaaucaucguguuauacaccuuggauauauucacccuugucaauuaaauaguuuaaaauauaaaagaaaaauucaagaccuuaaugucagcuaaaggccuuagacuuaguuacucuccccaaccccuucuggguuauuuuuguuuguuugaagaaauguuauugccucaaaaauucuugauuucucuaguuccucucacucuauuuuaauaucagucagcuauccuuguguuuccaucugauguuucacagauugagggcugugaagucacuuacccucucgaagcaguuaggagacuauuacagcuauuccagaaagagaugauaaggguuugaacuaugucacgugcaguaugagugccaaggaagggguugaauaguugaauucaaaaacauuuucagaaauagaauaaauacaaauucuugauaugacaggguaaaggagaggggagaauccaagaagauauugagaguacauuucuaacagaaguagagggcccauggcaaucuaugaauuaagacauagggcacaggguuaagagcagguuucagagggaacaaagauuugacauuugcuuuuggacuuguugaauuugagguaccuguaggacaucuaggaagagaaagccagaacagucuaguugaaauaugggguggaggguauaacauugagagaggcucaaaaggaacacagcggagcuaagugauucaaggaugguauauaggagucucaggucuuuucuuuaauauugucuaucaaaaucacuuccuugucuuccacagacuccuuccugagucugucuugcugucaacccugcagaagauucccacccccacccuguaccccuaaaaggcagggccuaugucuuuacuucuccuucuuucuuucuuuuuuuuuuuuuuuuuugaggcagagucucgcucuguugcccaggcuggagugcaguggugcgaucucggcucacugcaagcuccacuucccgguuccaagccauucuccugcuacuucuccuucuuuauaaccuagggacauugcuaaaagauagcaguuuuuaagaaaaaaugcuaaaagagagcauuuuuaagaaaauauaguuugacuaugacuucauuuucagaugucaggacugguuuuuguuucacuuuuuugcccauuaagauuuagagguuuucugcaagucagcagaaaauuguaguuacuauauccccuguuaugaaagcaaacccccaguuuucuucuggauaugauguguuaauaugggaacacacauuuugcugacaugcccuaaugcuuaauauuuugaugaaucaaucugggaauaagaauugauugaaaacaucucaauuuuacauuggcugaaguaaguauugguuaggaagaugggcagccaguuagcugacaggaucuacaccgugcuagauggauugcaauaaaaaaaaauagaauuaaacacaguauacugcuaucaauuacugacuggcaaguauguuauugaaccauaucagaaauaaaagccaaagcauuuuccugugauucccaaaaaagcucaaauugcgaauaucuuuagugccuaguaaacaaacaauucuaccuuguauaaugugaaauauuacagugaacaaaguauuuaguuuuuucuacuagcaaauuaagccuuuuuaaaauucugugcacacaaaaaacauaugcuuauuauauuaaaaauugauuauuugaguggcucuuaauucaaauaaagcuuuaaauggaaaagaauacauuccaguauaacagaauuuuaccuguacuaaacuaaaaucauaucuaaaauacaaauaaagaaacaguacaaaacauauccuuucugaagcaccauuaacagcaucuugaauuggcaucuaaccacagcauugcuuauaagguaguacaucuugugcucuuauuggccaaguuuuucaucugcauuccauggaaaaaaaguuuggcuaucauuuguaagaguaugaucagugguguguugcuaugagcccgugaaauagaaaaacaaaauuaggaaagaccuauguagcuagaaaauguggcuuuuuaaaauugucaucagaaagcuauuaaugacuuuuaaggaagcaagaaagaaaaaaaauuacuaaauacaaaagccuguuaaaaugauuucaguguuuuaugcuacccuuaugaaagucuuggacuucaaaugcuuuuuccuuugguaaugcugcuaaugauagcaaaauuuuuagccuuacgccuuguaacuggagacauuauuaauacacaaaaaugccuuucauagucugagccaucugauaauaggguggaguauauuuaaaucauaaugaauugggagggaagagauuguuaugugacagacauaaaaauccuuuaucauuuaagugaaguugcaagaacaguccccucauaagucauuauugcccccaauauacaaaguaccagaguccauugagaagucuuccaagguaaaauucuggacccauauuccacaguagcuccuauucuuccauaucucgagcauaccauguucagagacuuagaaaacuuguaggaacaugugagcagcucugaggucuuuauucaaguauaagacuuaauggaggccuaaccaggucagcaccuucagagggcguacagguggccccucuuaccuuguauaccuaauguuaagaacucuacagaauacuagggagggccuuuuucaggagaaaacaaagauuuccuuuuuugaaaauauaaauucaacuuccuuucucaauuuuuuauaagccauguuaacaauauuuuauuuuaucaugaauaucugaaauauuaggaauaagaaaagcucacaagagcuuuaaguuaugauaaaauacuugaagauaaaggcagcauucuuucuuuccucugcauugggcuugauuggugguucacuaaacugaaaagccacaggugguacugcagacuaacugcaaauggcccucauauuccagccaccacagaagcuagaaaaguuuugacuucuguaucaguuaggcuaacacagauagauguaguaacaaacaacaugaaaauguuaggagcuuaaacacagcuaaguuuauuucuugcuaccaugugucagaaaaggagcucugggcacaguagcgacuuagggacacuggaagauggagagucaguuacuuccacaaucauagaggcagagaacuugccaagcugugcgcaggcucugaaagcuacuuccuagaaguaacagucaucacuucugcucaaauuucacugacuaagucaaguuacacagccaugccugcauucagugugguggagauauguaauccuccugcagagagagauacuguauauuuguaaccaauaauauaacuaccaaacuuccaauucuauuugcuaugccaauggaguguagguuucagaacaguuugccugguuuauugugguuuucaaaccaccagcauaaaagccuacagacacaucaagugggagaggccuuggacuucauggccuguucuucccaguguggccaccagaguguggauuccaagguccguuuuuccugguuuguuaguaccacugaauuuuccgugagcauuaucaacucccuucacauaguaacuuugggcucaggaagaaaaggcauucauaaucucauuuaagagggugaagauagagugggaaggaggauacagagacugccauaaaaaccuguucauguucuauuauuuacacaaugggaguuuucugagaauugcuuuuaaugugaguuacaaagagauuuaaaaauaauaauuaaguugucgauauuagaacauuugaaaacucaguuccacuuccuuugcuuaauucuaauaaucugacccuaauucccuucucuaauguuuuuauuauauaaaugacaaugauggauguauuguuugauggugagccacugaacagguguaggaaauauacaaacaggcaggcuccaucuggaaaauuuucaucaaagagguaggauucuagggacuauaaaacuuauuuuuauaauuaagauaacaagagccaugcuugagggaagugaaaagaaaggcauacuuuugaggaacauuuauuaagcaaccacuguacgacagacucugugcuagguaccacggauccaaaguaaauauuuauagagagagcauauacaguauaugguaugguuugcaggaacucuggagggagauuuggccaaaggcaucaaaggcaaauuugacuaacagaagaggacaaacaaagaaacagaaaaaaagacauagaaauagaaaaaauggaaacagcagaccucucagugacaagucaguauauauuuuagcauugaacuccuucuucuguggaagguuguguuuuauauuaaaaugugaggcaugcagaguauuagaauuguagauuguagcuaguagacgauacugaggaagccuaaaaauuuuaccucuucaauguuagggagauugauggucagccagugaaaaaugggucuucgcuuuuuuauccugucacugaagaugagaugugauuauuuuguggaaaaagcagcaaccuugcaccacuucuggccacuuuaauuuaggcaaggacccaucuauguugagucacauguuccuguuuaauuaagaaggaguucagggucagugaaaaaugcuagcagcucugucauuccuuuaaguaacauggacagucagagucagcauuugcagcaaucuugggagcaucaggaagaguuauaucaggaaacaagauacuucacuccucuagcccaauccacuuacacagagaaaagaguuuacuguaugccauaaaguccuugacucuagacacauaaauuuacuugucuuguugccaaccuaaaagauagauugucuaaucagccucugaguauugaguuaaagaaaggacaagcaaaaacauuugggagaaaacagaacccuaacuaggauccaguguaaguuuuuguuucacucgaccuguuuuucaugucagaccuuucuaucagccuaacuguaacuuacauuucagaauucagagaucuccucccuuuuucagacaucacuuccucagaggccuuauccgugaaccccaugaaaauagucuccaccccaccuccauuauacucuguccccgaaccuccucuauuuuuucuaaaaacagauauaacuaucagaaauuguaccacuuauuuacuuguuuauuuuuugucuuccaccaaucuuuuuguuuuguuuuguuuuguuuuuuuuugaaagucuugcuguguggcccaggcuggauucgaacuccuaggcucaagcuauccucccacuucagucucccuacaagcugggacuagagguguaauuucuaagaauuacagaauuuugcagcaaaauauauauauauuuauauaaaauauauauauaucuaucuuggggucagcaccuuucuaguguuuuucaguuucaagcaguaucuuuggauagaggcagacuaggaggcaucuugauugccauuaacacacuggcucuugccaccaaugucuaagcuccaugaggaaaggaauuuauuuuguuuauugcuguguuuccauaauguaaaugucaaauccauuacucaccacaaaagcaugauuuggaaccauuuuccuggugaagguguuucagauagcugaagguagagagcucucuggacucugaaucccgacuucccugcucauuuuauccuucauauucuuccucuuaccauuuuuaccaauagguuuuuuuaaaaguaaacaagaaauugauuaauuuuauaaauuggauaucagagaggcuccuuauaucucagaggcugugugggagauauuuaacaaguaccaacugggagucagugaacgugcauucuggauuggugauguccuuggccagccuuggaguucuggcuuccuugagaucugagucuuccuauggaaaucaagauuacagugcauccucucagagcccugcacuccguagcaugcuaauucuaguuaucuacauuuaccuagauggccuuuuccaauuaucuauguauaucagaugguaucuacauacaccuauaucugauucucauuccgaucuuuaaaagugagaauaucugaaaugugcauuuggcuuguuuugggguuuucuuugguuugguuugauuuuccuacacuuagcuaaccagaacacaagggccuuuucaggaccuagccaguuucccuccauucuuggaguagcuaagggccagagagauguuaccaaauguuguuuggauggaccuaggacccaaagcauuuaagagguuuuuggaucucggagcaagaaaggaaccuuaggagauaugaggacaaauacaaauaucuuuuguauugauucuaauuccaaaucaaguaaauuggagaacaugagaauaaaugugguauuuaauuuguuacaguuucuccucccaucuaugaagaaucuucaagcuaugaagagauauguggugccacuuuucuccuucaaaucuccuuucucuguuuuucaaggucaaaaaaaucugaccaggauuguuucauuucuuuaguuguuuuuuuuuuuaugaaaauguaguuaagcuuuauuguuauguuucaaauuaagaguuaugccuuuguguuaauaaugcauggcaaacucagcuauagagagcuuugccuagcaaagcucccucucucccuuccugguaaacuuucugauagcuccaauguugcacaugcauaaagucacugacuucacccaguauguccugaagaacaagggacucucacuuggacuugcacagccaaagcagagaaagugacucuauucccaaagaaaaugcucucuuugaaaucuccagacuucaaaauagcacagucaucuucuuugcuaagcuuuacaacaacaugaggaaggaaaaggaugauuacagaaacuuucucauaucauuuuaugaaguuaaauuuaccuacauauuaugugcuucaguguuuuauauuuucuuuacaauuuuuuucuugccugaguuguaaauaauuugcucccccaacccccgcaacuuuucuccccucuguuuaaauuacucugugcuuugcauugcuuggcaucaagcaguaucuuuggauggaggcagacuaggaggcaucuugauugccagcaagaucuaacauucaaaaauaaagaaauguuuuuuaaaaagaagaucuuuauucaagugugguaaaacauuuucugagaucauucaggaagcuucagauuuguggaagggaggcuguaugcauauagaauguuauuauuggaacuuuauuauugucacauugauguuacauuucucaggaaauauaugcuaauguguuucuacuugcuuuuuuuaaggccuugaguagaugugcugaauauugaagcuauuuggcugccuagaaaauauaucuuacaauuuauaagcuguauguuauuauuuaaaaaaaaaaucaauaaucucccagaauuuugcaugaauaauauagagauagaaacuuaggugauuuacaucuuaugguauucaguuuuuaagauacguacagaugacauaccaggcaaccaauaaaaaacuauauaauguagagauuucucaaugaaauuaagauaauuuauaaaauauaguuuuccauuuuaauugucugaauuuaaacaacagagagggggacugauagaauuacagaauuuugcagcaaaaaaauacauauauauauaaucuaucuauuuuauauauauauauuaucuaucuaauauauauauaaucuaucuaauauauauauauauauauauauauauauauauauauaucuuggguagcacuuuucuaguguuuuugaauuuguuuaccagugaaguggagaaccagguccagcucuuucuccccuugggagcacaaguagaaauccccucauccagcuggcguuaaagagguuaaauaucuaaauuccaaaguuacugacucaaguauuauuauuaacuacuaaucuuuuacaugcuucuagccauauuuauccacauuuccucuguuauuauuauaauuguuuuagcugucuuguuuauuucuacaugcaguaacauuuccuuguauggcaaaauuuuuaaauuaugaacauauaugacauguaugacaugacauggaugaaguaccuauaagacaucauauauaucguauaauuaugugugccucacaaaagacaaaguucuuccccaaagugacacaucgauuugaaugauuuaaauauccauaugccagagaugcaguacugacagaaugaaccacagagguuaauauguugcuccauaugguaaguauggcauuggcaagacuugacuuugcuauguuguaugcgucauuaccucagaccugauggacugggagaaaauccaaaggagauuuaaaaaaauaauaauagagaagagccuuagaaaucuaucagaagauuuaguaauaugauaagggaauauuuaagagacaauguauuuuuuaaagcauuaauaaauggaggcaaaaauguugaggaauacagaauauaugugauaagugaccacuuccauucauagagauuauaaauaaacaacugaauggaaaaauggguaaaggagaugaaaggcaagucacagaaaagugauuacucagacuucucaaaaaaaaauugaaaacaaauugaacuuauuaauauacaaaaaauuaacauuuaaaaaauguuaaaauugaauagucauuaaagaaauacagaauaaaaauaaauaagauacuuguguacugcaaauuggcaagaauuuaaaagaaugcuaugaaucgaugugaauaaggauaugggaaaacagacaugcauaugccggcaguggggguguaaauugcacaaccccuuugggcgguaaguuagaaauauauuucuaaaaccaugcaaauuugccuuuacuuuaucccagcuguuuuaugucuaggaauauauucugugaaauuacaggcaugcagaaagacuacagacaugcaacaucauucaugauaguuuucaaaaaaagaaaaaaauuaaauccugaaaagauaaaauauccaacaaucaaguauuaguucuauaaacaauaguaugcccauuuguagaauacaaaugcugccauuauaaauccugugccauaagaaaauuuguuggcagaaaauauucacacuauauuucuagcugaaaaaggcaggccagauguuagaaucuaugauguaacuuuuugaaaaguaucagugcauacaaacaugcaaacauguauguucuauacaaagagaacacacacacacacauacauauauauauauauauauauagagagagagagagagagagagagagacagagacagagaaauacuagugaaacacaccaaaauauugagugauauuuuuaguuagguuccaaauaaguuuguucuuuuuuuccauugaccaaucacuuucguaacuagagaaaaauuaaauuuuuucauccauacucaaaaauguauuuauuuuugaauuacaugucacuccuucuucaaugaaguauuuguuuaauagguuuuuuuaaauguuguacauauauauauagaugguuaaguauguaguaggggcaucugucuuaacugggugcauguagauuuuauaaucuguuuaauaguucacuuaccugggauauaauuauccugcaacuccaacucuccagugaauaauuaagaaugggaauuaauccaugaaagagcucuaaagccuaaauguaugccauacaguuaccugcacugaaacugacaguuuagauauaggagauucuuuugaggcaucuuuauuuuuacuuuaagcauaagucucauaaauuugguuuucagguucucauagauuuuaaucugcaaguuagaaaaaggcugucagggaaggugcaguccagagagaaaagaaacaaagaugcuuuuuaaaaagauugaaaagacaguaaaggaaagggacaagauucuuaaagcaucagauagcaugugggaagaaaccugcuuuuaaguagucugacguaucaacucucuuacaccaaaguuuaguuauucuauucauaaugauuuccuagaguugugugggacacugggauacuauuuucauucuguuuaagaguauaagaaaguaugugcuacauuuuagaaaguuuuucacuaaaagugguuaaaacuuuuaaagguuuuccucaaaggguuaccccucaguuacuuggauaauuuccuuauguaaaauacuuuuuuucuuggccaagacagucaaaauggggcuuugguauggguauguguguauguauucucacccagcaaguggcuagcgauaggcuuugaugcuuggcauuguaaguaccagaauagcaaugaguguguaagauggucuuggagaugcuaaggauuagaaagaucaucaaauaaagaugauguagauguagagaccugcauuuuaaccuaaguuauaauauuacuuaagagaguaaaauaugaccaaacuacaucugucuuacccauugcuagcaauugucacauaaccuaguucaaucagggucucuaaaagguccaaauaauagucaagucacuuuccuuuuuucugauauauuaaaaaaaaugcaaaaccugguuuuaaaauugugacaucuuuuuauucucuaaucuuaugugaauguuucugugaccauauguguaacguuauuuaaagaugaugauuuaaaagucuaaauuugaggccucucuuaaauguaaaaggucucucacaaauggcucuucucuucuuccccuuacuacaaagaguacaagacuaagaguaguucacuuguaauagggaugggagggagaagagauaaaagaguaucuggagcaugagacacccuaaacuucucugagcgccuacagucugaucccuuagaccagggguccccaacccaccucuaauggaagaaaacugcucuauuugagucuuuauaaaucuuaugaggagcucucaauuucuuuauuuugaacuacaaagaacugcuuggagaguacauauuauccugaagggaccucaaacaaaucuaguuuuguauaccuacaccaauagagaaacaaauuucauaucaaucaagaaacucacagugguaugaccucacaauggcaaguguuggaaauucuaguaaacaaagcuuguaaaggauuacuuuaaaaaggaguaauguagguaaguaguuuuaggagaauauggaaacacgcuuauaagauaaauaggaaaacaacaaaaccauguggcugggaauaaaauuuccaggaacaguaguaaacaugaauugaaaaaguuccguuacuucacagaacucagaagugaaaaauauuuacuuuaaaccaguacggguuccucgccuguuagaaacugagcugcccagcaggaagugagcggaaggccagggagcauuaccgccugagcuccaccgccugucaaaucagcaacgcauuagauucucaaaggagugugaacccuauugugaacugcacaugcgagagaucuagguugcgcacuccuuacgaaaaucuaaugccugauggucugagguggaacaguuucauccccaaaauauccccaccgccaccccuguuuguggaaaaacugccuuccacgaaaccugucccuggugccaaaagcgcuggggaccacugccuuagacugagcaucuauuugaucaguuggcucucauuuucucuaagucaucccuuugccuuaaacugagcaucuaucugaucagcuggcucucauuuucucuaagucaucgcuuccuuccuuugaacccaccuuucccaguauaccucucuugcuccaucaacuuuaaacauacuuucacuuccucuggagcauccuauacccaucucacuuuguuauuuccuuuagguuccaguuagaccucauuuuccuuagcaagccccauuucucuaccaaaaauuguuuagcuuccccuuuuauuacucucucauagcacuuacugcacuaauuaugauuguuuacauagcuaccucucucccucagacuucucugacacugcucuggaauacaaaauaguaacuuaacuaggaacuagguggucagcaaacacagccauagaauagcauggcauuggccuggcuagcucuuauaagaggaaauaaaacaauaaguuaucucuuuuuggguuccaggagacaauauaucuuuaacguuauaguuguuuauguuucuccccugugauuaacauucuccuugcauagaaauuuacugagccauuauugaaaaugaaauuucaugugucuuugcuauauuauuguuaucagaacaaucugucauuuauucgugacauucuaaauguuugaccuuggauuagagcccuuugcaaauuuaucuuacauaacugagucaucaaaacagaauacauuauaauuuaauuauuacuaaauaauguuaaguuaaucaaagugguauuuaauacaauuguauuggaaauaaguaaugggcucuaaaauaaugaaauauagaccaaguauuuugaagaauuuguaucuuuggcuaguuucuuuucccuuugaaaguagaaaaauagucuaaaauggcuuugcugaacagaaaauuguuguaauucgcugaaugaugcuuccugccgugcuauacuuuuuugauggagguuucagauuuuuuaaaaaaucacuuuguuuuuacauuuguuuuauccauuuuugaguauuagagguaauauuuuucuacacauuacuuugagacacaagaacuggaaucauaagguuaaauucagaugaauuguuggcaagacuacuaaauucaaaugaaaaauuagauuuucugcuuuauaugcaguauauuaaauuuucacuccaaagaccauaaaacaagaaacucaagaaaaugcagagauuacuaaauuuacagacugguacaaaagcuacagacauacaucuuucacccaagguaaaagaugagaaaaauaugcaaaguuagauaacgugaccagggugugugauuucuguuuugcuuuugcuaaugggauguauuuucuuucauugguaaauuagggcauuugcuguaguagaaauuacuggagaacuugacuccagaagagaugguuccaguaaagaaacuuuuagaaacagacuggugucauuacagcaacagcuacaaugaucuggaaaauacaucacaagaccugcggucaaagcauaaucugacagcagcccagcaccuacucaaaaugcauuucaucuuucucauguuuuagaaacaguccaguggacauuuuuacagacgaaguuaugagacaaaguuuacagacaaguuaugugacaaaauuugaaaaagguuuuccaaauucugucucauaacucgcaaaaucagaaagcaaaugacuacauuauuuuuagcuccacaaagaugcaucuuuauagaguuaugguuuacugucaugccuccuguucuuaggaucaaugcaagaauuuucaguuuguacagcauuucugagacuuucgggcaaccguagcuguagauagucaagguauuuuauuccaugauguaaauaauaucuccauuugaguuuaauuccaggaaaaauuugccuguacauuuauacagaugauuugguacauauauaugaacuugaggaaacaaggcuauguaacccuacauauuuaucuuucugccauagcugccaaaaauguaaaaucaaagucaguuccugagaguuauaaaaucugcuauaucaucagcuagcuccucuucuuaguuuaagauggucuagauuuuuuuuaaaucccaaaucuuuguuuuaaucuaccagacucaucauauaguuaucuaauuugugcccugcauuaggggguacuugggaaauaaauguagacugcaauccauuugccuacccagaggggagaccaguuuuaauuuucaaaaagacaacauaaggcuagaaguauugccaagaccauaaacccauuagaauuaggcuguauagaaaucauuaauaaauauaaaugucagguuuaggacucguguagcccucuggaaaaguauugaauuaugauugcugucaggaaaaagaaaggucaacauaugucucugauuuauagguguggguauacaauauauaaaacaaauauaaucagauacguacugaauugcaaguauuuauagaauaacuucacggugaaauuauguguauauacaugccuuuauuauacuuauggcuacauuuucaguuuugcuaucauguucaggaaagcaaagcccuuucaggggacuuuucaaacugugucaaggaaggaaauguggaaccuguaguuuuaugcacuaccuaucuuauuaccaccaucguaauaaaacuuucauuguaaaagaagccguuaagaacaagccauuuuggagauauuuuauugagcuuuaaaaauauucauguugucuuuuaaaaauagauuaacaguggauuaacaaaacauagauuagaacuagagaguaucaaaaaagaguauggaagaagauaccauagcuauauacaugguauauguguauagcuaaacucaagugauuuagucuuuagaauuaggaaaaucuauucauuagccacagagucaaaaugaagaugaacaugaagcccuuuuuaugaucucaugaagcagagaaaauuucauuauaccaugguggugcuauuucucaagcaaacuauuaaaccaggauuuuaugguaaaaaaaaaaaaaucaauuuggacacucauuugaguuuuuauuaaaaagcagcauuauguuaugaucaaucacauuauccaucaauauaguuacaucuucugguuguacauauacauacagagauauuucaagugauaggauuugauaugauuguuuuucuuugugcuuuucuaugauugcuugauuuuuuauuuuaaaaaugccuuauuuuacaacagcaacaaaauucauucuaaaacuagggaaaaaaagguuugacuuaacgguuguauuuucaguaauaaagugugcuaacaauuccaguauaucauauuugacugaaagaucuugggugggacagugggaagagugagcaccagaaucacuucuuaauacuaacucuaucauuuauucacugcauaacacaguaguuaucaacauuuauguauugcuuucuauuugccaggaucuauucuaaauuuuacuaauuuaauccucacuaugaggcaagugauaucauuauccccaguuuacagauaaggaaaaugaggcccagugauguauagcuaguaauaaguggcagacucugaauuugaacccaggcucuagaguccuuguauuuaaccauuagcaguauaccgucucucauauugggaaagucacuucaguuaucagagccucugcuuucucaucucaaaaauaaagugacuggcuccagaauguuuuauuauagacaguuugccuggaaacacagaaagaaucaaguggcagggagcagugaauuaccauauucucagcgaucuuucucaagucauugucuuauauuuguuuaaggaucucuagguuugcagaaacuagcaagaguauaguuaauaugcauacuuacgcaaaaaaaaaacccaugcugcucgaagaacggguccacccugcauaggaguuuaguucugauaagucucauaauuggaaccagaaaacaaguguaacagauguuuugacauuauacuucuucacagcaggugucauggauagcuauaacaguuacaaaccuuuaccagaaguaugaaaacugaaggaacagggaagaaaccuucagagacugugcuauguuuaucuuccuugaugaaguguaucaccaguuuugagaacauuaaauggaagcugauuuuuaccacguaaaaggugaaagccuugaugaaaugauuucuguguuccaauuuauuaggaaagauaagauaaauaauucagaacugaaaguaggaaagaaacuuuuuuauagagaguaaaaaagaaaccaaauccaugccuguaagaugaacauggaagaaugaguggguuaaagaauacaggaagaaaaaacucacaucuuauagcccuuaacuauuaacauuuagauaaagauggaaggaaagaggaaucucguuuaagacauaguuuacuuauaccuuagccacuuucaaaauguucagagaaaggaaaaguacuauucgacaucuauaucacuuuuccuguuguggcuguaacaaauuaccacaaauuuuauucaaccuaccacauuaucuuaagacccuaaaaugaaaaaaugacucauuuggaauagggaccuucaaaacugaaauuuugaaauaauagugaaagauccaauauuagcuaagaaaaguuagacauacgcuauaauaacaaauaaauacuacaucucaguggcuucguguauaaaacaguauuucuugcucuuggaauaucuuuuaugaguccuauaacuacagagcaucuccaucucaagcaggaacucugagaaaccaguguggguuaaucuuauaacucuaucaucucgauauguacccuacauuugccauggcaagaggagcccuaaauaguuacauggaagcuuuuuacucccuaguucaaaaguaacaugucacacauucauauucucuugucauauggcccaccuagcccuaaggaagcuaggaaguguauuccaugugcucgggaaugaagaaccagauauugaugucucuuaaguaacugauauguuacugccuaggauccuaucuggcaagaaacuuucugugagacuagcauaagcagguuucaaaauuuuuaaugagcugaggucauugaaaaauaugaagaguagucaaguuaaaaaaguaagaugaacauuuuggggguuaguguucaaacuaggaagaauagagccgauacuuagaaaagaugugaucauuuuaacaagagauagggcaaaucaggagagaagagaaauugcauagagguacuuguaauucaagagugacuaggaaaguuuaauugcuuggaguggguuuccugguuaagauuaauuguagcccaaaguaaaagaaaaccugcaagugagaucacuaaacuguugauagugaucucaacacucauggagaauagaaagggaacuacagcacuaaagucuacaaauauugucuugauuuuucacaagagugaaaauauagauucugaaaccuuuauaccagagagcuugaugauacucucuuacacaauucugaaauggaugauaaaauagauugugaguccauagaagggaaagugauggucaaaugaagccagcaugaacucaaaaacauuucuuucucuucauuuccugagagagccuauacacugguagauaagggaaacagugugguuauaucaggguuucacuaagguuuuugagaaaguuucucaugauaucucuugaggaccagaugaggaaagggguucuaauugauaauacaguuaaguggauuuguaacaaguggcaaauaagagaaaguuuuuuuaaaaaaguaagaauagaaaaaugaacuacagccaaaucaugaaaauccuuauaagcgauauuaagggauuuagacuuuuuaaaauuauaaucuguauuuacuaaggcuaagaaaugauaagauuuguguuauagaaauaacacuuuucugcaguguagacaacgcuuaaagcaagcuaauaccagagacaagccaggagguaagaggugaugguagacggaauugagagaguugcaguauaauuagacaguaguugauagauuugaaaggccuuaaguucauaagguggacaggguuuuucauuaauagaaugucagaguggaaauacagugaaacaccaaacacuacacucaggaagaagacuugagcaaauuagugaauagugguaccauuggcugauaaagaaagcagauuuagauuaugauaaauuuuagguagcuguaggauagcaaacuagagcuaucuggaggcaccuaguuaagcccuggaacaaaggaggaauuuagggcagagaucuaggucuagaucucuaggagucaugagcauauagaugacaguaagagccauagaaguauaugagaugaucuagaaagacccuauagacugaaaagaaaagagcaccugggaccaaaccugggggaacaucaauguuuaaggaauuuaugggcagaagagaccaagaggggguagucaaagguggucuagugauuagaaacuaaaggaauaguuucaaagaagcaguggucaguaauguaaagugcuacugaaaaaucaagaaaaagaaggcccugaguaugcauagcauguaaccacaacgaagcuagagcaguuucaauaaaguaaugggggcaaaaucauauuaauauuauggagggccaagaaaggaggugaaguaauagaaacagagaauggggugauaucuggaaggggcucaaagguaagauuuuuuaaugcucagaugcuaauggaguccauggagaagaggagguagaccacacuugguaaguaaauuaugcuaaacugagacccagccaguuauuucuccuaggccauaaaucacaggaauaucauaguguuuuuugaaaacugccaagcuauguggauuucaugcuuguuacaucaugaugaagcuugguauagccccuuacucucuccaaaagucaaucagaacuguagacuuacuauuucucaaucaaucaaaaauauauacacaauuaaauugaaucugaucuuuauuaccuucugagagacacuuguguuuuuaaaucugcuggcaguucaguguuacacagauuuucuuagugacgguuucuaugaaaacacuuuaaaaugcaauuuacugcugugaucaguaaugggggaggcuguaaaauuuccacuguucuaaauucuacucccuuugcucugucaugccuggacugucauuuuuguaaaccauugucuucuuguuggaauuuucugcuggaguguacauugcuguugcuaguguuuuauucgaucacuggcgaugaguucuguuuuuuuuuucugauaucgagcauuucaaacuguucccuaaugagucugccucugugcuccagugcuguuaacuucaauagauuuccuauugugaggauaugcuuccaaaaaauaauugacuuauuuuccuuagugacuuuccauuuuuauggaauuuucauuauuucuaaaauuguggauuuuaguuuaccuacccagaacuucucugauacaaauuuaguuucaaaguuuaaguggcauuugaauacuggggacuugagaacuuugaugcauuuauucagcaaacauguauugagaacuacuguauagcagcaucuaccucgguuuugagguuccaacucacauaagaaguucugcacgaagcugacauuugagacagagucagacaaagcuaugauuacuauucagugagauacgugacgaauauugcuaugguaucauagaaaagccuuucugaaaguaacaaugcuggaguuagguuuugaagaaugcauaggauuuagcuagaugaagaagggagagagcuaaguuaaaagaaaaaagaaaaaaaaacaggcguguaucuauuuuuuaaauaggcugggcacgguggcucaugccuguaaccccucagcacuuugggagccugaggugggaaaauugcuugagcccaggacuuagagaccagccugggcaacaugaugaaaccccgucucuacaaaaaaaauaccaaaaaauuagccgggcuugguggcacaugccuguaggucccauauacugggggucagaagucggggucggggcaguugagguagaugaaucaccugaacccggaagucaaagcugcagugagcucuaaucagaacacuucacuccagccugggugacagagugagacacugucucaaaaaauaauaaaaauaaaaauuagucuauauuuuauauaaagaagcugggagucugugaaaugaguuagaaaaaaaugauggcagggagaaugcuucacuuaagaauaccaaucuucuccuagaauuauagccuccauuuugucauucaaucuaccauuuacuuuugcuuugauauucuuuuaaaucucagcucuguucaucauaccucucuugagaaaucuuuaguggcucaacauugccuucggaugauagcuagcauucgagacucuccagaaucuagcuugagugucuucauuaauuuagggccuacugauccucucaaaaauugaaguacucguuguucccugaacucacuucucacuuucuuaucuccaccucugcucagguuauaccuucuacuuagaaugcucuuccuuucugucugccuuuucugccauaucuuagaaucauaccuauucuuagaaccuaaaauaucugaaauaauuauuaguauguucaugaauaccaauaaugaaagucauuuaaaauaauuauuaaaauaauuuuaaauucagucauuaaaaagaauuuuaugggauuauuaugaaaagauauauugcuagauaaaacaaaagggauauaauauaguauguuuaaucacauuuuuuaaaaauaaacugcugagcaaacuuuaggcauauucaaccugguauuaacagucauuaucucuggccaguuggguaaaagcuacucuucucccuaccccuguuuuggcuuuucuauauuuuaucaguaaacuucuugugcuuuuacaguaagaaaacaaaauaauagauguuauuuucaacuuuuaaaauaguucuaaaaacccuacucuucuuucaagcggcucaacuuagucuuuccuucacagauuuuccugccauucaccaaucagaaauaaucuuuaccuuuucuaucacauauuuuuguguuuauagcagcaucucucauucuaugauuauauuuuaauuacaugcuagaacucccacaguaaccaguugguaccaugaacagggaucacucuguugaaugaaugaauucaugcugauggcaauuugaaguaguuauuuucuuuaaagggcuuaaaaccuuauuagagagacaauacaugucaagaaaaauauaaaauagauguuaauuuauaagacaauaauugucaaguaguauauaaaugugggguguauaguacggucaguacuaaaggacuucuuuaaacacugucaguagaauccucuuucauaaaaugagauucagggauuauggcugagauaggugccaaaaggaaguaguuuuacuuggaaaaauacuucaggaacauuugaaggucaaaauuaugaaugcagaggcacagacuagagucugcgaauagucgcagcccacccuccccaggccucucauagaggcucugcacaaaaauagucuguggcagcaguaaucuacuaagcagaugaucugcacugauaaaaaaccauugacuaguuuugauuuaccuaccuuuucuguuuucuuagugaugguuauuaaagugacaaagagaaagacuacauuugguggggguggggaucccaacuuaaaccuuguaagagcaucugcugggaggaaagaaaugaaccagagauaucuuuuugucucaaaucaaguaaauauuuagugaaagauuggaaugucauucaugcuuacuacauucagauguaguauaagaaaaacaaggcaucccgaauagauuucuuccccuaaaauuaaaaauuagccuauggaacuauacagguaacucuuaggauucagucagauuccagacuuagugauacugacuggcacaucugcagacuucaugggaagaaacagugaugaaucaaacgacagggaugaaaagagauucaugaggcauccuguccaccaggaaaccuugcugcauccuaaaugcaaacugguucaguucauuuucucucaucuccuuucucuauuaguauaucaauaacuuuucuugaagaaauauauacauaauugcaaaugguguugucaguguuucauaagaagaaaauuccuguucuggaagcauccagucguaacuugcugugcaaaauacuaugucuucccuacuuuauucauucuuagagcuauuaaauuucgguucucugugcuaaauaaauucauccaauccugguucaaguaaccuccuucuuaggucuagauacuguuuucauuacuguugccuuuaauuuugucuaauuguaaaaugccgaaguagacacaauuuggcagcccuugagaagcacugccugcucuucucugagucuguuuuuguaagcagaaugucaacugucugggucauagaagaagaaacaaaccaaccuuugggaccagaccaauuguguagcuguauaaaaacaccuagagaauuuuucuaucuaaauucugaauuuaagaugaaaauagaccucuaguaccugaacuuucucuugggaaucugaaagacugaugacggaugcuacaugugggaguuggagaaaagccacaccuugauauauuaucuuauucuuugccauucuuagcauaaugaccuuuuuucaaauucugucucuccaaggugcacuaaaagcuuuugaguacuugucauacauaaacacuaaaugcaaagaucaagagaaaguaauguguaagauuaaaaauaggagcaauggcuuaaaguaagaugcugaauguuguuaauguauuccucuuacagcuucguuguuuauaaaagguucuuuauuuaaauauccuuuucaaauagugucuguaggaugcuucuguaaguaauauuuguagauuuaaaauuaugaggccauaaguaucuugaaauauuauuuuaaguucagggguauaugugcagguuuguuagauugguaaacuugugucauggggguuuauuguacacaguauuuugucacccagguauuaagucuaguacccacuagacuuacuggguuauuuuuccugacccucucccuccucccacccuucauaagcccaaguguguauuguuccccucuauguauccauguguucucaucguuuagcucccacuuauaagcgagaauaugugguauuugguuuucucuuccugcauuaguuugcuaaggauguuccuucaaaggacaggaucucauuccuuuuuacagcuacauagcauuccaugauguauauguaccacauuuucuuuauccagucuaccauuaaugggcauuuagguugauuccauaucuuugcuauugugaauagugaggcagugaauauacgcguauauguguauuuaugguagaacgauuuuauuccuuuggguauaugcccauuauggguauauuagaccccagugcaaccccaaugugauugcuuggucuaaugguagcucuguuucuaggucuuugaggaaucgccacacugucuuccacaauuauugaacuauuuacacuccaaccaacaguguauaaaccuuccuuucucucuacaaccucacuagcaucuguuacuuacuuuuuaauagccauuccgacuggugugagaggguaucucauugugguuuuaauuugcauuucucuaucaaugaugaguuuuucauaugcuuguuggccauauguauguugucuuuugaaaagucuguucauguccuauaccuacuuuuuaacagaguuguuugguuuuuucuuguaaauguuucuuaguggucuaaaauauguauguacuuuuucaggaaugcuuuacucucaagucauuuuuguacuguuaauagcuuuuaaaacaaauagggaaucuccaaaugaguaacauuucaugguauaacucagucuguuucguaagaguucuuucguuugaaagaauuagucauuauaaucccauaagacagucauaucauuauuuggauauuaauagaaaugccauuuuuuccaugggauaauaucuuaaaauacaaaaauaguuuauugaauuuuacuuguacuguguuaccaaaaauaaaggccaaaaugaaaagcuaagugccaucuagauccuguuuguauuagaaaaggcuacauuagagccucacauuccccagcaagccuuuuucucucacaaauacgguccacaagggugcuggucuuauggaaaugacugaacaaaaaucccaccaagauaauuuuuagaaagcagaaaacuuaacuuauccucagaagcauuuuaauacauuuauuuucuggaguuuaacuuaaauuugacuguguggccccuguuuugcaaucccauguaaagaaauccacaguaacaugccaucccaaguucuuuauuaguaacaccaguaacuuuauaauuuuauauaguuacaaauagauauuuacucaggaaaaauaacagauucacacaagacuugcauauuauauauuuguaagaaucuuaaggugccuauuuuuuuaaucaccuuuauugcacuauaaauacaauaaaaugcaccaauuuuaagguacaguuugaugagucuugccaaauacauauagucaugucauguaaucauuaccacacuuccaucauccccaaaaguucccucacacuguuuugcagucaguauccuuuuccuaucucuggcccuagggaaccacucaucugucacuguagcuuagauguuucuaaaauugcauuuacaucgagcuaugaucucuaaugucuaaaugaucgacauuuagaucauuucauuagaacaaaacauaugcaguauguuuuguucuagcuuucuuuuuuguaacuuauaaugcuuuucagaucuguccauauuauugcguauguuaguuuaugcuuuuuuauuucugaguauuucauuguaugaauauauuacagauuguuuuccaaucuccaguugauaaacagguggguuauuuccaguuuagggccauuaugaagaaagcugcucugaauagucauauguaagucuuugugucaguguguuauuuuucuugagaaaauaucuagaaggugaguggcuggguucuauggaaaaaaauuacauuuagcuuuauaagaaacuacaaaacuguuuuccaaagugguuguuccacuuuguguucucaccaacaauguaugacagcugcuauuucuucaugucuuugucaacacuuguuaccgucagucuugaguuuuagucauucugguggguaugugcagugauaucucauugugguuuacauuuuuuuaaaauuagagacaggaucccacuguguugcccaggcuggucuugaacuccugcgcucgauccuccugccucggcuuccuagaguggugggauuacaggcaugagcuacugcacccggccuaaaaauuuuugaauaaaauacuaaacauuuuuuuaaaaacauuucugcuacuuaguguauucuuugaucaucuaacauaaauaugauuuggaauauaaggaaaaccuuaauacacuauucuggaugucugauaggguuuuagacaauaacuucauggcaguuugaugagguuuauuugucuauucuauagcuaauagauuaugaaaacauucagaaaauaaagugaauuccuuauugcauagugguuguuuugccuauuguuguauuaguagucagucacccaaauaccuaagcugcauaaaaccuaaaccaguuaacauuuaaaaauaauguuugagauuauagcuggaaaguccuaguggauuggcucauucuuucucagagucacauuugcucccaguaagguguuuucagaggccuucgucagucuugcuucaaauaagcugagcagugaagcagacacaacuuccccaaaaugacaucagugccuuuuuaauaauuagaccccacgcuggcauaguguguuacuccauaauugcugauuguuuucacauggauagaauuugaaugacccugucuuccauuagugauaguauuaagauaguccaagguggccuccauuuuucuuuacuauuguuaacuaaguugcucuuugcuuagaaggagguccucugguccuuguuuaauacuugcuucuaaugcugccuacuccauuugugcugauacugcugacauuccaucuauuacauguuuuauacauugcuccuuucugaaucaugucuauaucuguauugaauuguguuucuuuuauucuugcucuuaacuaugugucuugauucuuguuguuuucacuauauuugcugcauuugccauuuaguaucauuaacauaucuuuuucaugaauuccaccuuuuagaaauaugguuccuuuuauucuaauugaugccuuuuccucaaauuucauuuccugauagcaauauugucacaccuucuguuugguagcauauacuaaacagucuugccuuuuacauccuaauccuuauuuucauguaugugaacaggagagcaacuuuggcauauuuuuacuuuucacuuccucccuuccacuuagcauguugacgccaucuaaaauuuugucuccauuuuuuaaacagaugaaucaacaauuauguagucguaauugucucacuucuuugcuccuguuuuuccuccccaucucuuccccuuuuguagauucccuuuuuacauuauaaggaauagauccuugaguaauucuuuuuuaugugugcuauuugaugauguauuauuuaacuagguccuaucagaggaacauaaaaguuccaugaggacaugaauucuugucuuuuguuguucccugccuugccuagaacagugccuggcaaauaguaagugcuacauauauauuuuuugaaugaauaaauuguuuauggaaacaauuauaaauugucaaucacauguuacuacuuucugacaccagguauaccccuacaagaggugaucauuauugaugacucaggguccucauuaucucuauugcucuaauuugagugccucuaaauuaaauaguuucaauaugccagguuuaaauuuuucuucucuuuauaucagacuaaaagugguaguaguagaauccucggaguauggcauuugcuggcgccagagguauuccaagaagcaguuccuagaagauguuaaccaaaggucaucagauccagagaggaaggaaaggagacaacaugauuuucagagggaggaacuauccucagaugagggaagggucacuuuuagggaaauaaagugcacaccacacaggugggaggagggaacugguguguguguguguguguguguguguguguguguguguguguguguauacacacauauauaucacagacucagucuuauguacauauugagcagaguuggggaaaaucuaugacuauucaugagggaaaucaggcacuugcauagugggugguaaacauauguaacauacaucccauguucauucuaugguggcguuuuaguauuaaaguaagguggaacuuggcucuucaugcccuguaauucacuuauuugacauaaaggcaauuugugugcagccuucagcugaccaaaacuggcugucuaucaauaaacaauguuuauaaaacagguccucugucuaauuggaguuauggcaggaccacaaggcaggggaaagggguugucagcuggcauccagcagucuaucaggguugguugggaaaauuuccagcuauaguuguuucagcaaugcuucucaggagcugguuucugcuugauuacaggaaaacuuauggcacaacauugggaccaaccccucauccugcuagccaugagauuuucuuuuuuuuuuucauuuucucauguuagccuagccauaggguuuccaucuugucugucugucuguugggguauauuuuaacagagauaugacuuaauagccuggcagaugucagugcaccaaagcuuggaagagggaaaauuuagguuuguaacucauaacaagccgguuaaaaugaguucaaaguugaagaugagaagccaagacagaagacauuauuaccccaaugagaaggcaccugcaacagcuuucuaucaggugugaaugagaaagaagcaaguaauuagcucugcucccucccugaacagugaucauuuuucuuccaucucuaaccccaagucugcccauucuuacuguugagcuaucauuugcacuauuaaucaaucuguugucccaguuaucuauugauucauaaaauaccaccccaaaguauuuugucuuauaguacagugucucaaaguauagugucuuaacacacaacuguuuauuucuuauuguucugucaguuugggucaacaguuugugcugggcucagcugaauaguuuuccacuguucuacucaggaaucacuuuuguagcuucagucauugguagccuuacuagggcuggagaguauaacauacccucacauuuacaugucuggggccuuuaugcuggcuguagauugagucccucucauucgacaugguuucucaccugggcuucuuuacaugguaucaggaauguuccagaaagacaaaaguuggaagcugcaaggucucuuguggccuacacuccagaacuucauaccaucacuucuaccacauucugcuagguuagccuagauacaaaaggguagagaaguacaaaauguuacggcuucauuuuucauaucacaccugugagagccuaccucucagcauuaccuucaaacuugaaauuuucaauauugcaauuuauggguuugcauaacuaucucuucuuauagaauugaacucuuugagggaaggaauuaguuuaucuauaucugcaguauauaacagaggacuuguuaugaguaagaucucaauaaaugaauggugugccagcugguugauacguacauacauauacaugaaugaauauccuguuuuacauggcuaaauucugugauuauaagauuaacagaaaugguacuuugcaaaaacuccaaaguaaauuggaaguaugucuuuuccauuuuaaaauaguagggguuuuuguguauaugucagucaauaaccauagaaugcaguguuccuagaacauacaaauucaucugcauaauagagacuuaguaauguuuccugauucaguucccagaucaaauaaccagaaaugaucaucucuuuucuacaccaucauugucaaauauguuggaccuuuuauaguccaaguuacauuuugucuuuggcguguauuuaaggucagauucauuaccauuugugccaaaauaacaaggucuuaaaaguaguugcaaauguagacccaaauuacuuuguaacuacaguucuuaaaccuuaugucagaauuccugagggccuucugccagaauuggaguuaacaaugaaugcaacuauauugcuugauaguaaaaauagccuacuaguucugccccaguguaaccuuacccuaucugaaugggaguggucugagggggagguacuuguggacuaggauuguugccuauagucuagacaagcaggguagucaaaccuagugucccuuccaaagguagaaaaguuucaguaugaaugaacagaaggaaaaauagcugaggguaaagaaaugaacaaaugaauuauaugagagaaauccaauauuauauuaccuuaaaagaggcucagagcaagagaugacacugucucuuagcuuaauuauaccaaaugccugaaagagugaaccuguauguuuucugagaccacuccugcuuuggaagccugcaaaccugaguggccucacuuuaggagacauauucauacaauaugauggacuggacaaauuacaguauuaaugacuaaaugaauucuaguaaugucccgguaucuuuuaagucauauauucuuuggauguaacagaucccguuagaagacugggaguugacugugauauugugaaauauauauuggucuuuguccccuuuuccuggcauaaaugacgucuuuuuauaugcuaaugaguugacugacagcuggcaaccccuagggagcuucaggauggggccuagucaccagaaagaccaaggcaugacuggaggguugggacuuuugucuccaucccccaaucucuggggagugaaggagggcugaaaguaaauuggucaccagugguuuaaucagucaugccuguguauugaagccuccauaaaaacccaaaaggacaguguuuccagagcuuccagauagcuaaagaugagggaggugcuggaggguggugcacccagagagggcauggaauccccuuccccauaccucuucauuuguauucuucaagauauuauuuaucauaaacuggcauguauaaaaaauauuuugaauaaucuaaaaggccuacuaccuaacagcacuaaaaugaccauuugauguuucacagaauuuuaaaauccuaugucuuaguucuuacauaaguaauucacauugaauuucaccaagauccuaugauacccacuugccuacauugcuguacacuguugcugaaugcugucaagcagcugucacauuauucuuccuguaauuuggaaauugcuauaaauuugccaaauucuuccaaacccuucaggcaugauaaauuuuacauuuauagaaauuauuuuguccaccuggagucuuucagacacuuuuauguaacuguggucugcaaguuaguaaaagcaaauuucauuaagagaccaaaaggacacauguauaugcaaaguuaauauuugcucagacaaauaauccuucaugaaugcacaaugcagauuuuuuguggauuacaucaaagaaucacaaaaugaauaacaaucauggaaggacauugggugaauauuuuagguaaauauuuuuaaaaaccuuuaucuuguagagcuacaagaaaaguagcuaugcauaugaaaucaagucuuaauaccauaaagucuuaucaaauauaaugcagaauuaaauugaacaaagauaaagaaagcuuuccugacuauggaaagaaaauauauagagacagaaaagaaauugaauuucagaucuuuguuucaagauaaaaaugaauuauuauaaaauagaccuguauucauaacuuagacucuauuucaguuuucuacacugcgagcaaucauaggacugaagggaaauuuauuauaaagucaccugggauauuacuucauaaacauagaaagcaacauuagaaauugaaaugggaauaaugaaaauuucauuuuaaaagaauguaaaugggaggcaaggaaagaacugcugagauacauaaaaaagucauuacuucuuuugaauuccuauaaauacugaaaacuguuuuccauuaacagaauacuggugcuacaauaaauauauuuccccuuuguauguugggaccaaaacuacucuaaaaaugcuuuuugugaugauaugccagaugaagaguuugccauuugccacccaggaguguggccuaggagucagaaaaccagagguaaaugugcaagcugaccauguagcugugucugguugggagaauuuaggggacguaguccauuauuggcacucuugguaaaguacaaagucaguggcaucccuuguacaaagaagaaaaucuugcaaagaguuaaccacugcagaacauucaguaucuaaaucuaggugcauuccacuauaauuaggguguauuuauucauuaguagcugaacauuuugcagacuauaaaaauuuaaauguucuugaggcucauuauggcaccuugugcaucacagauuacacaguugcucuguaucuuuaugugccuuuuauaucuuaauuuaggucuuagugugacuauguauaucacuucaugaaauuauaaaccauaacaaaugauuauggaggaauuguuauaugcccuuauagaaaauagaauagaaaaaaaugcauauuuuaguccucccaauauauucuuauuccauagccuaagugccaagucaggggcuuuauuucauucaucuuaaaugggaaagaaaauaguucccaggaacaaaauggcagaaaucuaucuacucagggauuaaagaguauaacuuuuaucaagauaaaaugaauaguauuucaaagaaaccaaaagaacacuaaacacuguggaaaacaaagaacuagagcuuuggagcaaaacagauuccauacucagccacuuaccagcuaugugaucuugggcaaguuauuuaaucucugagccuguuucuguauccauauacaaagacaucuaugccucugagugugauuguuaggauuagggauaauagguuaaguuccuagcauugugccugacacauaauaggugucaaucaaugguuaccaauauucuuacaggguugggaagugugauuucuugguuguaacccacaguuacucagcaaaggcaagcuagaggauacuuccauugcuauaguugagcuccuggguaguggaaaucuuuuaacuuacccucugagugugacuugcauucauuagcugcugacacccacuguuguauugucaacauggaaagcucuuugccaggaccaucuaccaccucugugaggcuagauucaucuggcuaguuacaggaagacagugccuuuaaccuggaguauacaggacguuagaguugaaagggucauaugcuagccaccagcuggugcaccauggacccgugguuccuccaaauuauugcaaguguuccaagugucuauucagcaucaccugauacagaauaaugucuugcauauaucuaucuaugugcacuauucuuuuacuguugugauuaguagaguguaaauucacuucaaaacauugucaaauucuuaguagcuuuucaucauguuguauuuuugcugucagccauuauaaaacaugacaucaggguugauguguggugcaaaggaucauaaaauuguucgacaucauucagcagcccucaugcucagaaaaucaagaacuggugcucucauuuccaggguccaggaaaauauggaacacauaagcuuauacagcuuauuaaagaaaacacugggugaaaacucuguuaaucccuaguccagaacuuccaacaaugcaaauguuuguaucacugcuuauggaaaaaaucuguggaaguauuuaguguacagauuaguaugcaugaaguugaguauugaaagagcauggguuauaugaaagacauuuaaaaugguaucuggcacauauaaaggacucaauaaaugacagccauuaucaugacggcuauucaguaagaagugguuuugucacuuuuuucugucuguugcucagguaacuuauugcauccaaguauaacauuuuaaguuauguuauuugucacucaggcaaguacuucuguuuucacuucauagucucagaaugggagcggguguauguuuuuuaaaucucucuuccagaagucuuuuaggaguagacgcuauugccaucaauacugagacuaacuucugagccagguccuuguagugcauuuuauuguagccucagacagcuaguggccuuuaauuuguuugcuuaagacagagcucaguuuuguuauuaaauuacccaguaaaauuugauauguucaucaucacuggccaucagagaaaugcaaaucaaaaccacagugagauaccaucucacaccaguuagaauggcaaucauuaaaaagucaggaaacaacaggugcuggagaggauguggagaaauaggaacacuuuuacacuguuggugggaagguaaacuaguucaaccauuguggaagucaguguggcaauuccucagggaucuagaacuagaaauaccauuugacccagccaucccauuacuggguauauacccaaaggacuauaaaucaugcugcuauaaagacacaugcacacguaugcuuauugcggcacuauucacaauagcaaagacuuggaaccaacccaaauguccaacaaugauagacuggauuaagaaaauguggcacauauacaccauggaauacuaugcagccauaaaaaucgaugaguucauguccuuuuuagggacauggaugaaacuggaaaucaucauugucaguaaacuaucgcaaggacaaaagaccaaacacugcauguucucacucauaggugggaauugaacaaugagaacacauggacacaggaaggggaacaucacacucuggggacuguugugggguggggggaggggggagggauagcauuaggagauauaccuaaugcuaaaugacgaguuacugggugcagcacaccagcauggcacauguauacauauguaacuaaccugcacauugugcacauguacccuaaaacuuaaaguauaauaauaaaauaaaaagaaaaaaauuuuuuauauguuucugugaacugaagagauuaaaacauuuacuuaaauguuuuuaaucuguacccccaccaaguuccuuuagaccagaaucuuuauuaagagguuuaacaauagaucaauauuuauuuaaaauuugugccuggagauuugguauuucauuucacaauguggcccacaggugauagggagcagaaauauugacugagagaaauuuauaucugacuauacaaauuuaguacccauuucauaaacuauaaaccauccagauuaaucacaguaauuaaaugcaaagaaagguccacuuggguuuuucagguaaauuuaagacaagcuuuaucacuauauguuugguuccgaguuaucucaacauucauauuuaguaugaguucucuuucuuuaucuaggaauaugauuucuaagcuaaagaaaagaauauguggaaucugcacuuguaaauguccaaccagaauucucuuacagggaacucacccaaggaaaugagauaaaagauccaaaagcagcaagcacuucucugugcugagcauggccauuuuaagggaagccagaugacuugcaguauuuuccauaagugauucccauucagucagcugugucaggcaacaacuugguuguuuuguguuccagccauuaggcagcaaccucauugaagggaaucaccacaggccucuguuucuccagagagaggaaucuuacuccaauauaguaaauggacucaaugguugaggcauccaagccaccaguaggaucuuccucugcuauugagacgaaauaacccgauagagaauaaauacagcagggcuuagcccuauacaaauuuuuuuauaaguuaugucugcauuguuguccccacccagugcucugucauaaccuucagaauucucccagugcccaaauugacuauuccuuaaaagccuacuucaugccucacccaggccugcucaaccaguuuucucuuauuuuuucccacugucagaacauaucagcccuguccuccuaaucccuuaagacugugaugucuauucaauuaucuauucaaauaauuucugcuaaaauaugaguaagugguauaauauguaccucccccccccccacaaguaacauacaugcauuuuaacaguggcuuuaaguaaaugggaagacuguauucugagcguccugacagguagcaggagagauccuucaagaauaagcagucauuugcucucacaauaaauaucuguagggcauugaaccaacccugaacaaaaaagcacaaauuaugcucucacucuacaucaguugauagcugcauucaaagaggcgggacuucuguuuucauccucccagaagucuguggcacuggaacaguucuucaaagagagagaacagacacgcuuccauaaugguacuaauuuacagcugcaggcuuccuuuggggccacuuuuagaaauaagugcccuguuaguaaugggcacagaacuugccagagagagguaugaagugcgguaaaggaggucgcaaagggaagagaagaggugaggaacaguaugaugaguggaaaacacagugagaucagcagugcacugaaaugagaaauguagggagauuccauauuuauguauucuguucaaaggaaauaagguagauucugaaauggaaauaagcaacaucugacaugcagaagaagcuggcuagccauuuauuuuuuggucaaucucugaucccaucacuuucagcuaaauaguggcuaugguauugccuuguuuuuguuuuuguuuuuuaaaaaagggcucaacauaccaccucuauugccaaagacaccccaccuugcccaaccucaguuucuuggugugcucuaagagacaguuuaugguuccacuucuguuacugugugcaaaauuuugccagaaacaggcaauccuacuguccuucaucaggacacucauauuguuucaaagccguuggugacauuuggcugcuucauuagaaaacagauuuuuauauguguauuauguagguuguuuuguuguuuuuuagggggcagggagggagucugaagugucacuuccuuuccuaaaggucauccauuuuggcucuuauuuaaaguucaaaaguuauagccauuggccauggguuaaggugugugucauuugauuacauucugaaagagaauuauuagcuaaauugagaagcauaguagguggcuaaaauuacagacucuggagcugcgcugcugggauucaauuucugcuuuccuccgcuuacgggcuuugugaccuugggcaaguugauuagcuuccugggcuucaguuuuaucaucuauaggaauggagaucauaaguacaguaauuucugagugacuuaacguauaaaaagugcuucaaauaguacccagcauauaguaaauacuauuuaaguugguuuuaggagaacuaaacugagugucuuuuauauucaugugaagagaaaauugucaaauuuaguugaaucuaauuagaaagggaaaagaggcagauuccccgaugcauuguuucugaggcuaaauucaagucuuccuaugaugaacguacaguuuuguaugugugugugacuaacauuuauugacacugacuacuuucuguuuaagugguuuauauauuucauuuaauucucacaaaaaccucauguuguagguacaauuauuauccccauuucacaaaugagaaaacuaaagcuaagaguaaguaaauuuccaaaccuccaagagcuaauaaaugauguaauacuuaaaaguugaugcuuuuaccauauauaaaaaaggauugaagacuuaaaauaagaucugaaacuauaaaacuacuucagaaaacauaggagaaaugcuucaggacauuggucuaggcaaagguuuuauggcuaagacuucaaaagcucaggcaacuaaaacaaaaauagacaaaugggacuauauuaaauuuaaaagcuucugcacagcaaaggaaacaaucagcauagugaagagacaaccuguagaauggaagaaaauauuugcaaacuauucaucugacaagggacuaaaauccagaauauccaagaaacucaaacagcucaacacuaaucauuauggaaaugcaaaucaaaaccacagugggauaccauuucaccccaguuagaauggcugucaucaaaagacaacgccaggugcgguggcucacaccugcaauuccaacacuuugggaggccgaggugggagaaucgcaugaacgugggagauggagguugcagugagccgagaucgugccacugcacuccagcccaggcgacagagcaagauuccaucuccaaaaaacaaacaaacaaacaaacaaauaacaaaugcuggcaaggaugcagagaaaaggaagcucuuauacacuguuggugagaauguaaauuaauauauauauuauggaaaacaguggggaaguuucuuaagaaaaaaaacuaagaguagaacauaugauccagcauauuuguccaaaggaaagaaacccaguauaucaaagggauaccuauguuuauuaaagcacuauucacaauagcuaagauaaggaaucaaccuaaauguccaucaacaaagaaaaugugguguguauacauacaugauagaauacuauuuaccuguuuaaaaagaaugaaaucccgucauuugcagcaacauggaugagccuggaguacauuauguuaagcaaaauaaguaaggcagagaaagauaaauacugcguguucucacucauaugggagcuaaaaaaaucgagcucaugaaggaagagagcagaauugaaagguacaggagacugggaaggguagagagguggggaggauggaaagagauuggguuuguagauaccaaaaauauagcuauauagaaagaguucugguguucuguagcaguguagaaugaauaagguuaauuuauucuauauucucaagaaggcagaagggaagauuucaguguucaugacacaaaugauaaauguuugagaugauagauaugcucauuacccugauuugaucauuacauauuguauacacauaucaaaauaucacugucccauaaauauguacgauuauuauaugucaacuaagaauaauaggggaaagaaguaauggaaccguauacucgcaguugucaacaaaaaaaguaaauaaaucugccaaggaguacacuuggccuguguggaggaaauuauuaacauuuucugaaggacaucaaaugauauuagaauaaaugucagaacaagaaauguacaauuaaagucagguuuguaaacaaauauauacauguaguacaaguuuuuauaauaauguauguaucuaaauguauaacaaugagucaaaugaaacuggcaaagucugaugggaaacguuuggucacauucuuuuguguuuaaauuuuuaaagaacauguaucaguguauaagugauauaaaaauuauuagaaaauaacguaauucauguauuuuuaaaaguuggugcuuuuaacuacuguaaugucccccaaauaugcuugcagcuaacuauauaaauacauuuuuauaauaauuauccccuuuuuaucagaauauaguagagcaaaugaaauaugcuucauuuaauccucacucccuggguuguugguuuuaugccauguuucagccagaaucaggaaacuccagggccuuaaagagguuuucuccucauaagugcuaguaguuauuuguggcucaauauuauccagacccagugggaauaguuuuuaugccaaaaaaaaaaaagcaaaaauuucucuaacuuuuuuuacauaacagcauugcaaaggagaacucuggcucagccucauggugauuccuggcuuacuguacgauuugcuguaagagugaacauagccacagaacaagacgugcaccauugugcuuucuagacagugaagaaaauuuacucaucuccauugccugcuggccuuggcauuccuguaacugcucucuguucuuauuuaauccuuaauuaaccugucucauauuauguaugacuuguaagacaccucuguuacacacucagaaguuugaaucuucaaauaagauuacucggcagacauaaauggaacauuuccaucuccuuuuggcagugagcagcauuugcuguuauaucccucugcauguggugagauauagcugucucugauaccucaggugaaugacaacaccagccuauuaugagauuucucaccucugaauucauguaggauuugcagucuauaacacacagguucacacugauuguucucuagcacuuuuaugugugaagaggcugggaguacuagugugucucccaaagugugacucagaacugggcaauaguaggcuuaauaaagaagagaauagagagaaaaggaggaaaaguguaugauugccuuaucucccaaauuagauuguuggcuucuuagcccagacaccauauccuuuuuucugucuccuuuaauacuuauuagaauauuugcaaacugaguaugcagugccugcuuauggccuaaaggccuaagguuuuauuuaaugcauagauuaucucaaaaagaucccauuuccacucacuugaacuuaaugcagcccaaaggaaguagcauuuucuguaaauguuauugaaauuuuauuuacacugaauugagguaucucuaaauuaguuuuagauuggccucucauagaaccgugauucucauuucagaggacaaaucucuaaacuggugaugcaaugaagauaguuaugacaacagaaguguauguagcuauaaaacauagauauuacucugaagaaaguacuaacagugaaauccuauacacgacuaaaguguugcagugacugaaaacucauuccgaccaaggaugauggcauuuggcccacugacuagaguugggaggugcauacuauauugccauuguaccucugccaaaaaaauuaguugacuauacauaugugggucuguuucuagauccucucuguucuauucaauugagcuacaaacauuucuaccaaugcuaaacuguauugagaacuguagcuuucuagugggaucugaaaucagguuagguaaguccuacaacuuuguacaccuuucuuaaaauuacuuuauuuuagagccccucauuuccauauacauuuuagacuccauuuaucuaguucuacaacacaucagccagaaauuuugguugugagugcauuaaaucuauacauuaauuugggcagaauugccauauuaauauucacauauuuuuuaauuaauauucacaugauuuuuuucagucaaguuuuguaguauaaaggacuugucuuuuguuagauuuauuuuuagauauuugccuuauuggaacuacuguaaauggaauuuauuuuccaguuguuugcugcuuacaagaauacuuuguguauuuuugcagccuuguaaaucauuaauucuaguucuuguuauaaacauucccaaagauauucuguguaaaaaacaucagauuuucaaauugaaaaagacauaagagaaaacacaaaauugagaggcagauaucagaaaaguaguaaaauuguuuccaagagaacccuuugacuagaaguggugaaaacagguauccuugcuuugaccucaauagaaaaaaauuuagccuuucaccauuuaaguguguaauguuagggauuuaaguuuuuguguaugcccuuugucagguuaaauaaauuccuuaauauuucuagauuguuuuaccaauggguuugaauauuuguccaaugcuuuuucugcaucaguuggaaugaucaaguuuuucccuccuauguucuguuacucuagugaauaacaucgauuacuuuuaaaauguuaaaccaaccuuguguuacuaggacaagcuccacuugguuauuuguuauuuuuguauaugacuguaucuguaaguuccacaucuguggauucaaccauccagagauuuuuuuuuuaaaauggauaguugugucuguacuaaacauacaaacuuccuugucaucauucccuaaauauaacaacuauuacauagcauuuacaauguauuauguauuauaaguaaucuagagaugauuuaaaguauauaggaucaugugcauaugcaaaucuacaccauuuuauaucagggauuugagcaucuuuggauuuugguaucugaggggggguccuggaaccaaucauggaucccaagggauggcuguauaugaauuugguuauugaauguccuccccaccagaaauacuuuggaagauuagaguggucaggaaagaacucucugaagagagagcguuugggcuaagaaugaaugaagaggagccagcuaugcaaaacuggaagaacacuggaggcaaagcggaacagcuaagugcaaaggguauacagugcaaacaagcuugccucauuuagggaacucguccugcauuuggggacaaaaagaagcccaguauggaugggauauauuaaugauagggagacuggacaagaugaggugggcuagagagagacagggccagaugcagcagaaaaagaguugccaaacucucugguaccucagccacuuuccaaccuuugggaagcccuaagaauugucuuaucagagucuacucaguaucuacuaggcacaugcagcuauuuaauguaacuaaaaguauauaaaaugaaaaauucaguuucuuggucacacuagccacauugcagguguccagcagcacauguggcagauggcuacuuuauuggacaaugcugcucuaggaaagccaaaggagaaauaaugccaacuuugcuuagccucuucucuguaauuuucucuuuuaaagcuagaaucgguguuuuucuauuuaaauggaaauauaugugguaccuagaaaacuagcauguggccuacuccauaugcauauguucucauggauguuuuuuaccuaugacagaaaagaugaggacugguaaaucacaagcauucuuaaccucauuauaaauacauugcaaauguaaaaaugcaaaguguggaaaucauaaaugugaaaguggcuuucaauuuguuuuaauaggcguuuucugugucuuacuguaaccuagggaccuugcugcaagaaacugccugguaggugaaaauaauguucugaaaaucagugacuuuggaaugucucgucaagaggaugguggaguguauucaucuucuggcuuaaagcagauucccauuaaauggacagcaccggaagcucuuaauuaugguaagaauagaccacauuuuuuuuuuaaugguaaaaaugaacggcaucagcauaaaacauucacaagcaauauuuacagggguagcacagaaugcaaguuagaaugauuugaggaucaacacaaauaagugaauuucauacuuuuaauuuguugaaauuauugaucagauuucuauauguaacauugcuauauuaaaaagguagauauaaguacuuuuaaauaugacuauacaucugagaaagaguuuuuauaccaaaaaaaaaugacuuuguaauagauuauacagaguaagcguuguuguggcucuggaccauuucuuucgaaugucuuauaauugguccaauaaccucaucugauguuagguuccuaaaauauuaagucaaucaguucuuuaguuucucacucugaaaucgacaugguuucuuagcaucucagucuguggaacugauauaaaucuugagcaaagaaggagaugggaauuacauuuuaaaacggcagggauuuuuuucacuugaauuuuuaugcgucauuguaauuggaaauaaauauaacuugcauuaucugugguugggaugaaaugggccauuacaagauggaugacaacucaagaauuuaagagaaaaaaaaagugugcuuuaaauaaaauuagaaauuauauuuucauuaagggaagcagcauaugagccauggauuggugaauggguaugguauguuuugaauaaaaauguaaaaugauucuuuguugauuuaaaaugaaaaauuaccucauuauggaaacuaauuuguaaagcauuuauaaaugccuuaauuuaauucccaaauuagagaaagcuuuuuuaaaaaauugaggugaaauucacauaccauaaaauuaauuacuuuaaagugaacaaucauuggcauuuaguacaguucacaauguuguauaaccaguaccucuaguuucaaaacauuuucaucacuccaaaauaaaacccugucaccaauaagcauccuccucccauucuuccguuccguuguccccuaguagccaccaaucugccuuuuauuucuguggauuuaccuauucugggaauuucauacaaauggaauuauacgguaugcgauaucuugugucuggcuuauuuuacuuagcguaagauuuuugagguucauccaucuuguaucauguaucaguacuucauuccuuuuuaggacugaauaauccauuguauggauauacaaccauuuauuuauccauuuuuguauauuugggcagguuucaauuauucuggguauauacuagaagucauaugguaauuuuauguuuaacuuuuugaggaaccaccaaauguuuuccagauaaagcuuuugaauguaauugguuuggaaguugauuggggcugacccagcuaccacagaugcuaacccucacccuuaguuugucuuucagcgugucagcaagagagguucuuucuuaugagcuuucuagugauugcaagccaguuccacuauuccuuagaaucuagaaaaaauggcagagcugcuauuuuccauagugauuccucucuggggugauuguuguuauuaacucuagggucagauuauauuacuaagggggaugaucacaggauaaaagauagauuauaauacucaauauuuacacaaagguuuuuguuagaugacaaaacauuuucaagcacuaaggaagcuguaacugggcuugggaguccuugaauuugcucuuaacucugccagauucucuguguuauauagccuuuaaaaguccucuuacucuuaaacaauuuugccaaguaaaauucugccucuugaucacgguauaguuuuugaauuucaagcugacuaaaguguuguauuuacaaauuaaaguuucaauucuggauauaucuaacagccagacccaaagcauuuuaaguaaguaauaaggacaagucaagucuaaagauuuuuuuuaauugagacagggucuuacuuugucacccgggcuggagugcggcggcauaaucauggcucacugcaaccucaaccuccagggcucaagcaguccucccaccucauccuccagaguagcugggacugcaggcaugagccauugcgcccagucucugaagauccuugaucuagagugagggacuuuuuuaguagacuuuaguaaauuuuaugaaacguagaacaauuuagaugacaaggaaggagagauuuugauauaggagacguuuauaguauuuaauacccaguccaaugagagaguuccugaaagacucuacaagccuucuccuagcaacccagagaaguuuaguucccacagacuacaguuacugaagauugacucuaaauccuagcguguuuuuuuuuuuuuuuuuugagauggaguuuugcucuguugcccaggcuggagcgcagcagcgcgaucuaggcucacggcaaccucugccuccuggguucaagcaauucuccugucucagccuccccaguagcugggacuacaggugcccgccaccacgcccagcuaauuuuuguacuuuuaguagagacaggguuuuaccauauuggucaggcuggucucgaacuccugaccucuggugauccacccgccuuggccuuccaaggugcugggauuacaggcgugagcuaccgugcccaauccaauacuucuuucauauaugaaagcaguauauacucuuucuucacucuugucucacucagaauaggugaaacacucaaaucucccauguaguauggggucgggguggaugaaagaaaccuccaguccaaggaaccucucugaaacugucuuagggccacagagccaugaucaugccacuacaugccagccugggcaacacagcgagacccugucucaagaaaagugggggguggggcauagaauuaaaccuguugucacugcguuaucauaaguguuguuuuuguauauuuggcuuuaaaaagaaaaucaagcaauacuaaagggccuucccagcccuauugcuagccagaucauuuuccuuccuagaugaaaauacucuugauacagucucauacucuucucauaaguggcugagaaaucuuuuuguaugugucucucucauauacuuuaaaaaaaaauacaaaaugguagaauacucaacaccuguuuggcauauauugcuaccauccuuagucacagcugucaccaaagguacuguuuuuauaaggggaaaauagaauacugaucuccaacuaagaaaucauaaaucaucuauuuaucaucaauuauugaacagaaauuuuccuuuugucaccuggguauuuggggcugauauauccucuaauuaguuauauuagcaugauguaacuaaguacugugaaaugggagggaggcagaauuuuuagugagcagguuucccaugccauuagcugcgugacccuggcaagccaucaguuuguaagauaagaacaauaggaccuuuucccuauagaguauuaugaagaucaagugagacauagaaaaguagccaaaugcuauacaauuguaaguuacucuuggucuguuaaaauuacccaacaaaaccagguucaaagauccagguuucagagcuagguuauaagcuuuuacuuccagaaugugaucuugcuuuauauguaauaugucuuuauugaucucugcccagauauuaucuuacaaaauaagauaugagucuguauaaccuacauuuucuuaaagaauuagucuuaacuuguagccauagaaugauuuucaugaaaaguauuaaauuauugaaugccaagcaugaaaugauaggcagacaagaaaauuaaucuuccacccaaaaauguccauaauuacuaucuaucuacuaagaaggacgcuacuucacacagcuggagcugauaaucaguuaguacaaccccacucugaugucagagcaguuauuauagcaggcauacucugguuuucacuaaguacuuuuuuuucuuuuuuuaagaaaggccauccuguuuuaaaguaacaugacaguuuuggaggaggaguauuuauaaauccugcaguggcagaguuaagacaggaaaccacaugagggauagaaaaugaaauaacuuaagaaaucuuuaacaccacuguaaauggaguuuaguuaugauaguauauguaaaaguaaaaaauacaaauauguugggaacaucuuggaaacucuuagcuucuuggagaggcuggagauuggaaaaaacugaucugcuuccccuccuuuauuccacguccaucuccagaagacaaccuugugcugguuuguaucuuugugcuucucuaggagacuaccaaaaaaauucuuagagcuuagcucauguagcucaguaaaacaggugcaccuagguauuucaacaaaacaaggcaccaugugauuuaaagacguuuuuguuagccagcuauguuaauuuccacuguuuaaaacacacauaaauauuuuucguaaaugaaacuaucagagaaaaugagaccuuuaagcauguaagaacaucuguaaacagcaaugagugaaaaaaugaagaaacuuuccuaauugcuuuaaguuuguuuguaauuuuaauggaaagaaaacgaaguaggcguaagacaaaaucgcaggaauccaacuugguuaaucuccuaggauugauaacguaaaaauguauaucuuuuuaauauaagccaucuaucucauucagauaccacagagaaaguaagcuugcacacuggcugaauauuuauucuuggggggagggagagugauuuggaggcuaguuugauuaaacuagcagccugaagaauauuuauuuaauugguaauauuacuagaccuggaauguaaaaccaguaaagagaauaggaagacugcaugucgaacucauuugguaaguuuaaauacagucauguaucgcuuaaugacagggauacacucugagaaaugcgucguuacgcaguuucaucauuccaugaucauaggguauacuuacagaaaccaaguacacaucuaggcuacaaaccuauauagcauguuacuguauugaauacuacaggucauuuuaacacaaugguaaguuuuuguguaucuagacauagaaaagguaauguguuauacuaugacauuaccauggcuaccacaucacuaggcaauaggaauuuuuuagcuccauuauacugggaccacugucauauaugugcuccaucauugaccaaacaucauuauguggugcaugacugacacagacauacauaaccaggaagggucaccuacuugucuacugugccucaugugguuaugguuguuguuccucuuccagggagauacaguucagagagugacguguggagcuuuggcauccuucucugggagaccuucagcuuagggguuuguccguacccuggaaugacaaaucagcaagcaagagagcaaguagaaagaggugagccaaguacauucauuguuaguguucauguccagccccagggguaggcagugcuuauagugugucugcuugaggagggguguguuaaauacuguuugguuguguuaugagaccaucucugggguucagaagcagauuuaucuaacaucucugcucuuuauccaaacacuuugaaggauuucaaugcgagagagagguauauaggcuuuucuuccacccuuucccugucuggcaugacagcugcaggauugugcuguucacugucguuaagagaaauagggugguguuucucaaacucuuguauucuaugccagauaaaccuccuuuuaaauaauauucccaauugaaaugcaguuagucuucaggaagucuuugagaauaugacaacauuguagcacuucugaagaaacccuuugggguuccuagaccauagaugggaauaacuaaguaauggugacaggcuugcaugcacuuguguagcauacagucucgacaaaaagaaagcucgugauaaaauacugugcccuaaugucugguccccagugaggggcaugguuguagaaguggaugaaggaagaugccuuucuaacuuccuuucuaccuucuccuaccuuuacacacuacccaaugcacugcugaaacacugccaaccaacagacgguaaaagaauaugacucauauucauuuuuauuucccuauugaauucacauuuauaaaauccucauauugaauucacauuuauaaaauccucaucuucucuucaucuugaaaaacacagaugauuuuuuaaaacuguucacaggaucuaauucugaaagugaauacuuagagcaacuaaaauaugcauuuguauuguaucuuacaucagacuuucugagaaaugaacaaauaaaaaauguucuuugaauuagaacucuaagacucuguaauauugaauucugcaucaccuguagaaaauaaaaacucagccuccccagaaauggauguuuuguuuccauauaacuacaacauaagguaccaaaaguuaauaacugcauaaugcccugugugaacauuuugugucuuaccuccauucuaaauucuguucuccuucucuugggucuucaggauaccggaugucagcuccccagcacuguccagaggauauuuccaaaaucaugaugaaguguugggauuauaaaccugaaaaucgcccuaaguucagugaacuucagaaagagcucacuaucaucaagagaaaacucacauagugacaggauggcgccaaacucagccuucaggacucuguccuccagcagaguaacauuauuguucucauuaacaaugaauuuauaccacauuaccuuc

SEQ ID NO: 192718 - RNA, 75266 nt, Homo sapiens
accgccgccgccgccgccacagccgccagccgcuucgcguucggcgggggaggaguuggaggcggagaagaaggcggugguggcggguggagguucgagcgcuguucucgcuccggagccgcugcacauuucggugaggguuuuuuuuuuuuuuuuucagucuggcuuguuccgcugucgggagugugggggucggggcgaggaaauugcugcguucagcuccucaguuucucugucucuagcuucggaaggagcggggcuugucccuggccugcugcgccggccauggugggugggguugauggcugugggaggccuucuucgccuccugggcccuguccagcccggacccgggccgcgcuccuauccgggacggucgcgcccgccgccccccgacagaugacauugguugguaucggggucuucgcugccgcucuuuacugcugccucuucugcuguccuuggugacuuggccaaggagcccgcuggcuuuccccuacacucgccacuguacaagaguuugccccccaaccaacaccucacacccaccuucugcgguuucccgucaccccgcguagagcggaaccaucuuacgccacaggccugcagcaccccucccccgaggagccuucuguugccgucguuuugcugggcgucugcauuuuccccgauugucagugaggcucggcacgcagacaccccgcucgagccgcagcagucgcucuacucccgggaucagcaccuuuccgccagggcugcucucaguuagcgaugucaggccagagcuccucuugcagaugcaccuuuaauuuggccucccucagaugacugguaaucauuuugcgcacauucaaaauggugagguuaaagacgcucagaccaaguugaagcaaaggggaggugguaaauagucguuuugcagggaggagaguaaucugagaguuccuucuccggacauuaaaaaaaaaaaaauuuacauccgcauaggcgcuucuuuugagucugcugguucugugaaguuuaaaauuuucauugcaggcuuaauguauucuguuuuaucaugaaauauuuggucacauuucuuuaaaauggcagucaccuuugcugaaggcuacggaucauuugaaguguaugugaauaaaccugaggauaacaguaauaaacguuuaaacuguauuuuucaguguuguaauugucuuuugggguucaugucauuuuuauaugagaugaccacuuaauuuuaaaaauucauugcagacaugcaaguuugauguacacuucaacaauauaaauaacggacuguuagguaaaauuuaaauauuucuuuucaucccccagucccacuccaguguaaaguugacaguuuaguguucauuuuucaaaaucuugcaaaugcacuucuagacacauacaaguacacguaaaguuuuuuuuuuugagggaggcuauaccauauaccaaacauguuugcauaccgcuugcuuauugacuuaauuacauauguuggacauuuuuacuuuuuacauauaggucucccuaauacuuuuuaaaaggcuaacugguaucucgugaguuugaaugggcuauaauuuauucuauucccuuuuugaaagacauuuaauugcaguuucuuuuugcuauuacaaaugaugauuuauaaugaaaauaacuuucuaauuuauugaucgauguuuaauuacaaauuuuaauucauccuugauuuuaaaaaauuaaacaguauggaagaauguaagguaaaaauuaccgcuuccacuucuaguccugcuugcaucuugauugucagccacuguuaacaauucaguaaacuuccucuaugugugauuauuucuggagcauggguuccuagaagugaaguugcucaguuaaaagauuaugcauauuuuaaauuuugguaacccuuucucccucuuuauuacucuuguugaaaauauucuugaauguuucuuaugcauuucuucuucuagguaaacuuuagacugaacuaaaaauccuuagcuauuuugaauaagguuauauugaaauuuuagauuaauuuggagacaacugaucuuuauaguauugagucucucuccucagaaauguggccucuccauuuuauucacaucuuguuuuauacuguuagggaaauuuuuauaguuuuucuuuuuuuucuucauacguauaacauuccuuccugguauuccuauuuuaugguuugauucgugugguggauggaaacuuucaguaacauuucucucucucuguuuucucugguuauagcaaaacuuuugaguuuucuaucauguaucagauuauuuuauugaguugauuaucaggagauauucacaguuuugugguuuccuuuucaguuuuuauaacuuauguguuuuucucauugcuuuugcaauuauacaucuuauaaaauguugagcacugguagauuaaaaacuaauagcacugauagcuaacaacaaacauggcauuguuucugacuuuaagggggaaugcuucuaauguuuuagcauuaauuaugauguuuggugaagcuuucugguaaagccgcugauauuaaaauauuuccuucuagucuuggcuuuccaagaugcuuauguuguuguuuuugacauuuuuaaaaaccauaaaugaguuuucuuauauauauuuuuuugacaucuuuugagguggguauaugugggcaucaccaguauucccugguuuauauuuuccugagagagcacccucuuagaaaaucaaccuuauugaggauaacuuagauacaguaaaauguacuuauuugaaauguacaguguauuuuguuuugacaaauaugugcucugugaccaccaccacagucaagaguggaauauuuucauaccacaauuaagauauagaauauuuucaucucccccaaaguucccuuuugcagucaaucacaauuucacccucaggacuaggaaagcacuuaucaucuuuuucuugcuauaaauugguaucauuuugucuagaauuucauguaaguggaaugauguaauacauacucuuuuguaucuggcuuuuucucuuggcauguuuuucaggauuauccauguuuuucuguauuuaacggguucucauuuuauugcugaauagaaguccuugguauugauuuacuaguuuguugaccauuccaccuauuuacagauacuuggauuguuuccaguuuggggcuguuauuaauaaauagccuucauuuguugaacauuccuuuauucaaugaacauucauuuauuuugaauuuuugugaacaucuuuuuuuucuugguaaauaccuagacauggaacuuguuggguuguaugauacauggauguuuauaagaaacugccaaacuguuuuccagagugguugucacauuuuacauauccaucagcaguguaugacaguuccaauugcuccacaucauccucagcacuugguuauuucagucuuuuaaauuuuagcccuuuuaguggguauauaguaguaucauacugggauuuugauuugcauuuaccagaugacuaauggugcugagaauuugcucuaguguaugucuuccuuugugaaguaucuguugacauuuuuugcucauuaaaaaacaaacaaacaacaaugggugggccuggcgcgguggcucacgccuguaaucccagcacuuugggaguccgaggcaggcggaucacgaggucaggagauccagaccauccuggcuaacacggugaagccccaucucuacuaaaaauacaaaaaauuagccgggcgugguggcggauaccuguagugccagcuacuccggcugaguuaggauaauggcgugaacccgggagguggagcucgcagugagccaagaucgugccacugcacuccagccugggcgacagagcgagacuccgucucaaaaaaaaaaaaaaaaaaaaauggguuugucuuauugaguuguaagcauuuuuuaauacauucuuuauacaacucauuugacacacagagauacauaaacacacacacacacugcaaucugaagcuuguuuuuuuuuuauuuuccuaacuuuaaaagaagagcuuuuaauuuugauaaauucaucuuaccaacuuuuucuuaugauuugugcuucuguguucuaagaacucuuugcuuaaugcaaaguugugcagauuuacucuuaggauuuuucuauaaguuuucuaguuuuggcuuucaugucaaggcacauuauccauuuuggguuaguuuuuguauaugguguguaguaagggucaaggcucauuuucuuuucaaauguauauguaguucuagcaccauuuguugggacuacuuuccuuuccccauugaauuaacuuugucaaaagucaguugaucauauauguaaaucuguuccuguacuuuucucuugaucuuuaugccuauaauuuugccaguacugaguuaucaugguuauuuuuacuuauaaguauugaaauuagguaauaugaauccuugaacuuuauucuuuuucaaaauugccuuggcuauucuaacuuuaccguaaagcuuuuagaggcugcguguugguuucuacaaaaagaccugaagggauuuuaauuugguuugugucgaaugcauagaucaauuuaggaagaaucgacaucuugagucuuccaauucaugaauacagguugucuccauuuauguaggucuucuuucauuuccuuugucagcauuuuguaguugcagcaugaagauguugcucauuuuguuggauuuauaucuaaguauuuaauaauugauaccauuauaagugauaauuuucuuaaauuuuaguuuccaguuauucacugcuauauguaaaaauacaguugguuuuugcauauggaccuugaugcuugcaaccuugcuaaauucauucauuugaguaaauuuuuuguagauucucuggaauuguccuauguagacaaucauguuauuugcaaauauagaucaguuuuauuauuuuugaauuuauauguaacuccuuccaccuuuucuucuucuuagacuggcuaagaccuccauuaugauguugaauagcaguggugaaagcagauauccuucucuguuccugaucuuaagaagaaagcuuugaaucuuucauuauugagugugauagaguggugcuauagcuugaaugcuuaugucccuuccaaaauucauagcauugaaacauaauccccauugugagggggaucucaaggaggugauuaggucaugaagcuucugccuucauuaauggauucgugugcuuauaaaagaggucccagagagcuccuauccccuuaugccguaugagaacacagugaaaaaacugcagucugugaaccaggaaguggcucucaccaaacgcugaaucuaccagcaccuugauuuuggacuucccagccuccagaacugugaaaaauaaauuucuuuuauuuuuauuucuauuuuuuuuugacagagucuugcucugucggcuaggcuggagugcaguggcagucucagcucgcugcaaccucggucucccaggcucaagcaauucugccucagccucccgaguagcugggauuacaggcguaugucaccaugccuggcuaauuuuuguauuuuuaguagagacgggguuuuaccauguuggccaggcuggucucaaacuccuuaccucagguaauccaccugccuuggccucccaaagugcuggaauuacaggugugagccaccgcgcccagccgagaaauaaauuucuguuguuuauaagccacuucagucuaugggagcuuguuauaggaguccuaauggacuaagacaaguggccuuuuaucauauugaggauguucccauucuauucuuggauugcugagagguuuuuguuguuguuguuguuguuguuguuguuuuugagauggagucuugcucuguugcccaggcuggagggcaguggcaccaucucagcucacuacagccuccgccuccuggguucaagugauucuucugccucagcccccugaguagcugggauuacagguacacgccaccaagccuggcuaacuuuuuuguauuuuuguagaaaugggguuuuaccauguuggccaggcuggucuugaacuccucaccucgugaucugcccgccuuggccccccaaaguguugggauuacaggcaugagccacugcgccuggcagagaguuuuuuuuuuuuuuuuuuuuaaaucaugaguggauguugauuuuagucagguauuauuacuguauuuauugagaugaucauaugguuuguuucuguguuaaugugaugaauuacguuaacuuauuugcgaauguugaaucaucuuccauucugugguuaaaccucacuuggugaugguguauuaucuacuaucauuuuuauaaauuggugaaauuuuuuuuuuuuuugcaucuauguucaugaaagauacuuuuucauauaaugcugguuucauagaguugcaaaguguuucuuauauuuuugaaaaagaauuuauuaggauuaguauuauuuguuuuacaauuuuuuuuagaguuugcaugugaacucuucugguccuagaguuuucuuugcuggaaggcuucaaaggauaaguccaauuauccuuuaauaaauacaggauuauuaggguuaucuauuucuucuugaaagcuuucggucuuuguaugaaucacuuucacucacuaagugagcguuaguaguuuuugucuuucaaggcauuugucuuauuucauuuauucguugucauaaaguuguuucuuaauuauuuuaaugccuauaacgucuguaguggugucuuuccuuucauucuuguuauuagcagugugaccucucauuuuuauuugguucuagguuuauuuuauuaaucuuuucagagucaacuuuuuauuugauugcuuuuuuuuuaauuguuaguuuuauugauuucugcuucuuacuauuucuuucuauaugcuuuggguuuaaauuccucuauguuaauuuauuaagguguaagcuuaggucauugacuugagaccuuuuuucuuuuccuuccaagcacugccugaggugcuuacacaaauuugaugcacugauuuuuuuuaaaguucuuaugucacuuccacuuugacccaugaagguugcuguuuaauuuccaaauauuuggugauuuugcaugucucuuucuuuguauaauuuauuuuaaauucuuugauauuuguuuuaugaccagaauaugguuacucucaguaaaugucccauguacacuucaaaauaauguguauucugcuguuuagcaguggaguauucuauaucaaguugauugaugaugcuuguuaggccuucucuuuccuuacugaguuuuuguuuguuucauugaucauugagagaagaguugaagucuccaaguauaaugguaaguuuguuuauuucuccuuuucaguuuuugcaucauguguauugaaccuccuguuaggugcauguaaauuuaggauuguuaaaacuuuuuggugaaugaaccccuuaaucauuauauaaugcccucuuuaucucugauaguauuccucauuccaaagucuacuuuaucuaauauuaauacagccucuccagccuccuuuuaguguuuguauauuauuuuccauccauuuaaucugucuuuuauuuaaaauggguuuguucuagacagccuuuuuuaauucaucuugaaaaaucuguuuuuacauugaaguguuuagacuauuuacauuuaauguaauuuugauguaguuggauuuaaauauacaaucuuaauuguuuucuacuuaugugcucucugaugccuauuuuugagugcauuuuaucuucaccauuggcucacuacuuacacucaacuuuuccucucuuuuaaaaaguuaauuggcuucucugugauuuauauuuuacaucuuuaauaauagaccauauggaagcaauacuauaccacauuuuauauagugucagagcuuuacaacaguauauuuacaauguauauuuacaauuucuccuuaucuuuugugcuauuacuguuuuaccuuuuacaaaugccauaaaugcauaauaccuuguaauauuuguuuuauuccugugcugucuaguaugguagucauuagccaguguagcuauuuaaauuugaauuuaaaguaguuaguacaaguuaaauuaaaauugauuuucuguguuauaguggccucuuuuccagugcuuauucuuucugcaugaagaacuuccuuucacauuucuuggacuucaauucuacugguaacaaaguuccaaagauuguuucacaaauacuuuguuucacuuuuucuuuugaaagauuuugcuggauauaaauuuauuguucacaguguuuuucuaauauuaaggaugcuauuuauuaucuuuugacuugcacaguuucaaauaagaauuuggcugugauucuuauuuaguuccuuuuuucugcugucaguaucaaauauguuuuaucagugguuuuuaaauuuuauuuuauuuguuguuuuuuuuugagacaaggucucgcucuguugcccaaguggagugcagugguacaagcuugucucacuauagccuugagcuucuagacucaagcaauucucccaccuuagccuccaaaaauccugcauuugcaggccugagccacugugcccaggcugucauugguggugguagcgguuguuuuugagacagagucucacucugucgcccagguuggagugcaauggcgccaucucagcucacugcaaccucuaccucccggguucaagugauucucaugccucagucucccaaguaucugcgaucacaggcucccgccacuacgucuggcuaauuuuuguauuuaacaggguuucaccauguuggccaugcuagucucaaacuccuggccucaaguggucugcccuccuuggccucccaaagugcugggauuacaggcaugugucauuugguuuuuuuguuguuguuguuuuguuuuuuguuuuugagacagagucuugcuuugucucccaggcuggagugcaguggcgccaucucggcucacugcaagcucugccucccagguucaugccagucuccugccucagccuccugaguaacuggggcuacaggcacccgcaaccaugccuggcuaauuuuuuuuguauuuuuuuaguagagacgggguuucaccauguuagccaggauggucucaaucuccugaccucgugauccaccugccucugccucccaaagugcuggaauuacaggugugagccaccaugcccggccauaucauucguuuuuuauagcagguuaaagauguuaacaucuugggauauguguacauuuuuguguguuuuguauuuauacugcuuuuguaggggggaaucacugagcuucuugggauuuaugaucuuuuaaauaauguaugaaaaauucacagcaucuuucucuucuaauguuuccacugcccgcgacacccccccgcccuuccccccccucccccugcugguuugcucucuuuuugugggguuccaguuaaacucauggcagcucauuuaaugcaguccacaauucuuggaggcucuguuuugguuuuuguugcuguuguuuuuuaacauguuucuuuucaguuaaaucacuuuuuaucuaggcuuggaucauuucuuuugacuuaucuuuuucuuuuuuuuuuuuugagacagucucaguccaucacccagacuggagugcaguggugugaucuuggcucacugcaaccucugccucccgacuucaagcgauucuccguaccucagccuccugaguagcuggaauuaugggcgugcaccaccacgucucacuaauuuuuuguauuuuuaguagagacggguaucacuauguuggucaggcugaucuugaacuccugaccuaaagugauccacccaucuuggccucccaaauugcugggauuacaggugugagccacugagccuggccugauuuaucuugagcucacuaaaagcuuccuccccuaguuuuuuaaugagcccauagaaugcauucuucauuucuguuaacuguuuuuuauuuuuugcauuuccauuuucaucucuccugaaauuucucaugaguugaugcauguuccuaccuuugugcuagagccuuuaaaaggguaaucauaguuauuuuaauuuucuucucugauaauucuguuaauugcuuuaucugguucuguuuguuguugucucuugauaaagaggguuuuuuccuccucagcuuuuuugucuuguaauuuuugacugaauggcagacuuuauaugcagaacaguagagauuguggcaaauaauucuuaugucuggaugugagucugcuucugcaucugcuaggcuuuuaguguggugugggguugauucaaucuaauucgugauugagauggguuuggauuucguuucugugguugcauugugcuuaguguuaccuugugcuuagugugacagcugaagugccugauuuuucuaaguguuccuacuucacugucaacuuucagcuuucucugugugcccauaccucaguggagaaguuucuccacacacugucauuauccccagcaguagacuguuguuucuugaugcugacuagccuggagauggaggcagaguuuucucugucuuccuuaucuguacucaguguuacacaagcccuuugucucuuguuuuuggguaugggccaaugaugcuguaccuucucuccaugguagccaaacucugccucauaucuuuuuuuuuuuuuuuuugagacagaguugcacucugucacccaggcuggagugcauuagcgugaucucggcucacugcaaccucugccacgcagguuaaagcgauucuucugccucagccucccaagcagcugggauuacagccaugugccaccaaacccggcuaauuuuguguuuuuaguagagaugggguuucaccauguuggccaggcuggucucgaacuccugaccucaggugauccucccaccuuggccucccaaagugcugggauuacaagccugagcccugcacccggccccauuucuuugauagguuuugugcaggagagauuuucugcuccuuccccagugguagcaaaucuucaguguacugguauaggagccuggacuauaaacuguuuccugacucugcucuaggaguaaaggucuuuuucuuuuucuuuuuuuuuuaaauuauacuuuaaauucuaggguacaugugcacaaugugcagguuuguuacauauguauacaugugccguguuggugugcugcacccauuaacucgucauuuacauuagguauaucuccuaaugcuaucccuccccccucccccaccccacaacaggccccggugauguuccccuuccuauauccaaggguucuccuuguucaguucccaccuaugagugacaacaugugguguuugguuuuuuuguccuugcaauaguuugcugagaacuaaugaugguuucgagcuucauccaugugcccacaaaggacaugaacucauccuuuuuuuauggcugcauaguauugcaugguguauaugugccacauuuucuuaauccagucuaucauugauggacauuuggguugguuccaagucuaugcuauugugaauagugccgcaguaaacauacgugugcaugugucuuuauagcagcaugauuuauaauccuuuggguauauacccaguaaugggauggcugggucaaaugguauuucuaauucuagauccuugaggaaucaccacacugucuuccacaaugguugaacuaguguuccuauuucuccacauccucuccagcaccuguuguuuccugacuuuuuaacgaucgccauucugacugguguggagaugguaucucauugugauuuugauuugcauuucucugauggccagugaugaugagcauuuuuucauaugucucuuggcugcauaaaugucuucuuuugagaagugucuguuccuauccuucacccacuuuuugaugggguuguuuuuuucuuguaaguuuguuugaguucuuuguagauucuggauauuagcccuuugucagaugaguagauucuuuuacucauacccuagcagcaauggaggacagagauugcugcccuucccuagugguuuaaaguuguuguuggccguucaccguggcucacgccuguaaucccagcauuuugagaggccacgcuggguggaucauuugagaucaggaguucaagaccagccuggccaacauagugaaacccuguuucuacuagaaaaaaaaaacaaaaaauaucugggcguaguggcgggugccuguaaucccagcugcuugggaggcugaggcaggagaauugcuugaaccugagaggcagagguugcagugagccaagaucgcaccacugcccuccagucugggcaauagaacgagacuccgucucaaaaaauaaaauaaaaauaaaguuguugcuuuuuuuuuuucuacuaggagaaguguugaggaaggguuucauucauuucccuuguuggcagucaguccguuucacaacugaacugggaaugacacuccagcuuucuauacccuguagaaguggaacuccuacaaguggugcauuucuaaaauuaacuuuuuauagcuguuuacuguagugacuuuuguaucuugauguuauagcugucugucuuaaucuguuccugcugcuauaacaaaauaccuaagacuggguaauuuauaaagaaaauaaauuuauuuuucacaauucuagagccuggauguuccaaaucaaggugccaguggguuuaguguuuggugagggcugcugucugcuuccaauauggcaccuguugcuugucuuuacacagcagaaaaugaaagagcgaaaagggcuaaguaguuucccccagccuuuuauaagguacuaguccauucaugagggcagagcccuaugacuucaucacuuuucaaaagaccccaccuuuuaauaccaccgcaauguggauuaagaauuuuggaagauggcacaaacauucaaaccauagcacugacaauaucacuaaauuuucuuauaugucucaauuuuuucuuuuauauuucuuuucacuuucuuuaguagacuuuuaguuuuacuuuuuacagauuccuaguuucauugguaucgguuauuuuccucuuucucccccacccccacccccaccccugccuuuuuuuuuuuuuucuuuuuuuggucuugcgaugguuagaacuuuacauguuaggccgggugcggugcucauccccguaauccuagcacuuugggaggucgaggcagguggaucacgaggucaggaguucaagacuagccugaccaacauggugaaaccccgucucuacuaaaaauacaaaauuuagcgggacgugguggcgcaugccuguaaucccagcuauucaggaggcugaggcaggagaauugcuugaaccuggaaggcagagguugcagugagccgagaucacgccacugcacucuagccugggccacagagugagacucugucucaaaaaaaaaaaaaaaaaaaaaagaacuuuacauguuaaguagaaguaaugauugguauuuuaagaagaaaaugaugcugacauuucaccauucaguauaauuuugccguaccuuuuggacugauuaguuuuauaaggcuuaguaaauuauuuuccauuuuugguuucuugagaguucuuuuaaacuuuaaugaauguugaauuucauugaaugcuuuuucuccauccacugaaguguuuacuaaugaaaauagaaguaaucauaucuaaugaugagucuuuugcaguagacucaguauauacuguuuucaaauauauugcuguaauggcuugcuaauaucucagacuuuuucuuucuuuaucacuggaguugacaucuaauuuuuuauuuuuguaaccugucugcuugucuggccauuucuuuuuuuuucuuuuuuuuuuuuuugagauagaguuucgcucuucuugcccaagcuggagugcaguggugcauucucggcucacugcaaucucugccucccggguucaagugauucuccugccucagccucccgaguagcugggauuacaggcaugugccuccacacccagcuaauuuuuuguauuuuuaguagaaaugggguuucaccacguuagucaggcuggucuugaacuccugaccucaugugaucugcuggccucggccucccaaagugcugggauuacaggcaugagccuugucuggcuaguucaugaagauuuuacucugcucuuaaaaugagcuacaugucuuuaaaacaagcuuaugaaauccuuuucuauucucuggacaaacagguuuagcacuggaauuaucuauuuguauauuuggauagaaauuucuauuaagaccugugggccuauuguuuuccuugugggaagauuuuuauucccucccccgaagucagggccuuacucugucacccaggcuggagggcaguggcacaaucacggcuuacuucagccuccaucucccaggcucacgugaccucccaccucagccucgcauguagcugggacuacagcacacgccaccaugcccgucuaauuuuuauauuuuuuauagagauggguuuucaccauguugcucaggcuggucuugagcuccugggcucaaacuauccaccuucuucaucccaaagugcuggaauugcaggcaugagccacugggcccagccuagugcuguccuuuuaaguuauauuuuuauuuuguuaauucuugucaacguuauuucucauguauguuacacuuuuuauugugaguucauauucuuugaaauuuuacaugugagaauucugaccuggguugagagugaggugacuuucaacugggaggaauuagcuuugcuucugccggguacuuggaacacugcucccuaagacuuaacaauauucugacuuucuggcuuguuggcucauacagauaguaugaauugcagccacaaaucuaaugagguugaguuguggcuuugaauuguuaggcgagauauuccuccucuuuucuacuauucacccccuacccagaguuaagacauuuuuauuugcuuugaguugugagguuuaaaaaaaaauuuuuaucugccauacuguuagaaacagaaauugagaaguugaauuuucaugagaucuuguuuuauauauguguuucuuauucucuaauguuuaucugugugguuagaagaaggaucucauguccuagguuucccaggauaauuccacuucacaccuuauauuuuugucuaauaauuaauugcauguuuuugcauucugaagugucuuagacagccuaguuuucagugguccauaaaaaccuguugcuaacacagugauuaaacauuuuucugccaauuacaaaaggagcacaagugugugaaagaaaaguuggaaaacaaaaaauggaaggcauaaaaaucacucacagacccaaaaugaaauacaacuuuaacacuugaauauauuuucuuccagugacuauuuaaagcuuuuuauugcacugugcuuauaaaaauggguguaacuucaguaaauuagcacaggcugaagucaauauaaacaccagccaagucgagaacuagcauguggcugggcauggcggcucacaccuguaaucccagcacuuugagaggcggaggcggguggaucacuuaaggucaggaguuugagaucagccuggccaacauggugaaaccccaucucuacuaaaaauacaaaaauuauccaggcaugguggcggguaccuauaaucccagcuacucgggaggcugaggcaggagauuugcuuaaacccaggaggcggauguugcagugagccaagauugcgcuacugcacaccagcuugggcaacagaguaagacucugucuccaaaaaaaaaaaaaaaaaaaaaaaaagagaauuagaauguuacuagcacauccuucugcuauaauaccuuauucuuuuugucuucagcauuuugucauccuccucuccagaaaaggugauuauucucucuugguauguaacaccacagauuaauuuugcuuguuuuugaacuuuuauaaaaauggaacauacagcaugaauuuuuuuguauuuggcuguuuuucauuucauucauuuuugugagauccauuuguguuuguaauacuccuguuguggguagcuaugguucauuuuuguuguguaguauucugccuacaaauauauucuguuauauucacccauuuugcuguugaacauuuggguuguuuacaguuuggaauuauuauggacauugcuucuaugaacauuuuuuuuaauuucuuuauuuuuuuagagauggggucuggcuuuguugcccaggccagaaugcagugcuaggaugauagcucacugcagccucgaacuccugggcuagggcagucacccucaacagccugccauauaagugggacuguagcugaacauuuuuauaugucuugguaugcauuuguaagauggacugcuuaaccauaucauaugcauauguucagguuuacuaggugcuuccaaaaaguuuucugagaugaaugcagagauguauauuuacagcuguaauaugaaaauugccuaacauccaguugcuuaacauccacaccaacauuugauaugguuaauauuuuaauuuuuaucuccgguguguaaugauaacuuguucuaauuuaugacuucagccaguuuaugaaauugauaccuuuucauauguuucuuagccauuuggguaaccuuuucuggagugcgucucagcagguuaucacauuucuuuuggauuaucuuauucuuuuuuauauuuaggaguauguuauauauccuauaugugagcacuuugauacuuguauguaauguacauuucuuuucucauuuguggauuuccuuuucagucucugaaugguaucuuuuuaugaauggaaauuuuaaauuccauuuugcaguucauuggccccuuauuuaggaaauuuuaguuuuuguugccugcuuuaaaaaaaucuuucuuuacuccaacauuguaaagauuucuccuuucuuuggauuuacuguuuugccuuguacauuuagaucuacauugcuuuuggaauugaguuuugcauuuugugggaaacaggccggauuucguuucugcaucaguauccaauuaauguaguguguucagugaaaaaacguaucuugucccuagagcucuguaauguagcauugucauaagucaauuguauguaauguguaucaguuucaggacucuguuccuguguugguccuauaugguacuagccacauguggcuguugaagauuaaaauuaauauaggcuugaacacugcagaauuucaucaucacauaaaguucuauuguuugacacuuuuuuuuuuuuuuuuuugagauggagucuugcucuguugcccaggcuggagugcauuggggcagucuuggcucacugcaaccuccaccuccuggguucaagugauucuccugccucagccucccgaguagcugggacuacaggugugcaccaccaugcgcggcaaauuuuuguauuuuuaguagagacaggguuucaccauauuggccaggcuggucuccaccuccuggccuccagugauccacccgccucggcuucccaaacugcugagauuucaggcaagagccaccaugcccggucuguuugacacuuuuucuauccuauuccauugauacauuugucugccuauucccuaacaagccucuuauuaucauaaguuuuuaagguuugucuucugaaagaguuaccucuuuguaccuuguucuuuuuagugauaacuuugguuauucuuggccauuuacacuccuauuuacauuuuagaaucaccuugucaauuuucccccaaaaaaaugccugcugggauuuuauuaggauuacauuuaacccauagauuauuuaaggagaauugaaauucauaaaacugaaucuuccaagccaaugaguaugggauuuuucuucacguaguuaugucuucuaaaauuucugugaguaauauucugcaucuuucauuggguuucuuucuagggauuugauguuuauaguugcucuuguaaacgauauccuuucaagguaauauuaguaauaaauuuaguuuucuugcuauguguuggaaugugauaauacauuuuuauauugacuuuguaucugucaaccaucuaaaaguuaucacuauagaacuuuacuuguagguacuuucuuccuuuuuuuucauauauaaucauguuaucugugaauaaugagauuuuucuuuccuuuccaauucuuaaacuuuuuauuuucucucauuuuuaauucacugacaagcacacucacuugguagguguuugaguauauguauucagcucagaugacauggacuucuuaauggaaacuguggaagccaggaaacaauagggguacaucuuuauagugcuccaaaaaagaaaaaaaaaaggugucuaauguagaauacuauucucauuugaauauccuucaaaaacaaagacaauuuuagacagacagaagcagagagggaaguugucaccagcagacucauaacaaacauuaaaauauguuauuuaggcuaaaggaacaucagacagauggaggcauggaaauggaauaaguagacauuuucagaaagggauauugaagauuauuggguguuugaaacagucuugauaauguuugguggggcuuacauguagggugagcuauaugaagauaacaaccauggacauggaggaguuaaacuguuaugugaguuucuuucauuuuuuggggaccugguaaaagaacuacagacagugcucaacugguuucguuuaugauuuuucaacuuuacaauggguuuaguagggucuuuaaugcauuuucaacuuaauaauauuuucauuuuacaguggauuugucagggcguaaccccauuuuaaguccaggagcaucuguaguuugaaguagacaguaagaguguagguuacacuuugauauaaggacaagcugaaauggacuugcccaaacauaaaccaaaaccagacuucugugauguuaagacaaucuacuugcaauauaauugccugccaaaagaaaacuuaaaauacucauuagagaaagguaaguuauuuagagcuucuaggaaauaucauccagcauacaucaaggauacauuuuguaauuucuaggaaaaccacuaagauaaugauauuuuaaaggauguaucaaaaaagcuagcagaugaaauggaauaauaaaaaaaaauuaccaaggaauucaagaacggaggaauaaaggaacaaaggacaggugagaugauugaaaauaauagcaagaugguagauuuaaaccagacuacauugguaauuauguuaaaugugaauggauuaaauauucuaacaaaaagagaaagauuaucagacauuauauauaagugaguaagaccuaccuauauucuauuuauaagaaaagcacuuuacaaguaaaggcacagguaaaaugaaaagauggaaucaguauuguugcaaauaccaaaagaaagcugauguggcuauauuaauaccagacaaaauagauuuaaggagagaaguguuaugagagauaagagaaaaaaaaaucaugaugagugggccaauuuaucaagaagacauaauucuaaauauguuuucacauaguaacacagcuuccaaauauguaagacagaagcuaaaauagcuaaaaagaaagguagaucuguauuccuagcuggagauuuuaaauacauucaaaguaacugguagaacaauaagauuuaaaaaaguuuuaguaaaggaauaagaaauuugaaugguaugauuaaucaacuuaaccuaauugacauuuauagaacauuauauucaacaacugaaggcuuuacauuauuuuuaagugcauaugggacaugugcaaaaauauucugggucauaaaguaguaucauuaaucuucaaagaauuuaaaucauacaaugcauguuuucugaucacuauagaauuauauuacaacccaauaacaaaaaaaaaaaaauagacugcaaauauuuggaaauuaagcaagacacuucugaguagccuguggaugaaaaacaaagucacuguggaaauuagaaaacauuuuaaucugaaaaauaauaaaaauaauacguaucagaacuuuuggaauacagcugaagcaaugcuuagagguaacuuuaugcuuuagauguauaaauuaguaaagaacaaagguuuacaaucaguagucuaagcuccuaucucaagggagcaaugaauuaaacccaaggaaguagaaagaaggaaauaguauaaaaguagaaaucaaugaaacaggaaaguuuuacagucaguuaguuaagaaaacuuuuaaaaaaugaaaaccuguaaugaccugauuaagaaaaaugagagaaaacacaaauuacuaguaacagggaugaaaaaaagagacuucacuacagauccucucuauauuaaauuguuaaugaaagggaauuauguacaacuugauaauacauuugacaacuugaaugaaaggucauaaucccugaaaaacacaguuuagucagcugacauauaaagaaauagaaaaucugaguuguucugugucuauuaagguaguugaauuuaucaaaaaccuuuccacaaagaaaauccuagaccugauggcuucacugacaaaucugccuuacauuuaaguaagauauaauccuggguuuacacagacucuucuagagaacaagaagaagauagaaagauuuauuugcauauuuuaugacuuuaguauaaucuugauaggaaaaccugacaaaagcaugacgagacuauuuuaagccaauauuucucaugaacauagguaaaagaauaauccagugagauauaaaaggguuaauguauugugaccaacauggauuuguuuggggaauguaaaauagcuuucuaauaacauuugucauaguuugucauaaaugcauuuugucauaaaguuuguaguucuuaauuuauaucucaguugugauaauagguguaaauuaucaaaauuccgugugucuaaggaauucauucacuaaaaggaaaugcaggguaaguuaauuauacaagacugauuuaagaggaauuuuaaauguuuuuagggcauuuuggaggcauauauguaaauauaaauaugagagaauaaaaaauauucuaauggacuuggaagaguaaccaagacuuuuccuucaaguaaggaucaaauuguauuugauucucaaccuuuuuuuucuagaaaagauacuuuaaaagugaguuauuucuggcucccagcagaugagucauaaggguguagauccacgcuaucaguugaaacccuucuucuggaaguuuagcugauuuuugucucccugugccuaaaucuucauuuuaauuuacauuguuuguauuuguuaccuguugcaggauaagagaguagaguaacuuguuguccugcaguggacauagcaacucagacauuuaucaucacauagucccaguggguucgaaauucaggagcagccugguugcugauuuugguucaagucucucaagagguugcagucaaauguaggcugggacugcagucaucugaaggguaaugcacuagggcauuacccuuuccagguugcucauccauguggcuguugccggaagaccuuaguuuuuguggauuuugucaggaacggucaguauuucaccaugugggcuuucugugggucuacuugagugauaucaugauguggcagcugguuucuuccagaaagagugagcagagaaauuaaggaagccacaauccuuuuauuacccuauucuugcacaucacacacagucacauccaucacacugucuucauuagaaacaagucacaagagagggcucuaauacugagagcaguuuauuaacuugccuaaaugaaguuugaauccaugugugcccaaauacuuagcccucuuuuuccauuaugugaccacauuuccaucagagaaaggagcacagaauuaucucauucauucauucguuuguucaguaacuguuuaaauauacugucagacaauguacuagacaaaguguauguaaauaaaaaauaaacaggccuuugucuuuaaauucacuaguuuacugugagaaguguaccuuacauguccauguucuuccuugcauucuuuaaagaugauuccuauugucuguccagaucuguuggcauaauauccugguugaaaugauaaagugauuacuucuagguuaauaauucagagauccagaaauuaauacguccuugauugaguccuuuaauucuuagcaacacguuuauauauuuguuuuaguauuaguaagaaguauguaaaaaccccgaauuguuugaagugacuaauugucacaaguagagagcagucuguuauaaacauguuaggugaauaguaccuggaggaaacaacuaaucagcaaaggaaaugucuauuuagagaaaaacuagguguucccaauuuaccuuagcuacaaauuuggacugauuaaucauuuuaaucuugacccuagcuauggucuuuauucccuacuuaucucuucccuguuuugcuuuuuuucuuauuuuuuauacuuagagauagaaagugguagacggaauauagaggucucggauuaaguagaaauaauuaguaucuacagagagauucuagucuauauucauaacacaagaacuacuauuaaauaauaaucacagaauaagaaaguaugagaaauuaaaaagauuguuacagagaguaaugacaggcuaagagaauaaggaaaggcuaagggaaagaaguaaaaaugagugaaaucucccagucuguagagugaaaauaugaaagaaaaguuuagagacaaaugauuaacccauuugggccaaauaaagaaaaaguagugaggaaaaagauguauuugagacguguacaagagucucuaaauuaaaauagcucuuccagugcuguguaggaaaaauuuaaacauggccugccccaaacaagucuuugugaaauuauagaauaccagcuauuuagauagacccuaaauauuccagacagaaaaauuugguguuucuacaaaaugaggauaaauagguagacagguaggacacagugccuuucagaguuuagaaaaaaugauuuugucuugaacuguacuaaaguaugagggagauaguauuuucagauguccaaggacucaguguuugccuccaacauauacuuguugaaaccauuauuugaggaucuuccaguaaagggaaaaaaaaaaugauaaaaacauggaauucaaaguaggguacuuaaccugagcggguaguacaaucaaaagauuuccacagaaguagcugauuaauagcccuugaaaacacguagacuaaauuuagaucaggauguuagacggcuccgaagaguaucuuuaagaagaaaaguggaaucacauuaaagaaaaguuuaagaaacagggugauuuccaugauuucuguacuguuuccaauuccuuuccucucuuuaguagcauuccuaucaggcauuugcaccaaccaugcuaccaaaggugccgccauucgccauuauccuccauguugcuaaguggucagugauaggccuucaucauacuuuaacuuuuggcacgaucaguucugccuaaaacacuuucuucacuugguguucacacuucaguauuuuucuuuucucucacugcccucuguuguuuuuucugcuauagguuaagcaucccuaauucaaaaauuuaacauuugaaaaauguuccaaaaucugaaacuuuuuuuuuuuuuugagacagagucucacugaccucaggugauugcuugccuuggccuuccaaagugcugggauuacaggugugagcaacugcaccuggccccaaaaucugaaacauuuuuacugccaauauggcaccauaauuuuaacauuccacacaucaguacuuaacagaagcuuuauuucaugcacacaauuauuaaaaguauuguauaaaauuacuuucagacuguguguguaagauguguaggaaacaagugaauuuucuguuuagacuuggaugucauccccacgauaucucauuauguauaugcaaauauucaaagauuugaaaaaaucccaaauccgcacuucugguuccaagcauuuuggaaaagggauacucaaucucugcuucuuuuucccuggccucuucauauuugauuuucucagggcuuaacuucacuucuccauguacaccuagagaucucauccaaguucauaccuguuuugguauaaucuauacacugacaacucccaaauuauacuaacagcucauaauucuucagucaacaccagacuccuauuuaauauuuccauuugaaugucuaauagauaucucaaacuuaacucauccaaaacugaacugaauauauuuucuucaaaucuggcucuuccacaauuuuuccuacauuaauugaaauuuacuccauuuuucccauugcccagccuguaaaaccuggagucaaccucgaccuucuuucauauccuauauuaguaaauuuuguugauuguauuuuuacaauauguccagaaucuggucauuucuuaccaucuuuauuuuaacccugguccaaaccacuaugaucucuuaccaguauuauuuugauagcuuuuuaacagugcucccugcuuuagaccucauuccucuucaugcuauucaauacaguagccagagcauucuucuuaaaacagaagucaaauaucucuucuguggucagaacuuugaugguuuuccaucucagaauaaaacgcacauuucagccaggcacuguggcucaugccuguaaucccagcacuuuggguggccaaggcagguggaucacguggucaggaguuugagaccagccugaccaauauggugaaacccugucucuacuaaaaauacaaaaauuagccgggcaugguggcacacgccuacagucccagcuacugggaggcugaggcaggagaaucacuugaacccgugagguggaaguugcagugagccgagaucaagccccugcacuccagccugggcgacagagcaagacucgcccucaaaaaaaaaaaaguuaaaacacuguuaauuagcaccuauguuuuugccaguauguuaagauuauuauuauuuuuauauuccuuuucucuuuagcuguugcuaacagccucuuuugauucagauacuuuaaaggaucauaacuuguuacugaauuuauaaauuauaugggugaauguggguuuguacucuuacguauguuaauauauaucugucugugauuagacagguaacauauaaauuaaacucauuugcagagcuauugcauuaaugaugagcaauuagcaguagcucaaguguuuaaauaaauaagguguuuaaauaaaaacuuaaccaaacuuucaaaaaaaccacagguugcaacuucucaaauaguacuuuucaaauaguaaauaaaugcauuaauuucaaaacagaaguucuuuuuguauuuguuccaugauaaauuguaguuuuuccugauugaaaauagguucuuauuugggauuaaauuaucugaucaacugacuauugcaaagaauaaauacaucauuauuuacacacauuaauuauuguuauaagccauuacacauuuuuaaaaaaugaaguuuguauucuuacaguuaccuuuuagcaauuccagggcuaaaggaacuuuacugcuugacagagaagcaaugauagcacaguguaguagacucccaaauaguuugguuacauaccugagucaguacuucugauauuuuuguuuguuuacuuacaaauuauguauguguuguugucauugacagucuuaaggaugauauauacuuaggcaagguuuaucaagagcagauguaaaucuguauuucacauagccauuuugguauuucugagaguuuuugauuggcuugucaaauuguguuguauuuuucuuguuuuuauuuauuuuugggacgggaucucacuuugucacccaggccuggagugcaguggcaugaucucggcucacugcagccuccaccuccugggcucaagcaauccucccaccacagccuccugagggacuagaggugugcaccaccacgccuggcuaauuuuuguauuucuugcagagacagacuuucaccauguuggccagguuguucucgaauuccugagcucaaacugauuugcucgccuuggccugccaaagugcuguaaucuaaggcggaucacaggcauuugccaccaugcuggcuacaucacauuguauuuuucuaaguuuuauuauaagacuucacuaggaggagcagaaguaucaguuuugcuauuuuugugcuuuuauuaauauauuguucaauucauuguuucuuuguaggaaucuucugcggcuuguccauagugugaauaaaaacuaaaucacaucuauaauucuacugaacuggucacacagacgcugccauauaugucacaguacacugaaaaggagccagcagguaaggaaagucaguucuucuacauugaguacuucuuguuuuuuccucuggguaccuugaguaccaguaagugacauaugaucaucugaccuguggucuuacuaaaaggcugguuuugauccauauauugaauauuuguaaagcuuaguuucuaauuuuugauagguaaaaauagaaauucugguauuuucuuuccauacccauuuagcuuggaaagcuuuaugcuuuccacuucggagacuauucuuuugguagaauuguuaagggcauugguucuggagucauacuuuuggauuauuagacaaguuauccaacacuuaauuuuaacuuuaauuuuucaauuuuuaaaauagaauacaauauccaccucaagauuacugaugggauuaaauaaguguaacacuugauauuauuuauacucgauaugugcguguauuauaaauacauguuuguuucuguuuccuucuuggaagugauuauauuucuuauuuuaauacaacuaagaaauuauguaacuguuucauucauucauuuauucauuuuuuuuuuuuuuuugagauggaguuucgaacugucacccaagcuggagugcaguggcacagucuuggcucacugcaaccuccgccuccuggguucaagugauucucaugccucagcuuccugaguagcuggaauuaugggcaugugccaccacgucuggcuaauuuuuguauuuuuaguagagacgggguuucgccauguuggcuaggcugaucucgaacuccuggccucaagugauccgacugccucauccucccaaaguaccgggauuacaggcaugagccaccaugcccagcaacuguugcauuuauugacuauaccauaugcugugagaaaauauuuuguuuaguugcuguguaguacauguaauguauaauugacuaagcagacuuacacuuaauauauauauguguguguauaauaauguacuacuuagugaaaguugcugcuguuuacuacuguauaccccucagucaacaaaacuuaauugucaagucauguaaauguugauggcuuuucuuaccauaacauauaccauuuauugguaguuuugaaggcaggguaguauguguuugaccuggcucauugcuguuuucuuuuggauaguuuuaucugacguuaaucuuuggaacauauuuauugugaucuaguugauucuucaugguacagauaccauuuaaagagguuacuuguuaucuuugacauaaauguuuucauucuuaaaguaauugaaaccaucauaucauaaugcuaguaauugauucaucaaauauguauugagcacuuauauuaauauaauauauaagguacuuaauuuggaagaucucccauaaagagcuuuggcaguauaauaauuuggcauaugaaaaauauuuuuugauagguuucauuauaaaaaucugaaauaccuuaaagaaaccaaauuuuaaaacauauuuuuugaagggaaaaggccacuaacucuuauuauauaguacuucauauuuaauuuucuagugugugaagaauaauguuuuauaguacuaguaagguacacuucauguucagaagcauaugauuugauaaauaauaaaauauaaacugaaguaguuuuccccaacagguugcaagaauaaagcucauugcuguuccuguuuuaauuuuuuaacuuuuuuuucagcaauggaccaagaaucugguaaggcugucuggcccaaaccagcaggaggguaucagacaauuacaggcaggagauauggaagaagacaugcuuaugucaguuuuaaaccauguaugaccagacaugaaagaagcuuaggucgggcuggugaugacuaugaaguguuggaacuagaugauguuccaaaggaaaauuccucagguguguaacauuuaauuauuuaaagguuauuaauaguuauauaggaauugaucuuauaauuaaauuuuuggguggguauuaugcaugucugugaguguaaaugcagcacacuuccuaucaagaaauucuauuuugaaauucuuauugaauuuaauauuaaugguguauauauuuaaacauuguagaagaaaauagaauacagccaaucauuaaaauauaaccacacucucauaguagugauuacguugucauaaccuccagccaaaggaaaucaucuuugaaucaaaaagauauauuuugaaauuuuuaaaaauguggaucaaguagagauauuuuuucccugcauauaauauuuaaauaacuuuucuucuucuucuuuuuuuuuuuuugagauggagucacguucuguugcccaggauggacugcaguagugcaucuuggcugacugcaaccuccaucucccagguucaaacaauucuugugccucagccuccuuaguagcugggauuacagguguuugucacugcacccagcuaauuuuuguauuuuuaguagagacaggguuucaccacguuggccaggcugaucucaaacuccugaccucucaagugauccaccugucuuggcuggcuucccaaagugcugggauuacaggugugagucaccaugccuggcguucuuuuuuuuuuuuuuuuuuugagauggaaucuuacuuugucauccaggcuggugugcagugacgugaucugggcucccugcagccuccaccuccuggguucaagugguucuccugccucagccucccaaguagcugggacuacaggcaugcgccuccacgccuaauuuuuguauuuuuugguagagaugggguuuugccauguugcccaggcuggucucgaacuccugaccucaagugguccguccaacucagccucccaaagugcugggauuacagacaugggccauugugcccggccaacuuuucuucuuuuaauuuuauccuaaauuuaacuuggcuuguuuauuuuuucaucauuuuacaaaauccaaaggacaaggaaggcuuauucaauuaaaauuucuuaguuauucaaugguuuugaaaaaguauuuugcagcuauccauguaccauaauugcacauuuuuggacuggauuugucuucuuccucuuguucuaagcaaacuugacaagacauuucuagauuauuuuugcugucauauguaagaaucugaauuacuagcuagggucaucccauugaagaacccuucguucccagcuacuugggaggcugaggcaggagaauggugugaaccugggaggcggagcuugcagugagccgagaucaugccacugcacuccagccugggccacagagcaagacuccgucucaaaaaaaaaaaaaaaaaaaaaaaaagaacccuucguaccauauaucaaagaacccuucguaccauauaucauggccgaacuucaguuauuuuacaauucaugaauuuuuauuccagcaaaucucaaaugucuucauuuuuuuuauuaguggugaugcaagauaguuaugcuuaaaguaauuuauagauaugauuuuacucauguuucagaauucucacaauuaugacaagaaucaacauauugaucucuuuguuguuuuucagucauaacuauaacacaucuaaaguaaacuuauuacaaauguauuacaacaauucaauuuauaaucugucgagauacugagauauaauuuugugaauugccaacaaaacacaauagggucuaauuucucuuaaaucuguaacuauaguuauuauaucugucauaaguacuuuugaagguuuuuuguuuuguuguuguuuuuaccugcauauaauaaagaagguaaguuuggaaaucacugggaagcagauugguuacccuagacuccacuuacgagaggcuucccauuguauaaccucucaagagcuucuccuuuauaugucuugcagaaggcauuagauauuaggauuuagauagaaaacugccaaagccaugugagggagaugauagugaaaggcuguacauugacauaaaugaacucauagaguaaucagucugcauucucaguuaaggagcauagaagugcuugguaaauaaauuuacucauguauucaaguaguaauaauugguaugauuuccacuuaagugauaguuauuacauaaaauuuuaucuaaguuaauccuuuaaaauauguuuucuuuuguuuuuuaugaagguuccaguccuuuggaucaaguugauucuucuuuacccagugaaccuauauuugaaaaaagugaaacagaaauucccacuugugguucagcauugaaucaaaccacugagagcagucaauccuuuguugcaguacaucacagugaggaaggcagggauaccuuaggaagcaguacaaaucuucauaaucacucugagggagaguauauuccaggagcuuguagugcuucaaguguccaaaauggaauugcauugguucauacagacucuuaugauccagauggcaaacauggagaagauaaugaccaucuucaacuuucugcagaagucguggaagguaguagauaccaggaaucauuaggcaauacaguauuugaguuggaaaacagagaggcagaggcauacacuggucuuucaccaccaguucccucauuuaacugugaaguaagagaugaguuugaagaguuagauucuguaccauuagugaaaaguucugcuggugauacugaguuuguccaucagaauagccaggaaauucagaggucuucucaagaugaaaugguuaguacgaaacaacaaaauaauacuagccaggaaagacagacagaacauucaccugaagaugcagccugugguccagggcauauuuguagugaacaaaauaccaaugauagggaaaagaaccauggaaguucuccugaacagguagugaggccaaaaguuagaaaacugauaaguucaagccagguggaccaagaaacagguuuuaauaggcaugaggcgaaacaaagaaguguucaaagauggagagaggcuuuggaaguugaggaaaguggcucagaugaccucuuaauaaaaugugaagaauaugauggagagcaugacuguauguucuuggauccaccauacucaagaguuauuacacaaagggaaacagaaaauaaccaaaugacaucagaaaguggagccacagcaggaaggcaagagguggauaacaccuuuuggaauggcuguggagauuauuaccaacucuaugacaaagaugaagauagguaaggucacauccaguacuuuuuccgauuguguaguaaaugaagugguuucuuucuagaaccauguuugauggcugggcuauuugauaugaucagggaauuagacauuuugacuuaccaaauauuuuuauuuacugaaugcuaaccauacaugcaaacuacucauuagaauuuuucacaaaaaaauguuuuugagguuuuuaguaguuuacagaaguaaguucagauaaugauuauuauuauaaagggauagagaugcuaguucaugguauuucaauuaauaaaauguaaaauaaacauuuguuguauuuuuuaaaaaccuacauuaagccagucuggguuuaaaaagugauuaauaucacaaauuauugauugguaauacuucauuaacauugccaguagugacuaauaucacuuguuucccucuuuaucuguucuuccuguggcucuuccuaucacuaaguuuauuuuuuacuuauuuuuucuuagcauucaauucucauuaacaacucugugugguagauuccauuauuucccucauuuguaaauaaggaaacugaggcacagagcauuauauaacuuccuaaggucacagagcaacuuaaugguagagcuggacuuugaguaccuaacuggguauuccagagacuguucaccacuauucuuugcuauuuucaacagaacauaaaacuuauaauaagcauucugauugcucuuacaaacccguaucuuuuuuuuccaaaccauaagacaacagaaaaagaaaaaaauggagaauuucuuuguucaguugcugaauuuccauuaccccaguguccagauuuucaugaguccuuguaagcuaguugcaucccugacagugcucaauuacagugcaauugcaagauuuuauuagcuaguggaaauaauugugugguuuuuuuuuaguuagaaaguacuauaaaggaagaaauuuaccauuuugaauaugaaugcauuuuaauucaugucauaaaacaauucauuugauuuucuuuggacauaugaauuaagcuacuauaauacagauuguguaauuuauuauagaaaauauuuaaaauauaauuucugcugcucugucaaagucuguaaacuuuaaggguuaguaaguaauuuuuguaugauauacuguuuuuaagcuaaagguaaaguuuuuuucaguucaagcccacaguguuuuauucaguauccacacuucuaaaaacagaaauuggccacaaagccugaccugauguuaacuuccuggauaagcagaucuggaucugaauugaaaugaggguauuuuuucaaauauuuguauauuuuacugcagaaauauaguuauguuugauuacuguguguggccuggaccauguugggguuuguuaaguaguaguucuaaaucugggaaauauauaucaaaauuccaaaacacauuuagcccuaagauuuugaaauagauugcaagucucuaauauuauaccucuagguuacuauuuuuaaaaaaagacaaaacuuacagucuuugauaauuuauuuuuuugaaaguguaaggugcuuguauuuuuuuucccccaguuacacuuuuucuucuuuaaggagaaucauuuaauuuggcuauaccuuugucauuuugggcaaaauaaauacuucucuucugcuugcuuuuuauagucaguuauaaugucuuaugaugaaguugaugaaauuguuacauuguuugccaaccccuagagaaagguagucuuccuggcuccuugauuuuaaauugauuuucuuuguuuuggggguggucagugguggaaguguauucuuugccuugaaggacccuggacuuuucauaguuauaagguauuuucuuaguuauuuguaauucuuauucuuauuuuuaauuuuuuucuuaagugaugucaauauucugaacaaugauaguuuuuuuuuuuuuuuuuuacaaacaauauauagaugggaaaaaacauuuacaguuaauagaaacuguccuuuuaaauugcuaguaauguauugacuacagagccugugguuaggguaugccaaaaugauggaacuacuuuaggaucauuguuuaagacacauugaaaugcuuaaaaguuucuuguuucguuuuguuuuaaagaaucauagaauaaauucuaaaggauaaugguucugccuaggacuguacuuauauuuuuauccauagccuuaagauauguuuuacgaucucaaagugucuguacaguuuucuguacagauuauucuauuucugaacagaaacucuguuucuaugcugcuguguccuguuccucuacccuaauucccugcaaaggauuauaguugccagggugccuuuuuaauauggugccagcuaaagguuggaauuuaauagcuguacacuccuauuuaguuucauuuugcccuuguucaucucccugauguuucauugucauccucccuaguucuuguauuuguagauuggagagauggugaugcuagucuucucagguuuuggauggaaaguauaagagcugcugcuuaauuugggccugugaacuuugaguuuuuuuguaaagcuuaaaaaguugauauacuugaaaaguuuuuuuuugucaugcuuauaauagccaaaguagaacucaucaagaauauaacuaaaguucauuguggcauuuuuauuuuuuuauuuuuuauuuauuuauuucgagacagaguuucucucuguugcccaggcuggagugcaguggcgugaucucggcucgcugcaaccucugccuccuagguucaagugauucuucugccucagccuucugaauaacugggaccacaggcaugccaucaugcccagcuaauuuuuguauuuuuaguagagaugggguuucaccauguuggucaugcuggucuugaaccugugaccucaagugauccacccgccucagccucccagagugucaagauuacaggcgugagccacugcacccggccagcauuuuuagauauaggaauuuuggcuacuuuuuaaaaauaugaauuauauauucuuuuuaaguagaaaaguauuuuaaugaauucaugauugccuucuucccugaaaaauucuaaaugaucauuuaaucacaucugaaauguuacacucugugggauaaacauugcagccaguagcauugcucugagcuguuugacagguacugagcaccaccuuauuaaauuaggauuccaaggggaauuuuaauaggcagcauauaauuaccagacuuagaauuagaccaaagagcuaagguuaauacccugcucuuuugaaauauacccugagaaguuuaguaacuguuugaggacaagaucuugaguuuaaaaaaaaccuuucagcaauacuagcauaucuuaaccuugggccuaacugcucugaagagaggcaugccaucuacugucuguuccuuacuuauagcauuugagguuucuugcagaauuuuuguggccuuaggacuuaacuuugcuuaaaauuuaaaaaccuuacuuaagguaaaauguugggacaacuuacuuuguugaugauguugggaaauaaaaugauuguuagccauuuaguugacuucaauaugauauauuaaaggauuuguugaaaucuuaagugccagacuuuguuccaggugcccuguuaauacaaaucauaauggucccuguucccacaagguucacuagcuuuaugaagaagacaaaauauacguauuuauuauugugaggcugaauuaagcgccuuuccuguuccguguagguuaccugagagccacaaagaaagaguuugucugagaacuugguacuacccccaacaaauaaaacaucuauaugcagccaaggcacagaucuuaaagcauaugugcugacauuuuagcaaaccuuuuuaucuuguuuucaaguucauagaaguuuggaaggagcacauuagguauaaauguguuuguucugcagauaugcuagggaguucaugggauuacaauaaccugauacuaaggaaaaagaccagaaagugacaaaaagcaggcacaaugcaaaaaucauagccaucuuaaugaaauuaagcagacuuauauauuuggacauaauccauucauaucacuguauuacauuacaguucaguguuaauagugguaaaaaguuccagaauguuuagauuaugucagauaacaaaauauuuaaaauuucacuuuuuccuaggcuccuguaguugaguuucuuguggcugugauaaaugccaggaagaacaaaguaacaaguaccuuggggaauuauggaaugagagauuacuuuugguugguuuuauguuuccauagcuuauuucugccuaggauuuguacauaaauuuugucuauaauuucauucuguauaucaaguuuuuuuaguucacaauugaauguguagaguguaacauuugaguaaauuauaguugucugcuuuuuaaauacaacucuuaggugcuaaaagggaucaguaccagugaaggaucauaugaagaucaaaguaguacuuaauuuaguuuuuacuuugagaacuuuuaaaugugucauucacccgcuuuuaaaaucuagaacaaauggaucuucacuguuccaugaucauuuuuguguccuauuuguucuguugcuuacuccuuaaaaagugauuuuuaaaucuuuucccuuuuuuccuuccauguacuccugucacuccuaaugguuagcuucguuucuuauuuuccuguagaaguuaaaaauauguaaaugugaauuuucuuauuuuccucuucuccauauuaggggauaguaguauuuauuuguauuuuuaauuuccucuucaaugaagagagguagccccucucauucugugccucuaguuauuucugacacuucaucuaauuguccuuacucacagguugcuucccucugucucucaaccuugaguuuuucucaaucuugaagaaaaccuuuacuuuuucuugcucuguuauuugccuguuuguguuuucuuuucuacugcugaauuuuaagaaaaaguuuuccauacccacugucucuauucugucacuauccacucuucuuacugccuugaaaucuaauuccuaauauuauuucuguauucuuuuuuauugagacagucucgcuuugucaccuaggcuggagugcagcggugcaaucucagcucacugcaaccuccaccuccuggguucaagcaauucuccugccucagccuccugaguagcugggacuacaggugugcaccaccaugccuggcuaauuuuuuuuucuuucuuucuuuuuuuuuuuuuuuuuuuuugagacggaguguugcucuaguugccaaggcuggagugcaaugguaccaucuuggcucaccacaaccuccaccucccagguucaagcgauucuccugccucagccuccugaguagcugggauuacaggcaugcgccaccacacccagcuaauuuuguauuuuuaguagagaccaguuuucuccauguugcuuaggcuggucucgagcucccgaccucaggugauucaccugccucaaccucccaaagugcugggauuacaggcaugagccacugcacccggcccuauauucuuuaaugucaguggugaccuccugauuuccacauccauuugucuuuucucaguacccauuuucuuugauuucucugcacuauuaugaaaaauaauugcaauguuaaagaagcagcuguguuguagugagcugcacugaguaaacaagaagucuaguucaugaaauaauugaaaaacaaaagaagcgauuuuauacaggaaggucuugaaagaaauagagucugaucuguguuuggaaguggggaaaaggugaagugauuauaaagauauuccugauggcaagaaugcccacuuugaggacacuguuugaaauagagcauucuugaguuggaugcaagaaaguacugggaucagauagcaguaaauuauaaguguuauucaaagacauuuaacuuuuuauucuauaggucacuauuuccaaaguggguaaaauauauuaagugguacacaauguuuuuaauuuaaucauuauguauuuauguuaauggaaauuaagaaaauauagguagcacaucaaauucaggacuuaauggcuauugcuuauccuaacuaaauguauuugaguuuaaaaaaauguuaaaaaaagacucgcuaacaguuauugauggcucauuauuuaucaggcauugugaaaauguuuuauauauauuaacucacuuacccuuuacaugaacccagugaacuauuaaauacuguuguuguauucaccugauaugugaggcuaaaaaggcauagagagguuuucauagcuaauaagugguggguuuaacuccaggcaagcugaccaggaccuguauucucaacuaucguaccuuaagacagaggguuaaugugcaacugcagcaaaaauugugagagugauaggcaaauggcuuguuugugaaacuaaagcaguagcauuagaaaaaagagcuguugaagguuuuuuggaguaauacuauaaacauacuguuugauauguaaauugaagugaugguaguauucagaaugcauuuugagggaguggaauuaaauuuaggaacaccaauuaauaauugacuauauaggucuaauuuggagaaaagcauuugaacuaggguuuuacauuuuaggagaaacggagaaaaaggagcuaagacuacaagagccauugugcagagaaagaauggaaaguaagaaaggauuugaauguggggaguuugugaagagucaaaaaauaaguguuugcagaaugagagcauggugauagcauuaaaagauaacaaaucaagauagggauucaucugacagauuaauuuuauaauagaauuuuugacaaggaaggugaaaaaucuuaaaaugcuuagaggguaguuagugauugcgaaagcuuagugugaugguuggggcuggcuggggauaugcauuuaaaaguugucuccuuagcauugaggguuagguaucaugaguaauaaugauauaggcguggggucugcaaaccuuuucuuaaaggagcugaugguaaauauuuuaggcuuuggugacuaagaggcaaaauuaaagauaaacauguaaaaaccauuuuuagcucacacaccauuaaaaaacaggcagcagagucagguuugaacccaagccuguaguaguuugccaauccauaacauaggcuucuugauuauugaucauagacauuccucuuguauugaaguuuagagauauuccaugaguuauuugauuaauauggaaaagugaggacuuuuuaauguuaucucuuuggacaggaucauauucugagugaaaauuuuuuuuuaaaaacugagcuucucuuuuauauauguuaagaauugccacaaauuuauauagaaaucuuacccuaauuguuaaagacauuaaaauaggaguugguaauuuagcuuugaauuuuagaagguucuuacucaaggaaacuuaggucaauaagcuccuuuaaaacuacuuucuguguuggauuuuaauacuuauauaagucuagaaauuguuuauauuagauuauucuuugggucacagaaaauuguacagcauacaaggaacuuuggcuuagacccagcugaaagaacaccuuuuaguugcugugccuaggguuuauagcuuuccuucuccgggauguuaaugcccugccauccauugcuuacuggaaauuggcaguugauuuuauaucuuugcuucuaguaaacuucucagagcuuagauuagugcuacuguuuguuaauaucaucuugaucuuuugagugcaucuguuaauaaaggaaaucacuaacugcguauugacauaauaaucaucauuaaaaaauguaauuuccuaccaauuaucacuuccuuucaaaaauguaaacuaaaauuguuauuuuugauuuuccaagucuagugaacguagagagaucuuugaggagauucuuaaccaaaaugguugauaugguuggagggggcauuuaagacuuauuuucaacauugauaaguaauauuuuagccuuugguagcauaagaggacuaauucuuuaaaaacuaagaguaguuaauuguaaccaaguuggcuaaauguaaucaaaaguaauuuucugugcugcuuuuuuuuuuuuuuuuuuuuuuugagagggaguuucacuccuguugcccaggcuggagugcgauggcacaaucucugcucacugcaaccuccaccucccaaguucaagcugaacuccugccucagccucccaaguagcugggauuacaggcgugcagcgccacgcccagcuaauuuuguauuuuuaguagagauggaguuucucuauguuggucaggcugcucucgaacucccgaccucaggugaucugcccaccucagccucccaaagugcugggauuuauaggugugagccaccaugcccggccugaacugaaauuuauuuuguauucacagugcuaccuaaggacaguaaaguuuugccaguacugcuuuuuaugcauuugaaugucacuucuugaaaaguucuuugggaaaaaggaaggaaaaagacaguuaacuuuuuauuacaugguaauaguagaaauuuauucauagaaaauaugucauuaguugucaguauauaauuugaaaguuguuuuagucauguuagauaugcaguaagucuacuuacauuuauuccagguagcauuuaagauuaccaaauuguauuuaaaaauuuauuuagaaaugugucuaaaauaugacaagccccuaucuagguaccauggauguaguguaagaaaaaguaaagugauauauuccauaacuugccauaugccauauucuuuucaaagagucacacucuacugcaugcauuuauuuguuuaauagucugaagauugaauuagcaccugacaaagcauauguggcaucgacacuccacucuauacuaugaugucugguguauuaguucauccuugcauugcuauaaacaaacaccugagacuggguaauuuauaaagaaaagagguuuaauugguucauaguucagcaggcuguacaggaagcauaguggcuucugcuucuugggggugccucaggaagcuuccaaucaugguggaaugcagagcaggaacaaggcuucucacuuggcaggagcagguguaagaaagaaugaggggggaggugccacacacuuuuaaacaaccagaucuggugaaaacucaguaucacaagaacaguaccaaggggauaaugcuaaacucuuaugaaggauacacccccaugaugcagucaccucccaccaggccccaucuccaacauuuuggauuacaguucaacaugagauuugguggggacacagauccaaaccauaucaucuaguuaacaccccaaaugauaaaaauaacugaacacauuaugauaguuuauuucucuucugauuugcaguucugaaugcagugauggggaauggucugcuucuuugccucaucgauuuucugguacagaaaaagaucaauccucaagugaugaaagcugggagacucugccaggaaaagaugagaaugaaccugagcuacaaagugauagcaguggcccugaagaagaaaaccaagaauuaucucuucaggaaggguauguucaacagugagauuuauuuuucuguauauuguacaagagugguauauuuuacauucaaauguuggauaugccauuaauuguauuuauaagccuuauguagaaccaguaggccccccugauuuuuucauuaugcuuuugguauuuuaaaaagaacaauuaaguugaaaauacugauaauuucaguaucguuuauggagauacaauauaugucuccacuuggcuuuaauaagaaaaguugggcaccuaaaaugucauuuugguuaaguuaggaaugggugaauuagcacugucauugcucaagggagaaaggacagccucaagagggaaaucagugauucauucacagaaauggagacaguuaguugcaaaagcuaguguucauauucuugucuaauugcauuggaugagaucuccaaaauaucagugauugaugauaaacauuuuuguucuuuccucauuuuaaugggaaagcucuaguacuguaaggguugucaaacauaccaugaagggcuagauaauaaauauuuauggcuuuguguccagucuuuguugcagcuacucaccucuacuguugcaguauaaaaguagccauagacaagauguaaaugaauggguauagcugucuuccaaccuuuuacuauuuuauggguuucuagcaagaauguuuguugaauuuuaugaaagucuuuucagcaucaauggaagugaucaugaugguuuuuuacuuuugcccugaucaugaagaauuguucuauaauuagauuugcuaauauucaacuucccuugcuccuugaaauaaaccaaaucugaucacagucaugguuuauuguuauuuuaaugggcugcuggauucuaauauuuuacaugggauuuuuauaaugagauuccuagaugcaaauugucuuuuaguuuuuuguuucaauaucaguuugguacuugcuuugcuaaaaagauguguauucuuuuucuuuuuuuguccuugcaucuguugcuuaaauagcuuauuuauuccuuuaaaguuuguuaguauucccuugugaaaccaucuaggccucuuguuuuauuguagaauaucuuuuugauaauuuaauuuuuuucuaugauaauugguucuaauucuuagucucaugggaacuauuuugguaaauuauguuuuuuuuuaggaaaagaacuuuuucaguguagacuaauauuaaaacuuguacuucucaaagcauauacauuuucagcuugagauuaauccuauaagaaaaucuaggaauaaaauauauagaaaaaucuauaaagaaagaaauucacaaacauaauugguuucaacagugguagguugagguggcauuuuuuuccucuucaugagagagauauauauaucauaaauauacaucauagauauauauauauauauauauauuuuuuuuuuugagacggagucuugcucucuguugcccaggcuggagugcagugguacgaucucggcucacugaaaccuccaucucccagguucaagugauucuccugccucagccuccugaguagcggggaguacagguacccaccaccaugccuggcuaauuuuuguauauuuaguagagaugggguuucaccauguuagccagguuggucuugaacuccugaccucuggugaucugccugccuuggccucccaaagugcugggauuacaggcaugagccagcacgccuggccucaugauuuuauauuugauugccuuuaaucacuguuaguuuaguuuacuaaguauaaauuauucauaugucauuuguguuagcaguuauucacucagcaaauauuuauugagcauuuacuuugugccaggcauuguguuggauauuggcguuauaucaguaaacaaagacaaauaacauuccuucaugaagcuuacauuguaguaggaaaggcagaugauaaccaagauacaaacccaguacauuacacaugugaugauuacugugaagggaauaaaacagugaugugaaagaagguaaaugaugaagauauuaaaguggucagggaugacgucucuuuagaauugacuuuugagcugaguucuuaaagaugagaauuaggguucagaaagaacuuucuaagcaaaagaaaaagcaagagcagagauauugaauguugguaauuuaagaagcccaguuuuucaaaaauuagucuuuuacauuacuguagugccaaauuaugguuuugcucacacauuuuucauccuuagacuugcucuuagagcuagcagccuuguuuugaugaaucuaugauuacauauuuauuuucucuaaccuggauuuuauuuucuaacagugauucagacuauuuaguaagguaguuuuuguauuaccaugauguguguagaucacaagucucuuuccaauuaauauauuuugcauucagaaugauguauuucauucagaaugauguaguacaccaaaugucaauugcauaauuaugacaaccuaauuaaaucuagcccaaaaaaaguucuaauaucugggauggaacagaaagaagaauaaaaaaugggaauaaauuaguacauuuucaaaagcuugaguugucuagauagacaccaauagagcuuugaccaaagggagaaaauaaccuguacuuugguugaaauugagaaaaccuucaagguuuuaaaauuuguuaagcaucugcuaaacaucuguuaguuuuagcuaucuuuaggcuaaauauacaaacaacugugugacuccuuaauaauuggucacaugacucaugaaacuaaaaaaauucuuuucacuauuguacuuugcauaauuaaagggaugguuucugaaauaccaguaagagugaauacagauuuaaugacacaaguuugagugcuuuggaaauauuuaaugaauugcuaacaguuuauugcuuggguagcuauuucugguugaacuucucuugauaaacagaugaaauuacaguuguuuuaaaaaaaaaaggauucauacaacaauaaaaagugaguuuagacaguauggaaagaccaauuaaaaaccauuauaaccagcuuccuuuuugaacuucuaaagaucuuccguacacauaaaagcauauauguguacacguuccauuucauuuuuuaugcaaccgguagcacauuguguagacauauguguacaccuugguuucguuauuuguuuuguuuauagaucuguuuuuuagauuguuccauauucauauagauuuccuuuauucauuuuaagucugcauaguucuaccuuguuuugcuuaaagucacauauucuaagaagcucguauaaaguuaagucagaacuuacuguauacuacuacaugaguauaccaguuucauuugguggacaguuuuggcuauugugaguaaugcugaagaaaaaauaaaaaacacauuguacauguuuaggagaaauaacuggaagccgaaccacuaggucagugagugugcauaaaccuaaucuauagcuuuugccggguuucucuacaaagaacuuaaauuagucacuuucuuaccaacacuauaugaauugccuuucuucaaagcuuucuucagagcuucaccaacacacaggguauuaucagaauuuuuuauuuuugcuaauaguugaaacauauuucaguuguuuuaauuugcauuuugcuuauuauaaaugaggcagagcaucucuuuauauauuuaagggcuauuugaauuuccuuuucugcuaauuauuauauccuuugccuccuuucuguugauauauauugauguuuuucuuacaguuuuuuuuuuacauuuuaagcuucuauugauuaaggaaaagcccuuugucucucuuguauuguaguucacguuucucaguuugaguuuuguguccaaauuuugugacuucaggguuuuauaucaugcuuagaaugacacugaaauuuuuuuuuuuuuuuuuuugagacagagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccgacacugaaauuuuuauaaaauuuccucaugacuauucucguacucauuguuuaagugagguggggggugcauauacacauguacuucaaaaaaguauagcuaaaguuuauuuaagggauuuaaccucccucccugcgggcgaauacccaguugucccaguacauuuuguugaugaguccuuuuuuguuuuuguuuuuugagacacagucucgcuuuguugcccaggcuggagugcaguggugugaucucagcucacugcaaccucugccuccugaguucaagcgauucucaugccucagcuuccugaguagauggaauuaggcaugcacccagcuaauuuuuuguaguuuuaguagagacagcguuucacuauguuguccaggcuggucucaaacuccuggccucaagugaucugccugacucggacucccaaagugcugggauuauaggggugagccacugcaccuagccuaaugaguccuuuuuuuucuuccuguuuugaaaugcuuccuuuaucuccuccuuauuuucuugaucuguaccauugauuugugugucucuguuccuguuuaguuaguuucuaguaggaguagacugacaguaaacaaauaagaaaauguuaaacaaaaauaaauuuuauaguuuaaauaagcagaguuaugugguagucaguaacuggagagcuauuuaaacugaauguucaagacaggccucccugagauggugacuuaugaaucugacaugaacaucaagaagaaaguagcaaaguaaaaauucagugcaagaacauuuuagguagaggaaguggccccaagguagaaaugaucuccauguguuucaaaaguaggaagaacaguaggagcauaguagcuggggaagagugaugagagaugcuguuggagaagugggcugagcagaaagcauguguuauguagggauuugaaggccagguugaggaauucagauuuaaacugugaagggaaaguacucaagagcauuguuucaaaauucaaguagucaggguuggauuuuucuuacguuucuccuacagaaggagaaaacagcauagauaauuuguaaaucaaauaaauauguuccuauguaauuaggaacuauuucuguauacauaugacccuauaacugauuucuuuccuuuuuuuacauaauucugcaguuaaggaagacaguuuuuuagaauuauaaaaguaccaagagcuuagaacucaacagaauccacuugcauggaauagaauuaaagacaguguuaugguauguuuuaaaauaauauuuuuuucuuccuuuaaaauguuuguacuagggaacagacauccuuggaagagggagaaauuccuugguuacaguacaaugaagucaaugaaagcagcagugaugagggaaaugaaccugccaaugaauuugcacagccagcuuucauguuggaugguaacaauaaccuggaggaugacuccagugugagugaagacuuagauguggauuggagguauguagcacgauuuuauuaggaugcuuaauuaggcucugaguucaugauucuaauuuaugaaaauuaaaucucugcuagcugagaaauauuauaauuuucccaucuguuaguccuccucuucuucaaagcucauuucaaauguuccuuccuacuuggacccuuuccuacuuccuccagucagugaccucuuccuuugaccuuuagcucucuugaagcucaccuuacauccuaguuacuuacauacuuuuuuuuaguuuuggauuucugacguuuaaaauuuugcuuuauaugcccucuaucacuuagcauaauucuuucaaaaauagcuucuuaaugaauaccacuucaauuuuaaaaccuaugguugaaucagaaaacaauaagaauaguucuccuucccuauucuuccuuuuccuucucuauguaaaauauggaagauaaaauuuuacuuuccaggagauguugaaagcauuuaauuuacuuuaugcuugacaaagaauagucagcuucaaaugaaaguaacauguaagugaaguguguuguggaauuguuacuucuuacgauacaaugcucagaauuuaacuguuuugguuuauaguaucuuuaaaguguauaguagcccacugaaagcagguaacuauugagauauagaaaggauguccuccuaacugaucccuuuuuuuacuuuuucuggggcaaaaaagauaucuugguguauuuacacuuguuucuuucucuguacaaauauauuuuuaagaauuuguguuguuuuuccaguuaaaauuccuuuacagaaaauucagaaaaauaaauaagaaaaaacucauuuauaucuccugauaucucuucagguuuccagaacauauguuuuaaguccucuuuugugucuuuaauuucucuuucugugugugcuagcuacuucucuguacuucuccagacuguuccagaugggaaacugaacaucuucuugagaucuuccuugccuuuuccuauucuuacuccccaagggggaaaaaaauguguggagaacagacuuuuaucaccauuuuggggaaguagaaaugggauuucauuacagccaugcaauuuguauuucuaccuuaaacauucucauacucuaaaacacauuuucugguuucccaugcauuauggagaauaaguggcuuuaccuagucccagucuugcugaucuugauacgucucucuuuuccuccguuucugugucuccccauuaccuuuuuacugcacuccuuauuaauucagaagucuucugucuccauuaugcaaaguaauuccucaaaguguucagcaguugaaagaaucaucuguuuagcaucaucuaugcauguugggaggcaauuacgguuacauaugaaggaauguuuucuguuacacauuuucaagacucuaaaaauaauuuuuuacagcuccauugugaagaugcuccuuccuauaggggcacuaagauuuaacagauuauugacucauugaaauagugcagugaacuuuuucuuccccauccuccauaaaacuuguucuauacuucugguuuuuccuuuaggacaaauaauuggaggggacauuacugagauauguaguauuuuucaagguauggauaccuauuuccaaauacuuccaaaaggguuguuuuaccuaaauauuugaaggaauaauggaagucuuuacugaauauaauuuguuuguuuguuugagauggagucucguucuguugcccaggcuggagugcaguggugugaucucggcucacugcaacuucugccucccggguucaagugauuuuccugccccagccucccaaguagcugggauuacaggcgccugccaccacaccuggcuaauuuguguauuuucaguacagacaggguuucaccauguugcccgggcuggucucgaauuccugaccucaagugauccacccuccucggccucccaaagugcugggauuacaggugugagccaccaugcccagccucugaauauaauuugaacuuaaauuugagaaacuguuacuuuagguucuaauucacugaugaucuuucuagauauggcuguuguguuaagguuuuagaaaccuuacuaguggucccgaaauguccagagcuucaaauaguuuuuuuuaaauuauagaaaacauuuuagcauuaauuuuaagacacaaauuuugaagguugcucuaugucaacaccucauuauuugcuuaugugguacuauauuaauuuauguggcagcgucuaaagguugauaaggugaaaaugugguuucauuuccauauuaaaauagcaugcuauggggaaagcuauggcaaagagcagcaguucuugucucuaaagucaaacuuuggcacauuuuuuuuuguuuugccacugcuuagaaaaaagugaagccuuuugguuccuuaauuuaguuuaaaggaaaauggaaaaaguccucuaucaaguuuguuuacuuguuuucauugaaguugcauuaguguucaaaauacucaagaguaccugauagcuuggugugguaggaagugacacagagagaucaucguuuuagacacagacaaaucccaacucuaccauuuguuuauucuuugauaacuccuuaacuccucugucuuccuguaagaaauugaguuuuuauuaaucuaauaagauugugagaaguuaauucuguguggauauaacuguggcuuaauagaauuuaaaaauaauuuugauauaauuuuauacuuacagaaaaauggcaaaaauaguacaaaaauccucauguauccuucacuaagauuuccuaaauguuaacauuuuaaaaccacguuuguguuaccauucugucuuuccuuucuuuauacuuauaguaagguuuuuuucugacccacuuaugaguaaguugcaggcaugaugucccuuucuuuacuuguaauuauucuagaaugaauuuccgacauccaagaccauuuuguuauauaacacaguaaaauugucaaagucagcaaauuaaugcugauacaauauuauauaaucuacaaaccuuauuuagauguuuguaguuguuccaccagugcuguuagagaaauuuuuuucuggucuaaucuuuguauuagaucuuucauuguauuuaguuaacaaguuucuuuagucucuuuuaauguggacguuuccucagucuuuguuuuucauaacccugacauuuuuaaaaaguacaggucauuuauuuuuuagaaugucccuuagguuguauuugucugucaugaauagauuugaguugugaauuuuuagcagaaacacccuggaagugguguuuuguccuuugcaguacauaucagaaaacacauggugucaaaccaacccauuacuggugauauaaaauuugauuugguuaugguguuaucuuucagauuucuuuacaguugucauuuauccuuuaauacagcugacucuugaacaacacggguuaggggugcugaucccugugcacuagaaaauccaagcguaacuuuugacucuucagaagguuaacuacugauagcccacuguugaccagaagccuuguaauaaaauaaacaguugauugccacauauuuuguaugugauauguauuauauacuguauucuuacaacaaagcaagcuggagaaaagaaaauguuaagaaaaucauaaaaagagaaaauauauuuauucuucauuaaguggaaguagaucaucauaaagaucuucauccuugcugucuucauauugaguaguaagcugaggaggaagaggagggauuggucuugcuaucucagagguggcagagguggaaaaaaaacugaguuuaaggguacccaccuacccagcucaagccccuguucaagggucagcuauagucaguaggcuucuagcgugaagauacuuugagacuguaaauaaccuguuucuuuuuaaacuaucaaacuuccauccacuaguuuuagcaucuauuagugguucuugucugaaacaauuuuuuguuuuuuguuuuauguuuuuuuugagacagagucucauucugucacccuggcuggagugcaguggcgcaaacuugacucacugcaaccucugcuucccaggcucaagugauuguccagccucagccucccaaguagcugggacuacaagcaugagcuaccaaugccuggcuaauauuuguauuuuuuguagauacgggcuuucaccguguugcccaggcuggucuugaacuccugagcucaaagugauccgcccaccucggccucccaaagugcugggauuugcugagacccgcuuggcuggggagacccuaacccaguggcgcuagagcaauuaaagacacacacacagaaauauagaggugugaaaugggaaaucaggggucucacagccuucagagcugagagccccaaacaaagauuuacccacauauuuauugacagcaagccagucauuagcauuguuucuguaaaucauagauuaacuaaaaguaucccuuaugggaaacgaagggaugggccaaaauaaagggauagguugggccaguuaucugcagcagaagcauguccuuaaggcacgugcuauuguuugugguuuaagaacaccuuuaagcgguuucccucccugggcgggccagguguuccuugcccucauuccuguaaacgguaaacccacaaccuucuagcaugggcauuauggccaucauggccaucaugaacaugucauagugcugcagagauuuuguuuauggccaguuuuggggccaguuuauggccagauuuugggagggccuguucccaacagggauuacagccaccacacccagccugaaacaguuauuaccauggugacugccaaguacaugaucuuagaauuuuuaaaugauuauuuguaguggccaaauuacaacuugauauuaugcuuugagugucuagauuugcucagccuggagaagaaaagaaucauugggagauaguugucuucaaucguuugaagaguuuuuuugcaaagagaaggaagacacaauuuauguuguuugagcaggcagaauuacagcaacagagcaaaaguuacaaguaggaauacuucauauguuuuaaacuucuaguagugcucucccgcacugguacauaccaccuuagaaagcaguguauuuucugcauggaaggaauguuucuucuguuacuugaaugucuacuguggugccaucucugugccaggcaccuuugcacaccuacuuauuuaauuuguuuuauagaugaaggaagagucaguuacaggcucuuucucuuuguacuacaucuuacugcuagaugagggaguuucaguauuucaaggguggauggauucaguaauucuuaauauuaauuccaaaaucugugauuauaugugcaugucuguugcuuuguaucaugugauacuugauuuccagauacugcuaaacuauaacauuacucuuuucaagaaccauuucugugucucuuggcaacagauggguaauuuuaauuacggcacauggguugacaucaaaacuauuuuugagcuagguuguuuguggauguuuaggacuaugauauucaaauaggauauggaagucaacaaguuuaguuugucuuuagacaaaauaagcucaguuuuggaucucuuggacuuaagaggugguaggaguacaucuacucagggugcccccagacaacuagaaauguaggucaagagcuucgggggaaguuuaggaauuagguagagauuuaggaauuaccugcagagaggauaauugaagaaaaugggcuugaauauauuaauaauuuccaagggagcaagauuagagaaaagaggaccaaggacauacuuaacgguuuucaauuuuugaaauacauaguauuuccaagacuagaggaaaaggaggaaucucgauauguucagggguggaggaaggagaguaggaccaaagugagacauguuuuucuucuaggagcuuaaugguuuuuuagagaaaauuauaauuaaaaaugagcaguuaggagcuauuuuucaagcuguauaauaauggagguggccuaaucuuagaagaagacagauuaaugagaaaggcuugaaauaauaaaauauuuuaaaauccagaguuauuaagcauuacaaaaugagaaaagaaaaaagccgugaguaaugauagaauuaaaauaaauaugguuauuuucuuuaucauauucucaccuacaugcggauuggaaacugaaaaacaggagaaauaugugggaaauaaucggguggggaaauguacuauaucccucaccugaaauguuugguaccagaaguguuugggauuugggauucuuuuccuagauuuuggaauauuuacauauacuuccaguugagcaucccaaauuugaaaauucaacaucuaaaaugguucaaaaucugaaacuuuuugagugccaguaugauguacaaaggaaauacucauuggcacauuuuggauuucagauuuucagauuugggaugcucaaccuguaccuuuaagcagucucuagaguuagagcuagaaacacaaaagagaauuuuucuacaaauuuugugcauugaguuuggcagccuguuggaugagguagugguaucuuaacuacucaucuuuagcaccucacuuuucuguugggucccuccugccccuaacccuacaaguugguauuaaaauauuuuaaggucuucuguucacagcauguuuaucggcuugucaguaugcuaauauaauuauguccucagcauaagauuucccaaaucauaguggugaguuuuuucuguuauuuuuuuuuuuuuucagccuauuugauggcuuugcagauggacuaggaguugcugaagcuauuucauauguggauccucaguuccuuaccuacauggcacuagaagaacgcuuagcccaggcuauggagguauguucauaacucugaucuccauauauaaguugaugggauacaaaaugauaaagguuuaaagggauuuuuagacuacucuuaagaaaaggugaaucuuuuucccaucaguuuaguaacaguuauugaauaauaauugucaccaguaugugcauacaaauuauacuugauguccugcuaguuugccuuaaauuucaguauuucucaguuuuuacugcagaauggaaaauguuuugcuuacauuuagaaaauauacuuuuuucucuauugaauuauacaaguaugagagugaauaucuuauauacacacgcacagguguauuugugaaaugcaguugaagcuaaggauauauuacaaaucucuuuuuuucucauggcuucuaaauacuaucuggcugccuaaugcaguuaggaaauuugcuccuccuuaucccagcaaacauauacacacuuuaauaaguggggcauauuugcugccucagcuucucuugccuucuuuucauuauuuaacuaaaacagaaaaaccuguucuuaaauguauuugccuaaguucaaagcccaaguauuuucauguuugggaacuacuacuguaccaguggauuucauuaaaagaaguccuuucaaaucacuauuuccaaagugauuuccaaaauauagguacagaaaugacuggugaaugagccacaggugagagaacaaaaaauuggcaagaacuuuuaggagcauuauaauauauuuugucuuuaaauuuucugagauuagaaaguccaguuuguauauuuauuuauuuuugagacgagaucucacucugucacccaagcuggagugcaguggugcagucauagcuuacuacagcccugaacuccugggcucaagcaaucagcccaccuuagccugucccagguaguggggacuacacauacgggccaucagaccugguuuugguuuuuugugggguuuuuugguagagauaggguccaauuauguuacccaggcuggucucaaacuccugcccugaagcaguccucccacucuggccucccauggcacugggauuauagacaugagucaccaugcccagccagaaagucuaguuuagauugacaaguuagauagcagguaccuaucuaauauugauauauuuaauaauauauuuauauaucuaauauauuaccucucucuaauauauaauauauauuagauauaucuauuagauaaauuugucuuuaaaugaucucuaauauauuguauauuauauauuagauauauaacauauaucuaauauaucuaauaucgauagauauuagauaucgauauguaauaucgauauagauaucuauagauauuauagauaucuaauaucgauauagauaucuauagauauuauagauaucuaauaucgauauagauaucuaugauauuauagauaucuaaucuauagauaucucuagauaucauagauaucuaaucuauagacaucucuagauaucauagauaucuaaucuauagauaucucuagauaucagagauaucuaaucuauagauaucucuagauauagauauccaaucuauagauaucucuagauaucauagauaucuaaucuauagauaucucuagauaucauagauaucuaaucuauagauaucucuagacaucauagauaucuaaucuauagaaaucucuagacaucauagauaucuaaucuauagauaucucuagauaucauagauaucuaaucuauagacaucucuagauaucauagauaucuaaucuauagacagcucuagauaccauagauaucuaaucuauagauaucucuagauauagauaucuaaucuauagauaucucuagauaucauagauaucuaaucuauagauaucucuagauaucauagauaucuaaucuauagauaucucuagauaucuaucuaaucuauagauaucucuagauaucauagacaucuaaucuauagauaucucuagauaucauagacaucuaaucuauagauaucucuagauaucauagacaucuaaucuauagauaucucuagauaucauagacaucuaaucuauagauaucucuagauaucauagacaucuaaucuauagauaucucuagauaucauagacaucuaaucuauagauaucucuagauaucauagauaucuaaucuagauaucuagauauagguaucuaauauauagaugucuguagauauaauagguaucuaauauauagaugucuguagauauaauagguaucuaauauauagauaucuaugauauagguaucuaauauauagaugucuaugauauuauagauaucuaauauauagaugucuaugauauuauagauaucuaauauauagauaucuaugauauuauagauaucuaauauauagauaucuauagauauuauagauaucuaauauauuagauaucuauagauauagguaucuaauauauagauaucuauauauagguaucuaauauauagaugucuauagauauagguaucuaauauauagaugucuauagauauaauagguaucuaauauauagaugucuaugauauuauagguaucuaauauauagauaucuauagauauuauagauaucuaauauauagaugucuaugauauuauagguaucuaauauauagauaucuauagauauuauagguaucuaauauauagauaucuauagauauuauagguaucuaauauauagauaucuauagauauuauagauaucuaauauauagauaucuagauauagguaucuaauauauagaugucuauagauauagguaucuaauauauagaugucuauagauauaauagguaucuaauauauagaugucuaugauauagguaucuaauauauagauaucuauagauauagguaucuaauauauagauaucuauagauauagguaucuaauauauagaugucuauagauauaauagguaucuaauacauagaugucuaugauauuauagguaucuaauauauagaugucuauagauauagauaucuaauauauagaugucuaugauauuguagauaucuaauauauagaugucuauagauauuauagauaucuaauauauacauaucuaauauagauaucuauagauauuagauaucuguccaucugugcacacacaugcaugcauauacauguucacauacauuuaugcuagcucugcuuugucaucacuuuuuuuacauauauaacuguccauggagauugcuuucaauuacgcuuuauggugaguguuuuucucaaaguaaccauagcagaaauacucuauacuaggaaaaaagucagaaagaacaucaugagauaggauacaauuaggauuuuugccaaauuauuuaaccugccuuggcaaauucugacacauaagaaauaaugguauagcaugguaacuugcaucagaaauacauaaagauuaaggaucacucauuucguugugcuaaauaacucuuugagugaucuguucuagggucugauuucacaacauuuagucuuucauuuuaugcuagugguuuaugauuuccuacaauauggagauaacuuuaaaaagaaguguugagaauaaaauguuuuaguauuuauuacuaguggggaaugugacauuuggcaucuugaaagaagagccagagagacuggucuugagaggucaugcuaaguaaaggcacuagcagugaacuaagacaaaaggcaagcaagagcuugcagucucaaacauuguuggcuucuaccaauagugaacucaguggcauuauuccuaccagucuauacuucugccuguguuuaauggcuuuaagcaucucucuccucuaaagcuuaucagcuucuucacauuuuagugcucugauuuaauuuauuugaauuugauugagauguuucacuccuagaaaaucaauacaguugucuuccugucacucuucagaaaucuguuuuucuguguucaguaugcauuuauuuaaucauuuuuuaaaaugaaacaaaaauaauuuaugauuauuucuuuuauauuuaacacuaacacucuuuaaaugaaacaaaaacaaaacaaacugcuuguuuuuguuuguuuguuucucaagcagcccuauaacuuuuuggaaguaguugcuuucauuucuguuauuuucccaauacuagauuggucauuguuuucagguaguggcuuuuggugaaaauacuggcaguauguauuugucuccuuauaucugugucucuaauuugagugaggagaggguaaaaccuuaaacaucuuuaaccuuuugaaacuuuucuacuuuucaaaauggauuuugaaaaaauccccuugcacauuuauguugacaucuaaaauuuuucagcauaaaucuagguaguauuaguuauuuuaucauacuucuucgcuagaaaaauguuuaaaauuuuuaauauaaaaagugguuaaauugaguuacaauuaauaguauccaaauaaucaaaaauaaauuaugaauuuugguaaguguuuuguaggaagugaaucuaaugagauggaggcauuuuccuuucccaguuaugagugaauuuuauuuauuaccggaaugagacauauuucagcauaaauuuacuucugauuuucaucuuaugaauguaagguugaaaaacguuguucaccuaaauaaauuaauaggaauggaaggaguuuauuauggcauugucacugaauucuuuugagauauuugcccagaaucacaucaacuugucuagauauucuuuagauuccuuccguuuuuuuuuuuuuuuuaagcaaaggauuggaagccacccaaaagauuuguuacuuagucauuagaguucaguucuaccucaguacuucagauugucccugugaauggguaagaaguaugcuuuuauuuauaaaguggaagaaaggcaaguauaaacagaauguuagaacagagaaccagcaugauauacugcaggugcauucuuauguggaucaguucgaagaaagauuuuaccuaugaaagcuuauugaaacugauuaucuuaagacuguccauacccacgggccccuuguaaagucuuuacauacucacaauagcaccuguauacacccagguauaggcacuaggaaggcuguaauguggagguuuagaaggugggcuuuuguguuaaagaguuuggcugugugaccuuggacaauucacuuaacuucucugagcuuuagcgucuucauuuacaaaaugggaauaauaaaaucuaccugauggguuauugugagauuguguuaaagccuuuagcaaaauaccugguuguauugggaaucucucaguaaauaguauauucauauagguuuauucaaaucaauagucaacuaacugguguaaucagugaacaaaucuggauucaguggugaucauucagaaucgguauuacuaucuucguucuuuaaaaacugaauuguauuuuauucuuuagaacaaaauuuuaugcugauaaaggauuaugcuacuuuaaaccuacauguauucuagauagggugauuuaggcuaguugucuuucugccucuucgacuaacuauuguaaauacauuguacugccuaaagguauagauaguuuuuuuuuuuuuaauuuuuauagauuuucauacuaguggcuuaaaaggcuaucuuuugcuuguguugcuuauaagugauccuggaucaucuuaaauauaugacaguaccaaggcaauaaauuauuuuuacauauaugaaauuucagguguuacuagcacugcaaauaugcagauaaucauuagaaagagauaaugaacccauugagacaaacauauaucaaagcauaauuagccuggaauaaccuccccaaaugaaaguuacuauaaauaacaucccuuauuucuguuuauguguagcacaaaugaguucuugcaagcagguucuaucuugaguaguacauauggggaauuggaggagauucauaauuauagcuaugugagaaggaaagggacugauaacaggaucuuaccuuccauuuccuaucuugcaaugggaaaguucaauauaaggaauucuaaacuagaacaaagaaguagaguaacaagggauuggcuaggaggaaauaaagauaauuacacagaauaugggaaaagcgcauauaaggagcagccaccaccugucuggcaaagcuaggacaacccaaggaagagucccuaguccaucucagggcugaggucaccuugauggaaauggcacagcuguggcuugcuguaugagagagaagucacuuggguaugugcuggugaaacuugcuggaagucagcucucuuagggugcugaggaaagcuauucauaggaagguuucuaacuggaagugcuguacugcagaacuguccaacauggaugcugggggaggcugccaccuacuaagugcauuacaggaacuggcugcuagagaagcugugugcacugagucuagugcuagagaaagccacgaacaucacucuagucccagugugcucugucaagcaagcacacugggacagaaggaaggcccuuuccuccagcaguguucuucaacauccucugugaacaaagcuuagcaucaugccagcuguuaggagggaaaguauuuaaacagcccagauuuucacagagccgacacaauagugaauauggauuuguggagcaauaauuccauaaauggaacauuccagcacuuugauaacuuggcuuccauauauaccuuucaaugcacauuuaaauuuccauccaucaauagaauuguauuuccacccaacaaaauacagcuauuacuacaaaugaaguuucacccauuucccagaaugagcagauggcuaguuccaagaggcauuguauccaucgcuaguuaugcauuacuccacacauucauaguaacacugaauauucucuuauauaaagacuaaauugcaaauuuaacuuccaacaacuggcauauugaaauagaaaugggaaagaggaaaaguaaacuguuaacauauauaaauaagcagauacauaaaacaagcacauaaaauaugcagaauuacuaauccuuguucuguauuugcucaugagacugaaugauagcuauaacuucuuucuuccaugacccagucauauuuucccugcccucagccagaagcucacucagcugguuaggauucuuuacuugguagaauaacccagaccuacacuguuuauaucuucaguucuuucuuuuuuugucugcuguaguucugguaacuuuacuguugggcaugaaagcaguaagagauucacacuccaggugagauuaucacaggguuuucaagcagaggaagccuagucuguggagggcacacuguuucuacugguaacaggaggcucagagugacuuggggauucaaaguuaucaguuuccucagaguucagucagaugucuucauuccagguuucagaaucuuauuccuuaaccaaucaaugguaaaacuuuugagaaauuugaugagacuaagaagucaacucuaauuuucauuuagcaauccacacaauuacauuuugcguuugauuuuuaggagcaagagcaucuuuuagggcugucguggaugcuuucuggcucucauacccuauugugagguuuaagagaccugaguuuguaauuuuuuucuguaagugcacaagggcacucuuaauaauccaucucacaucacgauuuuuacaguuagaucacuguugccguaagaucaaguauaggagcuaucugggcuuucaagacacaugcuucaguuggaucuucaucacugucaaccacagugauaccuugauuaauugugaugccacuacagacuauggauuaauagcaucccauucucauuggcaaggagcucaacacugagcucaagcucaacagguguaaccaaaccaacccccaaauccuuuucuugccaguucugugucccgggaccacucuuaauaugaauucuguaccagucugaguucagucccaagagagagaaauacaguaauuugaacagggaaaauuuacuguaaauauuaacugcaacagaaguuuagaauaccaagggauuggcuaguaggaaguaaagcaaacucuaaagaauauaggauuagcagauuuaagaaacagcuuuagggcugagauggagcacucuacuucccuccugucuaaggcugagagccagaccuuauugggaaggacacagccauggcuuauggaggaguauuuaugguacugugcuggcagaacuugcuggaaauuugccuucuggaacauggcaaaaaucugcccucuggggcaagagaaacuucacagugaugugaccaagccccuagguacucugcugcagaaccaccuaagaugaguacaaggagaagcugcuggcaaccuuguccuguaauuaccaguuacuggauaagcagcaugugcuucaagagccaggcacuggagaagccacccacacuggaggagucugaugcuggagaagccaucugugcacagggaagccuggcacacugcaggggcaagcccaagggaaccaugaagcaaaguccuuuccuugugucucuccagcaccuucugcugacaaaacuuaaaaucaugucagcuaacaaaaggaaaaauauuuaaaaggcccaaaucuguuuucaaagggcagaaaugaaagguguauuuggagcugagaagcaauaauucaauuacuggaacaguguuucuuucuuuuugcaguguuucucugcauauccagagucaaauuuaguguucaauaauauuaacuauguuuauuaacucuuugugaaccguuuugcuuuuuccuuuuuuaguccugauuuugcuuugggcuuggcccaaggcaaguuguaaucccuauuauaagucaucucaaauucuuuuugggaauaucuaugguaggaccuuaggcauguauaaauauuauguuugccauccagaagaauagaguguuagcuaagcuaucaggcagaauucuucuucuauaugggaaaccuggcuuguucauuuuuuuuuauuaugguaaaauaaacauaauauaaaauuuacuauugcuacaguuuuuuaaaguguacaguucaguguaaucaaguguauucacauugcuguaaacaguaacuccccauuuucccaucuuuccagccccuggcaaccaccauucuguuuucugucucaaugaauuugacuacuuuagguaucucauguaagaaucauacaguacuuaucuuucugugacuggcuuauuucauuuagcauaaugucuucaagguucauccaugucguggcauguguuagaauuuccuuccuuuucaaggcggaguaauauuucacuguauguguauaucacauuuugcauauucauccauccaccaaugaacaguugauuugcuuccaccuuuuggcucuugugaauaaugcugcagugaacauggguguacagauacuuguuuuagucccuguuuucaguucuuuuuggguguauacccagaacuagaauugcuggauuaugugauaauucuguuuuuaauuuugaggaauuguugggcuguuuucucuagcagcuguaauauucugcacuccaaccaggaggggaggcccaguuuugauaguugucaaauuuccuucagguuuuucaucccuaaaaagaagccaaggucuuucauagcuccaugaucuuaugaugcuguaauuaggauauaauacuaacaaguaauaauuaaacgguguaauaccaauucuuugaauacaguagcaguucagaaggauacucgugcagucuaggaccacugacauaggccucauggaagagacaggacuuaugcagucccagagggagugauaggacuuaaaggauggacagaaagcaccaggcaggggaagcagcaugugcaccaagagcaaguaauuguacagguugcagacaaaaagacaaaagucucaacugccauucuagucuaauuagagccagaaaggaugaggaugacgcaucccagaugaucacaugaucugauguucuuuccauccuucuuagaacaguaauuugacacagauauuugaaccuguaaaugaaauucacaacccagauaaccuaguaauacuugugagcugguaaugugggugcgccaaauccaugccaguaguagauguagccauucaggagugcauuauuugcuuccauaccuggagcuucuaguagccucagccacauuuuaucuuucaugaagugaaccuuuccaaaauguuuauuauuuucuuucauguuauugaucucacauaggaaccaauaguuggaaaaaguaaccacuccuucaaaauauaaauacggagaaguagaugauuauugagacaagguaguuuuuuuuuuuuuuuuuuuuugagacagagucucgcucugucacccaggcuggagugcauggugaucucagcucacugcaaccucugccucccaggaucaagcgauucuccugccucagucuccccaguagcugggauuauaggcacacacuaccacgaccugcuuuuuuuuuuuuuugagauggaguuucguucuuguugcucaggcuggagugcaauggcuugaucucggcucauuacaaccucuaccuccuggguucaagcaauucuccugccucagccucccaaguagcugggauuacaggcaugugccaccacacccugcuaauuuuguuuuuuuuuuuuuuuuuuuuuacuagagacgggauuucaccauguuggucaggcugucuugaacuccugaccucaagugacccaccccgccucggccucccaaagugcugggauuacaggcaugagccauugcgcccggccgagacaagguauauuuuuauuucacauguagaaaguugggcucugcguguauauuuaauguuuugguuuguuggugauggugguaguuccuucugaagaggcaaaaggagcaaaggacuaaagcaaaagaaacuaacaaaaagagaauaauggugauauaauuuuggagauacccuaaaaauaguuuucuguuacuguuuuaaaguauuucuaacaaagaacuguaccuuuuguuuuucagacugcucuggcccauuuagagucucuugcaguggauguugagguggccaauccaccagcuaguaaggaaagcauugauggucuuccagagacccuuguucuugaagaucacacugguaagggcaaaguugaucucaaauguugaagaacacauuguacauuuaaguauauuaucaauauaccuagauaauuaaauacuugauuauuagaaacuuucacuagauuuuuuuuauagaaaccagaugcucacaaacuuucaccuaguacaagaauauuuuuaauuuucaagcgauaggcugagacaaauguuccucugucagcuuuuuuacaaagcaguauuuauuagauuccaaauugccaaguauuagacagaaaugccugccaauuaacuggucaaagacuggcucuuucgucuuucagagguaucuucuaugaguauaauauguugcuuuucaguuuuacuaaaauugaacuacgugugauugaccugaauuauuuguuguuuucagcuauuggucaggaacaaugcuguccaaucuguugcagugaguauauuaaggaugauauagcaacagaguugcccugucaccauuucuuucacaaaccuugugucucaauuuggcuacaaaaggugagugauagaauaauuaaaaauuuaaaaauacuuuaauagugucuucugcaagugaauaauaguaucuuuuuuuuuuuuuuuuuuuuggugagacaaaguuucgcucuugucaccuaggcuggagugcagugguucgaucucggcucacugcaaccucugccuccaggguucaagcgauucuccugccucagccucccaaguagcugggauuacaggcacccaccaccaagcucagcuaauuuuuuguauuuuuaguagagacagaguuucgccauguuggucaggcuggucucgaacuccugaccucaggugauccgccugccucagccucccaaagugcugggauuucaggcaugagccaccacgcccagccaauaguaguaucuuuuaaaccuguuuuauuuagccgcaaauuuguaguacuuuuuaauucauuguuaaaaaccugauugcauuuaaugauuacagaucagggauaauauggaaauauuuuauuuuacuaacauugucuaaaaauauagacaauaauaacaacauguuuuuaaucauuuuaggaagugauuaaauaucugaaaacucauuuuagaauaaagcugauuagaauuuuaaucauaacccugaaauuugguguuuucaaaaguaucuaaagcagagaagccuuuggcacuacucaaaguacuauaacaauauacagcuauucugcuaauacagguugguguuucugaaauguauaugagagauacuuaauaaccuaccaaguagcuccuauuccaguuuuuauauauugucuucaaauauuuacccaauaaaucuuuuuuuuuuuuuuuuuuuuuuuuaugguacauuaucucucuuuauuuacauauuuucuuuuuuucuuucuuucuuucuuucuuuuuuuuuuuuuuuuuuugcaccgcccuuaauccauuuaauccugaguggacacagcacauguuucagagagcacaggguuggggguaaggucacagaucaacaggaucccaagagagaggaauuuuucuuagugcagaacaaaaugaaaagucucccaugucuacuucuuucuacacagacacggcaaccauccgauuucucaaucuuuuccccaccuuucccgccuuucuauuccacaaagccgccauugucauccuggcccguucucaaugagcuguugggcacaccucccagacggggugguggccgggcagaggggcuccucaccucccaguagggguggccgggcagaggcgccccucaccucccggacggggcggcuggccgggcaggggggcugaccccccccccaccucccucccggacggggcggcuggccgggcggggggcugaccccccaaccucccucccggacggggcggcuggccgggcagaggggcuccucacuucccaguaggggcggccgggcagaggcgccccucaccucccggacggggcggcuggccgggcgggggggcugacuccccccaccucccucccggacggggcggcuggccaggcggggggcugacacccccaccucccucccggacggggcggcuggccgggcagaggggcuccucacuucccaguaggggcggccgggcagaggcgccccucaccucccggacggggcggcuggccgggugggggagcugaccccccccaccucccucccggacgggguggcuggccgggcggggggcugacccccccaccucccucccggacggggcggcuggccgggcggggggccgacauccccaccucccucccggaccgggcggcuggccgggcagggggccgacccccccaccucccucccggacggggcggcuggccgggcggggggccgauccccccaccucccucccggacagggcggcuggccgggcagaggggcuccucacuucccaguaggggcggccgggcagaggcgccccucaccuccuggacagggcggcuggccgggcgggggggcugacccccccccaccucccucccggacggggcggcuggccgggcggggggcugacccccccaccucccucccggacggggcggcuggccgggcggggggccgacauccccaccucccucccggacggggcggcuggccgggcggagggcugacccccccaccucccucccggacggggcggcuggcccggcggggggccgacccccccaccucccucccggacggggcggcuggccgggcagaggggcuccucacuucccaguaggggcggccgggcagaggcgccccucaccucccagacggggcggcuggccgggcggagggcucacccccccaccucccucccggacggggcggcuggccaggcggggggcugacccccccaccucccucccggacggggcggcuggccgggcggggggccgacccccccaccucccucccggacggggcggcuggccgggcagaggggcuccucacuucccaguaggggcggccaggcagaggcgccccucaccucccagacggggcggcuggccgggcggagggcucacccccccaccucccucccggacggggcggcuggccaggcggggggcugacccccccaccucccucccggacggggcggcuggccgggcggggggcugacccccccccaccucccucccggacgggguggcugccgggcggagacgcuccucacuucccagaugggguggcugccgggcggagaggcuccucacuucucagacggggcagcugccgggcggaggggcuccucacuucucagacggggugguugcccggcagagggucuccucacuucucagacggggcggccgggcagagaugcuccucaccucccagacggggucucggccgggcagaggcgcuccucacaucccagauggggcggcggggcagaggcgcuccccacaucucagaggaugggcggccgggcagagaugcuccucacuuccuagaugugauggcggcugggaagaggcgcuccucacuuccuagaugggauggcggccgggcggagacgcuccucacuuuccagacugggcagccaggcagaggggcuccucacaucccagacgauggguggccaggcagagacgcuccucacuucccagacgggguggcagccgggcagaggcugcaaucuuggcacuuugggaggccaaggcaggcggcugggagguguagguuguagugagccgagaucacgccacugcacuccagccugggcaccauugagcacugagugaacgagacuccgucugcaaucccggcaccucgggaggucgagguuggcggaucacucgcgguuaggggcuggagaccggcccggccaacacagcgaaaccccaucuccaccaaaaccagucagguguggcggcgcgagccugcaaucgcaggcacugggcaggcugaggcaggagaaucaggcagggagguugcagugagccgagauggcagcaguacaguccagcugcggcuccgcaugagagggagaccguggggagagggagggggagggggagggggagggggagggggagggggagggggagggggagggacccaauaaaucuuaagcauauuugaauuauuuaaauaaaggaaguguuuuauuucagucuucucugugaacucuguuuuugcauaaaggauauuuaccauccaguucacuaggaauucccaagucacuuucccaaauuaucuacuuaggaauacaacucccuuucuucccuauaaaccagugcuuuuuuucuccuucccuuuucccauuccuuuccuuccuuccgucuuuccuuuuccuuucuuugcuguuccucuauuucuauuugccacuuuguucuucucaaaauuccacuuaaaaucucugaaauccaguuuagaaauguucacuguucuuuuauaaaauaucucuguaugagauaacccauagugccugucagguaguaagugcccaguaaauauuuuacaaaucauaucagaugaaagcuauuauuagaaauuagagguguuuuuauuuuauuaacaacaaaaucacaaauaaaaacuuauggugcaaguuacaaagaccagcuagcagucuucaguaaacagcacgugcuaauguguauuauuugaggaguauugucugcauagagauaaugugugucucaagucucaugagacuuccugguauucuggauugagguauaaugcuggauucugaauuaguuuuaaaauacugcuuuccuugcucucucccuucucccagaacaaaauuugggaaauaauauuuuaggugauuuuucuuaaucuguuuaucuggcauuuuguuaauacagccuagauggcugugcuguacaauauaccaaccucuaguguuuuuauaagaguugaaguagguaauccaugaugaauuuaauauaguguuuggcacauaguaaacauauaggaaaaguaaugguaaacuuauuacuaaugaaaguuagaauucaguagaaaaugacuuuuucagugucuguacaugauggugguaguaguggaaguagguguuauuaaaauuauuggggaagcagaaaaugcagagccaccaacucuuaaaauuuucgagcauggcugagucugugagguccauucccucauuucauuucuacucccauacauuagaccuucaacccuuguugucuuaacuacuauuguagugaccuacuuuauuuccuuacuuccuuuagagguacuuucuuuucauuucuuuuuuauuugcauaaaucugugggguacaugugcaacuuuguuacaugcauagguuauguaguggucaagucagggcuuuuaggauaucccaucaccuggauaacauacauuauacccauuaacuaauuucucaucaucuucgccucuuccuauccccucacucuuccaaaucuucauuaucuaucaugccaucauuaaaggcauuuucugaaauguaguucugauaauguacuucccuucucauaaaagaaagagagggaccuccagucaccuguggaauaaucugaaguuuuaaucuugacauucaaggccuucugugauuuagacccccaacuuguuucuucagauuuacuuuucuguacacuugcucauguuucuaugcauuugcuccugaagucuggcaugauuuuucccuauaccaucuguaagauuagaugauauagguaggugcaguuuaaauuccaccuuuucuguccuuaauaaaugccgucuuuaaauucccaugauagcuucagagacuuaagaagcaguguuuugugugccugcugugugucagucacuguuagaugauuccucuuuaaugauucaugauuucuccuuuaauccucacaguacuuuaggacuuauuguuaucuuuauucccguuuucuaaugauuguuacuugucuaaguuuaaauagcuaguauguaguucaucaagaccacacucaucuauuugacucuaaaauguuauuguuggggcccaaucuguauggcaaguacacaauaaauguuugcugaaaugaaauuuuuuuuuuuuuuuuuuuuuuuuugagacggaguuucacucuguugcccaggcuggagugcaauggugcugucucagcucacugcaaccuccgccucccggguucaagcaauucugccucagccucccgaguagcugggacuaaaggcgcaugcugcaacgcucagcuaauuuuuuguauuuuaguacagacgggguuucaccauguugcccaggcugguugcgaacuccugagcucaggcaaucuguccaccucggacucccaaagugcugggauuacaggcaugagccaccgugccuggccugaaauggauucuuaaacgguaaacguaauauauguuguacagccuugaauuguacuugagacuuugcuguaacacaaaguaacagucucuucagucuuucuccugucaggaaauaccuuagugugaagccuuuccugcuuuuuuucuggggagaauguucccaagauacaguucuuuguugccuucgacagcaugaucucuucagccucccuuccagcagggaguucucuuugggaaaaagaccagauuugcaaggggauaaucuguuaucagauaacguagcucuauaaucguccauugguccuagaauguugugcuccuaguauaacugcuuucuccuucccaccuucucuccaaggucugugguugauuguuuugucauuuagaaggcaccuaacacucuuaucucuuuuuggaaagaaaugucauggcuuagaaagaaagucugaaguccaucugcuuugacauaucugugcuacccuaaaaugaggcuuuaauuugccaucgaccuacguuaauucaucguagaccuucuuuaauucacaccaaaucauaaaugauuuggugugaauuaaaguaggucugugguuucucuaguaaacgcauaauagacuaaauaaugauaauucagauuauuguugagcuaaacucugaccuccauguggacaugugccaugauucuuugcucacccucugccauugcaucacugcugaguuuagcagcucuuaauuaaaacucacuaaauuaaggaggaugaaugaccuuaaagauacgaacaugaauaagagacaucauuuacccucaaagaaacuagagucugauugggcagggaggaaaagguauuaaaauuaugucuuucugcauuguguggauuugaaguuuguuuuuuguuguuaagagucuuauuauuaggauaaugacacuguuuuuucuuuauuaaguuacuuguguggcaguuaagaugauucugguggcucuuaacauuuuuuuuuucuccagucgggaacaugcccugugugccgccgucauuucccaccugcgguuauugaagcaucugcagcuccuuccucugagccugauccugaugccccaccuucaaaugacaguauugcagaagcacccuaaaccuugacaguugaaaugagaucaguguaucaaaguaaaucugcaaauuccuucuaaauuucaugugcaaauaauuauauauaaauauauuuaaaaaugcuauauauaguauaugccauaguuuagaaagaauauuaaccuuucuaaacuaaauuuagguuugcagaaaguauuaaacauuuuuaagcugaauguugagacagugcauccauuuucuuuaguugaauauguuuguauuaauuguaaagccaagcuuaucaguugacucucuccagaauaaauaaucaucuguguggcauacguuauuggcuuugucuguaauacugccacuaagugauuauaauuaagcuguccuguuugcaucaaauguaaagacuguguucacaaccguaguaaaauuugguuucauuggaaaugaaacaaauucuaaaguaugcuuuuucacuagucccuuugauuuugcuauaucauaaccucuugguucauaugcugagaaauuuuucagaaaguccauuuuuguuuaaaauuagaacuuuucagaaugccaaaugaaggcuaaaauuuuggccagaacauuacaaaaguuuuaaaucguagacguaacucccccugaaauaaaguuagguaguaaaauccuuaaugaaaccaguggaugugcuuaacguaagguuaguaaagcauacaaagaaucuagugugcucagggcuugguacaaugagcugaauuagauggccuuaugaaacucuuucuaaccucuuacccaaccuguuucuccuugguuaaaauuauacuugaaggcccagaacacucauggcacauuuguuuaauauugcuuauaguuaguuuaagguaauuuugcuucuacaguauuuuggaaggucugaaaacuugcacagggucaucuuuguaauuauauaaccccaaacuaagaugcacaaugucuccuucaggugaucacacacaguggacgaguaugugcaaacauggacauaauaguucacuuacaaaugugauuugauguuaacacuagagaaugaugacuguagaacauuugagcaaguaaaauaguaaagcacauagugaguguauguccgucuaacugguacauugauaauuuaguuugggcacauaaaaggaauauuuauauggcuucccaaaugcagaguuacaucuuauucguguauuucucugaguauuuauaucccgucuccuuuuuucauucuuaaaaauaaaugaauuuucacuguuggcacauaugaggcuuaaauauaaggaacauaacacuugcauucuaauuuuugcauauauuguaaaugugucugguauuuacagcaaaauacuguguauccuuuuauggguaaaacaaaagugaacauugcaugcauguaaugugaugaauuuguaauuuaggaguucuuuggggcuucugugacuugggaaaugcuuacauucaggccuuaauguugcauuagcuagcauguuuucccucugauguauauagucacuguuguauaaacuaaucuuugcuuguuuucuacucugugaucuuuccauaucauauuucauuaaugaucaguuagugucaaggagucaaaacagauuaaaauuaauuucauguguauaugguggaaauuuguggcuagugugauuuuuguuuguuuccuuuuaaguacuguugaucaguugugacacuuacugguuaaacuuacguugcuaaagauuucucuauaauaagccacacauuauauuuagacuauauuaagggaccuugguuuucuucuagauagcagcugucccaaagaaaauauuucuucuuugucuguuaagauuuagcuauuaucugccaguuguuaagagguuuugguuccaaacucaaccagcaauguugagagcugaacuuaagauagcuguuguacuuuuugcuuuccaucuguuacuguccuucauucuuggcucccuacuaucuauaaacagcugcugugaagaagaaaaguugaauaagaguuggcuuaaauuuuaaaaaagaaaaagaaaauugagguuuuaggauuuucaugguaacaagcucugguauaagcuaaggcuggcaaguucagauacuaaaauauuauuugaucauaucuuggauccuuuugaaaaaguuaagacuauaugaagguaaauuagaaauaaguaugaauauuaauaaaauagcauuuaucuuauuucucuauuuuauguugugacuuaaccuaauuuuauuuuuuuaacauuuucuuauuucuuauaauaugaaugcugauauuuaaagguagaucuaugugguauucuuuguguuucuuaauuguuuaacucuuaagauuauuugugaucuggauuuauguauuuguuagauacauacgaauuguuaaaauggaaugcaaguuuuucaaaagcccaggucuaaauguaaugguugguuuauuguucuauaaccccagcccaucauuuucuguguaaaucauaaacaauaaacagaauauacucgguggucauuucuaaua

SEQ ID NO: 192719 - RNA, 46064 nt, Homo sapiens
agaagcucccggccgggggcgcgcacguaggcacgcagaggccgucacgugggucgccgaggcucgcaagugcgcguggccguggcggcuggugugggguugagucaguugugggacccggagcugcugacccagcggguggcccaccgaaccggugacacagcggcaggcguuagggcucgggagccgcgagccuggccucguccuagagcucggccgagccgucgccgccgucgucccccgcccccagucagcaaaccgccgccgcgggcgcgcccccgcucugcgcugucucuccgauggcguccgccucaggggccauggcgaagcacgagcagauccugguccucgauccgcccacagaccucaaauucaaagguaggcagaacggggacacccccgggugggguggggcgcgcggaccgcuggcugucggcgggggggcgcggagggcacguccgcggcccuggcccgagggagcgcccccucccccacgccccggcgccuucccuuucccggcugcuuucuugccgccaccucggccggccugccccuugcuccggcccgcuucauccccucccgcccgcccucgcugcggugcgcgcgccggccggggcgaggcggaggggagcccggcccuggcgccgccgccgccgccaucuugcggucccgcgggggcgccuccugggcguccggucccgcccgcgccgcgguccgccugggcccgcguccuuggccccagaggccgacggcgugcuucggcggggcgugggcggcugggcacccgagggcgugcgcucugggcugcggcggggagugggcucuggagguggcgcaagcugcgucugucgcccgcucccggcugucagcggcgcggggaggcuagggcacggcgcgggaccccuugggagugagagccgccccccgaccccugccccggcccggggagagcucgcugcagccggcccucggguuccgcggagggcgucgcuugucaccuuuccgccagguuuagaacucggccgucagguguaggacgcgccggggagguggagaguccuuggaggugccuggcgagggcugcccggugcuguuggcacggacccaggugcgugcgggcaggagcgaugcgucagccgcaaacggagaguuguagguucauaguagcggggcuuccugccuucuacgacauuucagugugccacccgcgugcuuuuauuuagcccuuuaguugagcuccucugcugagaaaccuucagugcgugugacuuuuuugcuuuuacguuugcgguuuccgacagauccugagaaggcugauaaggugucacccagcucuggaacuuuguagguuuuuguaguacugccugugauaaguuuuuuagucugacuuggugauccuggaagaaucccaggggcuuuuggucgguuuccuugucaauauguaguguacuuuaggaaagagaguuaaaauguacagauuuuuauuuuuuuucuuuguuuuuaaggaauacugaaagagugugaacaucuaauagaaaguagguuccuuccuaucuuuaguuaaguguaaagugagucccguuuuggaagucuaugucuuguauuucaauuguugaaugagaacaauuuuugugagguguauagcaauucuagugcuaaaagaaaaaauuaaauccuuuauuguuguguaaggcugaguccaagagaaagccaacuacauuguuuuccauaggaaaaacuucagguuuaggaauuuaaaauauauucuggaauuaugagauuaauauugcauaacuacauugcaagcuuuuuagugcguuuacaaauuucuuugaauagaaguguaagugagcuacuuguuggguaaggauuugguuuuaaggugcagugaauguauuuuauugcaaguuuauguaaguugugugauuuuuacguaguuguagcugggggaaaaccuuugaggaauuaugaagaguccugacucagccauuaucuugagauaauuuaauguaaaucuguaugguguguuuuuuuuuaauauuucguuuuuaucuuuugauuggcuguguuuacagugaacauuuccucuacuggauaacuauguguaaauugccauuagggauuuauaagccuuuacaaccaguuuuaggccaggaaauguccacagaguuugaaguuuucuccuuagggaaguuguuauguugcuauaguaagggaguaauaauaguggagaagcaaguuuaaaaaacaagcaaaagcccuacacagugacuuacucauauauuuccuuuuuuggggguguuggagaauuacagcuaugauuauagaacucauuguuuuuguguugccaguaaaaauaagacuagccagggaagcagaaaagguguguagaugguauaacagagacacaaccgugucugaggaaagaagcccuuucucuaugugccccaucccucccuuaggaagcauuuaaggaaaaggcuuguuuuucauuucaggggagguuuaggccaagagagugguugaguaaacacacugcugugagagaaugccugguacuuaaaugcccaauaguuuguuguguguuucaguuuaaagauggagaugauggggaggauugggaggugacauuugguguuugauuccuuaauauuaucguuuuagucaaagguaaauuguuggcuuugauggaaaccuuuguguauuuaaaugcacaguucaacacugaggagauucauuuagaauguacagucuacuugggcuuaguuuaugauagaaaaaaaucauuuaacugacuuacccuaagucauucaaaacuuucuaagugaaggacuuuuagaagacaguuuugcaaaauucuuugucaucuucuaguagguuuauuuuaguuauugauucugaguuugagaugguuucuccaggagugacucagguaaucauucugagauuggaugguuuuucuuuuauacaccuaacaagcaucuugaagaugaauuaacaguauguugcacaauuuugcaaaagcagacaccaacuauuucaguacauuuuucuguauaccucaguauuuaaaaaaaaguuuguuuuauacagucguuaacauauaaaagugcauuuacgauguaaugaauucugaaguagaucacuuguguuaguaaagaaaaagaaguagacgcugcuuuacuucaaauucuguuuaaaccuuggaaguaauuuuaccuagauuucagauuugaaacuugguauuuuaugugaaagauuuuuuuugucuuuaaaauuuuuuacaugauaaaauuccauuuauaauguauuacacauuuuauuuuucuaccuauuagcaguuuuuuuaaauuuuuuuauuuuuugagacggagucuugcucuguugcaguggcucgaucucggcucauugcagucucugccucccggguucaagcaauucuccugccucagucuccagaguagcuggaacuacaggcaugcacuaccaugcccagcuaauuuugaauuuuuuguagagacgggauuuugccaggcuggccucgaacuucugaccucaggugauccgccugccuuggccucccaaagugcugggauuacaggcgugagccaccgcaccugaccccuauuagcaguuuuguagaaaaguuugaagaagaaaguuuauaaaaugcuaaaauaaauuucaaauauauucuuaaugaucagagagagacgaaaauaaaccaaaauccuuauguugagaguggccgauaacaauaaaucaacaaagaaaauuaagcucucugagggaucgagggacguaugguguuaacaucagcuagugcaucugcauagaagcagcacggggcgggggggaaauuagagaauacuccucuggauggauauuuagcacauuuuuagguguuuccagucggcucuucauguuucccaguggcuauacaaaacgccuggggcucuaaagacaugaauguaaucuuuaaucauauauuacuccauuccuuaguuuuuagguaacucucaauugcucacagaauaaaagucagauuuuuuuuuuucaguaagacauaccaucucuuccaugaugugccuuccucuuguaacaccuguuagucuguacacauccauacuuucuucccugagaaagaaaaacccugcucauacccaagguucuuuguuccucuauuuuugcuggcuaagguaaaauuccuuaugacucagaccauguuccaugagauguuuuccugcugguuuucaaucacuggcugcauuguuuuaacauauaaauacaccagagucuuugauuuuaaaaacaaaugagcagacauguacuucuuugaccauaacucuuucuaguaugugucucucccuguccuucauuuccuuugcauucagacuuuuuggaaaaauaguccauauucacuguuuuuccaguuacucaccuuuuauucucuccuuaguccacgguacuuuuauccucucacuacuuauugcuaacuuaaucauuuccaguuuuuaucuuacuugaccucccccuggcucuugacaguaccgacaguuucucuaaaaaaaacccucaauucuucuggcuucuauaacagcauugucuucuaauuuucuuauuugcuccauuuauugucuuauuuguggcauuuuccucaaaugcucauguuucugagauucugauuugguuucauuuaucucacucugugaacuuucuuuguucauuucauuguuuugagguuuucucuuuaucuuccuugcucucugcagguauugcuacacccccaagucuguuuuaauucacauuuuaccgucagucaagagcacauacucaaacaacuuauucacuauuuagauuugaauauugcacagauaugauauucuaaacucaaaauaucucaaaauuuuuacuacccaugccuacucuucuucccauauuuuuuauuuuuauuuuugagauggggucuugcucaguugcucaaccuggagugcaguggcaugcacguucuuggcucacugcagccgugaccuccugggcucaagugauccuccugaauagcuaggacuauaggugcaugcuaccaugcccagcuaauuuuuuacguacauaugggggugccgcuguguugcccaggcugaucucgaacuccugaccuugcgugauccuccugccuuggccuccuaaagugcugggauuacaggccugagccauugcacuuggcuuuauuuuuauuuuuuaguggcaucaugauuacucacaccagaaacaauaugcauaucuaauaauuaaaaucuguguuucuauuuuugacauaaucccuuuguccacuucaauguguuucuacuuccaaauucauuuauuuuuaaaauucauucaauuauggaucuaauuugauuagauuugaguaucugcuacaugucagguaugaugaauaaauauuggaacuacaguugugagugaaacacaagccauguuuucauggggcaguucuaacaagagagauagauacuaauaaaauaaucagaagaauaaaguguaccccugaagagcuauauagugcuacgagaauguaaaauaagggucuucgaucaggcugucacaguugaacuaagauuccaacaaugaguaaaaguuauccuggugaagaagaaaggaaaaugcauguucaaauauccgguagcaggagggacugugaaacauuuaccauacugaaagaggucggcguggcaguggugaaaauagucaagaugaauguagugcugguuuaguaggucaaguuaggaguuuuguuuuuauccugagccacuaggguuuuuaagugaggggaggagcaguaaagauggagggaaucgaauaacaucacauuugcauuuaaaaauaauucugguagcaauguaaaauuauacuagaggggagaaagagaugaauuaggcggcugcagcaguacuggcaaguggugaccccuuggacugaggucaugguauuggaggugaugaaaaguuagguugaaucugugagacuugguggucucuaugugcacugagagaaaaggguaugaaugucugagauuucugcuuauauaacuggggaaaugguggugcuauuugagaaacgguggaugucuggaugaggacgaaaugcaucuuauuugggggugugugagagagauggaggaggaggacguaugguagauauguuuaggucuuucaggauauuaacaugaagguggauuugguuaaauggguguguuacuuaagaaaaggucugggcuuuggauaauuuccuuacuucagguccuuuuauauuuacuagucagcagacaucuccuuuucuuuucuuucuuucuuucauuuuuuucuugagauggagucucgcuuugucacccaugguggugugcaguggcgcuaucucggcucacugcaaccucugccucccgaguucaagcgaugcuccugccucagccucccaaguagcugggauuacaggcgugcaccaccaugccuggcuaauuuuuguauuuuuaguagagacgggguuuugcccugugggccaggcuggucucccugaccucaagugauccaccugccucugccucccaaaguguugggaugacaggcgugagccacugugcccagccuccuuuauugucagcucuuuacccuguccuccacacugcugcuggaacuacgcuuuggaaaaaggaggcuguuacuguuagucccuugauugaagaacucuaaauguuuucuuacuauguacuugaaaaauccaaaauccacugccuaacucuccagccucagugucuauucuuuuucuucuguccauaacuuuggcuauaugaaaccauuuucccaaacacuccaggccacugcaaugcuuugcacaggcucugcuuagaauauuguccucccucacgucugucaggcagccucuuauuucaagaaucacuuccucuugagaagucguugauacucuaccaguccaaguuggucagagccuucaugccacuguugaagcuugugcuuaccuguaauaacaguacuuucacauuagauaguaguuaggcuuacauauucuccccucccaaacuauacuaugaacucugaguauauaccuguuaauguuuguaguaacaaguucuggcaucauaaaaugauugcccaguaaguguugauugaauuaauaagacucagaugauuucuccaguaauuuuuauuuuuuggucuuggaucuugacucaguuggaguuuucaccugcuuuugcagguaauagugcuuucaaaauuuuguacuuccagaaaaggggugguaggcuauuuuguaaagagcugacuaacccuaaagguagguuguuugauguuuguguuuuuuucauuuguaaaguaagagguuaggacuaggugauuucuuggguguucugucuuuaaaaguuugugugaauauaugacaauugaguacaaaaagaaaaugcuauuuuucugugaagcagaaaaaugcauauaaagaauagggaaaacuauacuuuuaauccuuuaaaaagauuucauuguguauauuugagguauacauauaacaugauguuaugggauacauauagauaguaaaaugguuacuauagugaagcaaauugacauaugcaucaucucaacauaguuucuuuuuaucuuaccuuuacugaccauuuagugaaaucuuauuugccuuucagagguggaaguugauacaggauggaucuugcucucuuuugaucauaaaguuaguuuuggaaaaaaauuaaaugugcgagaggacuguuaacuugcaaaugcuuguuuacugguuuaauucauuuuauaacugaaaugugacucaaauuaguuuuaaauuaguaaguuuuaaacguuugaaaacuuucaaacaugagcaccuuauaauaugaaccucaguaugcguuaauuuaguaaauuaaauuuaaauauaaauuuaauaauugacauuuuacuauaaucauacguguuuauuuauauauuuuuguuugccuccauguuuguauuuuuuugcagcggucucacucugacaccagacugaagugcaguggugcuguuauagcucacugcagccuugaacuccagggcccaagcgauccuucugaguaacuaggacuacaggugcaugccacugugcccagcuaauuauuauauguuuuauuuuuuguagagacagucuugcuauuuugcccagccagaucuugaacuccuggccucaagcgauccuccugccucagccucccaaagugcuggaauuacaggcaugagcuaccauaccuggccugccucaguauuuuuaaaacaaauccugaaugauagcauaacauuucaucccuagauacuugaguuugcauuuauaaccaaaaaaggacauuuucuuugcauaaucaugauacuguuaacacguaauaacauuaacaguaauucuuugauauccucuaauauuuagucuauuacaaagaacaaaaucacacuuaagaguuuauuaaugagcaaucucaauggcauaggaaaucagguauaccuggucucacaggaagaggcuguuuauaaucuagauucaaggccagccaauauauaugcuggugacugaccagucaaaauuuugauggcucaccuugaaacacaacuauaaauagaugguuauagguuucagaccuucaaggucauauggacugggagacaaaacaguggcuaauuuggaccaguggcaagcagaagcaacuaauugagagaaaaaaggcagagaaacguaggcagagaggucuuuugaucccaggaauuaguuucucuugaauacagccucuuccugugaugccaguuauacuucauuuccugugccauugaauugcuuacaucuuuaugaugaacucuucaguauggguuuuuuuaauaauaaaauauucuuugcuuaaaugagauugaauuugauauuuucugaagccauauuuguaacacauuauucuuuaacauuucacuuuauaaaaaauaaauucuguaaucuguuauacauauuucacuuuguaauuguuauucuguaacacauauuucacuuuauaaaaagucuaaacuagugucuucaaugcuuauaaaagaaaccuccguaucauuuuugcugacuuaugcaucauuaauauaccauagcaugcuuagcugcuuuucucugguguuuggauguucuuuauaacuaguuaucacuaauguuugauacuguucugaaaauucagauuuaaaggagugagaaguuuaguuacguaucuuuuagcuuuuuaaggaaaugauuagauugaauuaccguuaaaaaguagggauguuaauuaaaaaagaauuguugcuaugagaggacuuuuaaacuuuuagcauuuuaaggaaaugauuagauugaauuaccguuaaaaaguagggauguuaauuaaaaaagaauuguugcuaugagaggacuuuuaaacguauguuuauaguauaacuugacaaauuucucaugggccuauguuuugacagcucuuuuguagcuguauguuucauguauguguguauaugugugaaguguauaugaauauguauauaauuuuaauucuugaauaauaugacauggagugacugucauacuuuaaagacauagggugccuuuaaaucauacaguguuuccuguuuaguuuuuccugugaaaaaauuuuacuuuuuaaagccuguagggccagaaucucuuggucuuguuuucugaguacuguucccacugagaaaaaccucacuaacaacagauccccaaaaaaucugugguucugaauuuuuucaguuuuuucuuccaggauuuuacaaguaagaggauuuauaagcaaauuaagcuacuauggguacauguuuaaaagucccuuguuauauaaaaucagugcuaaauuagaaaauggaaaaaguauagauauuauaaagcugucuauggccauaccacccugaacgcgccccaucucgucugaucucggaagcuagcagggucugguuaguacuuggaugggagauauuauaaagccaauaaaaauuacucaaucucacaaaauaaccucuguuaacauuuugauaaacuuuuuauagcuaugcuguguauaauuauauauuuguauuuuguauguuuuuaguuaagauuauugugaucauuuuuucauguuauauuuuccccuagcaaaaacuuuagaucuaaauaauaaaaaaaaaaguuuguuucagguucucugaaaauguaccuucuuuucuauuucuuuacauccuaccugucuagaauccaaaaacuuaaacuuuagauguggaccgcucguuucuauuuuaaucaagauguuaaauuauuaguaaguagcaugcacuaauuucacguucauucuugaacacuaacauuguucuuuuacaaauaauuuacguauguguacaucuuauuguucuuuggaaguuuagaguggagggacauaaaauugguaugaaauguugcaaaucaaaguguuccacuucuguguuaagacuauuguuuauuuucucugccuuguuuucaagauuaugucaccaggauuguuuaggucagacugagcaguguaugcaucagaauaccuuaaaaagcacuccuaaaacguuuaagguaguuuuuuaagaugaaaugucaauaaagcugugauggguuuaagauugaauuaucucccaucuuuaccaccggguagaagacguucuuuaaggugguaaguaaaguuaaucacaaugucacaugacaugagagaagccuuagagaucauuuugccuacaaauucuaaaaugaagcagguuagacugggauagagaggggaagugauuuacccaagguccaucagcuagguaaugguuuuagcuguuaagccucagauugaacauacuacauuaugcuuuuuuuuuuuuuaaagucauaguauaacaucaguaacaaaaaugagcaucucccuugccccagaaggcugccaaaagaauggaaagaaguguuuucauuuuuuauuuagguacguguuuauguaaaggugauggaugaguauuuauacgaccagaacaauacuacacuguaugaaaaugguguaaaagaaguaaaagacauggucccuuccgguugguaacuuuuucauacuguaauuuuaggcucccagaaugggaauacugguuuauaaaaaaugauuacaugaccauauuaaguggauuuuggagaguuuucaugauacauucugaaacuguugauuguauaguauggauaaacugauuguauaauaugauuguauaauauguuuguauaauuguauaauaugauuguauaauauggacagugaggcaauuucaguaauuaaagcccuuagaggcuuaaauaaaauagugcagucuugcuuuuccauuaaucucaggauccauacuuuuaugauguuagugaaaucuuaugaagagauauguuuuagugcuucaaugacuaaguuuuuaaaaauagaacuaagacucauuuuuuuucccagaaaguauuacucuauuuguacaaaaauauuuauacaaaaauauuucuucaguaccuacuacaccaggcauuguguuaguugcuggggauacagcagcuaacgaaacaaagaccuauucauggagcuuacaucaagucugauauuuaaauguguuugaaaaaaacauacaguaaggguaaauucaagugacaucauuuaaaaaauuuguaauaagaauguuuuagggcuuucuuggauguaaaaauguaaaauauuuuuugagugcuugauacuuauuucaggaaguguucaguguugaccugugugaccaagagaaauacaauaucaauuuaaaaaucuuuuucauauauugcuaauuugacugcacuuucaugcuuuauuguggcagaagucuaccuggaauacuuaugaauuagaaaauaaauaccguuugguuauacguacaaaauuuaugagaguucaggcccuagagucagaccugguuugacuucccacuuucauugcuuugaguuauaugaccuuggacuacuguuuaccuucuaaguugaaucauuuguaaacuugguauauuaaaauguaaugaaaguaucuacuucauggacuugugaggguuaaauaacauaguucauacaaaguuauugauacaugagugcccaauaaacgcuagcuguuccguuaguagauauucuguguacuauauaguauuaauauauguuuuguauauaugauuaccuuaacaugaugccacagauacucagcagcauaacccuuguguaacugggaaacaguuuaaucagugauacaacuuaauuagcuaaaaccuguuagaaacauugaagguagucaucaccugcauugcuguggcuacauuguuuguguauuugagcagagcacccagccuuccucauuagucugcacugcauagcuaagaauuuacaaagaccuugucaagaacugugaagggacugaaaauuuagccugcugcaguuuuguagauguugguagaagacaugagauuuccugaguuagacaguggacaucauuguucauggcacugcaaguggaaugggcuuuauauuuguguuguuuuccuugcccuccucaaguuccauggaggugacagagguguucggguagaugcuacucacauagugaguuugcaucauaacuagaaacccugagcuuagagaaccggaaucuuucauagugggcugcacagaaaccuaccugaccuuuguuccaguagaagaccuuaucuugauuauauuggucagugaacaaaccugccccucuccucagaagggagguguugucuucuaagacaguucacuauuuaauacauucuugaaaagauagccuggguaaaaacccccaggacuacuucuugcaagaugugcagaaaugcuagaggcccauggagaauugucuccuaaacacaccucugaguaacuagccuaaaugggggucacagaguucauaaauuaauguucaugugcauugucuguuuauucuuaaguuacauuuuagaaguguuuucuguuuucugaaaugcucugugugauauacuacugcuuaucccauauuaaaauuuuauucucuuaacagaaaacaaauacuaaaguugauaugcauacugagauguucaggagugacuauauuggugucuucagcuuaguuugaugugcaucaaaaauuaaguggaugucuggacagggcagauagauaugcugcaaaguaaauacagcaaaauguucaucguagaaugugagugaugaguguaugaguguuuauauaauuaucucaacuucuuugucaaauuuuucauaauaaaauguugggggaaaagcuagcuguuccccuccuccacaauugauucucuuugcagcugaacucaacucagccuuucaagguaacuuugucaucaguaguucacaucaaaauauggaugaaugauaacaguuuuuaagaacuguuacagugguucuuuuuuuuuuuuuuugauagcucuucuuagcuuagugggauuccuuuuaagacugggugguuuggagaauaaaggucccgcuauuuaaaaggaagucauuguucugaaugguugaauuuuacacauauggacugacuaaaaaggguauuuccugcuggaaaaauguuuuuaggcaaaggaggcaggccagucucacuugacugacuuuugggugagcugccuuaaaauuuucuaauauuuuugacaugucaggcucuaaguuuuuuuaaaacuuauguucagacuuuuuuacucaaaggccacauuuauguauguguuacauuucuguuugauuguaaaaauuugggacuaggaguaggauuuuggcuuaauggcagugacagcuguagaggaguugggacagaauacuuaguggcaggaaaugguagggcuuccaaagaacaacagccacauaauugaaagguagaaguauuuuaauuguagauuuuuuucaauauaagagugcaaauaaauguaacguaugcaguuuucuuuuuucauaugggauaguucauuauaaacagugacauaucucuaauauaaguuucuaucaauacuuuugauuaaaauggacuaguuaaaaaauuguuuccuaaauguuaaacuaagcauucauauugggcaaaugauaggauuucccugauuuauagggauuaaguuuuagaaauccucuaaaccuauuuauuacauaaauugcaucagauguucacuuugucaucaaaacugcuuuucacuguuuuuucaauuuuucaagguuauuucaaggaucaguuuuucugaaaaaacauuuuuauuguuuuucguaaauaaaagauauauacaguucaaggaauuaucaaaaguuaaauacucauauaaucaccuccaggguuagaaauagaacuuggcuagcauucggcaaagugcuccuuuuacccucucccaguuacuuccacugcaggauuaaccauuauccugacuuuuaugguggccacuuguuucucuugaugguuuaaucaccuaaggcuuacaaaggauacauuuucaauuagugaagcagauuauugguuuaauucagggguucuuaacucuaacuucauaacucauuuuuauauuuuguaaugcuauugcuauccugaaaugaaaugcauauauaaaaugaccaacauauguaauuaaaaauguuaaaauauauuugcccuagcuauaacauaaggggaaaaaaaggaaguaauuuuauaauggaaugcucauuuuaaguguaaauguuugggcgugacuacacuagaagacauaaugaaguagucagauacuuguacccuacuuaaguuuguagguacaguagucagauguuuguaucuacuuaaggugaguaaguuuggauuuaagagaaauaagaguuauccgaguaguacugacaguuuucuuaacauuguuaaaagggcaaaauaagaauaugccguuuuagggcauauagguagauucaugugaauauagguagauucaugugaauguguuaccuacagaugccugcugacuaauucagauguguuguauuggugauucagguaugaugaguggcauugcuauuguuagaauagucuucaguaauagugaacucaccuuuuaacauuuugaagaaaagaguacacauuuuuccuguucacguaauagaugaauacuuggaaaagagguuuuucaccaauaugaauuucuggaggaguauuugaaaauucggugcaaugggaacauaguacuucauugugugggucugcauugcagaaugucuaccguccuguuuccugcccccacccccugcuccuaaugaaaggagcaguuaccaccuaaaggguuauguuuguagcacuuucaguaaagaauauaacuucucuuuuuugaagaucuuaagguagauuucuucaucaggccuuuuaaucagcagcuccuggcgggguggggguacaugauacaaccccuccaucccugaacucagcucuccaacucauuuuaccuuccauaaaagucaauguaaaauguuuuugaauauuuaccuauguauguuuuuaugaggugggauauggcuuucgucagguucuuaaaggauucugugacucacaaaaguggaccagauauuucuuuccgugacuuuuuuaagcuauuaaaucugguuauuccuuugcuaauggucaucaguacuugauaauuuucuauuuuaaacuaggaaaggggcucaaacucuuagcuaucugcugggagcaacccucauugagaggcuagagggauacaauggagcagaaaaucucaaauucaguaguuaaguggguuuauuauagauaauucuacguuuuacucgcaaguuaacauguccuguuaagaauuuaguuuugaaugggugagguguauuucuuuugauauauuaucaucaucuuuagauaauuuauauuuuuaugucuagaaagcccacuaucuguauugacaauuuauaaucccuggugggcaguaucgugaaauguaaauacuauuucagaauucguacaacucuuguagaguuuguugaugaaaacugacccacagucauuuuaaaaaucaguuuaaaaaauuauuuuaccuuaguuuggauaauugguacuuuuuaaaauuggggagaauuaaauuaauaaaacauuuaauucuaaaaacuuacauaauuauguuaugaaaauacauaaauauguaauuaaaauaauuaggcauucacuauggauuaggauuguucaaaauuaaaauuuugugacaugucuuuuugucauguuacuaagaaauuggaucuuuauuuuaaucugugauugcuacuaauguuaaaguccuagucaaaauaguccuauaacauuuuacauuuuuaagcguuuguaguaauuauggguuugagaauguuaagaaauggaauuugccuuuaagacuucuaguuuuaucaguucaaaacguaucuccagccagccauuuuguggauucauguagugaaauggacacauuggaguuuucgucuuuacucucauacuaguuuuaugguggaguuuuuaaucagaugcuuuucaaaaagauaauggaagcucuugggguugaagaagcagcaaggguuguauguuguaaauggaaugauuaguuugaccauauaaugaaacaagcaguucagaagaucauacuuugucauauguaugcuuuuuuuuuaaaaaaaaaaugcagaccuguuaguuauauuaaaaugcuuucuuuucuauaacugguucucugccuuucuaugcuugcuucuaauuuucacucauuuuuaucuccuuccucucauccuaguuccaaauuuuuauuuauuagaaaauauuuuacuacuaacaaacuuuaagcauagcauaaaaucauuuugcuucuuagggcuugaaauaagugucuuuuaaugacuuuguaaaauuuuaaaagacaugcuuauucuuaagauugaaauaaagaaaagagagccuuuauaauaguugucuuugauuccagccuucuagcuuuuuuaaaaaauacauaacuuuaaacgaauuguuuuuagaacgauuuaaaauuacuuuuggaauacuuagaacugugguuauuguucccaacuggaacauguuuuuauguucuuccuccaaauuaacagguauuuauuuuguugucuaaauuaaucugcauaauuuuucuucaggcuuuucuucagcaaaauggaucagccuuuuggguucuuuguuuuguaauuuuauguuguuugggugcagaaccaaagcuuaaaaacuuuguaucuagagcauauggcauaauaaacacuuaacaaauaugugaaugaaugaauggauugaaugaaugaacaaacaaaauugaggugaagcaaaagcacugaugucauaggguguagggucuucagauguagagauuuuugcaguuggccuaguaaaaugaacuugaagauugacacugguuugcagacaacugggaaauucuguuauuuucagcaacguauuaacaacauacuguaaaaauacaguuguaaaguucauagauccaaaguuucauaguacuuuuuugauagaaaucauacauguuuaugguagaaauuuugugaaauacagggaaugaagaagaaaauaugacuuguuuuuaagucugccaccucgagaaaggcaguguuaguagccauuugggauauuuaugccuacaaaugucagcacuuaauuaaaauugagguuauauauuuucaguuuugaauccuucguuguugagaauccaauuaaauuuuguuuucucuuuaauuuuuaaacuuuacaggccccuucacagauguagucacuacaaaucuuaaauugcgaaauccaucggauagaaaaguguguuucaaagugaagacuacagcaccucgccgguacugugugaggcccaacaguggaauuauugacccagggucaacugugacuguuucagguagcaaaucauguucugaauuuauguacauuugaauuuugaccuuuuaugauuauguuuuuguuuaauaagguuucaucuggagggagggaaauaauucuuauauuauucugguuuugccuuuaaagaugucuuguuacaguacucugcaagcuguuucagaaaauuucucacucaucuucuguguagggaguguggucaguuuauaagaaauuauugucaauuacaaacuuuagucuuuauuucuacagcuaaccacuaccuucucugccuuuguuauuuuaucuuugaaaaauuauaucauuuuucugaugggucauucuccuucagaucaugaucauauuacacauugcaugcagcuauagaagugucauaauucuuuugcuuaaaaaggugcaaugccacuuuuuugccuacugugucaaaucagaugagucuuuaugccuuucauuguaaaugucaacaguguccugugugugaaaacuuuauuuuuauuuuacuacucucuuauguguuuacuugucaaagaaguaugcuugccauauauggauuacuuacuccugcuguggaguugauacugguaccauaucuaaugcccccuauaaacuguuucuuucuuucucagucccucugacuucacuaauauagcugagaaauaggaaauaggaaguaaauaugagaacuuuuaugguuccauguauuuuacuuaggggagaaccucucaggcugcauuuacucuuucuuuacagcaguacuucucaacucccacuauaugcuguaauaacacagggagcaggaacacacauggauucaucucucccagauuggaaucucuaggagcaugacuuagaaauguuacauuuaggccgggcgcgguggcuuaugccuguaaucccagcacuuugggaggccgaggcggguggaucacgacgucaggaguucaagaccagccuggccaagauggugaaaccccaucucuacuaaaaauacaaaaaauuagucgggugugguggugggcgccuguagucccagcuacuugggaggcugaggcagagaauugcuuaaaaccaggaaguggagguugcagugagcggagacugcacgaguaagacuccgucucaaaacaaacaaacaaaaaaaguguaccuuaaaaaaaaaaaaagccugggugaucuugauaaguaauccuaagauauuauaauaauucuguaucaguuuucaaguccacagcagaauuggguacagagagagagaacccaggguaggcucauugagagaguauuuagagguggagccugacuacaaaggccaugaaggacagaccauagaguucuuggugacacuaaaucuucccucagcagguauagccaaaaaccucaagagcuaggaaaaagauguuuuagugagucuugcgguaaggaggccugggaggagugcuuuucauguuucuuugcuaagucuaauucaucaguuccugggaaagagagaugggaaauaaagaugaaggaaugcaugcacucugcauguugcugcuuucuacuacaucuuuaagccuuuagcacaauuggaagaagagagaauucuuucuuuuuugagacagugucuugcuuuguugcccagguaggagagcaguggugugaucucaggugacugcaacuuccgccuccuggauucaagugauuuuccugccucagccacuugaguagcuaggauuacgggcgugugccaacaugccuggcucauuuuuguauuuuuaguagaggcaggguuucaccauguuggccaggcuggucucgaacuccugaccucaagugauccaucuaccuuagccuccccaaaugcugggauuacaggcgugagccacugcgccuggccagaagauauaauuauuucaauccacauggcuaaaaauaguuuauugguacaaacaguuauaucccuaggaauccauacaacuaugcagaaugacuuuuucuuugaggggccuagauugcugguuucuguguauuaauauuucuugagaaaacaacguaucaaaacacuuucucccacagaaaccugacuuauuaaaaccuucagacaaacugguuacugauuacgcaaacaugcccuuggauuguucuacuuaauuagaauuuggcuuuuccaguuuuuaguguaguguauuuccauuuacagucacucaaagcuaugcuucuuccaacaaccuucucugguuaauucucuguacuacaugcucauuucucuuuuucccuguguccuuuugacgcuuuguuuuuugaauuugcuucaauuugugcacauuuuuauauauguuuucaagaucgucuuugucuuguuauguggucugcaaccuaaauuagaguauaacuccuauaaacuuaaccauguuguaaguuuucguuuuauucacaaauuuuugguucauagugauuagcuuauaaucauuaacucagugaagguugcuaauggaauuuuauuuagcuuaagcuguauucugaggcauuuuauccaguacauuuccugcugcuguguauuuggccccuugaaaaaguugucuuaaccuugauagcaguuaauggacuucucagacacaccuuaugaauaagacuuuauuacauaauuauuucuuacauuuauuuacccguguuuaucuuuuugaaaguguagagauauaucuuagaaauaaucuaaaguuagggaaauaauuucuauaaugccauguacauauuuuguguaacuguugauugauucuuuguauagucuguuauauuggacucauguuacauaaauuuagcaugacuuacaaccacauggaaccuuagaaaacuuaaaagacgagaaauuauaaaugcuuaaaaauugcucacgccuguaaucccagcacuuugggaggcugagacgggcggaucuugaggucaggagaucgagaccauccuggauaacacggugaaaccccgucucuacuaaaaauacaaaaaaauuagccgggcaugguggcaggcgccuguagucccagcuacucgggaggcugaggcaggagaauggcgugaaccugggaggcagagcuugcagugagccgagauuguaccgcugcacuccagccugggcgacagagcaagacuccgucucaaaaaaaaaaaaaaaaaaacuuaaaaauuuugaauguuauugagacuguagaauaaauuuuagaacucaagaggcuauaugguuuccuuguguacuuuuguuuucuuagaagauuuaaauaaauucauaaacucugaaauagauguuuauuuaaaauacaauuuugaaaaauuaauuauauuaaaacaauauaugggcugggugcuguggcuuacgccuguaauccuagcacuucgggaggcugaggagggcggaucucuugagcccaggaauucuauaccagccugggcaaaaugacgaaaacccuuucucuacaaaaaaauacaaaaauuagcugggcaugguggcauguggcuauagucuuagcuauuuaggagccugaagugggaggauugccugagccuagggagguugaggcuacagugagcugagauugcgccacugcacugcagcgcagccucagccacagagugagacccuguuuuaaaaaacaaaaaacagaugguagugagguuuuaaguuacugaguauuucuccuuuaaauaucucaguuguauaauuuuaaaucagaaaacacuaaaaugaagccuaaauucauaguuuuaauaacuuauauuuaaucugagcuuauaggcauuauaguuaacguuggcaaaguuuugaaaauuuucacaagcugaguuuagaaagggcaaaaucauagauucauauuuaauuuuuaauuguaauuguuuauuuuguugguugugcaaaacuuaguaaauuagaaagacagacaauuuaaaaauacuugggauccauuaaguugauucuuaaacauuccaguguuugguuucuugaacccuucuugguuuuuuuuaaauuugcauauuugugaaguaguaggaaugauacuauugccagauacgguuuaaggcaaaucccagacuuaguauaauuuaaucuguaacuguuucaauguaugucuuucagacaugcaggagacaauauaauauauccuuuuuuucuuauuuaguaaugcuacagcccuuugacuaugauccgaaugaaaagaguaaacacaaguuuaugguacagacaauuuuugcuccaccaaacacuucagauauggaagcugugguaaguauagaagaagaauuuguuuugggaaguggaguuuaaacuguggguguuguuuagcagucaguagaaaaacuuaauuucuaaaaacuaaaaguuaaauuuagguuuuuaaaaaacugccaauuucuucauuauagauaauccuaacuuaaagaaugaaagaauuuuuaaauaguauuuuuuuuuagaaacaauuuagaaaugcugcuacuggccuggugcaguggcucacaccuguaaucccagcccuuugggaggccaagaugggaguaucucaagcccaggaguucgagaccagcucaggcgacaugacaagacccugucucuacaaaaacaaacaaacaaacaaacaaaaaacaaaaaaaaccaccacaacaaaaaugagcuggguauaguguuggacgccuguagucccagcuacccaggaggcaugggaggauugauugcuugagcccaggaggggcgacugcacuccagccugggaaacagaaugagaccaacuggaaaaaaagaaagaaaugcuaagaagaaaguccuaugguugcuaguaauaucaucgugauuuuaauggauggugauaguaacuaggauuauauaaagguucugugacauuagccgauaacaauggcagggugaucaauaaagagugcaccaguguguuucagccaagccaggcagcuucacucaucuuuuagcugucccgugaggugaaacuuacuuaccaugaucauaccuccuaugucucauguuugguuuuguuuauuuuuaguggaaagaggcaaaaccugaugaauuaauggauuccaaauugagaugcguauuugaaaugcccaaugaaaaugauaaauugguaaguaggagaauguaaaaaaaauugggagcuguugagcucucaguuccuuugauuaauuuugcuuuuauuuuugaccuuugagguaugugugauauggcuauuacacuucauaagacucagugguuaaguuuuaaaaaacuugguaugccuuuuuuuuuuuuuuuuuuaaaguaacauuuuguuuauccaagaagaaagaaagacucacuuuuaggucaagacugcauccuggagaagaaucauuuaagucuaccagauuuuuugugacguaaaccacugcagguucuuuuuuagaaugagauguguauacauaauuuaaaaauacauauaaauugcuuuuuggccacuauguaccggcaguuuggggauaaauucacuuacauggacaguuuauuccagguuuaguuauuccuagguauuuugcucacuuuuguuuuuagucaaauccaucugauuguauucuuuaguaaauaauuauuauguugcuuacucauuaguguaagucuaauacaauuugggggacugagggauguauuuguuuauucaaaaacaaacaaaaaauagucugugaauguaccgaguggguuguagucacuuaccuuguccauuucccugucuggauugcaaauuugaaucuuuuccuauggugagagagacuugaaagauaaauuuuucuguguguguaugugacuuaauacauacaauaauauggauaaauagaaugguguggcacaauuugguuacaaucugacaugacuacugccuuaaucuaguggccauuugcucuauugaaaaguaaacaugcagauuaaauaugugggcucaguuauuguguuccucuuucaggauaagcagaaaugaaaaggucucugguaauuagguguugaccaaauuauauuuugaauuuuuaaaaugccucuuuuaagugauuuuugagguauuugccaaaagcaaaaaauugugaacacauguauucucuguggaaagugaguguuagauggccuguguaugcuucccauuuggagguuuucuuuuuugcuuaggcggagggaagcuaauagcuugcccagcucuuacuguugaaaccaagaaaacaaaacagcauguugucuggauugacuuuuuaaaaaaaaauuuggauauuuucucacugagaguuuuaugucauuuuuuacaguaauucggucagcguaaaucuaucuucuaucugggcuucuacugugcucuggauagcacacacuuugagaugugugaaaaggauuggaaccccagguauuugauacugcugauuaagaguagcucucacugguuuagaaaccaaaccagaaguugaugggaaugauacggcaaugacaguugaaccucgccauuuacacaucuugggugaaaagagcaguuaugccuaccuauuggucuagcccauaguuauccaagaaaguaguuuugggucuguuuuagcgcuugaacaaauacugaauggaguucccagaauccccugcgguggaacucgagcaggaguaguuugagccuggaaccuuuucagagcagguauuacuaguaaccuaaaagcuguuaaguaacuucaaaguacuuuagagaauaucugagucugaaccuugauuagcuagcugcagaauguauuuucacuaauuggauuaucuggacuuguauauuaaauuguaggaaauaucugcuaaagauaauuuuuaagauuuauuuugaaaacuuagaagcaccuagaagaguagguaggaggaguacagugaaccucugugaacuuaugagcagcuuuaacaaugacuaguuugugguuaagcuuauuauauauaaauccuguuaauucucaucuuagguauuguuuaaggcaaaucccagacuugguauaauuuaaucuguaacuguuucaauguguauuuuucaaaguacuuuaaaaaaagagauaaaagaguuuuaaugacaauacuguuacuaugccuuuaaaaauuuaguauauccuuaauaucaagcuguccagacagcauuaaaacuugucacaaaugucauuaaaauuuuuuuuucugcaguuuguuugaauuagaugaaaauaaaguccaaauaguucuucuuuuuuuuuuuuuuuugagacggagucuugcucuguugcucaggcuggagugcaguggcacgaucuuggcucacugcaaccucugccucccggguucaagcaguucuccugccucagccucucuaguagcugggauuacaggugcacgccuggcuaauuuuuguauuuuuuguagagacgggauuuugccagguuggucucaaacuccugaccucaggugauccaccugccuuggccucccaaagugcugggauuacaggugugagccacccugccuggccaaguccaaauacuucuauuggaugauacguuucuuaaaucucuuaguuuguuacguuuccucucuuuuuuuuuuuuuuuugcaaauuauugaauguuuuuauuauuaaacuagguuugccuauagacuuucccacagaauugauuuugcugauuccauccuuguggugcuauuuaaccuuuuuucccugucccugguauuuccugugaucgaaaguuugaaaugagugguucuuauccaggggcaaucgauuugcuccucuggggaccgugcuuggaaacauuuuugguuuucacaacugagagguagguaagggugcuacaguuaaccuguuuagugggcagaggccagggaugccuuucaacuuccugugaugcacaaaacagccuccacaacaaagaauaaucuggcuuaaaaugucaguaaaguugagauugagacaguaugaccuaggucuguuaguacauuuaagauugucugauggucauacucugucauuccuacuucauacacuacuuacaauacuuguguaaggagaaacuugugcuuauguaauauuugguuauucagugguagaguuuaaaaaggcagaacaaaugccaaaguuucucuuuagagguuuuaaaaaaugaguugguuuauaagcaucccaccucgugauguacaguugaucuuccaccuuccauccuuucuuucuucccugcuugcuucuauauugauaaaacucaugaauuuaaacauauuugaguuuuaacucuugguaguuuauuauuauuguugaugcucaaauugccugguaaggagacuuuuuaaauugguucuugaguuuguuugacccucauagucuuugguaauuuucuugucuaauguggcaagauuuuuccagguccagaccuggaaagaagcucagggccauuucagugggagaugguauuucacaacuauaaucgaccggguaccugugacaaaauugauuuuuaauuuuaucaaacuuucuguucauuuuuuugaccaagguaagaguggaggcccauuuuucacuugaaggugcuucuucaaaugguaaaauuuuaaugauaaaacugugucagcagcauauaggaugauguggauccuuuuauuucuugggguaaugauugcauuuuaugguuggauuauguuggguaauucaaaaugugcaaaauccaauacugauccugagaagaaugggcggguacuucuaugaaccagcugaagugguguuucaauuacagcaauacauaaauacagcuuaugacuuugauggcucacuggccucgucauuaugauuuuugauggauguuuuugaguguuuauaauuuacauuucaaguuuuacacauagaaugagacuuaaagauuguaauauaucaccauuucaaauuuauguaauucaaacuugcaaaaauugugucuauacuauuuaggcuggaaguggccuuaauugauuaauguguauguuaaagagaggcuaaaacacaauuguguuuuuauaaggcaguauuucccaguguauuagguuggaaguguucuguagacaggugagcuuggaaaaauacuguaaaugucuccaagaggaaucacauugcguauuugccuauuaaaggcucugagaaaacguaacgguaaagaaauauauuuaacccaguauuuuuuuuuuaauuuaaaauaaccuaauuaacuuaggaaauaucugauguucugaaaaaauauacuuugggaaauacuauuccugccuaaacucacuguuguaguauuaacuacccugcagauuguacaagaaauguuacuuacugagaaauguguuuaaacucagugcaaccuggcacagacccaacuccaucuggguuguuaguugauuaugugacuuucaaguuaaucaguuuaauguugcaucucaucuuuuacagaaaauaugaaaucuuaagguaccaaaucugaagucuuaugauaguacaaaauauauaagaaguuuuuguuucuaacaauuaaggauaaaaccuuuuaugucuaucuaaagauaaacaaaacaccucuuaauauuuuauucaugugguaauaagacccuauugauaauuguauccugcuguuucuaggucaauauucucuauagacgaaguugauaaaacugguuaaaaaaaaaguaucuuugacauguugguuucuuucuaguaucuguagauaaaauuaguaguuaauauuccuuuucuuuguuuagcaugaaauuuggcucuuuggaaauuagggcauuauuggauagugugaugcauagauacaguuuguuaauuuacuucagaugaauugauaaaaugcuguaugaugcugaauccugacuuacacaguugcugaaaugacacucccuuauucaaagaaaauacauuucuaaaugugcaagguuaacaaaaaugguuugaaaacuguuggugauguauuuuuuaaaaguauagaguagaaaauauacuuuuuaucuuauaguuaugauugugauauagagaauucuuugagaucuuuugacccuuuauuuuaguuuauuaguauguuguaaaaaguauguuaacuuaagcaaaaucaguucagcuuuuaacugcguugcugguaacaacuuaguauuuaacguagaacucuguggauggcauuuguauuuuuuuauucagcuuuauuuaguguuuagagcaguggacaaguucauagggguuccuuacaccuuuauuuuuuguuuuaauauaugcauacauuauuaaaugaucaccacagucaagcuaauuaaccuaucaaucaccucagauaagcaccauuuuuaugggucacuuuauuuuaaagagucgaucaaaauuucauuuuugguagucaacuuagaaaaauuugguuaguguucaaagcagauucugcaauagcuaucauaauuguugaugcacucuccucaaauauuguagagauaacaagucuugaacuuuaugauuuuuuuuuaguguguuuuaaccccacucccucacuuccccagcccccccuuccuguaucucuuugcagaaagaaguacgcugguauuuaaguacuguauuagucuguucucacauugcuauaaagaaauaccugagacuggguaauuuauaaagaaaagagguuuaauuggcuuacaguucugcaggcuguacaggaagcagggcggcuucugcuucugaggaggccucaggaaacuucuagucaugguggagggcaaagggggagcagaugccucacguggugggaacaggagcaagagagagcgaaggggcagugcuacacucuuuuuaacagcuagaucucaugagaacucuuaucaugggaacagugucauggggauggugcuaaaccauucaugaaggacccacccucaugauccagucgcuucccaccagguuccaccuccaacacuggagauuacaauuugacaugggauuugccgggggacacagauccaaaccauaucaaguauguuguaugcguauaccccacuugugugaggauuuugaucuuuuuauggaugcuguuaauucuuggguguuuacauguuuggaacacaugaaaaaagaguaugauguuauuuuguugauuucuuuagacuuuuuaggaccuugauacuggauauauaaguaaggaaaugauugaagguuuguggucaucuuauagggugaaaaauggagccagcuuuagaagcacaguggcuugaguccauguuuuuauuuuuauaguuuaaaaaaucauuuauuugugacaaaacaauucucauuuauuugaaccaucacuaaaguaugggcuacuuuuugggaaauagcuuucugauuuggaucauagauaaagugccccaggaaacuuaggaacccuuucauuuuagaacaaaaagacucaauauuuuuuccuggauaacaagcauaagcaaauaccauccuuaagcacacuaagaugugucauuacccuaguccucgggaucagcaggugugugccaauacauuucauuuuguuaauggccccuagugucuucaguugaguuguugucagugcuaguacugaaagccauugagccuguucccuguauuguugacagcuggaggcacaugauacgaaagcgcuguuguacaaaauaggguucuuugaauuauuagcucuguuuggauugucagcucuguauauacguaauguccaauuagugguagugguuauuuuuuaaggaucaaaugugguuuuauuauuuuugaaguuuuaugaccuauucaguucuuuguguucacuucuaaaaaauuuuugaggccuuaacucugacauuuucuaaauuucuuaaauguauugcauuucauuuauguccuccaucugacauuugaaggugacauauuucccuuuuuuuuuuuuuuuuuuuuuuuuuuuuuuuuuuuuugagacagugucucgcucugucacccaggcuggagugcaguggcgcgaucucggcucacuguaagcgccgccucccggguucacgccguucuccugccucagccucuccgaguagcugggacuacaggugcccgccaccacgccuggcuaauuuuuuguauuuuuaguagagacaggguuucaccguggugucaaucuccugaccuugugauccgcccgccuuggccucccaaagugcugggauuacaagcgugagccaccgcgccugaccuugaaggugacauauuuucuagaaaaaaauacugauuuuuuuuaaaugaagacugaggggcuguaaagaacagggauuucaggggucuuauaaagggauuucaggggucuuaucauaaaaugguugaauauacauuauuuucuguugagacagaacaaaugggguaucaguaaguauaauuagggaaucccuuucccaccuguuuguauaauacaguauuuuaucuauuaaaggaauuugaaaagaaaggaagagaacuauggacuuaaugguuauaugagucuuuaaguguuuauuggccugggaugugugugagagagugaguguauugggggauaggcuuuaaguacaagagagguuuaugaaauuguucagauugaguguuaucaaagauaagaagacauacaagugcuuguuuuucagauuauugacaauuauuaauuaguaaacauuaaaagccacaaagaauuagaugguauucauuuuaaaacaauguaaggcuggcauaaauuuuaauaaaguauguacauuuaauaggugcauguaaugcaaguagauuauaacuaauuuuguuugggaaauacaaaaagcgaguucagaaacuacuuuugcuuuaacauagcuauuauuaguauuguuucuuaugcauuaaugcauuuuuauaaaguguuaauguuuagagccuaaugcuuucugugucagucauucccaauaucaugcagaagaaaucagaguucggugagaaucugagaauauguuucccaugccaucucaggguauaacuccaccagggaaugcuccgacugucacuucaaugagcagcaucaacaacacaguugcaacaccugccaguuaucacacgaaggaugaccccaggggacucaguguguugaaacaggagaaacagaagguuuguuauagggaguuaacagacuuaggagucuacuagugucaaugguuaaguuaauguagauaccuagcagauaagugguauugugaguauguuguaugaaguagauagaauugaacuaugccuaaaauuacaauaaaacuacaaagcacuuaaaaaucaugcauacaaacuauucuguucuaaaaaacuucugaacuuaacuaaaaucuauauagugagcaggacaguauaagugugaacauuaugaaguugcuguaauuuuuuucuuugagauuuggggaauauacucuuuuuuuuuuuuuuuuuuuuuuuuuuuugagauggagucucgcucugucacccaggcuggagugcauggcacaauuucagcucacugcaaccucugccuccccgguucaagggauucucccaccucagccuccugaguagcugggaguacaggcacgugccaccaugccuggcuaauuuuuguauuuuuuugguagagaugggguuucaccauguuggccaggcuggucucauuaaacuccgaccucaggugauccaccugccuuggccucccaaaguccugggauuauaggcgugagccaccacauguggcaaccccacaguuuuaacagauuguuuauacuuugauuugguuuugcagaugauaugcauacuaaggcuuuaaaaaauuaucuaaauguuuaauaauuuuuuguuuuugugauugggaauuauuuacuucugggagucaugauccuaaagaaacaguaaauuggcuguuuagagugggaaaaaaaaacuucagguaacuuuguuacuuaaauccugucucuuaauucauagguuaagaccuuaauuuugccucucucgguuuaugacaguacucuugacuuuagccuuuuaacucccuuuaugugcguuuuuauccaucacuccuguuaguuguaagaauguaggcccacguuuaugucuuuuaucuccuuuguucuucccaaggcuucuuugcaaacuuuuucuuguauuuccaauuccuaguucccucuuuuucuaauuaacccccaguaaaaauacuugggauauuagaacugaaauucugaugguuaaaaaagaauacagaaguacagucaugcaucuguuaaggauggggauauauauugagaaauguguuguuaggugauguguuguauaaacaucauagaguguacuuacaaaaaccuauauaugguauugccuuuugcuccuaggcuacagacuuguauagccuguggcuguacuacaaugguaaguauuuguguaucgaaacaaucuacacugagcuuauucaaccugcagccugcggcccacacguggcccaugauggcuuugaauccggcccaccucaaauucguaaacuuucuuaaaacacuaugaguuuuuuuuugugugauuuuuuuuuuuuaauagcucauuaguuaguguuaguguuaguguauuuuauguguggcccaagacaauuuuucuuccagugaggcccagggaagccagaagauuggacacccgugacuauacacagaaaaggcgcagcaaaaauauggcauaagagauaaaauuguauacuugcauagggcacuuacugugaauggaucuugcagaacuggaaguuguuuugggugggucagugaaugaguggugagugaaugggaaggccuaggacauuacuguacacuguagacuuuauaaacacuguacacuuaggcuacauuuauuaaaauuuuuuucuuuaaucuuagcuguccguaacuucauaaacuguaaaauuaaaauuuuugacauaaagcacaagcacaguguauagauaaauaaaaauaucuuuuuaauguccuuauucgcugccuuuuucuauuuuuuaaauaagauuuuuaaaaaaacuucuuuucuuaagacuaagacauagcacacacauuagucuaggccugcacaggggcgggaucaucaguaucacugccuuccaccuccacauccugucucacuguaaugucuucagggacaguaacacucauggagcugacaucuccuauguuaacagugucuucuggaauaccuccugaaggaccugcuggagucugacuuagaguguccuuuuuguuuucguaaguagaaggaguacacucuaaaauaaaugauaaaaagcauaacaguaaauacauaaaccuguaacauagucauuuauuaccaaguauucuguauuguacauaaaucauaugugcaauacuuuuauaugacuggaguacaguauguauauuuacaccagcaucaccacaaacgugaauaauguauugugauaagaccucacuagguaauaggaauuuuucagugccauuauuauuguaugggaacacuaucauauguaugaaucauuguugaccaaaacaucauuauacagaacaugacuggacaacucagauggaggauuacugcagauaggcuaaauaauauaguggaaacuggacaagauugguuuauuguuuuaguugauacacaccuugaccuuccagcuuauucugaauugcaguguuaaauguaagguuaccauucaucaauuuacuaagagucacagcauguugaaucucucuggugugcuuguuucaugguucucagaacaaccagucuuuucuuucuggaccaguuugaagcaacucucaagaaacaagcuguuuuauuggagccaaaccucacuaauagagguccuggauggaagcauauacuuaaaguuacaccugcuuaauuuuuuccaucaggcucuucagauugucacuccaugcaugacucaaagcccacccucccaucacacuuccccccauuacauauacauauauagcauaacauauacauauguagcauauguauauguaaauaaauuagauuuucuugcaccuguuauguauguucacugguuuguaaggggccuagguaguaugugauauaacuuauugggcacacuuuugaaauguguuucggcuucacuguauucuuugcauucuauucuguuuaugcuccacauauugguuaucauuucuucuccuuuuuguuacaaaagcaguauaacauuuuuaagagaaauucaacaacaaaaaaaucuaauucuauuugcuuagauaaauucuaaucuaauuccaagucuaauucuauuagaauuagaaaaaucuaaaucuaauuccaaucuaguuaucuuuuuauggaaugucuuccuauggacauguuauuuaaaauuugaaagaauggaaagcugcccaucaaaugcuuaacaaaagugaaauguuuaauuuuggcaaggcauagaauagaauauuuaaugacaugucauuuaauaauaguaauauaaauaauaguuuuguugauuugacaagauugugagaaaugacuuuuucccuucccuccguaauuuaaaauuuuaugcaauguaaagaauuuaaaaauaaucaguugucgagcuugaugauucuuuuaguuuuuuuucucuuugguguugaccccauguauaucuuuuuuucccccuuuuggagauagggucucacucucaccugggcuggagugcaguggcacgaucucgucucauugcaaccuccgcuuccugggcucaagccaccucagucucaugaguagcugagauuacaggugcacaccaccaugccuggcuaauuucuaaaauuguuuuuuguagagacagggucucccucuguugcucaggcuguucuugaacuccugggcucaagcaggccacccaucucggccucccaaaguguugggauuacagacaucagacauggugcccugcuucauccucuuuaaguuuuuaucaguuuucugguaugaguaugauacuuuuucccaauuuuuaaccaaaaccugaaaguucuucuauugccauauugguggccauugccaccuccuuuauagaguaagucagugugccaaccucauuaucagaaguuggauuugugcuaggauagaauuugaccacacugaaaaucacaaaugaguucuaacuacuauuaaggaaaagaacaggaaaaaguauuggcaggguaaaauauaucugaaacaguuuuuuaauaauaggggcggcuauuauuagauugguuggggugggagaaaugggggugaagaacaaaaaagcuagcaagagaaaaacucagagaauugaaguaggcugcuuuaaaacguugcuuaacugggaagcuugaagaagaauggaagagucugccgacaggucacauacaugcuguuguucauuagaaccucauuauaaauuuucauuuuuaaauagauuuuacauggauuuaggcauacuaaucaaaucacauccccuucauaagaauaacaaguuuugcccuuugaacaaucuguuuauacuuaauauaaaauuggcagcugggauggugugguaggugugcagccucugauaaaucuuauaaaaugaguauuguggaaugccauaaaguugauuuaguaaaugucuuuuuuagcaguuuauagcugaauaaagcagauuuuaccuaaaauuauuuuaaaguaagugaauuuaauuaaaaugaaaaaagcuuguuacacuaauacugcuacgauguguggugacauaaaugcuguuggagugaaggauguugggguacuuuagacaacgggcugaagaauacauaggugcugucauagauauuuaucuccaggccuucacuagcuucaaaugguucaauguuggugaggauuaagauuuuggggcucauagucuucaaagcaugcuaagugcuccugugauguugaaucacgugaauuaaagcaaacagcauuacuaaagaugacaaauuaauagaaguuagcuuuucuugggcauguuuuuucuuagguaguuuccgauuuuauuggaaugauuacgauaauaucccccuaccccccagaaccuuauuugaauugcacaaccagagcacggaaaaugaccuucaauggauuuuguugacgucauucagcauacuuucauugaauaacuacucuugaccaaagugcugguuuuagggguaaauacaaagagagauggcucuugcucucucagccuuugaaguauuacaggaaagaacuugaacaauaauuauuaagauacauaauaaagugcuaugguagagguacgugccagggauuaugggaauagagggagugggcugguuauuuagacuaaucugacugcugacauguacugauuuaggccuuuuaaagaguuuuucaugaacaaagauguagaauuuauauuguuauuuguuuaaaaccuguaaggagauuugguuaguuaaaaaauucccaauaucuuuguaaugcagaaugauauggaaccuagcaaagcuguuccacugaaugcaucuaagcaagauggaccuaugccaaaaccacacaguguuucacuuaaugauaccgaaacaaggaaacuaauggaagaguguaaaagacuucagggagaaaugaugaagcuaucagaagaaaaucggcaccugagaguaaguucuguugguugaaaauaaauugauugaaaugaagguauaggacaugugaguguuauuaggccauuuuagcaauuagcuuuuaaauuuuugcuuggucaguucuuucuucuuugccccagugccuuugcuccccacccuacuccucuuuuaacagucuucccgugguuucucauugcugcaaguuccuuacuuuagcacacauucuaauuauuugugaucuggccugcaguauugccagcuucugcucuuguuucucauguccuucccauuuugugcccuagucauacugaacugccuaggauuguguugucccacaucauagccauuagucaccuagggcuguugagcacugaaaugggauuuguucaaauugagcugugcuguugaguguaaaauacugauguugaagaguuaguacagaaaaagguaaaaucuuuuuuuuuuaaugguuacauacugaaauaguaguuuggguauauuggguugaaucaaauauauuauuaaaaugaauuuuacccauuucuuuuuacuuuuuaaauguacuguuggaaaauuuaacuuuacauacggggcucacauuugaagcucacauuguauuugcguggggcagcauugggcuggaguaugcuggagaagcaucuguuuaucaccccucuuugcuuuaguguaagcucuucacugugacuggaaaggcccagaacccugccccucccgacacagcacauacacacauugacguuuugcuacuacagcauauagccuuugcugggacccucuccaaaagaagaaaaaaaucgauuugucaugucugcuuugugccuccacuaugcugaucgccuucuacugcucuuacuuguuagaggccuuucucccucuagugggcaguaauugccuugguggcaagggcagugcuucauuuaucucugcauucaccauacaugcaugugguagucauucauguauuugauugaauuaaauggauggcgaaggaggacugauuugaauaugucugaaauuuaugaauaauuugucuuugacaaguaauuacuuguuucaagaccuaaauaccuauacguugcucucuaggcuuuguuugaagcucuuugcagcaaaguagaugauacaaaaauguauguaacuaaaauaagcuaaaugaugggaguuauuugauuauuccuuuuguuagguguauguaggaacuacacucuaaauuaaaggcacuguguuuuaagucgaucugugaacuccuuugcugaaaugcuuuuuaaagugaauuuuugugucucuucaugcuugauguuucauaguacccccucgagggguacccgucugcuuccaagcacuugucuggguagcggaaagaauaucuuuauuucacaccuacacgccauggaucuuuuaaaggauguuguugguuacuuuuacuucaucugccaugacuuccauaguucuguucuuugauaaagaugugcuccuuagggugcucaauagauuucuuucaaaagccacuguuuaccucuggcagggaggggagaaguggaaacagugagaaugacauagauggggcagggcuggaaaauaggaagagugaaccagggaaguaggugagagagacuuuauuccugguuucuacucuuuuuaugcuaguguucuguaugagauuuuauuugagagaugauucugcugcuggaaaaguaaaacaaaaaagcugggcugggcggguggcucacaccgguaaucccagcacuuugggaggcugaggcguguggaucaccugaggucaggaguuccagaccagccuggccaacguggugaaaccccgucucuauuaaaaauacaaaaauuauccgggugugguggugggugccuguaaucccagcuacuugggaggcugaggcaggagaaucacuugaacccaggaggcagagguugcagugagcgagaucacgccauuguacuccagccugggugacgagcaaaacaucgucucaaaaaaaaaaaaaaaacaaaacccuugaagacccacuggcuuacagaauuucagacccuauacacaggcccaccauaauuuuuugccagguucacuuucuugcuccugucuguucacuaucccuuuuaauuccccuagcccugugguucuuaauucacacugcaugugaaucaccuagugagcuuuaaaaaguuacaguugaccaggcuugccccagaccuaaugagucacaaucacaggaguauuaaaaguucuguagauguuugugauguguagcugaaacugagaauuacuguuuauauaggacuaauuagcaugagaccaaaaaaacccaacuccagaaaauccaguaaugcaaauaaaacugugccauuagguguacucuuuuaguuaguguuuauuuauaagcacaauaaaggaaucaugggagaaaauauugccuuguacugaaaaaaguaaaaaacuguccugccauuuaucagauugguuaacagacagagauaaagacaacuguguaguuaacagguauuaguauuuuucccaagguucacauugcacacagugucauaacaaccuccugcuuggagugacuucugcuuucuucugagaaaccuucugcucuaaagacauagugcugugugaagccauaucagcaagaaugaagcagccuacucuugacuggaggaucuaagucauuuugacacagagaagcacccucauuuuccaguccaggugcagagcuucagauaaggguuuccuauguacauuucucaucuaaauuuguaguuucugaagaaacaguauucuuucucugcuuugcagucgagaccuggugcuaccacuuuacacacagcccucugcuuugcuuugagcauauaaaaacacuguuacuuaaauuucacgcuaaacuguuuccuucccccaaauucugugauaccauaucucuguuuacggcaagaacacccuuuugugccucugcuguuccgguuccuuaguugcagugugucaguaaacccaaauggcagacuacaggucuggguaguuuuuggcugauugggcuaggacggauguaacugauuuuaaauaccaugggccaccuuggaaguacucuucuuuaauuauauuuuuagugggauuuaaaaaaagguaaauauagccuaucuaacuuuugcuuuuuaggaauacauuucucagcuccaguuuuaaaaaaucaguguuauugagguauaauuuauaucccauggagacacccacugugaguguacaauucauugauacauagaacuuuguaaccaucacuauaguucaguuuuagaaugucuaucacccccggaaaguuuccuuaugugguuagcaguuaauccccuuuuccguccccagccauaggcaaccacuaaucuacuuuccgucccuauagauuuuuagcuccaguagucucguuaguaugcuuguuuuuaaaaaccuuuuguguguguguuuuuuuucuaggaugaagguuuaaggcucagaaagguagcacauucggauaaaccuggaucaaccucaacugcauccuucagagauaaugucaccaguccucuuccuucacuucuuguuguaauugcagccauuuucauuggauucuuucuagggaaauucaucuuguagagugaagcaugcagagugcuguuucuuuuuuuuuuuuucucuugaccagaaaaagauuuguuuaccuaccauuucauugguaguauggcccacggugaccauuuuuuuguguguacagcgucauauaggcuuugccuuuaaugaucucuuacgguuagaaaacacaauaaaaacaaacuguucggcuacuggacagguuguauauuaccagaucaucacuagcagaugucaguugcacauugaguccuuuaugaaauucauaaauaaagaauuguucuuucuuugugguuuuaauaagaguucaagaauuguucagagucuuguaaauguuauuuuaauaaucccuuuaaauuuuaucuguugcuguuaccucuugaaauaugauuuauuuagauugcuaaucccacucauucaggaaaugccaagagguauuccuuggggaaauggugccucuuacaguguaaauuuuuccuccuuuaccuuugcuaauaucauggcagaauuuuucuuaucccuugugaggcaguuguugacugaguuuuucauccuuacaauccugucccaugguauuuaacauaaaaaaaaauaaaacuguuaacagauucuugcucgauagcuuguuugugucugucguguuauuagagggaacuccacuauauauggucacuugaaauuaugaugcaaagguuucucuugcauugaaacccucuuggauauuacaguauuuuuaauugaaaguccuaauucuguuaaggaaaggaguugauuaaauuuuaagguaccacugguauuuugggagauuauaaucaguuuguuuucaagauaauagaaaauaagguccaugagaauagaaguuaugugauuucagugaguugauguguacagcauggcugugcuccaucugauuuaccccauucuuaaguucugagaguauguucucaaggaagauuuaacucucuuugguuuuaaauuacuuuuuaaccagccuaauaaauaagucuuacuacuuuucauaauauuucauaauaguuaaaaguagguguuuuuuucgugcucaauuuggcacucaaaauaauguucauuauggaaguuugguaauacugagcaagccuguggaauuuucuuuaugaaaaaugauuuuagccuuugcaaauguuaaccaugugaaacacauuuucaguauaaguaugcguuacaggguuugauacuuuccugcacuuagguuuguccuauucuucauuuauucauacuaggauagaaaauuuuggaaucagaaaauagauccaguguuuagcuacauacaaucuaguacaagugaauuuuuauucuuaaacauagguguguuggcucuuuuuuuaaaagaugcgcucuaccugaaaaggaaauuggauuuuagaacuggauguggugcagugaaguauuuuaggcccaggucuguguacacauuuuauagaagaaugaaguacucugaaguauuuugguugccuuuucauuucaacuguguuuugaauuugucagaucacacauauauuguguuauugggcgcugugguaucuuuuauaaaaccucuugcuugugugcaaaaguuccuaaaaggaaacacaaguaaugccuauccauuacuagcaugcuaugcugcaugcuuuacugccauugcuguaugcuuuacugucuuuguaaaaaucccccucuccccuuuucugguaacuggaaaagcaugcuaaaaauagucuuauauuuucaccccauaaaugcagaaucaguaauuccuuggcuuaaagcucuuauauaaucaauauuauuggugguaaauaccaaguuugguaucucauagcuaucuuuuuuuaaagaaauuaaguucuugaaaauuuagccaaaucccguuuuaugggaaugcucuuuagaauucauuuuguucagccccuuuguucuaugguugagaaaucugaggccuuacgaagguuaagagaacuuuccccgugucucacagguagguagaggcagagcuggaacuagauaucuggucuguugacucuagcucagugucuucugguaacuguugaaaauugucuuaguuugagagauggcugaaauaaugaacauaaaaugcuauuuauaauaacaaguauaugugaaauuucuuauuguaagacuacuaccggcuuacuguugaauaguuugguuauaguguuuaggcuagaaaugccucccacauugguaauaaacauuacaaaauacaauguauuuuuagguaggcauuuuauaaaaugcauuaugccaugguugcuuuugagauagauuguagucuggguagcaucuuuaaaauguaugugggcuuaacuguuguucauaucaggagaugcucugauuguauaggugagacucuguuucuguuauuuuuaauugcuguaugaaaugugaucagauuauuuuacuaccaacaguuauaguuugaaaguccaacuguauuaauugacugauaauaugauaauauagagauuaaauuguuugucuucauuccuuauauguuuagaaguuuuugcuuugucugccugcuuacuuguauauguaagcaugagggaaauacacuguugcuaauacugaaauuacaaucaaguaacuaaggccuugaguucauaugugacacugaaugcacuagcuuccuucguucuauaacuaauguaccuuaacuucccccauucuuauauuuacaagaagcuaagucauuauguucugagugugugguauguucccuuaaaaaaaaaugacacuuggaagaaaaauguaugaaauucagaaauuccgaucaaagaaaaguaauucuuucuuuuuuuuuuugagacagagucuugcuuuguugcccaggcuggagggcaguggugugaucucaccucacugcagcuuccgccuccuggguucaagugauucucauggcucagccgccugaguagcugggauuacaggugugagccaacaagcccggcuaauuuuuguauuuuuaguagagacaagguuucaccauguuggucaggcugggcucaaacuccugaauccgccugccucggccucccaaagugcugggauuacaggugugagcugccgcacccagccaagaaaaauaauacucuuaaauacuuagauguucaccuaaaguugauauuauuugguaugggaauuacuuuugaacuguaaucuuucagauuacaccacuuugaaaacaaguuuuaacaguaggguaaaaauauaguuuuugaggguauucccaacuugugaucuucuaccacuuuagagacauucaaguaauaguuuucuuagagcuuugcacauuccuauucacugagauuuuaaaaauuucaccuuuauucgagggaaggaucaaugcuuauuaccauuuggaaaaacgaagaucagaagguaaaugaucuuuauuuucuagcuuuaaagggaaauuaaaccauucaugaauaaacuuuaaaaaugugaaguguccuuuuccuuuucacaauacaaaaaaaauuucaacagauugugugguuugugcauuuauauccuguuaagcauuaauagcuaaucacugggacuugaauucugauggcagauagucucuugcuuagugagauggaguuaacuauuuuuuaguaggaagugagaacagcugauuuucaugccacguuucauagccccacuuuugguagacuaccaccacgcuucuucgcguaagcaguggcaucuugggaaugaaugcccagccgcucguggguuggugcaaagaaguauaaacauauaucacuaaggaaaaagaaaguuugucuugcccuucugacacagugugugcacuucaggcaauuuuuggaaaauauaaaaaauuccaaauucugccuuucagcagcaucaauugcuaggaacauuucauucauuucccuguaauauuaauguucuuuaagcauaaucacuaauuauaaguuguauccuauuuuuuuccagcuuaauuucugugguuuauugaaaaccaaguauaaaugugacuaaaagcauuuugcuuuguuuuuauaguuaacuuucuuaagguuauggacauuuuauaauguaacauuugauuggccuggccucuugacaauucccuucuaguuaugcauauccuccuguugccacauuucuuguuuuaaaacucaguuucuuguuuuccaguuguugcuauguauaacacccaucuugaaagagaguauauaggaaguuauucagauaacuuuuguaguagugauauucaacuauagcaguaccuuaacucaugaugagcuuaggaacauaaaagauaauuguugcuugaauagcacccccagagauacugaccuaauuggucugggguggagaucuggcaugguaguuuuuuucaagcuccaaucaucggccagacaguugcuuuauguagguuuuuaaaugccaaaggcagauaugaaguagauuuaauuaagacuugacuucagcaauacaggggaacuuaaaauacuuauuuuucuuuaaacugcaggagucacuguuagguauugcuuaaaaaaaauugcauaaaagcuuugcuugucaaguuaggauugcuggaauaccacuaaagauuuuugacuugugaauaaaugagcugucaucgcaaaaaggcgauuugagaaaugugggcuucaguauuaauugccauuuugcugacacccaguguaccuaccuaccugagaaauuuauuuuguccaucauguauuucucaaagcaaaaggugguuuucaaguauaaugucguuuucaacaugcuuauuacuuaguuuuacgucagcucauuucaucaucauugauaacuugugaaauacuuaucuccauccuauggaauaggggagacggguuuagacagguucaauuagcucaagucuacacagcugaaguagcagagaaagugggaucuagauggucugauccuagugaucuaccauaugaaggacauaguuuguguccugguccaagucaaauauugacuccucacaaacaguaaguauggcaauuuugugaugccuuugauuccacuuuacauggaguacuauuauuugugaaaugucuuuaagauuuuuggucuuaaauuuuugaagacugcuuucccccuuuaucucccagaaaauugagaagaaguaaacuccugcccacuaacaaucucaguccgugaacaaaaccaacaugaacauuccuaaacaagaguguguguuacucuaagaagaaggcuauagaauuuauggaaauggcuuauguaaccuacaagacuggagaacagaaugugacuggccuuuucuaaugguccuuuaagauuuaaugauuaaagcaagaguuuuuuauaauugacuuuguggucuaaauucuugauacuguuuauaauucuacaaagaacaaaaauuguuauguacuauaggcacuuaagaacccugaggaaaaauaauacaaugugugugugugagagagagagugaguuacugacauuguuccaaaaaaaaaaaaaaaaaaaaaaaaaauguggaggguugaaaugguaaggaauuggaaucuuuuguauuuucgagcaauaagaauuccuauucuuguuucaaauagagguuuguuaggaauuacaguuguggggagcaaacuuucuuuuuugugcuguuuuaauucaaaauguauauccuuaauuguauauaauauguagauaaauauaugaggguauuaagcuacuuugaauuaaauuuaaggauauauuucacaugaaaacaaauacaaacgagaaucaaaauaaaguuuugcaaagua

SEQ ID NO: 192720 - RNA, 30947 nt, Homo sapiens
aaccaacagcacacuuuuauuuaaggaccuauagcugugcaggaugcaaacaucugggcaucagugacuuuccuccugcccccguuugucccugaugguggcagaagaucccagcugaccacagccccuuucucuggggucagagggagaagacaggcgcagucagcaggggcagcuguugcaggugggagggauauuuucccacaggaacaaaggucuccgugaugacacggggucucuauagucauguugagagccuaacggcccuuggcauaauugcugguguugggguagaaggugucuuggaguuugcucaagugguugagagggagggaggugccauagacuuggaggaacuggcacgaagccaaggauacaaauccaggcagggcugugggacaggauagggagcagggccuucuacugaaggagugacucaggaaggaggaggggaaggugacaagccccugggcaggagcccuguggccauggaucauuuuaaauugagaccagagagugagcaguccagggcagcuauaaccuuggcuagaaagggcagaggcagaugggccugcuccaucucgccucuuaagaaggugggcaggacggagaugccacaguggaugccacagcugccacagccuccugcggagaccaggaaggaagccuggcucucagccaugcaggauggaaagaaagauucuauuccaggaggggagcugcccuggaacgccccaaggacagccaggacccacuguucauucaggauucccccauuuucuccuacgggagcuaacgccugugccuggguccuggcagcacucuggacuccacacucuccuccuggguuucaccuuuguaacaggauccccgcagaccacgcccacgacaaacacugucuccagcgggcaggacaaaggaagggcacggcgccaggcaguggugugguugcccaucaggaagaggccgacuucucccggugaaacugggcagacagaaggcagugagaaaugugaucucgggguggggaggcucucagaaagaaaaagguaggacugaccuucugcacagcagcaauggcggggccaaagguagcuuugaccuccacacgggcucggauccaggccggcagcuuggccaggacagggggccgggcauaucgcugguccaggagcacuacgcuggcaaaauccuucuggugccugauggcccugccugcauaggaacagaggcuggggcuccgagcaacaccugccuccccccuacagcacauucccacggcgacccccuccccuuccucagacuuauauaggaaacagggcaggcaaccccucuuuccuguucucccuuucuccagcccccaucuguccacccagcuggaggcagccaggcucaccuauggacugguugacggccuucaugcacagguucuccaccagagccuucccugggggugccuggccgggggcucugggcugggagugaaggggaagacccaucaggacuguucccugccugcagcucccccugggaaaagacccugccaggcuuuggagccagaccaggaggcuucguggccaaugccagcagcagggguccaggugacaucacagggaagaucaagaggguguggaggggcauccaagcuuccggagggggcaggagacgccagcgcagcggggaaggccuggcuguaucagcccugggggugaugccacucccacccacugccuacucuccugucacccucugugacacuggggucacucacgaggguuugauccaaguaggccaucuucuccugcagcucugcagaccugauguuggggaagggcaugcccaccaucaccacacaccugggcgggggagacaagagcccagcagguggacgucaggaccucccgggucaucacccacgucaccagcugcuccguucuaccccuucccucagccucuccgacugugaucaaaacucagccucucuccacucuguaccuaccaccuggagagggcuuguucggcugagagaucccgucuaggccaauugacuggguccugauacagcaauggguagccuaaaauccaacugcucucccaggaccaaacccagagcugcugagccccucccuccagcuggcuggucugagcagucgcagcccagcugugggcucuaauggcagcagagagcaggcaggggcccagcugcugggagugagggccggccauguaucacggcccaggagacgagcagaaccacuacuuaccggccuagguugucagagaaguugaucccuucacucaucuuuccuccaaccacagagaggagcagggccccugucaccuggccucucuccuggccacaggccuguaggagaaacccagacgcugaguugcugagccaaaacuuggaugacacccacaacguuuccagcugccacccccacacgaucucagacccaagcccagcaugacgcccgcaccuggaugcaccuggaauaugccagcagcaccugcuccaccuggugugcgcucuuagguuccuggaauaucugagaaagacagaggacauuucccagagacagguucagggugccaggucucgagucugcucguggccuuguguuuucuggccaggggacuggagaaccucacagccagggacuuugggggaaauccucuguagucagggacugggagcgguggggaugaggagccagaagccuguccugacccgaugagcacgagagcucccaggaggacucaguggcacuguccucacaagugggaaggcugccgacaggccacucaccuucuuccuggcagccagacggcccagcaggccacccuucucccagugggcauggaccuggcgcagguacucguaggaggggaagaaacagaccaccccuccaggaaccacaccgcacagguuacagagaaugcgacccaccucguccaucuaaggaaggaaaggagggagggagggagcccccauggagcaaccccucagccacccacaaaccgcgucuucaccuugagacucaaaacugaggagagacccucggcaggacuacagccaaggaagaggacuuggcuccccugggugggaaccacggggugguaggugccaccucccaccaaacacacccagccgcugcugcugacugcgccuuucugacacaugucacagcacuagcgucccuagggggccucccuauugcccuggcacugaguccucccuucuucuguccaggguccugaugggcaccacaacgacaaucaggggcugcacaccccaggcacaccacaggagaugcccccaagccccacaucccuacccccggcaggggcagauauaaccaaagggcaagagagccaaagggaacuagcagcuuucuccugugugaggcguccucagaggaugccuggagguuuuaugaauacauauuucgcagccuaaggcgugaggggcggggaagcucagaccuuccuccauaagcaucuagaucgacgccgcucauucuguguggcucuaagcgggugucccugugcaauuuccccaacacugaaaacacucagggugggccagagcgccccugccccagaaaacccuuugcugccugaggccaggcuguggugcggcgagcuggcugggacugaccaucugaggcagcucucuuuucuggaacgugaauuccagcggcugguuggagaucccgcugcagaugacgaggggcaggauguugucuggagggaucacgugaccugguaagagccagggaggggccgaaaacuggagaugcaggugugcugcaagacacugcagagagggcauuucccugccccaucauccagcacaggaacagcgacugacagcgcucacccgcccaccaucaccagucacacugggcagcaggcagcagggagcaaagcaggagagccugggcgagcgcacgaagggugaggcucccaccccggggucuccuccgccccugugccuggucgcaguaugagguauuacccacagaaaacgggggccagaaccugaccucuagccugccccacccugggcacagcuucucaccacaggaaaacuccaccacgcgcucagcuuccaccccggcacaggccagcagcugcugccggaagucagacaccuguagaccaaggccacagcgucacggccccaugaccccucagaggcccagcagaaaggaagcgagaagucugggcuaagagacagcaaguacacacaaacugaaagaagaggucaaagaaaaggcugauggcaaacuaacaaaaagaaaaauggugacugauacccagugcuggcagucucguuuaaacuaugugcaggaacagcaaaggaaauccagcaaaucuggcacagucauuaucaacccuggccaugcagcaaaaucaccagcgaaaauuuucaaaaauacacauggccaggccccagcccaaacuacugaauaagaaucuccaggcuuucaccuguuagacuggcaaaaauccaaaaguaaccacucuggagaaacaggcauuccuagacaguacuggugggauacagaaugguacaauucucaugaaauuucacaguaguuaacaaauuaaacauauuuauacuuuuuaacccaggaaucccauauuuaggaguccagugagaagauacagcccacaaauaccaaacagcaugugcccccggaccuuucccuguaaucaugcgccugccuauccagaggguacugguuggauaagcucccuacaucuguccaacagagaaccacgcagcccacuagaggagcgauggucagacaacugacuaagaugccuucuguguaaauaaaacaggaaagggaaaaaugaagacacguuuuugcuuauuuaggggaaaaagaaagacugaaaggauaagcuaguaaaacggauucccuauggggguggggaaugggcuggaaagggaugagagugaggcuuuccugaauagaucuuuuuauauugcuuugacuuuugagccauacaaauauuuacauauuuaaaaacuacaagucagaaaagaaaaaagcaaauucuaaaauugaaaagaaaaugaaacaaaaacagccuaguuaucuaugaaacugacaacagaagcacacggagagaagccugguuccacgugacuuuagagccuagugaccaggcauccuuaguggguuacacucuaaaggcaaagaggaaaggcaauuucaaucagaucuauuguuagaaguaauauugguacuaugauuucaaaacuuuuaaguauauuauaggauagagcagauaaguauguuaauguagcacacauguucaggcuuaagagaaaaagagguacaauaaaaggucaaguaaacaaauccuuugauuuuuacuuagaaacaccaauaugggccaggcgugguggcucaugccuguaaucccagcucuuugggaugccaaggcuggcggaucaccugauuucaagaccagccuggccaacaugguaaaaccccaucucuacuaaaauacaaaaauuagcugggugugguggcacaugccuguaaucacagcuacucaggagguugaggcaugagaaucgcuugaaccccggaggcagagguugcagagagccgugaucaggucacugcgcuccagccugggagacagagcgagacugugucucaaaaaaaaaaaaaaaaaaaaagaaagaaagaaagaaauaccaguauggauucauucugaaaacauuuccuagaucugucuaccaaaacgccccaggagcacgacaaacacccuagcacccacagcuugacuucuaaaugucauuccccauuacaagaaaccagagcagcuuggagaaaugaaucaauccaguguggggaaaggacacccauggugaucccaugacauucugcugugcuggaggcgagacugaccgggccacggggaggaccugagcuagcaggaaggggcucucacaaugugaacgucagaaacaauaauuacuguaaacaacuuuuaauaugccgaaugaauaaaacuaugaaucuauccauacaaaaauauaaaaaucaaaagcuaaggcagcuggggcugggaagcacugcuucaggauucccagcagcuuuuuguccaggaggcccuucgcuagguaggagucaccacugugcagaaaugcgguuauauuuaucacagucaugcucaaaacagaaaacugcaaauagcuugcacaccuaacaagagagaagcagcuacaugaaaugcuauauaucuguguaacuggaauccagcacagcugggauacugaaauacgugcaugcuugcugacaaggagacaggguuuaugacccucuggcugcugagugaaaagagcaaguuccagugacagcacauggagggagccguacuuuuguuuuuaaaacagcuaugcacauaaguaaaaauuacgccuacaaagacuauuauauucauauacaucaaaaugaaccuuuuaaaaguggaaucaugauuuuuuuccuugaguuugaaaccacagaacagcuuucucugggagacaugugauccuggggcuacagaauggagcagcagaggagucuccacugcuccugcagccuaaaaggcacagcagugagagaauagcagugucacccagcggacaccacugggccugcucgagcugacccuuucuggcuuggggccccaggagagaacaggacugauaaugcaucucucccaagcccccaucucaucccaacaccuggggcacgaggggcugggaaagguguccuuaccggcugcaugguaccccccgcaaugaccacugcccggcauuccuucaccacuugggcaaagugcacagcuggauucaggagcaaaaacuucagggugcucugacugaggcugccuggaaaaacagaucggugggaggugagugcaagcccaacagacacuucugucgucccagcaaagggggucccccaggugaguccaggucugaggcacaagugcuagugcuuucucuuuaaauuaaacaccauuuaaucucuaggacaaccagcccacagagguggaccacacuguccucuccauccuuuuuuuuuuuuuuuuuugagauggagucucgaucuguugcccaggcuggagugcaguggcucaaucucggcucccugcaaccuccgccuccuggguucaagcaauuuuccugccucagccucccgaguagcugggacuacaggcacccaccaccacacccugcuaauuuuuuguauuuuuaguagagacgggguuucacuguguuagccaggauggucucgaucuccugaacucacgauccgcccccccucagccucccaaagugcugggauuauaggcgugagccaccgcgcccggccuauccucuccauuuucauaugaagaaacugaaguugagaaagaaaauaguccaaaucacaaggcucauagaugacaaaaucaugacccaaaccaaagcccaccuaccccacaguagaaguuucccuaggaccccugcccuagaggacccccaucccagcuccucgaucuccucccguccaccuccacugcuuacccuggucacgggacccccaucccagcccuucgaucuccucccauccaccuccacugcuugcccaggucacagcaggccagugcccacugcacugcuuccuccuaacccaggaaguucccaggauggaaggaaagaauccuuucacgcugcggcucccgggcucagcuuggcuccuuccugggaacugaaccuggccaagaaccaccugauuaccuuggcggcucaggaugacccugccguccugguuggccguagugagagcugccaggaagccuuggaugugcaucaguggagaagcuggucgcagggugcuggccugacucucgucugcaggggcugcaagagcugcacagagcagaacggggaggaggccucccucuggucagguccacacaugaggaacagaaguccuugcccaugcgugcagccggcucugccugcccacccuccugccucaccuucagucguccugggcugcaggcucugcaggaauugcugaaacccagccaguuugggcugcucccgggaugagaacacugcuccguaccguucagugaauccaaagagcugggugggaugagagagagcaguggagaggaacgagguacagccaugagagagaggcuggguggaucggaggcucugccaggcccaagacaccugcagcacacaucccaccaccccagcaaggcccacugcaccaaggagaguggagacgaaggggacucuggaguucccugagggcaggggaggaaagcauggcaagggcaggggguuggggcacagcugggucuuguucaggaccacaagaugggagcaguuaccuuucugcugaucaugcucuucucacaguaucgcugcaccugcaaaaaccaagcccagcuguaggcaugagugcaaacugagcaagcuauaaucuuaaaaacaaaacaaaaaacaccacuucuaccacccaggcagcacaacgcagugcuaccuucugaggcaccuggagccuccuugccaccaaccuugucaucuccucuccgaggccacccccuccucuacugccccugcccacaacgcaguguccuccucaggguggagacccucuuuccaaaugucucucucaagucuaagagugcucaguaaaauccaguuccccuuggcuuuccuuccaggugacaaagaguuaaaaaaaaaaaaggaacuucuaugagcaaagccacagaggagaugauggcugggaccugcucaggggcuggggcagugccacucagucggugcauccaaugugugugguuuggugccagaucuuagcuugggaugcagagaugaggaguuuggagccuuuaaaccgguuucuaaaaagagcgacguccuucgaugaggauucccucaauggugagugaugagacccgagacccaugggaagaagaggggagaaggaaagcaaggagggcaaagggaaggcgagagaaggagugccugcacccaugucccagcugugggagaagcgcagggacggcaggacugucucaggcugucaggccuggcggcugucacaggcaugugggagacaaggggagaaaggcaucaaggaugaccuggauccagccugucuggcagggauggcggcagugacagugacccaaauguguaauucaggggaaaagcugguuuuaagaaaaaaaaggcaggcaggaugggaagaauguggggccccaagucagugcagccagguuuggacgcugucucugccacuugcuauuggcucacuugugggaagccugugcucgccacccuccugaagucaccuccacgggccuguuugcuuuccuugcuggggcaaaaggauauccuagcucagagcacagcacauggcaugccgccuacaacagaggcagaacccuguacccgggggcagucacuguugcugauuugaguuacgagcuugggguucaggcggcaguggccguguuucaucuggggagcgcuggguacacagaccuggagugagcagaggucugaggcugcaaccagacccaaggcccaagugggaagacgugacagggguugcacagaacaaaucaacguccuauuccuguccauaagccugagggagacugugccagaagacggagugagagagcaaggaccuggagucucuaucuguucuauggggcaccaagaaaggucccuuucucacccaucccucaucccuguggccuucacucuaaaagaagaugacuuuugucucacaggcauguugcguuaaggguuaaguaauuacacaucuguuuugcuuuuucuuccuucuacagucuuaacauaguacuuuacccacagguggugacaggaaggaaauuggauguggaauguggaaagguggaaaccucuaccuugaacagguugauguugucgaucuggcucuggaagagaaagucguugauggucuucagcuccgucccugagaacaaacacaugaagggccuugggagcuucacccuaagccucagguuucagucccaggguuaagcucggaaguggcucagaucagcucugggcccucugagggcaacucucuuaccugucugugacagacucuguguauugggauuuugcuuaauguucccuaaaaaagagaauggaaauaggucacaaugcugguucucaggacccccaacccuucccuaucuucucucccuccacacugcacaucaaguaagaagagcaucuguauuuaaauggcuuuguuuugcuuuucacuguuuauagcaugcaacggacccacugagagggcagguggguccaggagccucccaugucugacucacgugcuugcacguggaacccaaagcccuguaaguucauguuuuucaccccuucuccaggaggccgggacacagcagccagaccaagguaugcagggcaccggagcacagaggagcugcccaggccacuggugagccugaggcaaagcagagcugguggcucagagcagcaacacgagaccagcucccgccaggagcucccacaggcuuucugcagcuuccacuuccacagacgccuuccaagggggugccccaucauaaaagaaggggacgugacagggucaugcaaagaggcgugggagcuggagucagaagaucccaggcucccgugcugggagcagcccuugcuccgagcucuaguuuaugcgucuaucaacaaggauucaaauaccagcacugcguucucacagggcacacaaaaccgcauaugcaagugcuucgaacaacccacagaacuaugccuaucacggaaacaccgugugucuaugugaugcuguauccuuaauauccccccagagcagggccugaaauaaaaaguccucagaacaugggcaaagaacccaugggucuaaauaaagcucaagucagacaacucaacuaagcuacaaagaacaagaauuuucuaaaucaaugaccaagacccuucuuuuuuuuuuuuuuuuuuuuuuuugagacugauucucacucugucgcccagacuggacugcaguggcacaaucucggcucacugcaaccuccgccucccggguuugagcaagcaauucucuugucucagccucuggagcagcugggacuacaggccacggcaacacucccagcuaauuuuuuuguauuuuuaguagagaugggauuucaccauguuggccaggcuggucucaaaacuccuaaccucaggugaaccaccugccucggccucccaagugcugggauuacaggcgugagccaccgcacccggccgacccuucuuaaaaacacagagaacugagguguccugaugggcauccaaggaaaaagcagcccagcgaguuuugcaggcccggggucagcagggggacgaggcucucacccccuagcacagccacgaauuucuccagcaaauacaggaucugcuucagguacaucagguucuuggccuucaaacgcuuccugagaagaagccaacggacauuaagugguggugcccugauggcgacucgccccgcccaccccaguggaagccuugcugcccggugccucucaaacugggucacaagcuacaaauccuuucccagagagcaggcuggccacggccccaggccucagagccagcggucaguccccagccuuccaggucugugugcagcacacaccaugaugugccuaggacaugaauggcaugcagcuccaccccgccacagcccgggccagaggugggaaccaaagugcugccugccucucagaggcccacgcagggggccaccaagggacugucccacuaccucagagggucacaucucacccguaucgcuccacguacugcagcagcugggaaugggccuggcagagcuggggaaagaacacaaaccaggcucugagcaagcagcugagggcuaagguacugacaucuuagauucaccuagaagaugcuggcccuggacacacaggaagccaccaaagggaggagagggggcuggcugcagacaaaagguacggguuuccacagcccuuaggcuggugggagcuaagagaaaagggaaggaagggaaguuuuccuccaguguccacugugggucagagaaaaagcaagaggcugaauuccucaaguauggaaucucccugcuaaguuuccaccggguugggaaaagaccuggagucuacaaagagugaugguucaaggccaccaucacaucccagccucaauucagcccaggcacaggucaguagagcuggugggaugucguggggguuuucacagucagaaaccagugggcacaccccagcuccacacucaugagcugcaugaccucaggacagagcuugaccaucuuugaaucuccaaguuuccaauguaaaacaggaacaccacacccauggcagagucagcgugaagaccagagacaccuggugccaugcauggcgcaugauagggcagcaggaggagccugcgcugaucuugagcauuccucaauucaguccccuccagacaacuucaguaaugacaaaauccaauccugaggggacuucugccucacacaugccaucucccuggcuuacagaacuggcugcuggcauccagggcuggagggacucaggagcaugggggcagaugaggugcagggaaaugaggcacucugucauagcggggucccccgaugcacuggaaagccauggucagccuccgaugaggucaccgccuugacucgugcacccucuaucaagccccaccuccggaggaacucuuggcccaggugucuggaggaaccauccaagucccuuuacgucacagcaggcccuggcccggggaggggaggcccacacaccugggagccgcugaccuccacgcugugcaugcccgugauggugucgaucagguugugcgccucgucgaugaucaccaccugguccugcagccggaugcccgcggccugccgaguggccgcaugcagcagcaucugauagggcagcaccaccagcugggaggggagaugaggccaccugagcagggcggggcuccccugcaggagccuugccugccugacacugagcuccugaugugagugcuucuauuuccugccuggacuguguagagacauucgaaaaacagcuuguggcaacggacaagcucuccucgaguuucacaugaaaagccaauacaugaaacacaggaaacuagggcuggucugacuccugaguaaaccaagggcagggcugggugaagggaaccccugcuuagccuuguccauguccucaaggucgccccggaggcccccgaguuuccacaaacaccugcagaccaucggugcaccaggaagcggccccagcuucuacuccuggagcugcuacuccccagcugugugacucuggaagaguugucuaaccucucugacucuugcuuuccucaucugcaaaauaggguugauacauccuauuucaaagugaggguuaaggcguggagcugggguaacaaaaauaaaagcaacucugcacaucuuuagguguuuguuguuaggaaaguuuccaguuaaaggaauacucauauaaaaaauaaaauaucggaaaacugaauggcuccaucacccacgcuuggugagaaaauaugagucacuuaacuuuucugggcuccaguguccccaugcacagaauuucacuggaauacuauuaacauaaaagcaaaauauggucaaaguacuuuaaaaauucaaaaauuguaaagauuuugggccauauuaugguauuuguguauaaaugccuauagcacuaaucuugcucuaaaggcaaacagacgggagggaaggccugggacaccauggggccuggcagcuuuccucaguuucucugccagugcccacacagcucagcagguaugcuggugagcauuuagcugcugugcaaaugguuacuuaguucccugaaucuuuuaaaaccuuacauuuuuuucuggauuauacagaauuuuccacuagugauaucccguuuccaaagucacucaaauuaaagaaguagcaaggaaauagugaaacugcacccaccaaauaacagugagauacuacuuuugaucugcuacauuagcaguucuuccuucuguuuaaaaaucaagagaaguugaggcagagaagacaguauucucacgugcugcagguagguguaaguuagggaaagcuuuccaguuaagaguacugauauuacaaaaaggaaaaacuggaaaacugaaugguucuaucacugacauccuccaucacaucauaggcauggaaguugggagcaucacuuggaaagccauuuguaaauagauguaugcagcacacucuucucagcuccuggcauccccccucucccugugguuucacuaggaaugcaccggcuuuccuggcuccuaaauaccauccccaguaaugccaacuggcccugcugccuggagaccccaagggaucccacgcgccuccuccaacucacacaucaggagagaauggguuaaggugccaucaaccugaccacgguggggggcaucccccaaacuacagugugaugaggaccccccucauggccuagaccacagugagagucaagagcggcuuucuggcccugcagggcccucaccugggcugcagggauggcaaggcggcucccguaauagggacaggcccgggccuccuucccaagggccagcagcugcuccauguccuucaccucugccagggccucaucccggagaaggcccaucugcucgugguuguagaaggggcaggcugccugcuucuccugccuccuccucuuuggcuucuccuccucagcuccuuucuucuucucugaggguggcacaggcacaaagagagaaaacagagaggacagcaacuguccacgggcccaagaggggguuguguaauguugagacccacuuccaugggguagggucuauaagacccucccaaguacugccuacuguggucucaucggaacacuguaagguuuuacuucuguucuccagaaagagcccguaaaaucaucuccaagccaaggauucggaccagacacugacccagagaguaggaacacuuuuucccaaggagaggggacucaggaaggaacuggggucuccucugccauucuuucuaugaaagacacuuaauggucuucagucacugccaccccugccucacucucuccagaccaccugcggcuacaccauggucccaguggcuaccgugccugcuucucugcauguccacacagcggucguugauaagcugcacagaaccuaggcuuuucacgucuucauuuacacaaagguucugcagcaaaggagaaagaaagaggcaaaaagauggugccagcuaaaugacauccuaccaacacacguggaccugccccgccaccucuccuuugccuuccagugcugggccggccaggucagggagggggcugcuccucacacgguucagccugucacagacccagcgucucccaaggccuggacgagcaggacaaaguuguggcgaaaggagcaggauggccccugguggaaauacuggcuacuguuuaccugccgggagccaagggagaccagccgaacauccuugccaaaggggcucuucuucaccucaugcacaaacugggccagcugggaguguguccgacuacaguaauaaaucuagcagagagaaagaaaggcgcuucaaagagagaaccaaaacaucccacagcauucucuaacaucaaggcacgccagggccugagaggcugagggaaagggaguggcucccaaugcacaaagccgaggcaggacagcaaugucccaugucaggcaucuaucgagggacccagggauucccaagucacccacagcuccagaaguucaagggaaugccccaaaggcagcuccuuccacgagucauauccagccucuaaucaaccgcuuuugggggguuggccaaucuuuggacaugggugaccaucucccguggcaaaggguccccacuuggggaggguggguuguuggugggaggggagggagugugucacacacauccccaaagggaaaaaggaaggcugaccagaauacccucucucuacuccucuaaggcaagagugaagggagaaaaaaagaaaauacaaagaaaauaccuacuuccgacagaaaacaagucauaaaucaaugaaaccaaaugggaaaugucagaccauacacaacccauagcccuccaugcaaaugggaacacagacaaagggagaagcacaccaugagagacccaaagggcaggggacucaugucuguccuacccguaccacccagcagggacagaaaacacccagauuucagcccagaacagcuguuccucgaugcccugggguggcaagcauggcccugcccccaggagaggucuccccaggccccgaacccaggagaugucuccccaggccccaaacucaagagaggucuccucaggucccuguucccaggaaaggucuccccaggagaggacuccccaggcccugaccccaggagaggacuccaggguccacugcagcuggccaagggagcaacuuaggaccaggguugugugcaagaagcaacggaguccaagugcuggaagcuccuccuuuguggagaggagggugagaaguagccaagugacuccagccuccuccccaggggugcacagcccagccuauacccccagcacagcaccagcugaggacacuuguguuaccuuaguuauguguucuuccuccaggucauccucauccucauccacucugugugugugagagagaacagaaaacagucuucccucagcaaacucagcaaaacgcacugagcaucugcugagcgcuggugcugagcccuggccauucccagcaauggguuccaccaagguagcaggugcugcucgcucagaaacucccccaggcaaaugccaaccccaaccucccauggccgcucaggucuguggguagggaaauguaaaaaggagaaaggggcucagcacccccaacccaagucuugagucggaagccucgggacucauggcaggcugcucuccucucugcccucccuccagcaagcuggaccccucugaggccccagggcggauauuugcucuucaucaucucaggccuucggauguucugugccuggaauguugucuccccucaccagcucccagucaacucugagauagcagcagaaacaucaccuccuccaggaagccuucuuugaccuucccugguaggccuggcugcucugacacagauucauggccccugcucuucacacccaucucauucaaaaucgcuuccucucggucuaucuccccagacugucauguccacaagggaggacccaggucggccuuguuucugcugaguccccguggccucaccuagagcuugguaugcagcaggaaccccaugaccaucuccuggaugaagcuacaacugaccaaucgagugaacagaggaugcugucacuuaugaccagcuacaacucuucuugugucagugccucagucugcccuucccagcaaugcgggaagaauccaucagcgccaggcguuggcagggaagccagcccugcaucccauggccugaagcugagcuagcucuacuagucuaugcuccucagaaaacacaaaaccaucugacaggcacacgcuaccuauggcaacaucacauaaaaagaaaacauuuuuguucaccucgaaauuccuuucuaacaaaacagaauacaauugucuugggcuaucagaagaguaauuauuacaggcuuggcuucauggucacuaaagagcaggcggcucuaucuuaaaaggcuuggauucaaucuuaugucgcaugcuggacaaagccagcaggagcucacugagaggcugggugugugaagaaaugaagagcaaaaauuuucuauucagaacucagguccuccgaggcucacguuaucuccugaaacgugagggcaugggaagccccagaagcugaccuacaggauccauggcucuugcccagaccugaaggagcacuuuguuccuuuaauauucaccaccuccaucuccacucaaguucucugccuuguccccacgggcucuaagggagaagagagggagcagaaacaugaccucggaggcgggcaggaaggguucauggagcacaaacuguuuaugacccccucucaccagcgaggcauaaagcaacacgguggucucugcccugggcaggggcagaagucgaaguucacaugcgcagccuggaauuacacuaccagacugcaacgaggcagcaucugcucauucaugucaacucgauuuuauugagcacaccccuaugccaaacacugggucagcucugggaacaucaaacuauaaagacgugguuccugcccugaagcagcucgagcccagccagggagaggaggcaacaacagaagcacaagcaggugcaugagcaaaacagagcagcugacacccgaagccaccaagacgacaccugagccaggccuuaaaggagaggaagacaucugccaagggaggagggcaggguguuuggccacagcacguugcaugagcaaauccucagacaggacagaggaaggccuggugcgcuggaggaaguucagggcagcggggaagcuggcgucugguggauggcggcuggagguggcaucagaaggcgcccugcagacagacugugaaggccggggaugaaccuucaggaauauccauggagggucucuggucuugcaguuacccuccgacagaugugguggccaggaugucacaggacacacgggacucaucaucaggugcagccccccaccccauccacaucaccauuuuguuuuccuuguaggcaaacaugcugacuucacauaggugcuauuuguuuucaugucuauuaacuguccccuccaugucuucuucccuucuauguccacagcaucuggacagugccauacucagagcagacacucagggaugguggugagguuccagugugaaugggaacagggcugugaccagggauccugugggcccgaaauggccuggguggccugcucagggcuaagucacccagcagcucauggcucaucaaguggaaaccuugagucuggaccaacagaggcuuuaugggagaaggaaagcucaggcuaaggacgccuugaugguuggcaccucacagguuacccagugcagucagcugccucagagccugagaucuagagccaggccagcugaguucuagcccagcucuccacugccgaggcuuguggccucagccaaggagucucuccuuguggggcugcagccuccuuguguauaaggcgcagacacaaauguuccugcccugccugagcugccgugaggacagcugagaggacacaggccaggccggugacuguccucacugccacuggcacucauggacccuaggaaggacccggcuuagagcagagggcagaggccaccaugccucuugccaggugcuucauggcaucuguggcaugagggaaagagcugucuucaaggguguccccuggccuggggcaggguagugcuaccgccucugucucaccugcucgccaccuuuuucuccucaucacucucguauucggcgaggaccagcuccuccuccccagacuccagcugcuccagccgcucagccuccgggccugucucuagcaucucccugcugaggcggaggagauucucucuuucuucuucuuccugccucuggacagggguaguggagguggugagggaggaagaagucucagcaccaguacccaccuccccacaugccagagacaaagcacaccacgccccauucacauaggccuggcugccuggcuggagagaggucgacuccuaggauccacgccucaaccacucacagcccagcuucuguacgggagcacauagccagugagggucacggaggggagaccaaggcccugaccacgcacccaugagccuccaagcagagcaacccugccuggacauaauccugccccccaagaaaugaggcucaccaggcgcuuggcugcauacuugagcugcacccugugcugcagcugcugcaggcguucuucucgcugcuuccuccuggccugcuccgccuacaggaggcagacaugaaggaaaaucaccaaggaagcccaaaaccaggccucuccuaaggagucugggccacucagcccggcgccuccucacugggggcaucucuccuuccccggccagcacucaagggcugccgcauccccucccgggaccucaucccugccggucccagccucgcugcucacugcggaaggcggcacacuccucccaaagccacacgcucuccaucagauccauuugcagccauugaaccaugcugccaauggcaaugaucagguccuuucccaggugaguaauaaaugggcaccaacaguuccuuauguggagaaggccugcugaccuccagcucaaaaaagacagcacagcggcagcaccauagacccaaggagcugagggaagagcugagaggcacggcaacggcaggggagcaugcacugccugagucucggaaucgccccagaacaaucgcugaagcccuguuuccuccaguacucccacuuccggauaccccaggucucaccuuuagucgguccaccaggucccucucuucuuucuucugcacaaacugaguaacccaggccgguucuccagcaggccucggggugccugcagccccuucgcaggaagaagacagacacagggauucaucuuucucaucauguaaggggccaguuccaguuucaaggagucgugccucuucuucacgcuucuucuguucaaagucacggagccaagagagggccccacaaauaagacuuaaggacuuccccugcaggaagaaaaaugaucuuuagaaacaggaaaacaacaaagccucccaaaugaccuuuccccauuuuaauaaaagcuugaaagaaggucuggcuguacauaggagaggaugcucuaagaccagccuaggaaaggaaaggaaggaaauuagcacuagaauagccaggaaaaacagaaaaaagaaagaaauggaaacugggcccaagaagcaggaaaaagcuucuuuaauuauccagcucacuguucugaaaacaaauuugaagcaguuuaucagauucuauguaaauaucgcacauaauuagaagaaggggagacauuagacaaaaaguccccuaaaagaauuaaggccccaaaaugcugagcaagaaaucccagguacucgccaacagggagccagagugaccgcgcggccuucgugcagcucgugcguggauacaggaugaucagucaugagcgccagugcuuacgguuuguguuuuguuuuguuuuuuuuuuuuuaagcaaacuaaucacucuggaagacaccacucugucuguuuuugagaggaggucuugcuauguugcccaggcugguauggaacuccugggcucacacaguucucuggccucagccucccaaguggcugggaccauaggugugcgccuccauauacagacuggagaacacuacccuugacuuaagaccagaauuuuccauaagccugauugaguuguauuccuccaaauuccuguguugaaauccuaacccccagcaucucagaauguggccugaucuggaaauaggacugucgcaaauguaauuaguuaagaugagacuacuaggacgggacccagccuaaagggcuaauauccuuauuggaaaggggacacguggaugcagacaugcacagaaggcaggcgaugugaugauacccaaggagaacacgccaccuauaagccaaggaaaggggccugaagagaucuuucccucacgacccucagaagggaccaagcaugcugacaccuugaucucggacuccagccuccagcgcugugggaugucaguuucuguuguuuaagccccaguuugugaagcuuuccucuagcagccccagggaaccaauacaguucuuccagagaggacccuucagggagcgccacaaggaggcggcccugguguccacaggggaacucagcucaggggagucucuggaggaccccaugccuucugcuccaggcagucagcucucugagccugcugaacccagaggggaucucagaguauccagggcggggugaaacaccucguaugacuacgguuggggcagcagcgcggcgcaggagucagagucucaaacuccacagccaggugccaggguuccagcugucucccccaccugcagcucuguggcucaggcuggccucacuacgcuuguuuccacgagugcagaaauggaaaugacaacagcggcaccuuccucauagagcuggugcaagcaggacauuaacacacacaaaaggccaaauccucuggauuagaggauuaccuggcaaauaacaagugagcgguuggaguuagcuaacuuuuugcuaucauuaaguaauaauaauaaaauuauuaauagcauuauucuggaauaugggaucuauuaguuuucaucaaaaucuugaaaggcccugggauaggauagaaugacauuguugacaaauggauggaucccauauuuuuaggaaagccccauauguaccauuucccucagcuuuugauagaaaguaaauggcaaagaguuccaggcagcauuucccagcagcaccuggagggcggcucuucugugcugucugugauaucggaagcagucagcuucagcugucacugggcugggagacacaaugguuagaaagccagugcccuccauuugaaagugagcugaggaaguuccuaaggguauggucaaaguuaucuuucaaaaacaaccgugguauacuccggcacaacagcaaaagaauaacugaggcccacuguuuucuacaucguguaauaagaccacaaaacuuuuagacuggaaaauguuaaaaggauuuauaaccaaaggcucaccuuccugggguaucaucaacaguuacaugauuuaugccaagauaagcaaauucauucacucugaacaccugcugguugcagcaagcauggggcucagagcugaggacacaaaggugcagagccccuagaaaaugcucacagguucacauguaacauacaauucgagggcaucauagauccccgcaaagcaugcauuccagguuggaugacucccggaacugcaguauuacacaaggcacagcacacaccaagugguaauggugacucaacuugauagaccuguauaaggcuuaaaaggugacuaucaaggauaaacagcaucuggggcagcuaagguggggcaccugugcauccacggcggggaagggcaugguaggcacaacagguaacacaaaccccacucagggugucccacagcauggcugcuucuaugggcugcgggacacccaggacaggagaaaacacucuauucaggagaugauuuagaagacagaagaaugucaaagguaauaaagccacaggguacauucacagagacugcacacaagaagaugaagcuauagaaccagaaacaucgacaauuaaaggcugagcagaggaagaagacgcagaagccuggagugcagaagacugagauggaaagaccugagagggagaagauggguugucaggcuaaacaaggugaaaggggucagguacaguggcucaugccuguaaucucagcacuaugggaggccaaggagggaggauugcuugagccuagggguuuaagaccaccggccugagcagcauagugagaucucauuucuacaaauuaaaaaauuagcuaggugugauggugcacaccuguagucccagcugcucaggaggcugacgugggaagaucacuuguugccagaagguugaggcugcaguaaaccaugaucuuaacacugcacucggcccugggcaacagagcaacacccugucucuaaaauuaaacaaggcagaaugaacaugcacucaucuguguuccaaagcacacuaaaauuaaccaaaguaauauggaggcuuacacccacaaaaagaaaguggaaggaguaauauguuuuaggagagagggaaagaaggcagagacauggaagugauuucggcagagacacucaagcccaaguguccccagagaucucccccacucauucucagaaagacucaggaagugguaggaacacagcaggccacugaaaacaaagggacggguugaaauucuuuuuaagaacaauuagauucucagguugcaaucccugcuccugcuccuugcagaagacaggaagugggcucuaaguggaagcugagcuaggagagcccuggaggcaaccggcagauugaggaggcaagagggagggggaggagggccaggcugaaagcaggcacugagggggacucuccaccuggauccccuuccccagaccaccucccggaagaccggcuauugggcuucagcgucuguaccugcugggccagggcucagaggcaccugcucuggagagacugaagacucuagggaaaaucccacagaugugcuggcaacuggaggcccccaacaaaggagcccagccuggcagccacagccagugcccugcagacucagccuuucugugcccuguucuucagcauacacaggcaguccagggcugccagacguuugaggaaagccuccaaacggacguauacccugauguggugugggugcggccgucuguccccauuaacacucaugcugaaaucugucaagucagucugaggagcaacuaauucaaaugacagggaaaggauggaggauuccaggagggcuccaagguaaaaauggaauuggucacugcuguggacugaauuguauccccaccaaaaugcauguuaaaaaaauguuuuuaaagaacaaaaacaaaacaaaagaagcuguguaugguggugugcaccaguaaucuuggaucuugccagccaccagguacuugggaggcugagaggggaggaucgcuugaguucgagaccagccugggccacauagugagacugcccaucuuaacaaacaaacauauguugaaauccuaaccccgccaugugacucuacuacagaucuggccuucaaggguaaaggaggucauaacggagcagccauaagggagcagcccuuguccucauaaaagagaaagagacaccaaagauuuguuuuucuccuccucgucuuuucuugcuccacaguaagaacgcagccaucugcaagccaggaagagacccccuccccagaaccagaacccugccagaaucuggaucuucaacuuuccagccuccagaauggugagaaaauaaauuccuguuaagucacccagucuaugguauuuuacuauggcaguccuggccgacuaagacaggaguuaucuguauggaaaaucauauugagaggccacuggaugaugugggaggaacuggcauagguauauuaaaaacuaaacuaacuuuaaaagggcaauuauuaacuagaaaaaacagaauauuaagacauauuguucaagacaaaauuauguucaaaacauaaucauaacacacugguucacucagcagagacuaaaacuuagaauuauauuugaaggauggggaacgggagggaaaagaguugguaagaaagccgucucaucuaccguaauagguaggcaccaaugacuucagccuaauuuuucucagaccacagagcuauguuuaagacuuuaggccgggcacggugacucaugccuguaauccuagcacuuugggaggccgaagcgggcggaucacgaggucagaagacugagaucauccuggcuaacacggugaaacccugucucuauuaaaacuacaaaaaauuagccgggcguggcggcgggcaccuguagucccagcaacucaagaggcugaggcaggagaauggcgugaacccgggaggcggagcuugcagugagccgagaucgucccacugcacucuggccugggcgacacagcgagacuccgucucaaaaaaaaaaaaaaaagacuuuaauagaggaagugacuauuacucagauaaacagagacuacucugcccaacuucaaacuaugaaaaucucuggauaggcaaacaggaaaagcuaguacggcugcuguuaaguuguccuuuucaguaucucucacuguucauacucacagugccaguuggacucucaaauaucccaaucuugccagccuccaaaacccgguacagcucugccaugaagucuuccuggauggaauagggugugaagggaaaaggaaaauggauggcaccaaccuucuguguuucauuagccauggaccuaggaaaaauaaauacaacauuagggagcucucucaugguccaggaagaaguggcuugaaaucuggagcauuauuuaagagcagucuccacacuuauuaccaaauuucuccuuuuuucugggaagcagagaccauguucucuccauccuucgcagcagguccacgugaggccauaccagaaucacgcacuccaucuagcggcauuuaacggcuguagcagaaugcagaccaggaaagccccuaaacccaaucuccccugcauuucaccguggcuccgauaccuuucuaaugccucuacaaaaggcuuagagcucucuucucacagaccagcaccccuaagaucaaggguguugcuuauaaugacuuuugcagcuuucuucucccacgucucugcaaugcacauucacaagccgaagcuacuucacuuuaucccguugugaaguccuggaaaaucaugacgcacaggcagaggaccauaagcacagcuuguuguuuggauagcgcaaguuaacauacacgucccuaucuuuuuuuuuuuuuuuuucgagacagagucucacucugucgcccaggcuggagugcaguggcgcaaucucggcucacugcacgcuccgccucccggguucacaccauucuccugccucagccucccgaguagcugggacuacaggugcccgccaccacgcccagcuaauuuuuuuuuuugguagagacgggguuucaccguguuagccaggauggucucgaucuccugaccucgugauccgcccgccuuggccucccgaagugcugggauuacaggcgugagccaccgcacccggccuacacguccuuaucuuacaaguaucuuuaguuugcuucuuaguucauccuggccuccauuuccagcaccgaacagagccaccaccuacuaacuuuucuggccucuagaccuaugagcuuucuguuugguuccagacaggagagcucucuucacagccacggggcucuggcuggaacagcuucccaguacugagaccaggcauuucucuuuccuugcuaggcuaaggucuaagaaaaacucugcuccacguugacgucaucuuuuuuuuucuccucuccugaaccuaauuaucucugagacagugauucaaggaagaaaggagaaguaaacgcuaucuggaggccugacucuuccauccugguucccacaccucucucuuuggaacucacuucuccaagcucuuugccaggucugucucuucuaagcacaaauguuaguaagucccaaacccauuuuacuaauauuaguagaucgagagcccaucuuuauaacuuuggccucaauaagacuagugauagugucacucuauuuacgaggggaaagguaguugccacgaugcucuucgguuuaggggcaauuaaaaugacuacagauugguggcaguuuauggauuugcacaagaagagagaacucacagaacuagcauuauuuuacccucugucuucacagagguauauuuggcuguuuuguuagacauucuggggacaagaaaaaaugaaaaaagaaaaacaugacuacagagguagaggaauuauuacaagaaggguaaucaaaaaacaugauuuacaauucaauccugagagagggguauguacugaaaaagcuuuaacacaugaaggaaaggggaagaaagguaccuaacaaauuuuugaguaccuccuauguguuaaacacucuacaguggucuuuugcuuuuauuaucucauuuaaucuguacaacacuauaaggauacagcuacuggauacugaugcuuacagaaauuaaauaauugcucaaagucacagcuaaaaaguggaaaaccagggauucgaauccagguccaaaugacucugcuuuagugaagcucauccgguugcaagagauauccagcauaagugaagggagguucacugaagggagguucacaaacugagaguaagaauugaaacuaucugggaaagccaaaaacagaggcagacuacaagcugcaaggcagcucggacuucaagacagcuccaggaacgucaccagcaaacacacacccacgggguucacucuccugcucagccaggugccggauacagccacaaucucacucccucagcgcacucgguuucugcuuaucccaaacuuucgcuuacacguggccucaucagccccuggaccuuucagcuucagcucccacugccaaguaaaaagucuucaugucuccucguucugaaucccaagacaaaaagcugaccagcagcuccucucaagacagagcacuggucagccugagacuggucaggcucccagccucaucuacucagcucgggccuugcacuugcugcuccccuuggccuggagaaggaguccuccucaauauccaggcuuuggcucaccuccucagagaagccucuccggcugucuggccgcuggacaguggucaaacaccacccccacuccucacccccuagcuugcucuaagucacuuuuaaaaaaucacauuacucuguauuuaauuuauucauagcucuuagcaccaucugaaccuauuuauucuuccucacuggaauauacguuccauaaauagaggaaccuugucugucuugcucuucucuggcuccaggacucagaacuaggugcuucgacaccucauaggcauucaacaaaaaucugaugaacgaaugaguagccagccagacaucggggcuguaagugaagguuucucuuccgaggcuggguaacggaggucccaugacuugaauaccuauuaguuaaauggccaguucuuuaaugguuucaaaccguuuucagauaaccccacaaaaacccugugugguauuuuuauaagcucuauuuuauagagaaagaaacugagacucaguaaacuuauaugacuugcccaaggucacucagcaagugcuugaacucaggauuugaaccacaucugccagacccccaagccaccugaaacuuucuaucuccucacuuuuccucccaccaggauaagugggauaaaaaagacagacuugguuaccaaacucuagaaugacaacacuaaacaauacagaagaaacguaaguauuauuucacuuccccaucagugguaauuauggaucucauuauuccagaagcagcacaggcuaaaucauagagguuuagauaaaucugaguauaacggauucacuaagcccuauuaaaaacauuugcagugacuuguucagcccucuucagguuggcuguguggaggacaaccaucaccucccagugccaaggcacacaccaggacagcaaagcucacgcucauaaaacgagguuagaguugugaaagcacuucaggaacauauuaguucuuaacguguucauuuucuucaguccccaauuaucacucauuacugaguacagacuauuguugugggcucaguuguguccuccccacauugaucuuggacaucccaagccucugggacugugagaaaacacauuucugugucuaagccacccaguuuaugguauuuugucauggcagccggggcugaccaagacaacuauguggcagguacuaucuaccguauggcccuaaaauguuuuaacuucacacaccuggaaagcaccacagccccaagaaaaaagcuuuuccgcacugcuguuaagccagggccacacacugcaguacugcggugcuccaccagcuggaggauggccuggcccauaauacccgcauucccaccuugcucuggcccuguguccccuccaacgugcauccugagcucgcacccuguguggaacccaaacagcugcuuaucagcauuuaaguccauuuuuaugacacuuccgucaacaaucuggucaagugcacucauuccuggccuccguacuguacccugcuccgccucgauucccgcccugggggaagcuagacucaugcagcuaacuuuaucggcucugggcucugauugccaaguuuaggaucccagcuguauccuugcuaaaguuagcaucgcuggggcucaguuuccguaagagacagguggguuacaagcgcucacucacuguugcagugucuuaucuacguaagauaauccaugaaaagcucaacacagcugggccaaaucuaagacccagacacgcggcugcuguuaaugcccacuucugcgcaccgcccaguuccaccgcaggcacaaccuuccuaggccuacccguccccacacagggguucccgcuugucaaucacgcuggcccggcccuccacuuccggaauguuuucccgcuccggacgggccacccaccuuugcaaauagggguccggcgccggaacagacgcccaguuugcgauuucaccagucugcccuuccucgucccgcugcuccucguccuaaggagcucugcugccacacagcacugcgcucaccuucuucgccggcagaauugcuacgcugaaagccaggccccgggaaucagggcaaacgccacugaguuagaaacuggcggguccccucagugaaaggcagccggaacaacccccgccgcugcgca

SEQ ID NO: 192721 - RNA, 24813 nt, Homo sapiens
uuggaaggugagauuacaaguaaauuuauuuucuucuugaaacccuuuugaauaaaauaaacauuucaaaaaaaugauucaggcucuuaaaauacugaggcuuauggugcauuaguuuucaacuuaacauaggucacauuaaaaaucuguuuaggugggucaccacaaaacaaauauggacacaagacaaaaaguaacugaaaggggagaaaguuucaagauuaauuuaacucauauuguuggaguauauaaauuauuauguauccccgccagaaaggacugacuagagcucaguaaacaacaugcauaaaucuaauucuggcauauuacuaaaucauaccuucagaaccaguauaagcuugagaaggaucaccuauuauguccauugacagugaguuguaugaguccugagaauguuuuucugucaccccugcuguaugacuggauaaagaugaugaugaagacaaucccagucuaacauaucuucuuuuuuuaccacagagugaacaaucuacugguguggcacuagguccccggggcagcugaacuucaucucuguuguaguuucugacagcuccacugugaugaacagaacguucucuuugccagauauaauggguuggugcaauggccauaaccuauaauagaaagcuaacuuuuagaauuuuaguaauauuucaaaauuuacuaaaauugaguucaaaacuuauaacucaagaacaacugucucuaaagugaagauaaaaauccaaauugcugauuuaaaaaacaaagcacuuccagauaaggcaauauuacuaaaaagugacucauugcuuggaucuuuaagacaauaauugacaaaguaaauuauuuuaaacaggaaauaggacugaagcaaucuuccagguugucaggguauuuauuuuuuaauucugaauauucuaaguuugggaaagauaauacaguuacuccaaaacaauaugugauucuuaacuuuggaauguauuggguuaaaaaaaguuaauuggccgggcgcgguggcucacgccuguaaucccagcauuuugggaggccgaugcggguggaucacaaagucaggagaucaagaccauccugucuaacacggugaaacuccgucucuacuaaaaauacaaaaaaauuagccgggcgugguugugggcgccuguagucccagcuacucaggaggcugaggcaggagaauggcgugaacccgggaggcggagcuugcagugagccgagaucgcgucacugcacuccagccugggccacagagagagacuccgucucaaaaaauaaaaguaaaaauaaaaauaauuaagguucccagcuauguguguuaugguaaucuuaaaaugucugcaauuaugacaagagauauggugaauaagaacauagguaaguuauuuaaccucgcuguuccucaguuuugucagcauggagauaauaaaugucuauuuuagaggguugcugcgaggaucagaugaggcauuauuuauaaagccucacuaucuuccaggcauuguucuauaagguuuguuaaauaaaacaugggcuuuagaguccggguacacuugguuucuuacccuggcacugccacuugcuagcuguauaauacugggcaaguuauuuaacuuuucugggacucaauuucuucaucucuaaaaugggcauaucaucuacuucacaggauuauucugaggacuagaugaguaaaaucaucacauagugaggaucuggcaaaugacaauuauuuaagucaagcuggggaacuguacauaugugcuaaccucaugaaaucuaaaacuucuaagcauucuaagcaaaagucuuuaguuacagucaucaaugacccaaaguaaaugagaacuguaacauucgagagcuggacagagccuuauuaauugccuagagcagugauuuucaaaacauuuagaaaguccaggugcaauggcccacuccuguaauugccaccaugcccagcuaauuuuuguauuuuuaguagagacaggguuucaccauguuggccgggcuggucuugaaugccugaccucaagugauccacccuccucgcccucccaaaguucugggauuacaggcgugagccaccucgcucagccaaaaacuguuauuuuugcaauaaguucaucauagucucuccacauacuaacccaccuaggaaaauacacaaucaugguuauuuuuaaauaugucuacauauauuuuauacacauauaaucauauaauuagaauuuuacugugauaagugaauuaaaaauaaaacuaccagggucaagagagcuagauuuucaucuuaauucuguuacucuggcaggugcaguggcucacacuuguaaucccagcacuuugggaggcugaggugugcggaucacuugaggccaggagcucgagaccagccuggccaacauggugaaaccccaucucuacuaaaaauacaaaauuaguugggcaugguggcgcaugucuauaaucccagcuacuugggaggcuaaggcaggagaaucguuugaaccugggagguggagguugcagugagcuuacaccuugccauuacacuccagccugggugacaacagugaaacuaucucaaaaaaaaaaaaaaaaaaaaaauccguuacuucuaugaccuugggcaaauuacacaacuuucugggccauagggugucuuuuauaugagaaaauaggucacuuucagucccccaaugcugugauucuaugaaacggacuucucugaaacacuaguagcaguugauguacuagaaacaucccccuuuuuuacuuuaucuuauucuuuugucauuuuuagugauuggggggugccuugggucaguguuccuaaaauuugauacuuggcccucuguuuuucuguguauauacucuaccugucugugaucucaagagguaguauaauauagguguuaaaagcacugacugucaaaaccaacccagucagcuucuccucucccuggcagggaggagaauggggaggaauggggagcagacagggauaggcaugaaaaaauuaaaaaaaaaaaaaaaaaaaaaagcacugacucuggagucagacugccuaggccugaauacuggagugcugcuuuacuuauugugugucuuugaagaagucacuuaaccucucuguuccuuaguuucuuaucugggauuaccuagcuagaucuaagaauugugagaguuaauaauacaugggcaauacuuagaacagugccuggaaaguucuuaaaaaguauuaauauuacuuugaccuugaaucucuuaaauacucgaagcaucauuuauacguaaugacuuuuaccauaccuguugaccauucauuuaauuauauccaguuacugccuuacauucaugucuauauaccaaauuccuuaucuucccaaagaauccaguuugcuucuguaggcuucccuauuuccauuauggaacccauuacucuuccuguuauauauauuugaaacuuacaguucccucucccauguacccuauauccaacugguuaccagguaaugauaauuauaauuuuuuaacauuucuaacaucuguuucauuuucuucagcacugcuaucaauuuucuucacaaccuuguuuccagcuauagcaaguuuagcaguuuccaauacauucccuauauuggaucucuuuugcauacugucauuggauuauucugucaaaacacacuacuuaucucauugcuuucuaaauuccuaaucuggaaucaaguaauagauagugaagaacucagcuaugaugauauuguggcaucuuggccagaguauuaacgggaauagagaaaaacuucuugauuaaauugcuacccuccaugaugcaugaaaggggcuggaaguguagucuaacucucucauuagauaggcauccucccuaaugugugaaccaguuuagaaauuaagccaucaccaauguaaauaaaucccaccuuaaaggaguuguugauaagaucaucagguaagaagauaaaaucagaauaaacaaagaaauaguccacucuuuucuggagaagcccuauauauauuuuccaauuuaaucacaacccaucucuuuccaaaaaggaaugaggcagcugagaaaaaaggggaaaaaauuucauugagcuuagacccaaaagggaaauuucgacuaaaaggggaaagcagacaugccaguaauaaaauguaauagaguugauguggucaaggauaauaccuggcuuuuagcuucuuugcagccaagauuaaaaaaagaaaagagacaauuacaaaacucacuauuugaaaagacagcacauguucuuucuuaugucagugguguauaauucaaagagcacuaaguuauuaguaucugcuacuuauuaacuucauggccauggacaaaucacaaucuuacuaagccacaguuuuugcaucugugaaauggagggaauacugcggcuauuuaauucccaagacaagaaauaaaugcauuuucuaaacuaaccaauaugagagguuuauauggaggcuagaugucacagaaaaaagagaacacuaggaagucauuagauguucuggcucugcaacuucuaugauuuugaguaaaucccagccuccucgguccucaguuucauuagcugugaaaugaggaugccaccacccccacagcuauuugugugauaauuucuguaaaagucauaauuuguaaagcacugugcaaauguaaaguauuauuauuauaagcuaguuuguagcuacuaucuuaacuugagguuauuuuaggauaugggacuaaagaaauguuucguuuggcaguaugccaggcuuucaguaacaaauguauagaacaguuacauuuucaacaguaugucuugcuauuucaggaaugggaauggggugauauaauacuucuuuacaauaaacucccagggcacugaacuugguguguuauucauaaaguaguuguccagugaacacuuaacagaacaggauaaaaucuacuaggcaguuaccuuuucuauacgccuacaggauucaaauguaccuuguuggaacagccaaaaaacagcuucucuaucugccacuggaguaagcggcagugcaaagugagcucagugaauaauuauuuuauaguuuauuguuucccuauuuaauggauaagaagguaugaaaaagaauuggaaguuccauucauuugaucagucaacaaauauuuauugacuacccacuaugugccaggcacuguucuaggcucuggagauagaauaagaacaaaauaaggcugggcgcucaugccuguaaucccagcacucugggaggcugaggcagguggaucacuugagaucaggaguuugagaccagccuggccaccauggugaaaacccugucucuacuaaaaauacaaaauagccgggcgugguggcgcaugccuguaaucccagcuguaauccuagcuacuugggaagccgaggcaggagaaucgcuugaacccaggagguggagguugcagugagccaagaucacgccauugcacuccagccugggugacagaaugaaacucugucuuaaaaaaaaaaaaaaaaaggucaggcacuauggcucacaucuguaaucccagaacuuugggaggccaaggugggaggauugcuugagcccaggaguucaagguugcagugagcuacgauugcacacugcagcuggcagccuggguaacagaaugagacccugucucaaaaacaaaaacaaaacaaaacaaacaaaugcaaaauaaagacccugcucucuuggaaucuguauuuuagugggaggaaauuuauuaacaagauaaauaaguaaaaagcagucuguuacaugaugguugagugcuaugaggaaaauuggaacugagaaagggaauacagaguaauagugggaggaacuacuuuuaauuuuaacagcuuugaaauguaauuaaaauaccuuagaaucacccaauugaaauguacaauucaaugauauucaauauauucagaguuaagcaaccauaaccacggucaauuuugaagcauuuucaucacucuauauauaaagcaaucacacuccauuuucucccuucucucagcccauaacaacuacuaaucuacuuucugucuuugaauuuguccauucuggaccuuucauauaaauggaaucauacaauaugucguccuuugugacaggcuucuuuuauguagcauaaucuuuucaagguuaucugcguuguagcuugaaccagguacuucauuccuuuuaauugccaaguaauauuuuauuguagggauauaccuuauuuuguuuauccauucuaucagcugauggacauucagguuguuuguacuuuggcuauuaugaauacugcuaugaacauucauguuaaaguuuuuuguguggacauaguuuuguuuuuacccuuuggcauauauagccaggacuagacuugcuggaucauaugguaacucuauguuaaccuugugaggaauugccagacuguuaugcaaagcaacuuccccauuuuacauuuccauaagaaguguaugaggguuccaguaucuccacauccucuucaauacuuuuauuuuuguuuuguuuauagccaucauagugggugugaaguaauaucucaucgugcuuuugauuugcaaucccugacagcuaaugauguugaacaucuuuucaaguguguguguguguguguguguguguguguguguuuuagcaauuugcauaccuucuuuggagaaaugucuauuuggauuauuugcccauuuuuuaaauugauugucuuuuuauuauuaaguuguaaagcucuuuauauuucuagauacaagacccuuaucaaauagaugacuugcaaaaaauuuuuuucauuuuauaggucaucucuucacuugguauccuuugaaggacaaaagguuuuaauuuugaugaugucuauuuuauauuuucuuuuguuacauguuacuuuugguaucaugucuaagaaaccuaauucaaggucacgaagacuuaccccuauguuuucuucuaagaguuuuaugguuuuagguuuuacauuuaggucuuugauccauuuugaguuaauuuuuauauaugguauaaaccagagguucggcuucauucuuuugcuuguagauauccaguugucauagcaccauuuguugaaaagacuacauuuuccccauugaauuuucuuggcacccuugucaaaauucaauugaacauaauugugacgguauauuucuggacacuucuauuccauggagggagauacuacucuauauaaggugauaaggaaaggucucucugaggugacauuuaagcagaauccugaacguaguuaggaagugaagcauacugauauuuggggaacaacauuccagguuaugggaauaguaagugcaaagaccaugagaugggaguguaacugguaucuuugagguaaggaggccgguguagcuugaguggaagagcaaagauaugagaugaaaucaaagagauaagggaggagggcugauagaccauguaggaccaugacagggacuuucucuuuuacccuauguaaggcuggaagacacuggaggcuuuugaguagagaagucaugauuugacuuaccuaaaaaaaaaauuacucuggcagcuguaugaagaauagauuauagcugcauaugguggcucacaccugcaaucccagcacuuugggaggccaaggugggaggauugcuuaggcacaggauuuugagaccggccugggcaacauagcgagaccccaucucuacaaaaaauaaauuagcugggcaugguggcacaugccuguagucccagcuacuugggaggcuaaggcaggagaucgcuugagucuaggagguuaaggcugcaaugagccaugaucucaccacugcacuacugccuggguaacagaguaagacccugucuuuaaaaaaaaaaaaaaggugggggugggagagacuauuuggaaacuuaugccaguaaucaaggcaagaggugacaauaaaaguauaguauuagugguggagguggugagaaaugguaggaugcuggauauuuuuucaagguacaaauauaagaaaaagaaggguaaauggaaauaauuuuuuggccugagcaacuaaaacaauagaguugcuacuuaugaauauguggaagacugcaggaggagcaaaucuggaggucugugucaaggagucaggaguucaauuuuaggcacguuaaguuugagguaucaauuagacaaaaaauaccaacaggcgauuucguaugcagaucuggaauuggaagaaauuauuaguuguuaguguuaaagccuugagagugaauggggucaccuaauaaguuaauaccaauagaaaggagaagagauccuaagucugagcccuggggcacucuaaugaaguuggugaggugaaaaggaacuggcaaaaaugacugaaaaaaaccugguauccucaaaaccaagugaagacaguguuucaggaagaaaugagggauagugucaaaugcugcuaaauugaguagauugaggaauacaaauuaaccuugggauuuggccauauagagauauuugguggccugacaaguuucuacagaaugauaggaaaaauacuuuauauaacagguucaaacagaauggaaagaacagaaguagagauagaauacaagcaauucuucaaggaguuugguuauaagggaggcaaagcagagaaauguagugguagcugggggauaaaguuuuuguuuuuguuuuuauugauggauaucuuagagcaauucuacauucugauggcagugauccaauaaaauaaaaaaugugaaaugcuggaaaggggacaauuacuggaaugugauguccuugagaaagcaagaaaagaugagaucuagugcacaaguagagggaauggauuuggauaggagcaaagaucguucuuucacaguaacaaagggaaggcagaauauagggguacgcauguagguaggauagacgauaagaugugagcacguggacagucuguucuacugcuucucuuuucucaguaaaagagaguaaugcaugauuguuguaauugaagugugaggacagagaugggagauauuagaaguguacuagauuuuuuacuucauuacauuuacaguuuauuguuuagacaauagauaagcaaauaaauaauuacaaauuuuauucagugcuacagaaggaaacaaaguauugugauaaggauaauggaauuaaauucauuuaaauaaggugaccuuuuugaagaggaaaaacaaguuccauuaauuuuuuuaaauguugcuaaauuuuaaaauuaugaaaaagcauuaggaauaauauaacaaacauccauaucccuacugccuagaauuaauagauguaauacugcuauuuuugcuucaagccuuuuuuauuuuuauuuuuugggacagggucuugcucuguugcugaggcuggagggcaguggcauaaucauggcucacugcagccugaaucuucugggcucaggugauucucacaccacagccucucaaguagcugggacuacaggugugcaccaccacgccuaccuaauuuuuuguauuuuuuguggagacaguguuuugccauguuacccaggauggucuugaacucuuggacucaagugauccaggccaccuuagccuccaaaagugcugggauuacaggugugagcuaccaugccugccugcccuuuuuaaauuaaaagaaauaauauaguuucugguauguauuuacuaagugcucacuaaaucaauguauauuaaugaauaaguuaauucuaucaaaucuuaagauuugcaaguauaucaacauuuaucaaauuuuucuuaacuaauacuagagcuuacagugaccacugcuuuccauuuaauuuucuacucuagaauuuuucugugguuugaaauagugacuuuauuaaaaaccagaacauuugguaaaauaacugauuauuaaauuuuuagugucuugcugauuuauccuaaaagauuuggcauuaaggaaacaauauauucuuugugaaaagaguuaugauuuuaaagaauauuuaaauuguauaccauuuaauauauguguuaaauaguguuucaauuuugggaaccugaaauuucacauacuuuauugagcagaaauuauuauucaacuccaguguuauuguaauccuaaauaagauauuuugguuuguucauaucacccuuuuucaauauauugaugauccuuuagacagaagaaauacacuaaaauaaaaguacuuacuauaagccgggcacgguggcucacgccuguacucccagcacuuugggaggccgaggcgggcggaucacaaggucaggagauugacacuauccuggcuaacacggcgaaaccccgucucuacuaaaaauacaaaacauuagccaggcaugguggcgggcgccuguagucccagcuaauugggaggcugaggcaagagaauggcguggacccgggaggcggagcuuguagugagcagagaucgcaccacugcacuccagccugggugacagagcaagacucugucucaaaaaaaaaaaaaaaaaaaaaguacuuacuauagaaguaggcugcucugaaaaauagaaaugacaauuuguuuguuuguuuuugagauggaguuucgcucuguugcccaggcuggaguacaguggcaccaucucagcucaccgcaaccucugccuccuggguuuaagugauucuccugccucagccucccaaguagcugggauuacaggcaccagccaccacauuugguuaauuuuuguauuuuucuuuuucuuuucuuuucuuuuuuuuuuuuuuuugagauggagucucgcucugucgcccaggcuggagugcaguggcgcgaucucugcucacugcaagcuccgccuccuggguucacaccauucuccugccucagccucccaaguagcugggacuacaggcgccugccaccacgcccggcuaauuuuuuuuguauuuuuaguagagacggguuucaccauguuggccaggauggucuugaucuccugaccucgugaucugcccgccucggccucccaaagugcuggcauuacaggcgugagccaccgcacccagccuaauuuuuguauuuucaguagaaaugggguuucaccauguuggccaggcuggucucaaacuccugaccucaggagauccacccgccucagccucucaaagugcugggauuacaggcgugagcagggcuugcccgguugacaguuuuuaguuauggugauaauaagacagcaacauuguaauacacaaguuguauucaugguaaugaucaauggucuacuccacauauuagaaaaaaaaaaaaaacccagaauaccaaaacauuagaagcacauuaaaaaacaaggauaauaagauaaacagaaaacaaagauuacauauauaaagcauuuuaaaauucuuaccuccucacaacaucgccugcuuacaauagcccuauagucaauucuaucccagagcuggucccuuaacuuuaagaaauuagggaacaauuuucuccaguuuuucccuaaagcccauggaaaaauuucguacuugguuucuucuucaucuucuucaacuguauuagccagauaccuaacaaagaagaucacaacccaaaaaagaaauggguaaaggacagaaacagguaguucacauacaccaagacauaaaagugguuuauaaacacaugaaagguguucaacguuaauuaaagaaaugcaguucaaaaauagagauacauguaguuaauuuuaccuuguuggguucuagguauuucuuauuccuacaaaucuugagcuuuguucugggaugcaguuaguuacuuugaaauagucugauucuuucagauguugcuuuuaugauuuuuuuagguggaucuggaacaauguucagucuggggcuaguuauuccucacuacugaggcaagaccuuccugaguacucuucucaaugcuccaugaauuaugaaucuuuucagccuggcuggugggaacagccacuauuugcagccguaugugaauguuaggcaguauuccuccuaaucuuuucuuaacaucuuuccucagauucagguaauuuucuuauacacauaugaaacucagcauucugcugaaugcuugauggggaccaggcaugcacagaagcaggaaaacaugacucaucauaaggcgacuaaucaaaaucaaccccaaacugauacccaugguugacauaaaagauaaggacacuggaacaguuauaacuauucuguauguucaaaaaguuaaguagacauauugaaaauguacuuuuagagaugaaaacuacaauguguacaaugaaaaauacacugauugggauuaauggcagauuaaauauuacagagaaaacaucugugaauugaagacacaauagaaaguauucaagaugaaauacacagagaaaaaagaaacaaaaaucauaaacacaagaugagggccgggcgugguggcucacuccuguaaucucagaacuuugggaggccaaggugggcggauugcuugaggccaggaguucaagaucugccuggccaacacagugaaaccccaucucuccuaaaaauacaaacauuagcugggcgugguggccugcgccuguaaucccagcuacuugggaggcugaggcaggagaaucgcuugaacccggaaggcagagguuacagugagccaccgagauugcaacacugcacuccagccugggugacggggagacucugucucaaaaagaaaaaagaaaaaagaaaaaaauaagaaaaaauaaacacagcaucaguuugaugugggacuucaagaaacaggcggaauuggagacucugaaggccaguaucaauaacaaugaaggauucuuucaaugcacuguaaucugaauagggcagacagaaaaugagguggacagaagacauuugaaggaguaacagcugaaaguuuuugaaauuuaauaaaaacuauaaaccuacaaagaaguucaaugaaccucaaagcacaugaaacaugaagaaaauuaaaccagugaacaccacaaucaaauugcucaaaaccagugauaaagaguaaaucuuaaaaguacucagagaaaaaaaaaccauuagauaacacaggcaccaugauuaggaugggguagauuucucauuggaaauaguacaagucucacagaugacuuuccaagaaaaacaggcaacuuacaauaaaaauauuacaaaacacauaagggaacaagguaccaagaacaguaacagacccugaaaucugaaaguaauggaacagacacagaaaguaagaauaacuauuuccaguaaagauaauacgauacauggaaaaguauauuugaaaaagaagaaaauagaacuuuuauaaauggaaaauuuuauaaugaaauuagcauauuagacauaagcugaagauaaaauuagugaacugagagauaagucuaaauaaaugaucuaaaaugcagcccaaagaaacacagauagaaaauagcaaagauuggcccggcucgguggcucacgccuguaaucccagcacuuugggaggcugaggcggguggaucacgaagucaggagauugagaccauccuggcuaacacggugaaaccccgucucuacuaaaaaauacaaacaaauuagccaggcgugguggcgggcgccaguagucccagcuacucgggaggcugaggcaggagaauggcgugaacccggaggcggagcuugcagugagccgagcacuccagcuugggcgacagagcgagacuccuucuuaaaaaaaaaaaaaaaaaaaagaaagaaaagaaaaaagaaaauagcaaagauggggauggguccaguggcucacaccuguaaucccaacacuuuagaaggcugaggcagguggagugcuugagcugaggaguucgaaacccagccugggcaacauggagaaaccccaucucuacaaaaaaauacaaaaauuagcuggguguuguggugaaugccuguggucccagcuauucgggagauugaggugggaggaucccuugauccagggagguggagaucgcagugagcugagaucacaccacugcacuccagccugggcaacaguuagacugucucaaaaaaaaaaaaaaaaaaaaaaaaagagagaaagaaagaaaaagaaaauuucaaagauaagugauggggaagaccgagcgaggcauaacaaguuuaauugguuucaaaaggagaaaaaggagauagcagaggaagagaaauauuugaagagacaguggauagaauuuucugaguugucuguugaaaggcaucaaucuucaggccaggcucaguggcucacgucuguaaucccaguacuuugggaggcuuaggcggguggauuaccugaggucaggaguuugaggccagcuuggccaauauggugaaacccugucucuacuaaaaauacaaaaguuaaccaggcaugguggucugugccuguagucccagcuacuugggagauugagguggaaggauugcuuaaaccuggguggcagagguugcagugagccaagauggugccaaugcacuccagccugggugacagagcaagacuccaucucaaaaaacaaaaacgaaaaacaucaauccuuaaucuucagaaagguuaccaaaucccaaguaaguuauuaaaaagaaaccagugccaaacaccaaagaaaaagaggucuuaaaagcagccagaaggccaggugugcagcucaugccuguaauuccagcacuuugggaaggauggcuugaagucaggaguuugagaccagucugggcaacauggcaaaacuccaucuuuaaaaaaaaauaaaaaauaaaaaauuagccgggugucgugcuaugugccuguggucccagcuacucaggaggcugaggcaagaagaucacuuuaacccuagagguagagguugcagugagccaagaucaugcugcugcacuccagccugggugacagagugagacccugucucaaaaaaaaaauuaagaaccuccuauauguuaguaauugaaagaugaaauaaaauguuauauguuccuugcccauaaggagccuacaauuaaguaaagaaggcaaguaagcaugaaacaaauaauugugaaagguaauguggaagaaugauaauagaaguucagagucuuauaagaauacauagaaaggaaacauuauaagacuguauagaaaggaaaagaacuugagcuuuagaacuauggcugagaaaauauuuaacgaggagaacuauugaggccauacaaaaaguaugauuagucuuaaaauggaaauuauaauucauguuauuuuuaauauggagcuuacauaauacaacaugcaguacaaccuuacagauaauuguauugcauaaacucaauagugcucuacugguaauaacuuuauaaaacaaguuaaacgaauucaauuucaggcaucuaguaagauuuaaacuaaagcuucuuuugguuuguuuuuaauucucagguaaaaaaaaaacacaaaauaaauauugcaucaacauagauacaauacaauacugagauauauaaacagcaauuuaacuuagugguugauggcugaauuuggucauugauaaccacuccugaguuugugccccugcuuugcugcuuacuaacuuguuuguucuuagaaaguacuuaaucuuccucucaguuuccucaucuguaaaauggggauaauaaaaaauuuauuucauagggaaaauuaaaugaguuaauacuacauuaaaauuuuuuguggugccuugcacauaguacucaguauuaccuaauacuauuauauuuagcaaucauccuaaauuuugaguucauuuuucccugugcacuggaaaauauaucuccugaauacaaguagaaaucaguuucuuuggcugggcgcgguggcucacgccuguaauccuagcacuuugggaggccgaagcagguguaucaugaggucaggagaucaagaccauccuggcuaacacagugaaaccccaucucuacuaaaaauacaaaaaaaaauuagccgggcgugguggcaugcgccuguaguuccagcuauucaggaggcugaggcaggagaauugcuugaaccugggagguggagguugcagcaagcugagauaaugccacugcacuccagccugggcaacagagagagacucugucacaaaaaaaaaaagaaagaaagaaaagaaaaagaaaaaagaaaucaguuucuucuaguccuguuuuuuuuuuuuguuuuuuuuuuuuucuccugacagcaucuugcucuguugcccaggcuggaguauaguggugaucauagcucacugcagccuugaacuccugggcucaagugauccucuucaucucagccucccaaguagcuggcacuacaggcacaugccaccaugccuggcuaauuuuuuuauuuuuauuuguguagagacuuacuauguuguccaggcuggucuuggacuuccagccugaagcaauccuuccgccccagccucccaaagugcugggauuacaggcguaagccacuguacccagccuaguccuauuucuuuaauaacucuuugauucugaauuaaauacacuuugaguaaaaacuuuaccuucagugcugacagcuauugugguauucaacuuaaauauuuuuuauauguguucucuagguaaacacuuaaaauuauauucauauggcugggcgcgguggcucacgccuguaauccuagcacuuugggaggcugaggcaggcggaucacuugaggucaggaguucgagaccagccuggccaacgugguaaaaccucaucucuacuaaaaacacaaaaaauuaguugggcgugguggugggagccuguaaucccagcuacuugggaagcugaggcaggagaauugcuugaacccgggaggcagagguugcagugagccaagaucacgccacugcacuccagccugggugacagagugagacuccaucucaaaaaaaaaaaaaaauuuuauauauauauauauauauauauauauauauauauauauauauucaugcauucccaacuacagcauuauauccagcuauaggguagaaaaggaaauauacucuuuuuuuuuuuuucuuuccugagacggagucuugcucugucucccaggcuggagugcaguggugugauuucggcucacugcaaccuccaccucccggguucaagcgauucuccugccucagccuaccgaguagcugggauuauaggugcccaccaccacgcccagcuaacuuguguauuuuuaguagagacaggcuuucaaccauguuggccaggcugguaucgaacuccugaccucagaugauccacccgccucggccucccaaaguguugggauuacaggcgugagccaccgugccuggccagaaacauauucuuaaauaaugcaaauuccaaauguauucugaccuauagauuggaaaaccauuucacagaucacaaugaauauaaacuaaagucaguggaagaacuggaaaacaacuguauuccuuugucacagcucaguguguuuaguaaaagagccagugaauaccaaugguaucaaauacgaauaaugacuauguuauagauauagguccacaaagacuauguuuagagcauuuuccacaaguuguucaauguaaaagggcaaugaugauggugauuuuuacuauauauuaauugaaaauuucagagaauauucugguuuuaaaaaauaucuaagucacaaagaggagaauuugggauaauuuauauggaagcauucugaaaaauguaaaacaugcaauacaaauugaagaggaauacuccaagaaaucuuggccaggcgcaguggcucacaccuguaaucccagcaccuuggaaggccgaggcgggcagaucacgaggucaggagaucaagaccauccuggccaacauggugaaaccccgucucuacuaaaaauacaaaaauuagcugagcgugguggcacguggcuguaaucucagcuacuugggaggcugaggcaggauaaucacuugaaccagggagucagagguugcagugagucaggauugugccacugcacuccagccuggcaacacagcgagauuccuucucaaaaauaaauaaauaaauaaaaaaggaaaucuuaggcauauagcaugauaagugaaaaaaacauaaaaauauccuauuaaaguaaaaaacauacagcauuuauacaggaaggccuauucaaagauauacauaagguuuuaaauagccucuguuuuaaauaagguguaauguauauaauagauaacacaacaaucacuuaguagaaaguauacuuacagagcaauaaagaaauuuauccugguaugcucacuuauaguaaauuuagcccucuugaaauaaacaaaggucauagccaaaagauacuauaaggaaaaaaguuaaaaauuaauauuaauguuuugcuuucauaaauaaaacugcuuuaaaauaguuaacuuuaaaauuuucugaugaauaagcuaaaacaauaaaguguuacuuauuauagaauuguguacuuaauuuuuggauuccuguaauccaccaugugaacagugaaaaguaauucuugacuauuuauuauaucauuauaaacuagaauggacuccuaaauuuuauuauugccaauaguuugagcuaaaaucccacuuuuaucuaauuuaaauuucaaaccuauacagaaacugaaauaacagcaaaaugaacagccaugcauccucacuuagaugcaccaaauuugccauguuugcuaucucuauuuguguguauguauguguauauauaauuuuucuaaacccuuuuaguuacagacauccauacucacuuuuuaaaauaacuuuuuaaaaugauuuccaaaugacuucagaaauuagaauaacauggcuguauuuucauggggagaauguguuuuaaauguauuauuagaaagauacaucucuagccugauuauuagcacauaugccagguucugucuguucaaauuaaaaacaaguuauaauaauguaucagauuaucucucguaagacauuuauucauccuauuguaacaggauuugccacaaaggugauaccaaguuuucacaguaacuuccaguaaaguacucuugagaucguguuaagacaguacuccagguaguuacuuuuccaacacugcccccuucugcacaacaacuuuacugcaccuuaaaaccauaaaguuuaaaacuuccugacgggcgcaguggcucacaccuguaaucccagcacuuugggaggucgaggcggguggaucacaaggucaggaguucaagaccaggcuggccaauaugguaaaacccccaucucuacuaaaaauacagaaaaauuagccgggcgugguggcacaugccuguaaucccagacauuugggaggcugaggcaggagaauugcuugaacccgggaggcggagguugcagugagcugagaucacgccacugcacuccagccuggaugacagagugagacuccaucucaaaaaaaaaaaaaaaaaaaagaaaaagaaaaaaaaaaaaucacaucauaacuccacaugaauuguauauuugauauuacagcauuacuguuaauuuuaaaaguucuaugacauuguaauuguuuuaaaacagcucuuaacuuuuagugauauauugugaaauauuuauggauaaaauguuaggaugucugggaucagcuucaaaauaaucguuuuuggugagaggcauuagaagaaacaagaacagccacaguugaucuauuguagcuagaugagaugcauauggaggcucuuuguucuauucuauuuacuucaaauuguguauguuuuaaauuuuccaaaaugaaauuuaaaaaauuuuauaaaccuucuucuaguguaucccugucaucuuaagcuuaaauaaaaaucuucaccccaguacuuuguauuuaaucacaagcuaaccuuccacucauucccuuuacuguuggcuaguagugauguaaagucacgcuuaauuuucaaauaugacugcuugguacaaaauggcauuuacaaagcugaaaauucuuagcacgagaaauauuuuucuaaaagaaaaaaauugaaaaauacaaagcugaaauuuuauuuuauuauuauuauuuuuuugagacagagucucgaucugucgcccaggcuggagugcaguggcucggucucggcucacugcaaccucugccuucugggaucaagcaauucuccugucucagccucccgaguagcugggacuaugggugcgcaccaccacaccuggcuaauuuuuguauuuuuaguagagacaggguuucuccauguuggccaggcuggucuugaacuccugacuucaggugaucugcccgccucagcaucccaagcgcuaggaucacagguaugagcgacaaagcugaaauuuuaaccauucaacaaaaucuaaagaauauagaaacaucgcugcucccaguguguaagucagacauucuuuuaugaaacacugauuccuaaacaacauguuaaacuaauuuuacccuacaaauuacugagauuuguuuucucugacuuacaaaauacuaaaaugcagacuaccuuaguaaaguaaaucucagaauauuuuuucuccacagccugauaaaagguaauaacugaucaaaauguauuaagucuauacugauuuucuguuugugguucuuugguuuuuguucguuuuugagacagggucuggcucugucacccaggcuggagugcaguggugguaccacagcucacugcagccuugaucucccuggcucaagcaauccuccugccucaggauaaaauauauauauauauauauauauauauauauauauauauauauauauauauauauuuuuuuuuuuuuuuuuuuuuuuuuuuuuuaagagaccaggucucccuauguugccaaggcuggucuuggaacuccugggcuuaagugauccucucgccuuggccuuccacaguguugggauuacaggcaugagcugccacaccuguuuugauuucuguuuucaaucaaauacaaauuuaaggucauuuaaauguaaucaauaauauucuacaauuccuuaaguauagacugaaucuaugcuauaugcuaauuccagaaauucauguguaaagcuucugcuuugaaggagcagugcaggcuagcucuuauuuuuuuaauuuuuaaauuuaauuaauuuguuuagagacagagucuugcucuauuguccaagcuggaaugcaguggcacaauugaucaaagcucacuguauccuccaacuucuggguucaagugauccucccaccucagcuggguggcuggaacuacaggugcaugccaccacacuuggcuaauuuuuaaauuuuuuagagaugggggucucacuauguugcccaggcuggucuccaacuccuggcuucaagugauccacccaccucagccucccaaaguuuugggauuacaggugugagccacugcaccuggccacuagcucuuuucuuaaucauaacuaauaagauagaaaauucuuauaaggucucauuaaagcucuaaugguucaguuacauuauaaugcugguuaauuguuauacuguuaccaaauuuaccuugucugcaauuuuacagcagcaguccauccacaagaaaucuugaauuaaaucgucaucuacaacaaaagauagcuauaacuugucuuuuaaaaacagaauguuuccuuuugaagaauuaauuucuaugucaagagauuauacauggugcuuagaaauaaaacaaaaaugaaugaaccaguguugccuaagguggaguuuucaguucuuugguguauuuaccauugcaaagacuguacgaaaaacuacugcuuuauccuucaucaagccaucugauuugccuuaacauauggcucagauuggagaaugguagaaguguuugguuuacugaauauccaacaguauuuuuaguuuugcauucuucucuccuauuuaucucuauuccacuuucuauuacucaaauacauaugaaaaugucuauauaaaaaggauucauaauucauuauuuauaauuaacauuuugaaaaaacuauuaggauaaaaagaucaacaaacaaacacauuguuaaaaauaauaacaucuagaaaguagguaaaauauuucaauucuaaagggcuaaaauauauaaucucaaaauacauuaauaguugucagaauguaaucuagaaaaaucuguuuuuccauucccccuuucucucuuucucuuuuuuuuuuuuuuuuuuuuuaaagagacagggccucacuauguugcccaggugggccuugaacuucugggcucaagugauccucuggcuucagacuccugaguaccuggaacuacaggugcauaugccaccacgccaggcuccucuucuucauuuuaaguaaaaaggcauaacuucuuuauauucauuuguguacacuaaaauaucaucaauguagucauacggaaaguuccaagaauaacuacugauuuccugagaauaagaauuucugccuugcuaacuuuuuuuccuuuuuuuaaacagggucucacuuugucacccaggcuggagugcaguggcgugaucuuggcucaacuguagccucaaccuccuggguuugagauccucccaccucagccccccagauagcugggacuacagguaugcaccaccaugcccagauaaauuuuuuuuuuuuuguauuguagagaggggguuucaccacguugccccaggcuggucuugaacucuugagcucaagcgauccacuugccuuggccucccaaagugcuaggauuacaggcaugagccaccauauccagccuuuuuuuuuuuuuuuuuuuuuuuuuuugagacagagucuugcucugucacccaggcuggagugcaguggcaugaucucggcucaacuguagccuccaccucccagguucaagcgauucuccugccuccgccucccaaguagcugggauuacaggcaugcaccaccacgccugaugggguuucaccauguuggccaggcuggucucgaacuccuggccucaagugguccgcccccuucagccuccuaaagugcugggauuacaggaaugagccacugcgccuggcccauuaauucuauuuauaguucuuucuuuuuuuuugagacaguuucacucuuguugcccaggcuggagugcaauggugcgaucucggcucaccgcaaccuccaccucccggguugaagcgauucuccugccucagccucccaaguagcugggauuacaggcaugugccaccacacccggcuaauuuuauauuuuuaguagagacaggguuucuccauguuggucaggcuggucuugaacuccugaccucagcugaucugccugccuuggccucucaaagugcugggauuacaggcgugagccaccgcgcccaggcucuauuuauaauuucuuaaguuaccuaaaaugguacagccagguauuuucccguguuucugaugaugaguuuuggguacuaaaaaaguuugcagguaauaauuuuguucugcucuuaaugaaaagaaggggaacuuuuauuaacauucuaaaucugauggggaagcaucuuuauaucuuuuucuacuuauauuccuuacauuuuuuccuguuucaucuuuucauuuugcuuuucuuuaaaucguaacuagcuugcuuuaaugcgccugaccuuccucuagaaacaagcaagcuacaaucuaccagacuguagcaucuacuugacuugauucauuacuccaaauauuuuucagaacucaucuauccuaccccuuuuucuaaucuguuuaccuuauuacccuaccucaaaaaaaaaaaauucccucucuuuccuaguuaggaguacaguacuauaaagaaguuucuuuuugccaauguuaagaaauuaucagcaaaguagcacugucucauaaccuaaacaaauucaaacucaguuucauuauauggacaugauaaagcauaguuaauuuuuaacaauguucccaaacuguuauccugaaacuucucuagugugaccaagcuuccuaguuuucuuggguuuagcagagaaaguccugggaaaccccuuaggcccagucaaacugggucaguuagcucaccugagucuuuauguaguauuuuauuuuaggucaaauaaaacucaugccaugggcuaugaaguugaauugcccagaauuuacauuugacaucuggauuuaaguagucuagaagcuagaugaguaugaauuuuuaauccauaaggaaacaaaacaaacaaaaacccaacauugaaaaaaaaagacuaaguaaaacaaaaacaaauuugguuggagaugggaaauuuaauacaaaaauaaugauauccucuuugaucagaauaaaaacauuuagauguuuacauucuagguuuuuaguacuuuauaauuaccacuauuacaauauuuuaaaccuaccaaauaauuuaaagaaagcagucauauccugacgcuguauaaccagacaagguccuuuggggcguuuagauuuguuguuauuauguguauuuuuuucaaaugcuugccaauuaucuuuacaaauaggacgcuucagaguaaugggcuuuuuaggcugaugugaucuauuugacccugauuuuacauaaacagugacaguagguggugucucacaacacaucugauugugccucauuuugguuucccaauauuc

SEQ ID NO: 192722 - RNA, 261870 nt, Homo sapiens
ucccugcuucucccccucucccgucagccucccuccgaguuuggccccuccggccgggcgaucgacguuccgcgugcgugcgggcgccugacuucacuuccggcuaacgcgcucggcuugcccccuggccccggauggugacuggugguggugcugcaccucccgggacugucacugagccgcuucccagugugauugugcugagcgcaggccggaagauggcggcugcggcugcggcggccucgggccccggcugcuccucggcggcgggggcgggggcggccggggucucagaguggcuggugcugcgggacggcugcaugcacugcgacgccgacgggcugcacagccuguccuaccacccugcgcucaacgccauccuggccgucacuagccgcgggaccaucaaagucaucgacggcaccucgggggccacacugcaggccuccgcgcucaguggugagucuuccgcacgccgggcgggcgcgaagccggggaaagaagccguccagccccggggcucggccucgcgacucggggaagcgagauggcgagagggcagggcuggggguucgggcccagccgugaagggaggcccggaagcugauggagggggaccuuaggacuuggcuuuuucagcggcugcaguugggaggaaagaccggcgagucagggaguggugggaggggaguugccuuucgggccuggagcguccggucuggcuugguccuccgcgagaggugaggagaccuuggagcuuggcaccggaggaagcgaggcccggguaggcccuggagaggcugucgguccugcguccgguuagaugagagcgaaaggcuggaaggguugaccccgggcggagaggcugguggccggaggcgaggggcggggagcgucugagccggcaaccaagcccucccuugugggagaggagccggcagucugcuguucucaggucccgcagugcgggggacagaccgcgggcugugcgcccagcgugggggugggggugggguggggguggggugggucgugguggggguggggagggaaguaggcgggccagcugccugaacugcuuggucgacgacuguaggacucugcggacgccgaagacgacuagaccugguccccuugcucggggcuuccaacuucuacgccccagugacgagaaagucaggaccugugguguaugaaauagauuccuuuggguuuguaacuucaggcugucucuacuuguuuucccacagcgagccgaaaauuaggauuugaaggugugucugagucucaccauuggaggagagcacuucuggguggcguaaaccuugguccagggacgggacuuucagaugcgugagguguaugcucaguggacggacuggagugguuuuggaauggcccuggcugaguuagauuuggcggagaugacauuucauuugugguuaaaugauggguggcuuaauuuggauguuguagguuuagauugaaaaguuaguguaugagugaaucggacuccugcauagagauguaauguauacaacugucugcguuuagccaaguggaaguaguuauguggucaaccaauucacuuguauuuuaacguagacgaacaaggaaaaguuuacuaugugaguaauaaggcauuuguaagaguaaauggcaauuuagggaugcaaacgugaaauuagacauguuaauuauuguugaugugagaguugugaaagaauuggauuauguauaguuucaggauauaaacuuggaacauaucuaagagaaaguuuugggagguagguuuguaauuuuuucuuuucuuggcuuagguaaaugaugggguggcccagauguagcagugaacaguuacugcaacuuggacauaauggcuucucacuguguguaagagggagaugcucauugguaauuggaugucuuucuuuuuaaaagucauuuaaaaguauuucaaguaugaaaagguaugaagaguaauuacagugaacaccaugcauccccaacucagguuaagaaauaaaacuuuacaaauaggauuaaaaucucagcugaaucucuccuggacugcauuucuccaauccucccucuucauaaacguuaucuuuaauuugauuuuauccuuuucauauaugucuacacuuucuaguauauguuucuaucuugaggauguaguauuuuugugauuuuuaacuuggaauaagugguauauguacuaggauuucuaaagaaagucauuaacaaaaguauucaaguguuuuggauagaaagaggaauuuuauggugugcuuuuuaugucuggaggccauguuugagaauaauaaugugugucaggauuuguugguuggggaaauuggacauauauuuaugugccuguacauggaaggaaagacaauauucacuuuagugguagauuacuaaagaggaggguuuuagauguauaacaugaagguguagguagauaaguaaaauguagcauugauuugggauaacagguuuuguuggggcaucuguugauuagaagaguucgggauuggauacaauugcagguccccaugcaugaagauugaguaugugaauuaaaauauguagaaggguuuauagugaacggaaugaaggauuacagaaaaaauuuggaaguuaacaauggaugcauucugaaacauuuucauauaugagaagugaaauuuauuauuauuuguaaaauuuauucguauuuguagagaugggguuuugcuguguugcccaggcuggucuugaacuuccggccucaaaugauccucccaccucagccucccaaagugcugguauuacaggcaugagcugucccaccuggccagaaguuuguuauuaauaauaauuaucagagguuguauaggguccuauuugccccaguucagaugauugaggagggaaugcugcauuuuauguuuuacuuagaaucugcagguauuuaguaaguuugcuuuuaaugauuaauagagggugacagcccuauaaauagaguagagagaagaugccaguagcgaucaugguccuaacauaaucccucuuucccguuuaugggcaaugggccacuuucuuuucuaccacagaggaaagacaucugugucugaggggauaaagacuaggugauacaguaauaggucuuauggacgccugggguucaguuuauaggguuauggguugccuguagauuugcaguugaaggaugggaacaggacuuguauguauauguauugaguggcaaagacagugaauuuuuaacuaugacuacuaguauaugucuuuauauuaucuguaucugauauaaaauguuuauaaauacaguuuaacuggauuaagagcuaucaguauauacacaggcuggguaaguauuugcucccugucaguauuuaagagugaagauuuuugaagcucugagcugcgugaucuggcuuuuacuagucucucuagucuugucuccuuauuuauaaguuuugugaaaugguccauuuaauucuuuuuccuaacuacaguaguuuuguucuuucuuggaaugcaccaauucgcuccagucauuuagcuaagucuuagucauuuucaagaccuagagcguaucuuaacuuccugaucccuuuagccagaaaugacugaagcccuaagcacauaugguccuauuaguguccauuuuaguaaucuggcagguuaguauuuugugguauuuuuucaaccgucuugaacuauuuaaguuuaaauuccauuuuauuuagcuuuuuguaaauauaugaggucugucucauauuucaagcuccuuguggggagguacuuuguuuauuuguuuauauaucccuuccccaggaugccuaauauacaguguguguguauguguguguguauguauauauuuauuuauuauuauuguuucuuugacagagugucacucuguggcccaggcuggagugcagugaugcgaucucggcucacuguagccucugccuccuuggcucaggcaguccuccugccucaccuuccugaauagcugggauuacagguacacaccaccagaccuggcuaauuuuuuuuauuuuuauuuuuuauuuuuaguagagacaggguuucaccauguuggccaggcuggucucgaacuccugaccucaagugaucugcccaccuuggccucccaaaguguugggauuacagguuugggccaccgcgcccagcccuaauauauacaguauaaacucgaguauuuuugauuggaugcauauauaacaaugaguauauuaguacuuccuuauauacuaauugcuaaguaaacacauuccuugacuuuuuuuuuguuuaaauauguguuucuuuuuuagagcaguuuuagguuaacaacaaaauugagcagaaaguacagacaguucccauaugcccucuaucucugugcucacacagccucccacccaucaguauucugcaccagagugguauguuaccauccgugaucuuagcacuaacaaucaucaucucccaaagugcauaguuuacauuaggauuuacucuugguguuguacaggcuguggguuuggacaauguauagugacauguauccaccauuguacuaucauaaagaauaguuucacuacccuaaagauccccugcucugccuauucauccuucccuuccuuuuccccccaacuguucccuccccucucccugcuggcaaccacugaucuuuuuacugucuucauaguuuugccuuauucagaaugucauaguuguauuuauaccguuuguagacuuuucagguugccuucuuuaucuauaugcauuuacaguucuuccuugucuuuucauggcuugauagcucauuccuuuuuagcgcuaaauaauauuccauugucuggauguagcacaguuuauccauucacauaccggaggacaucuugcuggcuuccauguuuuggcaauuaugaauaaaccugcuguaaacauuugugugcagguuuuuguguagacauaaguuuucaaaucauuuggguaaauacuaaggagcucaauugcuggguugcaugugagaguauguuuacuuuuguaagaaacugacagacucuuaguggcuguguaccauuuuguauucucaucagcaaugaauguucuacuuccucaccagcauuuggggguuuuauauuuuggccguuuuaguaguuguguagugguaucuccuuuuuuaaaauuguaauuuccuaaugacaugauguugagcaucuuuucauaugcuuauuugucucuuuuuauauguuuauuugcugacuuuguuuuuuuuuuuuuuugagacagagucucgcucugucgcccaggcuggagugcaguggugugaucucggcucacugcaagcuccgccuaccagguucacaccauuuuccucccucagccucccaacuagcugggacuacaggugccccccaccagacccggcuaauuuuuuuuuguauuuuuaguagagaugggguuuuaccauguuagccaggauggucucgaucucuugaccucaugaucugccugccucggccucccaaagugcugggauugcaggcaugagccaccucacccagccugacuuuggguuuuaaaaauaaaaaagcuacacaccacuugaccauacuguucauauuacuagauauguccuucacccuagcuauuguuuguucaugaaauuuagcauaauaguuagaaaggagcuugguucuggacacagauagcuuggguuaagaucccagugucuuaaaaauuuuuuuuuuuuuaaauucaucccauuacacagaauuauuuuaauuuuuaaacaccugucuaaauuuuuaaacaccuugacuaaauuauuuaauauuucuguuccaguuuccuuauuugcaaaaugaggauaauuguacuaauugugagaauuaagugauuaugcauguaaaguguuugcagcaguguacuuaccagacaagugccccaaaaauguuugucuuaucuacuuuaauucccuguaaauaccuugcuuuuggccuggugcuguggcucaugccuggggucccagcaccuugggaggcugaggcaggaggaucgcuugagcccaguaguuggagaccagccuaggcaacauagugagaccuugucucuagaaaaaaauaaaaaaauuugcugggcaugguggugcacaccuguagucccagauacucgggaggcugaggugggaggauugcuugaaccugggagguugaggcuucagugaguugugauugugccagccugggcaacagagcaagacucugucucaaacaaacaaacaaaaacaagaaaaccuugcuuuuuuuuucuuuuuuacuuaaagcuuuuuuuauauucaguuuuuggacuuaaacugaacuuugaacuuccuaagguuuuuuugugauuuaccacuuuccaccauccuacagaacccaucuagauuuugcuuuuuugugagaguaagauauuguuaagguguucucuuacuuaauuacugggggugaugauuucucuuacuuccugaaauaaugccccuccccaguguaguacauuuuauaccguuugucuuuuuuauaagcuuuuuugagauuauguggagagagcaugcgcuuuauguuagguaguccugaauuuugaauuuuaguucuuuuaugaacucacuacuuaaaccuccugaaccucagcuuccucaucuguaaauuaagauuaauguuuaauaggaugguggggaagacuaaguggucaaacauguuaaaagugccuaacagugcaugacaaauguaaaauaggggaugcucagcaaaugcuaauuccuuugagucucuuggcugcuuggucaauauugccacacuccucgugauuacuuuaaaaaauguucacuaaauguuuauacauagaggauaggcagauguagauggaaauauaaauguuuguaacaaauauacaguaaucuguguuuggauaaauaucuuuuaguguauugguguggcuaaaugucagaaugaaguuaagauaguuguauuacuaguucuguguguauacagauuuguuuauguaguauauauacauauguaagugaagguauaugugugcagguauuaaucaauggauauggcaguauauggguaggagacagucaugucucuucaguuuccgaagugaauuccagaucuguguugcagugaagaagaaaaaaccugcucaguguuuuuauuuuauuuuauuuuauuuacauauugagauggagucuugcucuguugccuaggcuggagugcaauggcgcagucucugccucccggguucaagcgauucuccugccucagccuccugaguagcugggauuacaggugugcgccaccaugccuggcuaauuuuuuuucuauuuuuaguagagauggaguuucaccauguuggucaggcuggucuggaauuccugaccucgugauccgcccgcccuggccucccaaagugcugggauugcaggcgugagccaccgugcccagcccugcucaguguucuuagacaaacacuccaguuuuacauuucuuuguaucuuuuuucuuuuccuauauagauagugacuuuuuuuuuuccacuggguuuuuagagucagucccucaguaauacagauaaugacuuugauuugagaaauuuguauguggucauaaauaagaggaagaucuuuguacuuuacuguagcuucagugagguuuagaucggguguuuuuuuuuuuuuuuucuuuccugauguaagagcuucuugaucaaacuucaggcccagagcugccugcucugagaggucauggugccugcauaguccucaagaaauaauuuuuuuuggcuaaaaugugcagucucccagugauggaaacuguaaaugauucaaaacaguucuaauuccuggcuaacuucgguacaugcggcauuccuacucucaacuauucuuugagagauaaacaugauauagaauucggaucucaauagcccuagaagaugucuuaugaaugcauuugaguuuuuauaaaaacuuaauuuagcagaaucucuuuuugggcuaugaauauguacuuuggcucuguuucuggugacugacuuuagugauauuaagaaagaauagaauauuggcucuggagccagacaauuuaaguuccaggugugaccuuaugcaaacugcuuaaccucucucugugcuucauaauuaguacuuaacucacuggguuauuguaaagauuaaauaaacugauacauacagaauacugcuugacucaccauaaacagucaauaaauguuacuuuuuuuuuuuuuuugagaggucgcccugucgcccaggcuggagugcaauggcgcgaucucagcucacugcaaccuccgccucucagguucaagcgauucuccugccucagccuccugaauaguugggauuacaggcgugcgccugcacgcccagcuaauuuuuucuauuuuuaguagagacaggguuucacaauguuggccaggcuggucucgaacuccugaccuugugauccacucgccucggccucccaaagugcugggauuacaagugugagccaccgugcccgguccuacuuuuuguuuuguugucuuaaauuauauaguucaguucaacaaguguuugucugccuuauguagguaacaagguuaauuugaacuaccuuggccaugauucccauauuuuaaaguacaagaacucccaguuuaagguaaaaaaauuagggcccuauuaugauuggagcuugguugcaguauuaauuaauugagaaaauauuguaaaaacaacugcuuuuaagcaguuuuauuuauuuauuuuauuuuuuaauuuaauuuaauuuaauuuaauuuauuuuuugagaugaauucuugcucuguugcccaggcuggagugcagugauguggucuuggcucacuguaaacucugccuccuggguucaagcgauucuccugucucagccucccaaguagcugggauuacaggcacgugccaccaugcccagguaauuuucgucuuuuuacuagagauggggucaggcuggacuuggacuccugaccacaggugauccaccugcuucggucucccaaagugcugggauuacaggcaugagccaccaugcccagccagcaauuuuaauuauuagaccucuuuuaccuauguaugugagaaagaauacaacgugaauguuuugggcuuucuuucccugcuggcuuagcuuuuaagauuuuuggggaggagaggaaacagauuaguuaaugcuuuuccauuugcccuccaacuucaaaaauuuuguugcuauuuucucuucacuuguucuuuuugucuuuuuggauuuguucaauaccuucuuuauuccuuuacugucuuuucagugggaucuugggagggagcagagguaaauguggauguaugauauuauuuuuaaacugaaaaucucuaguuguaacuauacuuacauuguuaaacauuuaguagucuguccuuaggaauguuggcuauaaguauauauagaacuuaaaaaaauaauagauuucuguaauauaguauguaagaacaguggggacgcaagcaggagugaccucucugauauguguguuguauugcugauggcuucaugaaaagggugccuuuggcaagauacuucucugagauaccaacuuuaaaaugggcuaauggccuguaaucccagcacuuugggaggcuuaggugggaggauugucugaggccaggaguuugagaccagccugggcaacauagugagaccccgucucuacaaaaaaaaaaaaauuagcugggugugguggugcaugccuguaggcccagccacuugggaggcugaagcaggaguaucacuugaguccagcacuucaggcagcagugagcugugauugugccacugcacuccagccuaggggagaaaggggcuuuuaauaccuuucuaaacauagaaauuuuuugcauacuguagaacuguagcacuucaaauguaagggauacaaaaaaguuaagauaaacuuggguguagaagagaauaucauauagagauacaaacugcaaaaagaaggaaauacagacaggagauaauagagauacaaauaaaaagaauacaguaauugcuuuauaaaacagucuguggccugggcaugguggcucaugccuguaaucccagcacuuugggagaccaaggugggugggucaccugagguacggaguucgagaccagccugaccaacaugguaaaacccugucucuacuaaaaauacaaaauuggcugggugugauggugcaugccuguaaucccagcuauucgggaggcugaggcaggagaaucacuugaaccugggaggcagagguuugcacugagcugagauugcaccauugcaauccggccagggcaacaacagugaaacaccaucucaaaaaaaaaacaaaaaaacgaaaaacaacaaaacagucuguggcugggacagcgcuguuaaaaaaaguaauuauuaggcugggcaugauggcugucgcguguaaucccagcacuuguggggccaggacaggcagaucaguucaggaguuugagaccagccuggccaacuuggugaaaccccgucucuacuaaaaauacaaaaauuagcuggguguggugguguacacuuguaauuccagcuacucgggaggcugaggcaggagaaucgcuggaacccgggagauagagguugcagucagucuagaucacagcacugcacuccagucugggcgagaagagugagacugucucccugcugcccccaccuuccccccaaaaguaauuaucaucagguuugaguauguuaaaucagggaugcaucuuagaggagguaaauacuauguuuacuuuuuagaggaaaugaauuuuugaguggggaagaugggaaugucuucuucaagauuuauugugggcagcaggaauuuaaaucuucauaauuuguuuauguacuuuuacuuugauuuaugaaguaggagagacagaagacugggagauggcacagggcagugguucucaaccuuuguucauuuagaaucaucaggggaaauuuuaagaaaauaccucgcuugggccccaguauucugacuuaaguggccuggagugcagcccaggcauacuguuuuuuuuuucuucuucuucucagaagugugccagcugguucuaaugugcaguuagguuuaggaguucaaacucccuggcugggcaugguggcucaugccuguaaucccagcacuuugggaggccgagguggauggaucucaaggucaggaauucgagaccagccuagccaacaugguggaaccuugucucuacuaaacguagaaaaaauuagccaggcgugguggugugccccuguaaucccagcuacucaggaggcugaggcagaagaaucgcuugaacccaggcggcagagguugcagugagcugaaaucacaccauugcacuccagccuaggugacauagcgagacuuugucccccacaccaaauaaauaaauaaauaaauaaaaaauaaaacaggaguucaaacucucuaacucccuagacuuuagagaaguuuguuuagugugucugggauaaaugagagcuucccgccccuguccccuuuugaaacggagucucacucugucucccaggcuggagugcaguggugugaucucagcucacuucaacgucuuccuccuggguucaagugauucucuuucaucagccuccuuagcagcugggauuacagguguguaccaccaugcccagcuaauuuuaguacuuuuaauagagacaagguuucaccauguuggccaggcuggucuggaacaccugaccucaagugaccuguccuccuuggccucccaaagugcugggauuacaggugugagccacugugucauuauggcauuaauuaccucuugauauacuauaguaauuaaugccauaaggaaaauuacagcugauaugaggaugaugguauauuaaauuugugcuuuuagguagucuugggaaggccucuuugaggugguguuugaguaaagaucugcaugaugcaagauagcaucaguacagauauccaggggacauuucuguuugucuguuauauaauagacaaaaacagcuagauagauuuucauauuuggauggaauucgaguugggcugacuuaaaauguaggcucuauaaggagugaugaagaugucugugugacuaccauucaggagauaucuggcaucuauauuaaacagaaaacaguaauuucaaauaugagcucuaaauagaaauucgcaagggcacauguuccaaaccguaggauuauuauauugauuaguagcugaguugcuucucacauuggcaccuuugugcagcaguagcaauugauuuuuuuuuuuuuuuuugagauguagucuggcucuguugcucaggcuggagugcaguagugugaucucggcucacuacacccuccgccucccggguucaagcguuucuucugcuucagccucccgaguagcugggacuacaggcacacaccaccacgcccggcuaauuuuuguguuuuugguagagacaggguuucaccuuauuggccaggcuggucucgaacuccugaccucaagugauccgcccaccucagcuucccaaagugcugggauuacgggcaugagccaucucgcccggcgccauugauuuacagacgguuaaggguucucuugcccaacaucaguuggggaaguuagucuucaaauuuuacuuaacuauagccaguuuagccagguugcacaccuguaguccuagcugcuugggagacugaggugagaagauugcuugagaccaggaguuccagguuagccugggcaacauagugagacccugucucuuaaaaaaaaaaaaaaaaaaaauauauauauauauauauauauauauauauauauauauauguauguauguauguguguguauauauaugcauauauguauguauauauauguauguauauauauguguguauguauacacacacacacacacacacagcacgcacgggugugccaaguucagcauccuaaaggaauaauauaacuuaugugucccaagacguugagagauauaacugugauaaauugaacaauguauaugaagaaaccccacagcaaguaucuuacacggaguaguaggucuuuagagauugagcccucuccaugauaaauuuuucguggugauuauauuuucaaaacaaaugaugucagauacuaaagauuauagcaaaguaaguggucugaugacacuuuugguuaaugugaaugaagagaaucauaacuuggaacucuuaauuccaguaauuuuguaucuuuuggagaaccucuucugugcuuaaguagauguugguucucuugccugaaacaacacugucccugcauuguguuuuauguuguauuuuaucauguguuaccccuuucuuuguggugcagucacugaccuuucccaaacuuguuuugcagugaguucugcuucauaggaauacucauuuuggcuuuuaauacuauaguguuacuaacauuuuuucucuuauuaaaugauuucauuuuugguuaauuauaucaaaagcuuugugagaaccuuacauuaauuuuguaccuucuuuuuaaaaaauuuuaaaaauucuuguggguacauaguagguguauauauuuuuggguuacaggagauguucugauacaggcuuguaucuucuuuauugacuuugaaugaucuuugcauauaguaccuuuuaauaggcuauuuuaaaauagcguugaagucugaugagaugucaguggaaauggaguuuuacaguguauugucaguuugaaaagauaauguauuucuuguaacauuuuugcaaguuuuuuaggguuguacauuauuucuuaaaguauuagaauugguaacuaauuaaaauuucuuuccuuugaaauuuucaauuuugccauccugggcaacauggcaaaacccugucucuacaaaaaauacagaaauuagccgggcgugcugucacacaccuguagucucagcuacuugggaggcugaggcgggaggauugcuugagccugggaggcagagguugcagugaguugagauugcgccauugcaccacuccagccugggcaacagagugagacccugucucaaaaaaaaaaaaaaaaaaaaaaaaaggaaauuuucaguuuuaaaagggacauaccuuauaggauguuagacagacuaaggaaaaaguaaguacguauaauuucauuaccuagagaugggcauuguuaacauuuuggcauuucuuuuuacuuucuucuauuaguauuauuuuuuuuuggagacagagucucgcucuguugcccaggcuggagagcagcggugcaaucucagcucacugcaaccucugccuucuggguuuaagugagucuccugccucagccuuccgagcagcugggacuacagguucaugccgccaugcccggcuaauuuuuuguauuuuaguagagacaaaauacagggguuucacuguguuacccaggcugcucucaaacuccugagcucaggcaauccgcccgccucggccucccaaagugcugggauuacaggcaugagcuaccaugccuggccucuucuauuguuuaauauauuuuuauagaauuuggaucauagugauguguuaugaacuacccccuccuuaguuaauagcauaguuaauaggcuauugcuccauguguacauguuuauucuuuuuuuguuuguuuguguuuugagacagagucucacuccgucacccaggcuagagugcaauggcgcgaucucggcucacugcaaccuccaccucccugguuccagugauucuucugccucagccuccugaguagcugggauuacaggugccugccaccgugcccaguuauuuuuguauuuuuaguagagacaggguuucaccagguuggccaggcuggucucgaacuccugaccucaagugauccgcccgccucggccucuugaagugcugggauuacaggugugaaggcauugcgcuuggguguguuuuuuccuuuacaauaucauuuaaaaauuuuuauuuuuuauagaauauaaaguaaaguugucuauuuuuuguguacuugucauacagguacacacaugcauagauugauguaacccaccaucacagucaggauacagaccaguuucaacaccugaaaaaauucccugugguaucacuuuguagucacaucuucccuuuaccacuaaucuuuugggaccacugaucuguucuccauacuauggaguuuuguguuuucuacauuguuacugaaauguaaucauucaguauguaaccuguugaugcuagcugcuugcacuuagcaugaugcccuugagauucugucaaguuuuugcauguauuaauauuucauuccuuuuuuauuacugaauaguauuccaucguauugaugcaucauuauuuguuuugccagucacucuuugaaauauguuuggggcugggugugguggcuuauucuguaaucccagcacuuagggaggcugaggugggcacaucacuugagaccagguugggcaacauggcaaaacuuuguaucuacaaaaaauacuaaaaauuagccagacaucauggugugcgccuguagucccagcuacuugggaggcuaagaugggaggauuaccugagcccuggaggucaaagcuguggugagcagugauuucgccacuauauuccagccugagugacauagugagaccuugucucaaaaaaagacaaagagaaagaaaaaaaaacauuuggguguuuucaauguuugaugauuauaaauagagcgacuauaaacuucugaguauagauuuuugugugaacauaagcuuuuaugucuccaggguaaauacacagaagugggauuacagggccauuugguaaguuuguguuuaacuuuguaagaaacugucaaaccaguguggcuguaccauuuguauuuccuuuagaaauguaugagaguuccaguuguucugcauccuugccagaacuucauacuaucuuuauauuguuaagauaucuauacugccccaaacaauuugcagacucauugcaauuugcagacucauugcaauuccuaucaaaaucccaguaacuuuuuucuauuucugcaggaaaaaaaaaaaaucuguucuaaaauucauauagaaucucaagggacccuaaauaguucaacauaaucuugacaaagaacagaguuggaagauuaacacuugauuucaaaauuuaguaugaagcuacaguaaucaauauagcaaaguaccagcauaaagauggacauauagacugaaggaauauagagccgagaaauaaacuauugcauauauggucaaaugauuuucagcaaggaggccaagaccauucauugggggaagcgacaaucuuuucaacaaauguugcugggaagacuggauacucacgugcaaaaaguauaaaguuggacuuuaacaccauauacaaaauacaacaacggagaauaaguguuggugaggauguggagaaauuggcacucuugugcacugcuggugggaauauaaaauggugcagccauuaugggagaugguggaguuuccucagaaaauuaaggaaaaaauagaauuaccauaugaucgcuguucuguuucuggguguguaccucaaagaauugaaagcagggaaucaaggagauauuuguacaccaguguucauagcagcacucuucgaaauagccaaaaggcagaagcaaccuaagugucuguccauugauaguugaauggauaaaaggaaggaaauucugacauaggcucuaauguggaggaaccuucaggacauuaugcuaagggaaauaagccagucacaaaaggaaaaauacuguaugauuccuuccauucaugugagauauuuagaguagucgaauucaugaagacagaaaguagcaaagugguugccaggcuuuggggagaggggauaaaagucaguuacuguuuaaagcguacagaguuucccuuuauccugauggauaaacaacagcaugaauauacucaauaccacucaacuguacacuuaaaugauaaaaugguaaauuuuauguuuauuuuaccacaauuaaaaaaacuacauaauugaaaaaaauccaauggccauguuuauauagucauaucucuugacucuauuuuguuccauugagcuauaugucuguccuuugccaguaccacacuuucuugugguacugccuuuucaaauacauuucagucaguuuauuuauauggugcaaucauagcucacuguagccuugaacuccugggcucaagugauccucccaccucaguguccgaguagcuagaaccacaggugugugccacuacaccuggcuaaauuuuuuuaauuuuuuuuuuuuuuuugugacggagucucacucugucgcccaggcuggagugcaguggcgugaucuuggcucacugcaagcuccgccucccagguucacgccauucuccugccucagccucccgaguagcugggacuacaggcgcccgccaccacgcccggcuaauuuuuuguauuuuuaguagagacgggguuucacuguguuagccaggauggucucgaucuccugaccuugugauccaccugccucggccucccaaagugcugggauuacaggcgugagccaccgcgcccggcaauuuuuuuaauuuuuaaauuaagauagauacggggucugucucaggcuggucucaaacuccuggcucaagcgauccuuccguguaggccucccuaaguguuguauuaugggugugagccaccaugcugacgccaccugggauuuugauugaaauuccguuaaaucuguagauccauuuggggaguguugagguuuuuaccagauugacuuguucaguccaugaacaugguauuauuuaggcuuuugauuuguguaaucagccuuuuauacuuuucagcauacauauacaccuuuuguguauauguaugucuaaguauguuuuagagcuauuguaaacugguauuuuaaaaauaaauuuugguuuuagauuaaucagugcucguauagaaaaguaugauugauuuuuaucuacacggguaaucauuucuguaaaaagggacaguuuuauuucuuuuugauuuguuugccuuuuauauccugauuuuuuagugcagugacuagaucuuuuaguauaguauugaauaggaaugguaagagcauacauccuugucuuguuccugaucuguaugggaaaguauucagucuuuuaccaauaaguauguugacaugccaggcacaguggugugcuccuguaguccuagccacucaggaggauggcuugagccccaggcguugcccugggcaacguaacgagacccugucucuaaaaaaacaaacaaacaaaaaaaacccccaaaaaacuccagaccuugugauccgcccaccucggccucccaaagugcugagauuacaggcaugagccaccaugccaggccgaaaaagccaaauugcuugauacguaccauagacugaggucuccagcugugguugcgugccauuucaggcacaggauucauuuuguaaacagaugacauacauuuaccguauugauaagugcaauauagugccguaaauguauuuucuuucucucucuuuuuuuuuuuuuuugcaauucagcuuuuuauuguaaucauaugacuugucccugccuuuugggaacacuucgagcaucacuaguguuaccuuuuauggguuucauaguguuauucaggguuuaugguauugcacuaaacccgaugaaaauacaugagauggccgggcgcaguggcucacgccuauaaucccggcucuuugggaggcccaggcgggcagaucaggaggucaggagaucgagaccauccuggcuaauacggugaaaccccaucuuugcuaaaaauacaaaaaaauuagccgggugagguggcaggcaucuguagucccagcuacucgggaggcugaggcaggagaauggcaugaacccgggaggcagagcuugcagugagccgagaucaugccacugcacuccagccugggggacagggcaagacucggucucaaaaaaaaaaaaaaaaaaggaaaauacaugagaaucaggagagaucacuuuuuacugcgauuaccaauuaacaauugagagaugaacugcucaccuggauaugauuagggucacauggugguacucauaacacuugaacucacugcaauaggaacaaaauuaucacaguuuuauaauauguacuacagcuaauuuuauuuaguuaugauuuaauacuguauuuuuuacauuuguuuacauuuuucuugacuggugccauguacuauuugugugcguaaguuuugauaauuuuaacuuuauaguagauuuguguauauuuuaugucaguaaaugaucaaauagacuaauaucuacauauauuuuaugcaucagugacauacuguuuucuuaauuuuuuagauauuucuaggcuacguguuuugucuacauguuuuuuaaauugucacaaaucucugaaauuuuuuucaauguaugaauuggaaaaaaauuuauguaugaguggucucaugcuguucaaacuuguaugguucgaggguuagcuggguuuucuucuuaugcauaccuguaauaaaguuuaauuuaaaauguaggcauagugacagauuaacaacuaauaauaaaauagaacaauuacaauauauuaggaguuaugugaauguggucucucagaauaucuuauguacuguacuuuuggaccuuugauugaaaauaucuuauuguaccauacuuaccuguuuuugggcuucuauugacuggguaacugaaacugcacaaagugaaacugcagauaaggaggggcacugcuguaucuaauaacuguccaugcugucuuuaugcuuauugaguuuugcaaaaaaugacauccaauaauucauuuuuaaaaguuuuguuuuugaacacuuucauuuugcacuuacagaaaaauugcaagaauagaauguuacaaagaacuucccuauauacccuuuacccagcucuacuaguuuuaaacauuuuacuacauuugcuuauuauucccuuaauauauauguguguguguguguguguguguguguguguguguguauacacaucauauuuuauucuacuugagaguugguugcauauaucaugcucauuuucccuauacuguugcuguguuuauuucucagaacaaugauguucuuuuauaauagcaauuugguugucaaauuuuaguaauuucacauugauacuuuuaucuaauuuaugguacauauuugaauuuaauccaguuggcccaauaauguucuuuagagaaguuuuuuccaguuuaagauccaauucaggauaauauauuguguuuagucacuauguaaacauuuauuuuuaauagaccauuggccugaaaaucuuaaguguugaauuuuuguucuuuuaacagcuaaaccagguggacaggugaaaugucaguauaucucugcuguggauaaaguuauauuuguggaugauuaugcaguaggguguaggaaggaccuuaauggaaucuuguuguuagacacugcucugcaaacuccaguuucaaagcaggaugaugugguucagcuugaauuacccguuacagagguaaguugaaauaaguaucaaugugguccucuacuuaauguaaucuuagacauauuagauguuaaaugaaauuaagucauccuuuaaggacguuauuauauauauugcuauaaaaacaauuuacuuauugaccacaacuucauuuaaauauuaauacucaccuuuucucugcauaauuaauucuuguugaagugguguuuuuaggugugaauggugcaucagcacagguuaaacagcuguaaccgagacccaaaaaaacaauggcuuaaacaggauagcuuguuuccaauaauaguccagggcuaaguguauggccaucauugccaaccucaacacuuggguuagcuugggaguuuaagacagcugcucuaggugucauuauuucccagucacagggaaagagagggcaagaggcuagaggagagcacucuggcaucucucucuucucuccuucccuuucccugucccuuaacccccagcccccucuccuacucauuuguucuuguucucuuucugccuuucacaacucaaauacucucucauauagccucauauuuaccccauuagacagaauuuagucacaugaccacaccaagcugagagggagacugggaaagaggugguucuuucuuucuuuuuuuuaauauuuuaaaaugagagaggaauagacucugguaaaacagcaguaauuuuuuuuuuuuucuuugagucagagucuugcucugucacccaggcaggagugcaguggcuugaccuuggcucacugcaaccuucaucucccggguucaagugauucucuugccucagccucccuaguagcugggauuacaggcaugcaccaccacacccagcuaauuuuuguauuuuuaguagagacggguuucaccauguuggccagacuggucuugagcuccugacuucaauugauccgcccgccucagccucccaaagugcugggauuauaggcgugagccaccgcacccagccacacaaccaguaauuuuugcuaugcaucaugucuuucaauaacuugaguuuuaaguuuuagccauauauacuuuucuguaguguuaaauuuucuuuacuuaauuuuuaagucuagcccaacuuaaauucuuuuguguggcuucauauccugcaguuugaaaguacauuuuucauaauuacuggauuuugcaucaccuuaaauagaauguaaaagauuauguuguguucuauaauaaagugagauauuauuuguguucaugcuaacuuguuaugaaaguuaucaaaaaaguauguccaauaaaguauauucacuuagauuuuacauuuagugucauauaacaguagucuauuauauguuaauauugaaagcauguugcugaaaguuugaguuccaaaaacagagaagcugucuuuuucucaucagaguauuugggucuggaggcaugucuaaaaucuuuggauagagaauuaauuaguucuacuugauuugaacaaguagaaacuuugaaaaaccauuugaaaaaauugaacauuuuucccuaauuuaaggaauauaaaccagcugauaucaggauauauaaucagcagcaaaaaaacacuaucaaacuauguuuagguuuaacaaacaauuaaagaauuacaauaaaauacuugaacacuuauuaacucucaagucaguguuuuuccuacuacagugaaaugcuguuuagcuucuaucccuuccuccaccuaguuuacuguuaaaucuacuguuuuuuuucucuuuguacuuuaaucacagcuguaacuguuguucagauaauauuguuuguagaucuuccagcauuccaggcuuccuuuacugcaucagauuaguuugucacugucuucccuaaagucuuagguuugauuugcucaguguagauauauucuuuuccuuauauuagcauauaucuuuauuacaguaguucauauugaauauguggauaacaaugcaaagggcuuuuucauauuacuugcugacuuaguguccucuauuaugacuuuauauagcuugaguauuuaaagcucauuggaggacuuuaaguuugucucuucagauuuuuuccuguauuauuuuugcuuaugguuucagcuuguccauuuuucuaucuugauuugguuuacaauaacuacuuuguguuuaaacuuuaccauguaguauuucuacacugaauacauugcuuuaucucauuuaauuuuauaauagcccuuuaaauuauuguuuaauuaaguagauuuguuaaaagguaaguuuaguauaguaccugucauaaucauugcauauuaaaauaucugaaagaggaucugaauuuaauuuuuuguuguucuuguguugaauuuucugugauuuuuuuauuuuuuauuuuuuauuuaggcacagcagcucuuaucagcauguuuagaaaagguagauauuucuaguacagaggguuaugauuuguucaucacacagcucaaagaugguuuaaaaaauacaucucaugagacugcagcaaaccacaaaguugcuaagguaagaaguuaauagauugccucuuuugggguuauauuacaauggacaccuccauucuuuugcacuuuccuuuccucuccuuuuggaaauguucuaauucuagauuuuucuuuuaaaaagcagaaugugcuuauaagucaucuuaaaguugaaacuggcugggcacgguggcucacaccuguaaucccagcugagggaggcugaggcgggcagaucaccugaggucaggaguuugagaccagccuggccaacauggcgaaaccccaucucuauuaaaaauacuaaaauuagccaggcgugguggcaggcgccuguaaucccagcuacuuggaggcugagacaugagaaucacuugaacccaggaggcggaguuagcugagauugcagagauugcgccacugcacuacagccugggggaaagagugagacucuguugcccaaaaaaaaagaaaaaaguugaaacuuugaaacuucuuaaucgaagcuuaacuucaguuugugggaacuauuuugcuuauuguguuuucugaugcuuccuuaaaucuuucuuagugccugauggaccuggauuggucaagaggcugaugaaagaagcuuccuuguuagguugugagcuuggaugcuuggauaagaauggacuaugucuuuggaaauugagccauuuugugcuuucucugaaauuuuuuggcauacugggauguauaugagagacagugcuuucaauuaaauccuuggguauauuuuuauuaauuuccuccagauuuuucuuuuaaggccuuuucuaaguuauacugcauaucaaacuucccuguuauugaaggauauaagguagaagguaaaagccauuuuccuauaaguaacuugggcauuugcaaagauuuuucucaagugcaguuguaacuauacuaaaauauacuaauauuguguuaugauauaccuugcuuuuuuucuuuuauuuuuucuuuugagacagaguuuugcucuuguuucccaggcugcagcgcaauggcacaaucucggcucacugcaaccucugccucccggguucaagugauucuccugccucagucuccugaguagcugggauuacaggcgugcgccaccacgccuggcaaauuuuguauuuuuuaguagagacaggguuucgccauguuggucaggcagguggcgaacucccgaccucaggugaucugccugccuuggccuccuagagugcugggauuacaggugugaaccacugcaccuggcucuuuuuuuuuuuuuuuuuugguucgagacagagucucacucuguaaccuaggcuggagugcaguggugugaucuuaucucacugcaaccuccgccucguggauucaagcuauucuccugccucagccucccgaguagcugggauuauaggcacacgccaccaugccuggcuaauuuuuguauuuuuaguagaaauuggguuucacuauguuggccaggcuugucuugagcucuuaaccucgugauucacccaucucggccucccaaaguguugggauuacaggugugagccaccgugccuggccaccuugcuuuuuuucacucaagaauuugucuuggauaucuucucauauccucagagaucaucuauguucuucuuaguaguugcauugaauuuuuuuuuguagauuugucaugauuguauuauaccuuacucuauugauggggcauuuuauuuaggaaaacagaaacuguccuaugaguuucaacagagauaauuuauuguaagaaauuaacugguguuugaaaacugaaaaagugaaaaggagauccugagauaacagagauaacuauaggaagcaguuuucaccuaggucuggaggaacaaagaguagagauuagggguuaucagaaccuagaaacuuagagaauaggccccguggaucugggacuaggaagugcuacccaguugguaacucaggagcuuggacgagggcguugcaaaacugggacucagaucucugaagagagaugcuacuugacugaugguaguaccucugagggaacucuaugaaacuggaucucggaaugcuaaaacaaccaaaccaaaacaaaaugcugaagacuggaagaaucaacuacugcaucauguccuuugcugaaacagugcugauggcaauggccaguaaauaagaaggagcaagucuuucuucaucuuucuuuccaguuuccuuccugugcuguugcugggagaaccuaaaagccaggaaacugguugaaaagaggaaauacaguaugcagaguccuagccccaaccugauagagcagagaauuaaaggguagauuuggagcucagagacaacaguuuaauuaacugcacagucuaccccuuuggcuacucagcaucuccauucacacuuuauauauuugaacuuucauauaacaaaacuauuaugcuuuuuaaaaaauuuauuuuuauuuuuggagauggggucuugugcuguugcccaggcuggagugcaguggugcgaucuuggcucacugcaacguccgucuccuggguucaagcaguucuccugccucagccuccugaguagcugggauuacagaugugcaccaccaugccuggcuacuuuuugcauuuuuaauagacaugggguuucacuauguuggucaggcuggucucgaacuccugaccucaugauccacccaccuuggccucccaaaaugcugggguuacaggugugagccaccgcacguggccugguccucaguuuauuuaauuuuuuaauuuaauuuuuuuuucuuagacggagucugucucugucacccaggcuggagugcaguggugugaucucggcucacugcaaguuccaccuccuggguucaggugguucuccugccucagccucccgaguagcugcgauuacaggcgcgugccaccacgccuggcuaacuuuuguauuuuuaguagagacgguuucaccauguuggucaggcuggucuugaacuccugaccgugugaucugcccaccuuggccucccaaaguggugggauuccaggcgugagccuaguccucaguuuauaauggucaagaggauauauuggucaagaggauguauaauagucaagaagauaucuaauuucuuuuuuuuguauuaccuguuccuuauuagcucugucaucauucagcaucucaacuggucaggauucuuuacguacaugaacgacccaucuucauucuugaagaaucugaauccucacuggugcugugucuuuauuuuauuuuauuuuuugagauggagucucacuuugucacccaggcuggagugcagugaucucagcucacugcaaccuccgccuucuggguucaagucauucuccugccucagucuccccaguagcugggacuauaggcacgggccaccacaccuggcuaauuuuuuguauuuuaguagagacgggguuucacuguguuggccaggcuggucuugaacuccugaccucaggugauccaaccgucuuggccucccaaagugcugggauuacagguuugagccaccaagcccagcuggugcuguauuuuaaguuguaauuguuacuucaucuuuacuauuggacuuggaaguacuaaggggcauccuagagaaucucuuggguucugcauaaguucuccuugccccuguuacuuagcaucaauccagguuuccgcuugucaguuccagucauacaaacuaguagaacuucuuugacuauuuauucaguggcaagaggaccucaaaguugcuggguagcaaucucaacacccacuucaauggaaguguuguuguaccccugcuggaacauuccucccuugggaguaagaccuguagagcugaaagcuuuaaaaaaaaucugugaaugaguuuauuaaauauaauagugggcaugcccagagaaacuguaucauacauuuuugguugauucaaagcauaugcuucaucuuguaagguagaacuccauaaccuuucagcaugucucuuucgguuagcguugaaaaugagucuuuaguaggccauugagcuuuucugccaggccagcuucaucaggaugauacacaguaagaccaguggaaaaaagauuuuuuuuuuuuuuugcuuugaaauacuuuucuugaucagaagcaaaguuuucuacaauaccaugacauucugucaguccacaggcaauggacuauauaauauuacggcagaaaacuauggacagaacagguaaaugcauaccuagaauauauauuuguuauguugaagacaaauugcugccuaguccaugacuaggaaucccguauaaucaaccuacugucagauagcuggcuguucccccugggaaaugacgugauauuugccacccaacuuugguaacuguuuggcagauuaggcaaucagcaacagcuguagccugguuaguauugguacagggaaguuuacauuuuugggccugugcauagccuccauaucuguugccaugguauuuugcacacaaguccauugagcaagcacuggagugcccguggagagaggcuuacugucauguauauaauguguauaacuucucccauuucuucugaaauggaugccuuuuggucugcauugacauauuucauacguauuuuuacccucugagaguucuauucauagaccuuuguuuuugaccuccuugcugcuagucuucuaguucuguuucuuccaagugccugaccaucuagcuaacaaauuagcaacucuguuaacuagugaggaucuuuacuucuagccaacucuaaauccauacaagaacagucauacauacugacugaaguucuaucuauugagaagauuuaccuucaccacucuccuugugauuggggcuaugauucuguagccauccacuucgggguaguaccagcauaucaugcagaaccaucuguaaaucagggccaagaguauuuuccccucauauuauuucaucauaaggaguuccccaugaagcuauugauguagaacaaggaggagacauuauagugggaguagguauugaauucugagccacuuguuuauucaguuuuugccuuuuggacuuugugaagacagaucuuuuauaaaacacuugaugaaggauacuuguugcuggugcucaauauuaugguuggugugucagauaacauuuggacagcucugaauuuguagacauuaguuucguagauagauauuaaucucuaucugggacuaguaaggaacuaggagcuguuuuucaaaaggagaaugguuauuugcaugagaggguguggcuuugcuccaagacccuagcauucugcugugugauugucccaauuagguugccacaggcuccuuacagcaucauuauuugcuguggacuucuagugucagugucauugaaagugcucuuaagguaaaaguggcagagcaucuugcaguacagucuggucuuguugcagaguuucuuguuuugcaccuuacucaaaauuggcaaccuuauauguuucuugauacuuggauuagagcacacauucaaguaugcuaaauauuggcucccaaauccaaguaggcccacuaaguacuguggcuuuuguuucugugguugguguuacaaguuggagcaacuugucuuucagucuggagggaauauccugacaugaccagaccucuggaccucugaaacuuaaccaugguugcagaaucuugaguuuuucuggggacucuuauucucugguuugcaccuuacucaggcauuuaauuuccuugcuguuuccuuuucaucuggaccaaucagcgugcugucaugauguaguggaccauuauguugaucugcaggauguuaggaugaucaggauuucuagaaugugagauguggucuuagggaaagauugcaaagauuuauuauuguuccugccagguaaaaguggacuuuuuguauaguccuuaaaaguaaagauagaaaaauauuggauagaacuguaacuaccuaccagauaucaggggauuuguugauuugcuuuaauaaagauaccucauuuggaaaagcagcugcaauggaagucgccaccugauaguuuaccauccacagucauucuucaagauucauuuacaacaguccaguaaaggggacgaggucauuugauuaccucuguaucuuuuaagucucucucucuuuuuuuuuuuuuuuccaauacagggucuugcucugucacucaggcuggaguacaguggugugauuuuggcuuacuguagccuugccguccugggcucaagugauuuucccaccucaaggcuucugaguagcugggaugacaagugcaugccaucacgccuggcuguuauuuuuuaguagagaugagaucuugcuauguugaccaggauggucucagacguuuaggcucaaacgaaccuccauccucagucucacaaagugcuaggauuauagguaugaaggcacugugcccaaccucaaaucuuuuacaguggcauuaaucuaaaaaauuucuucaggaauguagcauugcuuuaguuuaauaucuuuguagagaaggaaaguucuaggggcuuauacuucauguuuucuauauuacuggcccacagagaagagcagagagcuaaucuggggauuguuuucaguugccuguuuuauauuaugcauucaggaacuggggaaguaacuauuacacaauaaggauuuacagacccauagaacucucugagacagcuuugggcugaaacuuuauuaaucgcuugaccauccuacgugcccucuuucuuggaccacagugauguuuuaggucaguucagugccauguuuuuguaaugccugaaagaucuuuucccccaugcacagucacuguagugaaugcccauaggucuuucugagggaagguuuggaguaugauuuacaguaccaacuauaguugggguaucauaggauccuuucucaaggggagucauccucccuuucaauaaaaagcucugaucugugaacagauuaauuaggucuagaaguuuucauucucccucuuuuuuuuuuuuuuuuuuuuagcaauucaagucauguuuuugucuacaaguuuuuccaguauuguauagauaaauaauaauuuacuaggcugccuugaguauacuagacaagaguagaaaccauucaugggugaacuggggacaggauauaaagaugcaauuacauuauagacuuauuucucugggagaauaguacuuagcauuuuuguggucuaacuucaguaauuguuguaauauuaaauaaucauggcuaacauuuaucgaauauugcugauggcgaagcugggcccagaauccagaugugugacuauaaggccuguguuuuuaguugcuauugcuggauuauggugacaacagcaacaaaaacaaugcaucugcuaagcugaacuaaauccucauauaccccaguaaugguaauugucuaaauauauucuuauggauggagguauuugagugccuacucugugcuuaacauuguacuggaugaauaggaaaaaugacagaugauuuuaguuguccuuaauuuuuggugauauauauaagaacauguguuacugucugguucugaauugucuuuuccagaauaguuaguugagguuucauuuaaaaaauuaaaaaauuuucauugauaaauaauuguauauauuuaugagguauaaugugauguuguaauauauguauacauuauagaaagauuaaauuaagcuaauuaacauaucuaucaacucaccuacuuaccauuucuuugugaugagaauguuuaaaaucuauucuuuuagcaauuuugaaauauacaauacgugggccaggcgcaguggcucaugccuguaaucccagcacuuugggaggcagaggcggacagaucaucaggucaggagaucagccugaccaaccugaugaaaccccgucuguacuaaaaauacaaaaaaauuagccagggaugguggcgcaugccuguaaucccagcuacucaaggaggcugaggcaggagaaucacuugaacccaggaggcagagguugcagugagccgagauugcaccacugcauuccagccuggcgacagaguaagacuccgucucaaaaaaaaaaaaaaaaagaaauauacaauacaugauuaguaacugcagucaccagaucacuaaaauuaauuccuccuaagcuucccaaaguguugggauuacaggcguaagccacugcaccuggccuuuacugcacauuuucuuuacccagucacccauugauggauacuuagauugguuccauaucuuggcuuuuguaaaauauuuuauuuuuuuuuauaacugcaaguuucuguuuuaaaugauaaacuaaugaagaaaacugacuugaaacugaugaguguucuuuauuugauaaugguuaaguuaugauuuugguuaaaacuguugaguacauuuuccuuugcuuauacucccauuuucuuucagugggccacaguuacauuucaucuuccucaucauguguugaaguccauugccagugccauuguaaaugaacucaagaaaauaaaucaaaauguugcugccuuaccuguggcguccucagugauggacagauugucuuaccucuuaccuagugcacguccagaacucggaguggggccaggccguucuguagacagguaugaaccuugcuaacaaaggugacagugagauagaauugauuaguuuuugcauuaaacaaggaauaacuagaaaaucugguuaugauuuuuaaaaauuucacaauuucuagccuaauuuugaaauuaaaaaaaaaucaauaugaauuagaaucugaaaaccagauuuaaaguaaacugcuacuugaauugcuauuuuuaaacacuauauuuuaguacacuaaagguauuugaagggauuauaaagccacauuuuggaaauuccaguuuaguacuugcuuaguaaauauuuuagucaaauuaaaauuacuauaauuauuuaaugauuaauaacuauuuuuccauugaugacauuuugugaccuuugagauaaauuuugccuaacuuaccaugcccuaaugugaguauaaggaaagugcuaucauuuuauaaugaaaaaaaaaaaaagaccaguuuaaaaaauaauaggaauaauuuugaguuaacaauuuuuuaugcugcucgcccuggauuuaaacaguauuacaaaaaucauaccuaaaccaucauuuucuuugguagagguuuuuuugaaugccuauuuuguuuaauuaauuaaaaaaccagugacacauucauuuaaauacuuaaaugauuugcuauuugaaaugacgauugagguucuuacaaaaaguaccaagguuuagaaaugcuguacugaaauauaauacgcagcaauuuugauuagauuuuuguuugccuuuucauguaguauuuauuuauuuauuuuugagacggaguuucacucuugucgccuaggcuggaguguaguggcacaaucuuggcucacugcaaccucugccucccagauucaagagauucuccugccucagccuccugaguagcuggaauuauaaccguccaccaccaugcauggcugauuuuuuuuuuuuuuugagauagaguuucgcucguugcccaggcuggagugcaauggcacgaucucggcucaccgcaaccucugccucccagauucaagcaauucuccugccucagccuccuugguagcugggauuacagacaugugccaccauaccggggcuaauuuuguauuuuuaguagagacaguguuucucuguguuggucaggcuggugucgaacucccuaccucaggugaucuaccugccuuggccucccaaagugcugggauuacaggcaugagccauggcacccagccaaauuuucuuuuuuuuauauuuuuguuuugagauggagucucgcucuguugcccaggcuggaguucaguggcaugaucuuggcucacugcgagcuccgccucccauguucaugccauucuccugccucagccucccgaguagcugugacuacaggugcccgccaccaugcccagcuaauuuuuuguauuuuuaguacaggugggguuucaccguguuagccaggauggucucgagcuccugaccuuaugauccacccaccuuggccgcccaaagugcugggauuacaggcgugagccacugcacccggcaugccuggcucauuuuuuguauuuuuaguaaagacaggguuucaccauguuggccaggcuggucucgaacuccugaccucaaggugaucuacccgucuuggccuccuagagugcugggauuacaggugugagccacugugcccagcuguaguauuuauauuuuuacauuuucauuggaugugacuuguaauuuccuaagcaucuuucugaaguacauuuauaaauaguaugugcagauguuaucaaaggcacuacugaauaaauucauuuuaaacuucuauuauuuuuaguauggcucuucuaguucaguagcaauauuuauuaauuuaucuuuugguaaacugauuucugcguaaucacuuacccucuuuuuguuaguuaagugauuuuguuguuacauauauaacuuuuauuagucguauuaacaauugggcagaauuuuuauauucuguaguaguaaucucuugggcaacaugcagacuaucauuuuuaaucagauuaucuggugauaugugcuauggcugucauuaaaauauucuuugggauaugccugagaugggaaaaaagaaaaauacguaauuagaacaagugcuucuugucugagaucuaugccuauuuugagauuauaaaagagucagcucugcagagcuauuuucuuugcaaacaguugcaguguuucuaaagaaaucagugcaagcugugguaaauguuauauuuuaggaaaugcagccauuagaugggauauucaguauuuuuagagguguuaaaaauguccuaaaauauuaauuuugauacagacugugguguuuuuuucauuaaaaaucaaucuaggagccucugaaggcuuugaugaacuuaggucuguggaagguuugaguuagggucuauuggaugcuacugcuguuuuauuggguaauauaacgaaaugagauaggucuucuguucuaagacugauccuaaagacacauauaaugugaaacugagaaugcauuucuaaccaaacagcuauuuguuuaaaaaccugaauacaacuacgaguaaaccuaaaguuacuagcaauuuuauagaaaaucaugugcuaauuuaagggaagaauuuagaagaguauuuuccuguuuucuuugucaugaccuuuaccacuuuuucuuucuguuaucaguuguaauuuuauguuaggaugaauaagcuuugcuuaucaauccuuucuuacuaaaaaucuuuuggacuucucaaaaaguuuacuaucguccuuuaaaaaauuacucugguacuuucuguuauaguuugacucuuagugagcugauauauuuuaauaugaaaacauauguaaucuaccccuggaguuguuuaucaacugcagccaccaaucagguuuucuccuucccuuucuguuuaagggaaauucccaaaaauuaccguuuuuaguuuaaaguaaaaaauugaacuuguucaucagaccauuugcaguuuuugcugauaacccaguaaaauuauuuuuugcauuguuaaauagaaguuucacugugauuugaugccuaacuucaauuacauaaaguauguuuacuuuuagaucacugauguauagugaagcuaacagacgggagacauuuaccucauggccucauguaggcuauaggugggcacaaccagaucccauggcucaagcuggauuuuaucaucagguaaaaaaagaauauaaaaaaauacuuuucucaguaggccuuuguagcccucagcaaaauuaucacauuuuuuuaacuuuuucagaaacuuauuuugugcaccuuguaugcuugcuuguaugcauggaugcuuguuuuuuuggcccaggcuggagugcagcgccacaauguuggcucaacugcaaccuccgccucucagguucaagugauuccugugccucagccuccuugaguagcugggaauacaggugugcaccaucacaccuggcuaauuuuuguauuuuuaguagagaugggguuucaccauguugccaaggcuggucucaaacuccugaccucaggugaucugccugccucggccucccaaagugcugggauuacaggcaugccaggccaggaaaaaaauuguuuaagcaauuaacaacugaguauuuucuuuaagauuagauacaacuuuuuuaaaaaacaauuauuuuuauuuuuugucuuugagacagggucucacucuguugcccacgcuggaguacaguggcccuaucaccacucacuucagucucaaccuucccaggcacaggugauccgcccaccucagccucccugaguagcugagacuacaggugugugccacugggccuggcuaacuuuugcaccaaccuaauuuuuuuuuuuuuugguagacacaggguuucugguguugcccagacuggucucgaacuccugcucaagugaucuacgcaccucauccuccccaaaguguugggauuauaagugugagacacugugcuaggccauaauuuuuuuuauaaaaucaacaaauaguauucuucagauuugguuucugacaaguauucucuuuugaugcauguuuauuuccaguguuugacaucugcauucauaacacaguaguagaugcuuaggguaaugcaauaaaagcaguuuuacaguuucgaaauucucauuuuaguugggauacaaauuacccauauacuagauaacuacagaagcagcauuacagguagugcauugcaacuugaauaucugugcauuaaagaacugauuaaguugcauagguagaggaagaauuagucaagaaaaacagucauaguuuuguguaggaaaagaggagaguauaaaguguaaggauuaacacgauacagaggcauaagaaugggacauuauaaaaagcuuugcugaauuagagggaaguuaagaaaaaugauuuuagcuagauguaauauguuauuuaauaggaaacuuaaacugagugguauagaguggcuuaccacuguuaccacugcuaaaagaaucuaagaaaucuaauacuuauaugucaguuuaaauaaagcaugguuauuuaacuuuauuuauuuauuuauuugggacagggucuugcucugucaacccaaguuggagugcaguggcaugaucacagcucacugugccacagcucacugcagccucagcuuccaaacaauucucccaccuuagccccucaaguagcugggauuacaggcaugugccaccauucccagcuaauucuguuuauuuuuuguagagaugagauuucacuguguugcccaggcugguuucaaacuucugggcucaggcaguuugccugccuuaaccuucuaaaguauugugauuacagguguaagccacugcgccuggccuaauuuaagaauucaaguacauuuugaaguacguuaaaguaacugucauuuagaaucugaagauugauuauuccuucguuaucuucaaguauucugaacaucuuuacuaaaauuaaaccagaaaacuauauauauauauauauauauaugaauauuuuauucaaaguuugucagauuuccuguuacagauagguaaguuuggagacuggcuaauauuagaaucagugaaauaauuucucuaaauuaaggauugaacauggaccauuuuucuagcaacuugucuuucuuuuaauuugguguaauuuucuaagagucucuguuaagugaugccuugauuuuuuuuuuuucuuucuguugaguuauuguucauuauauucugucuuugcagagaggucaaauaauagguuuccuagaauacucugauucuaggaaauguuaggggcugauuauuuuaaucuucuaaaauguauaguaaauuugcaucuauaacguaaauguucacaaauauuaauauuaguuuucagguauauuucaguucagguuuugaaaauauauacauauauauauaaauugugccuggcccuugaauugaaauauauauagcauuuuguccuauguuguaugaauuagauuccauauuaugugaauuagauugacuacuuugcuuucccuuuuuacuugcccuucuuguucaguuguaugugauugaguauuuaauaauaaacccauuggcuggugcaguggcucacacuuguaaucccagcacuuagggaggccaaggcaggaggaucgcuuaagcccaggaauuugagaccagccuggaugcuguaaggagaccaugucucuacaaaaaaaauaacagaauuagcugggugucaugaaacacuucuguaguuccagcuggggggcugagguuggaggaucacuugugcccacgaguucagggcuauagucagcuaugauugugccauugcacuccagucugagacucugucucuuuaaaagagaaaguuuuaaagagacucugucucuuuaaaaaaacaacaagaggcugggugcagggcucacgccuguaauuccagcacucugggaggcugagagggguggaucacaggaucaggagauugagaccauccuggcuaacacggugaaaccccaucucuacuaaaaauacaaaaaaaauuagcugggcgugguggcaggcgccuguagucccagccacucgggaggcugaggcaggauaaucgcuugaacccggggagguggagcuugcagugagccgagauugcgccacugcacuccagccugggugacagagcgagacucagucucaaaaacagcaacaacgacaacaacagaaacaaauaguguaaaccagccagacucuuucucuuauacuuaauauuucagaugcuuuaguauagcaaugagaaaaguacuagaucagggauugcauauauguguaccucucuuugauuuaguggucauuuucugaauuuucaaauaaugcaggcaauuaauaaauauuuggagguuucaguguauuguuggaccuaauauuauaggcuaauuuucuuauuuucaguauagaauuuuacuuaaaauuaugaacuuuuaaaaauaacuuuuauuauaaagcuauuuuaauaaugauuuaccuuuucugucucuuuucuuuauaauuuugcagccugccucaucuggagaugauagagccauguguuuuacuuguaguguaugccucguuuguugggaaccuacugaugaaccuuggugagucuugauguuucugggcauaauaggcuaagucagucguguaaauaaugcuucuaaauuuuacuuuucugcuuaugauauaauuuuuugccuuuuugccaccuauauuuuugucauuguccugagaaugagcuagcccugucuauacucuggcacaccacuuggcauacagugucuguaaguuugacuuucuaaaaauuguacacaagggaaguaccaaacaguagaaccacgcucuaacgaaaaccggaaagcuaugguaaagugaacuccagcgugagcuucagcaguugaaucuuggucuguugagagcauguugucaguagggaauccauggagagagccuuauaguauacauuucuaauuuugaaguaauuuuagggagucuuugaugucucugaauuuuagugcaugaaauuuuagaaccugguuaaacauuagagaucauguauugaaacuucauuuuuacaaauaacuauucugaggucuuauuaauagaaauaauaguauauuauuauagcaaauauuuauauaagaugguauacuagguaccauucugaauacuuuauguauuuuuaaaucauuuaauucucauguuucccugugaaguagguacuauuguaaucuccauuuuauaggagggaacuaugaauauuuuccaguuuaaccuuuacagucacucuaugagauaggaguuacuaucccauuuuaaaaugaagagaauaaaauuugcugaagggcauauggcuagugauagagccaggguuugguuuuaggauauguugcuuauuuuguaugaaaauuaguuugaagucucugaauguuaaaucagcugaugugcauggggcaaacuugcuaaaacguauugcaguguaccuauggaguucagauuggaaaauacuguaugaaaaauucaaguuguaucuaucugcaggcagagaguugaauacaguagucccccuuauuugcagggcaugcauuccaggacccauuggauaccugaaacagcagauaguacugaaccauauacauacuauauuuuuuucccuauacauccauaaccuaugauaaaguauaauucauaaauuaagcacagaaagagauuaauaacaauaacuaauaaaauugaacauuuuuuuucccuucagauggagucuugcucuguugcccagacuggagugcaguggcgcgaucucggcucacugcaaccucuaccucccggguucaggcgauucuccugccucagccucccgaguagcugggaguacaggugugcgugggccaccacacccggcugauuuuuguguuuuuaguagagacgggguuucgccauguuugccagguuggucucgaacuccugagcucaggugauccacccaccucagccuuccgaaguguugggauuacaggcgugagccacugcgcccggccuaaaauugaacaauuuuaacaauauacuguaauaaaaguucugugacuguggucagucugucuguguuucucucucuccaaauaucuuacuguacuguacucaucuauuuugggaccaugguugaccauggguaacugaaaccauagagagugaagcugugggccaggcaugguggcucacgccuauaaucccagcacuuugggaggccgaggcggguggaucaccugaggucaagaguucaagacuagccuggcuaacauggugaaaccccgucucugcuaaagauacaauaaauuaucugggcgugguggugugcaccuguaauuccagcuacucgggagggugaggcaggagaaucacuugaacuggggaggcggagguugcagugagccgagauuguaccauugcacucaagcuugggcaacaagagugaaacuccaucucaaaaaaaaagagugaagcuguggauaagagggggaccuguugcaugagcaauuuucaguuuaaguugaguuucuguuuggaauugucuuuccccguaaaggcuguguguguguguguguguguguguguguguauauauguguguauauauauauauguauauauauacacacacacacacauauauguguauauauauauacacacacacauauauauguacacacacacacacacacacauauauacaccauuuuaguauauauuuuuuaggucccuaugccaauccucaaaaaguuauuuaaccuauaccugaaaaguuauacaguauuaucaaauauuauuuucuuuguaaauauuuucuauggaaaguugauuaaaauuucuaacuugggauacugaaaacccauguuuucuugacauggccagggauucagggagucuaccucuucuuugcaccagcauuugggauuccucaaacacucaagaaguugauuuggucucuuaagaccuggggcaagucuuccaaauggguaggagggaagaggauugauggaggcuggggaaccuaggcaccuucugaauuguaaaggggaaaggaaaaauuugaaagggcgaaugggacucauauuuugacugugcgaguugauagagaguuacuuuggagggagguugaaguuaaaaacauaaaaaauggaccauacccuaguaacuagcaauuccacuucuauuuacguacccuagggaguuaauugcucuuguaggcacagaggcauaaaguggauggucacugcaguuaaaaaucggaauccuuuuaaaugccaaucaggaggggaauagccaaauagaaugugcuauguucauauaauagacugugguccaacaguuaaggggaaugaacaguaagaucucuguuaaucacccucaguaacuuucagauauguuacuguaucaagaaaucuuucguguuaauagaaugguagaugauuggauacaugauaaaauguauaugugucauguacagugacaccaauuguuuaacaauuuaagacccuguauuuuauuuuuaaaauuuuuuuucauacauacuuccacaucauguauuuucuauauguacauuuauguauguaaacuuaaaaaauauuuuagaaauguaucacuuaaauuuauaauggugguuuccuggaggugggauuggaaauuauugggauuagauuuuaaaauugaugugggucuuuagcuuuauuuuauauagccgcguguaacuuauauaaauaaaauuuuauugaaaaaguuaaaacucaggaaagagagagagacggaaagggguaagguacgcuagauuuagcugggagggaaccuggcccaaaugucauuugcuuggaagugcacuguaaaaggauuuaggaaagacaucuacauauuaaaaauugcccaggauuuauagauggauuuauauauguaaguuguaggugcauuguaaaaagaaauacauacauuuuaaggaguagcauguuuuauguguaaaguucuuucuuugccauggaaauaaaacaaugaguuuaaaaacaaugguucuuuaagaaacauuuauuuuuaaaauuuuauuuauuuauuuauuuauuuuuuuggagacacagucuuacuuuguugcccaggcuggagugcaguggcgcgaucuugguucacugcaacccuugccucccagguucaagagagucucgugccucaguuucccaaguagcugggacuacaggugugcgccacaaugccuagcuaauauauguauuuuuaguagagaugggguuuccccauguuggccaggcuggucuggaacuccugaccucaagugaugcacccaucucagccucccaaaguggugggauuacaggcgugagccaccacgcccagccuauuuuauuuuuuagauacggggucuugcuauauuguccaggcugaagugcaauggcuauacacaggugugaucauagcuuacugcagccucauauucuugggcuuaagcaguccuccugccucagccuccugacuaacugggacuauaugcuuuaccaucacgccuggcucauggguucuuguuuugguagcaggauccugacauuucuaaugccuuauaauuauagcuaauagaaauaaaaauaaggaauaaccagaaagaaauauaaaggaaucauaaaguugagcagauaggugcuaaguugauccugcuuacaauauuugagauaauucuuaaagucauuauaccagucuugauaugagguccuaguauuuuauuuuuauauuuuaauuuaaauuuuuaaauuuuuuauuuuuuagagacagggucuugcucuguugcucaggcuggagugcaguggcacgaucguagcucacugcagccuugaacacccaggcucgagggaucuuccuaccugagucucccgaguagcugggaauacaggcacaugcuaccacacccagcuaauuauuuuuauuuuuauuuuuuguagcaaugaggucucacuauguugccuaggcuggucucaaucuucuggccucaaggauccaaccaccuuggccccccgaagugcugggauuacaggugugagccacggugcccagccuguauuuuauauuucuuaaacuuguuauguuuuuaauuuaacauuucuucucgcucaguaagcauuuauuugaaagaaguaguguauaauuuaugaacuuuacauuccuaaggcucuuaggaaauaaauuuuauuuaaaaguuauuugucugauuugauccuauagugaauacauaagguauauuucuguguucuuaauauauauuauuuuauucauacuagagaucuuucugcuuucagaucuuuuuuuuuuuuuuuuuuuugagguggagucucacuccguugcccaggcuggagugcaguggcgcgaucucggcucacugcagccuccgccuccuggguucaagcaauucuucugccucagccuccugaguagcugggauuacgggcgcccaccaccaugcccagcuaauuuucguauuuuuaguagagacgggguuucaccguguuggucaggcuggcgucgaacuccugaccucaugauccacccgccucagccucccaaaguguugggauuacaggcaugagccaccgcacccggcugccuucagaucuuuacuaaaaaacuuuuuaguaaaauaauuuaguaaaauauuuaguaaaauaacuuuuuguguuaugaguggcauuuaucgaguuucagcuguauaucauuuauaguuguggccccugauagauauggagaauuuuaaauugaaacauaguaguuaaucauucaaagcuguaggaaaccagugugaggaaauaacaggaguuuaaacaauuuuguaguauguaauauagcauuguauugguuuuucaguuuuuucugagauugacuuuauaaucaguuaaagugaguaacaacugcuauuguugaauguuuggaauauugaaugugugaauuuguaaacgguugaacauguuagagugaucuucauaaaacugaaugauuugguuauauuaagucuuuaaugaugaauacuuuaaguucaguuaaaaaaagaugaugauccuggaguucuguuuuaauguacaaacugaauugcuuuauuuuuaguaaacuuuuccuuucuaaaucuaugcaaaggucugaacacgaaagacauuccccaaacugcccauuugugaaaggugagcacacacagaaugugccauugucagucacucuugcaacaaguccugcacaguuuccuuguacggauggaacugacagaauaucuugcuuugggucggggagcugcccucauuuucuagcugcugcaacuaaacgaggaaagaucugcauaugggauguuuccaaacuuaugaagguauguuugaauuuugaaguaacaaauuaguaauugaaaaaagaucaguuguaaacuuaggcuuuucauuuguuuaggugcacuuaaaguuugaaauuaaugccuaugauccagcaauuguacaacagcuuauucuaucaggagacccaagcucaggaguugauucaaggagaccaacuuuggcguggcuggaggacuccucuaguugcucagauauaccaaaauuggaaggagauagguaugugaguuuguuuuaguaguauuuaauagauguuacauguuuuccuaaauuuuauauucucauaguucuaauaauuaaagaggaggaaaaaaaaguuacgcaguuaagagaucagagaguaaauguuugguuagaaaucugaaaucugugauucuugaagaaaaaucuucauucagaaacaccguaguuuauaaaauaugcuuaacuuucuaucacaaucuaugucaauuggaaauaauugccacauugaacaauagaugaugaaaagucaacauuggaaagucuaaauaaugaaaugaaauucuauuguaguuucaccuucugcuaaaucuuuucauagagcauucgaacuagaugauuucaguuuccguuuuuucauuagcaccucaaauuauggcagugcuaaugaauaauaauaaugggaugaccugaggugaggcaagaggaucuaauuguuuaaaacaguguaccaguagucagcagugaguugagauaccauaauuauugcuauagaaauauuuugguaaaauugcuguucuggauucuccuucacucaacuucucugagagauuccugauuuuugugguggggugggagagucaaaguaucacccucuuucacccacuuguuuccuaagaaccacugugguuuugacugaacugggcuaguaagauucuguagguggaggggaagaagauuguguaggcagccaugugaaauggagcuauuuaacugugaucagaugucuugauagacugagaauaucugccauuucacuuccaggggcuccuuauguuacugacaugugauggguguuacucuguagucagugauuuaucauuuuacuucacaaccccuuuggugggauguccuuucauuaaggaauaauguaaaguuuuauuaauggaaauuauuucauuaauggaauuaguggaaaauuuacaauauauguguuacuucugucuaguuccucuugguaauaacauguugauuaaagccuugugguuguucuauuaauauaaaucucugugaaagcuuaaugggaaagcagcuuaacuguugucugaguuucugaccauauuuugccaauaggacuagauauuaagcaugcuuaauuucugugauuucuuagaaguuaguggaaaaguaauagaagauaaugaaauuuauauguccuucuaggcacuuacuuuaauuugaacuuugucuugaaguuuuguaauuuggggauuaaaaauggaaucaaaauauacuucuaggauuacauacacccauacacauauagucacacccuccuagguaaaaucugcauuuuagauaaacauguauucuguauuauuaguggaaauacuucucaacauuauaugggguaaugugcuugaguugagguaaucucuacuugcuuuuaagaaauucacaaucuagggucgaaggucaauuuucucugaagaaagucucaaacaaaucauacaaaaacauuaaguugaugugguaggaggaagcugaagaggugaaacuucaucccuaaccuuaagcccccucucuucacuuccccuccccaagaaguaggagcaguccuguuggaauugauagugaauauaaugagccacacuaccucucacuuuaugugacacaagauccaauauguuugguuauaaaauauacuauguggguuucauuagcuugaagaauaauacauuaauuggaaaaaucuaagcuuauccaagaaguuuaaaguaauuagcaauauaguuugcuuagaauaguuuuuguaaaauuuguuuuuauuucuuauuuacauugaaggacuaaggaauuguuuuugacaauuuuuucuuagaagacuauauuugucuucugaauuaaggaagaagauaugcuaauacauuuaauuuuaaugaauuaagauuucuucuagaugauucacuugucauuuguauaucaggucaaguugguaaaaauuccuugaauguaaaugaaauuguuuaugggauugcuguaaaccaagguacuguuacaauauuaguaugucuguuuuucagaaacacauauaaucuuaacuaaacauuuuuacuuuaaccauaauauuuauuuugcauguuuauugcuuuguaaaagguuuugcaaaauguagaaggcuuuaguaaauacagugccuauuauauaaauagugcaugcuuauugcaggaaaaugggaaaaugcaggaguggaaauugaugaaauauagaguagucauaaucacacuaugggauuaugguaacauuuauauguauucuaguuucuuuuuaaaauguguguguguuuuuuuuuuuuuuuuggagacagagucucacccugucgcccagguuagagugcaguggcgcaaucuuggcucacagcaaccucugccucccagguucaaaugauuuuucugccuuagccuccuugaguagcugggacuacaggugcccacgaccccuccuggcuaauuuuuuguauuuuuaguagagaaaggguuucuccauguuggccaggcuguucucgaacuccggaccucagaugauccaccugccuuggccucccagagugcugggauuacaggcgugagcaccacgcccagccgcaugugauuuuuuaaaaaguuuuauugaaguguaauuuucaaaccauacaauucauguaaguguacaauuuaguuauuuuauucauauaauuuuuuuucuuuuuuuuugagagagucuugcucugucgcccaugcuggagugcaguggugcgauccugguucacugcaaucucugccucccagguucaagugauucuugugccucagucuccugaguagcugggacugacccgugccaccaugccuggguaaauuuuguauuuuuaguagagacggguuucaccauguuggccaggcuggucucaaacuccgggccucacgugaugugccugcuucagccuccaaaagugcugggauuauaggugugagccacugcaucuggccuuagccauaaaauguuuuugucacaaaauauuuuaaaagaaugugauuuuacaaauauauauauauaauuuuuuuuuuucucuugaaacaaggucuugcucugucacccgggcucacggcucacugcacccuuuaccuccugggcucaagucauccuucuaccucagccuucuaaguagcugggacuaaaggcauguaccaccaugcccagcuaauuuuuuauuuuuuuguggagauggggucucacuguguugcccaggcuggucucgaauuccugggcucaagcaguccucccuccuuguccucccaaagugcugggauuacaggugugagucacugugccuguugccugauuauauuuuugagaacuuucagaauaaaacauucuuugcuaauuuaaggcuuuuaucuggcaacugucuuugaaauaucaagacaccugaauuccuuuaaaacauacuacuacuuaauuuuauuguucaucuuaguacagcagguuaauacuugguuauuuauuuuucuuuaaugggcagccauucuauacuuaaaaccuguuuucuugguuuggacuucuucauucuugauaauucccaauuauuaauauuucuucuugggauucauuuuuacacuuacucuguuucucugaaaccagccaauuaggcuaaugaauuagcagcugauuuuaaacuuuuuuugcauuuuuugcuuuuguaaauuacagcauuaaauugguuuaugggcaacuguuaucaccugaaaaaacuaaaacagagaaacuuuuucaaaaauauauaagugaauuucccccagccgccgcaaaauauuucaaacauugccuuggagugcaguaauauccuuaagcauuuucagugcggaauaccacuucauauucuguauaaaauaacaucguaggccaggugcgguggcuuauguuuguaaucccagcacuuugggagaccgaggcgggaggaucacaaggucaggagauagagacaagacuuugucuugucuugaugacccccaucuucugaguugucauaguuuuccuauauguaaaggaguucuuagccucuccaaaacaaaauacagaacaaaaauaaaauugcauguacaugugaguacacaaacauacacacuugcuuauacaacuauuauguuugguuuuaggcuguccugaauucaguaauagaauaguucuuaaugcuuuacuacugcaagcuggugcuugauuuuauuaguugcugcugucuuuuauauuuuuguuugcccaaacuguccuuagucacacaguagucuucaaauuccuacaaauguuauuauggauucuuggagguuuccauacccuauuucaguuaggcauuuauuuaaugauuuaagaagauuuuugucaguguuguuaaucaguuaugauaucaaacuacucuuuauauaucauuuaagccuauuuuaauuauaugguugagauguguaguagugauuuuaacacuguacuuucaggccaggcauaguggcucaugcguauaaucccaggacuuugagagguagaggugggaagauugcuuaagcccaaggguucaagaccagccugggcaacauggugagaccccgucucugcaaaaauuaaaagaaaaaaguagcugggcaugguggcgugugccuguggucccaccuacacgggaggcugaggcaggaggauugguugaggccaggaggaggucagggcugcagugagcuguguuccugccacuguacuccagccuggaugacagacugagacccugucucaaaaaaacccacaaaaccaacuguucuuuuuucuuugcuuucucauaugauguauacuuuuuuugaaauucaaauuguuuacuuuguuuuuugauuuaagugaugauuuacuggaggauucagacagugaagagcauuccagaucagauucugugacagguauguaaaaaguauuagauaauguauuuaaaaaauucuuuacacaguugugcauacagcuaacuaccacuuaauucugaauuucuuaguuaaugcuaacucuaaauuuuugcuaguauacacagaagacugaaauauugugugucagagaucucaaauuaguaguauguacauaguguuccauauuuaaaauuuaaaugguaccuauuugagccaaaggaauuacaguggauaguuacguuaaaguuuugucacauaugucagguaauuaaauguuuuuauuuguauaauguauucuguuaacuaaaaguaguguuuaaagcucuuuauucauguaggugaauaaagaacuacauuuuaaugugugaaauuauagacauuaaaacaucaaguaaaugcugccuuacuagcuuuuaagauacuagggcaaaauaauauacuucguauuuuaauguuauuuuguaggaaaagcuaauaguauguuucaaaauaguuuuacuaugucagaauuuaaauccuaacucuucuacuuaauauagucugauugcauuuccugauauauagcauggugguauuaaagucuguuauuuagaguuuuaagaauuaggccaggcuugguggcuuacgucgguaauccuagcacuuugggaggccacagcggguggaucaccugagaucaggaguucgagaccagccuggccaacauggugaaaccccguuucuacuaaaaauaaaaaacaauuagccaggcgugguggcgcaugccuaucccaguuacucaggaggcugaggcaggagaaucguuugaacccgggaggcggagauugcagcgagcugagauugcgccauugcacuccagccugggcaacaagagagaaacucugucucaaaaaaaaaaaaaaaaaaaaaagauuuagauaagauaaguucauauaaaguguagugccugggaaguacccaguauuuuuaaaaagugaccauuauuaaauuguggcuauuguuuaauguuagaugcuguguacuauggacauauauaacuuaaaucuuuuuagaagaggaaugguuuuguauaguacaguucaaaaaaauuauaguuaacauuugguaguaaauauucuuuaaauuuuaucaucagauuuuuuugaaaggcacuaaauggaacacuggacaauuuuggguuaaucuuuagcagucuuuugaagcaguucuuagcaaugaacaaaaaaaaucaccaaauaaggcaggaaaaugcccuuaaaaaugugcaaauguguaauucguucuagagaaguuaaaaauuguuuuuuuuucuuuuaaaaaaacauagacugaggaagcuaaugcucuuuuccuauuuuguucuuuugcaaaaacauaagagguuacuacuacauuuucuuucuuuguuucuuucuuucuuuuuuuuuugagacagagucuugcucuguugcccaggcuggagugcaguggugugaucucagcucacugcaacauccgccucccgaguucaagggauucucuugccucagccucgugaguagcugggauuauaggugccugccaccacaccugacuaauuuuuguaucuuuaguagagaugggguuucaccauguuggccaggcucaucuugaacuccugaccucaggugaucugcccaccuuggccuccuaaagugcuaggauuacaggcgugagccaccgugcccggccagaccuggcucuuucuuuuguuuuuuugagacggagugucccucuguggccaggcuggucucgagcugcugaccucaggugauccacuugccucagccucccaaagugcugggauuacagaggugagccacugcgcccggccaaguuuuugaacucuuucaaaaaauaacuccuuggucuuguuaaauuacuuaaacugugggcuucaguuuuuccuuuguaaaguguuugcuauguuaaguuuuuuuugauugucacuggaaccuuuccuuugugugcuauaguuuuguuauuuucccugggucuaaggaucucaguacauguuuuuacaguuacaauacucguauuuggccaauuuucuuacccuuuuucuaccuuuauucuuuucaucuaugccuguuugauuuuucacacauuuuaaagauacuguaaucauguuuacuuuagcuaauagugucuugaaaauuaucauguauuuuugucgacuacauauagcacuucauuuagggguguaaaaauugucuuuauguauuaaacaguagcugugguaagagaaaauaucuuuccaguucaaaauuuuuaauugccucauuugaggauuuguaaguagcuuauucauucacaguaaaaguauguaucuucuaaacuaauuuuguuauauuggaagaccauuggugacuuuauggaggcuuauagaguagucauguauauauauuugauauuaaugauuggugucuucucuuccugaaguaucuaaaaagugauaagguaccauuucagacuuaucagagcauauccaauuugguggaaaucacaguucuaagugauuuucaucaaauuggaugauacaaucugaagaauuaugaaauauauuuauuuucuguuuuuuuuuguuuuuguuuuuguuuugagauggagucucauucuguugcccaggcuggagugcaguggcacggaucuuggcucacugcaaccucugccuccuggguucaagcaauucuacugccucagccucccgaguagcugggauuacaggcgcccaccaccacaccuaauuuuuguauuuuuuguagagauagggcuucaccauguuggccaggcuggucuugaacuccugaccucaagugauccaccuccgucagccucccaaaguguugggauuacaggugugagccacugugcccggccuauugaaauauauuucuuaauuucaaaaaugugagugcagauaaagagacauuuguuuuuuaguuggagguuaugagguuugaagauaucuaagaggacugcauagggaaaaguuugguauuugaaccacagaucagaauuaaguauacauggcuucuugugaagauugagaagaauguuugguaggaaguuaaagaagggcucaaauugaaauuugaguuuuaaaagagugccuagauaaaaccuaauugcuuaccugaggaaguuugguuaacacuacccaaauaagcagaauagagaaggguuuuuaaaaugauugucugaagaauauuaugcuggugcuuguuuguagguauuuguguaaaaauuuauuuuuuggccuaguagguuuuagaaauucugaaauagguagaguugacaaguucugcagggcguuugucagucaucagugugcuuugucacccuucugaguagaauguauaguuuaugcugcuucccacauguugaauaaauauuugagaagcagcaaaguaauaaugccacuuguaauauuuuccuuuuuaauaaagucucaccucacauaccauuuacuuugaauauugacugaaauuuguguuaauauauguaauuuaugguuuauuuugucauaguauauacauagaccaaaauuguuuuuucuuggcaguuuccuacauagauuagaaagaaaacauuuaaguaaauuugucaguuuaguccaguugggcauccucaggauuuauugugguauaguacauguuauaaaaauaucucaguugaucgcgccacugcacuccagccugggcaacagagugagacuccgucuaaaacaaaacaaaacaaaaaacaaaaccaccucagucagccuucaauuuccaaucugaauuguagagaaaauauacaugaauauugaaugacagaaaaaaggcugcaugugacuauagccaaaugaguauuuaaauaagugaacagcuucauuaauacaauuaaaucauguuuauacugaaaauuuuuuucugcuguagcuagaaaauauuuccguuuuaggggguaguagucauguuaugugaaaugacaucauccccagauuaugggaaauucuagauaugccagugagcauguagaagagaucaugaauaaaauaguguaaaaugguguaaacagagcuuugaguuacccuaagugguucuucaugaaucucaguugcuuauugcucuacuugggcaacuucuuuuuuuuuuuuuugaaauggagucucgcucugucgcccaggcuggagugcaguggcgcgaucucggcucacugcaagcuccgccucccggguucacgccauucugcugccucagccuccugaguagcugggacugccggugcccgccagcacgcccggcuaaauuuuuguauuuuuaguagagacgggguuucgcuguguuagccaggauggucuugaucuccugaccuugugauccacccuccucggccucccaaagugcugggauuacaggcgugagccaccgcgcccagccuauuugggcaacuuucaaaccuucauggagucaccuugaguucauuuuuuuucuuuuaagacggaguuuugcuuuuuugcacaggcuggagugcaauggcgugaucuuggcucacugcaaccucugccucccggguucaaacgauucuccugcuucacccuccccaguagcugguauuacaggcacaugccaccacgcuuggcuaauuuuguauuuuuaguagagacgggaguuucaccauguugaccagucuggucucgaacuccugaccucaggugauccacccgccucacccugccaaagugcugggauuacaggugugagccuccacgcccagccuugagcacuuuuauauuuauuuccuuuucucuguuuuuccaaucuaaaucauuaaggcaauuauauauauauauauauauuuuauuuuuuuauuuuuuuuuuuuaaauuuucuauuuuuuguauuuucgaaaaucgccuagagugguuuuuucuuuugagacgggaucucacucuguuguccaggcuggagugcaguggcgugaucucagcucagugcaaccucugccuccuggguucaagcaguuucucuugccacagccuccugagcagugggacuacaggcauguaccaccaugccuggcuacuuuuuguguuuuugguagagacgggguuucaccauguuggagaggcuguucucaaacuccagggcucaagugaucuggccugccuuggccucccaaaguacugggauuacaggugugggccaccgcgucuggccuaaccuguaguggucuuuaugguauuauugcuaaugauguugcugccugacugaaagaaguuucugccauugagauagagacagaucaguggaaagaauuuucaguuuagcgucaagagauuauacuugauuugggaguugacugacaucuauuguaagacuuucuuuccuuuuuuuguuuucuggaaacgggguuuuacuguguugcugaggcuggucuugaacggaacuccuaaucuaaaaggauccuuccaccucagccucccaaauagcugggauuacaggcaugcaccacaacgccuggcuuugugauuaauaucacagguuuaaagguugagacugagaaacucaguccuguguuucaguauagaaacugaguucugagacuguacuacuuuuaagggaauaguuuaaagaaggcacaauagaaaaaaggucagcagggcaugguggcucaugucuauaauccgagcacuuugggaggccgaggugggcagaucacgaggucaggaguucgacacuagccggaccaacauggugaaaacccaucucuacuaaaaauacaaaaauuagccaggcgugguggcaggugccuguaaucccagcuacucaggaggcugaggcaggagaaucccuugaaccuggguggcagagguugcaaugagcugagauuaugccauugcacucccgccuggguggcaauagugagacuuugucucaaaaaaaacaaaaaaaaagaaaagaauaaaggugaauaagaugauauaauguaauguaguuguguggcuuuaaaugaaauaaagauuagcagauaauacagaagacacugaauguuucacauaaagaugauacaguuuuggaacuuuuucuuccuaguuauuuuuuuuuuucuaaacugagguuagaauuguauuuucugacauuccacugauaaucagcagaggauggggugagagagaagaaauggugcuuauaacuccuucagaguggcgaaagaaaggaaacugagauuacaaucuuuuuuaauggauauuuugcauagcgcauaaaugacagaugcauaaguaguauucucucuuugguuuagaauugaagugcagaaauucuguuacuuugauauuaauuuaaaguuauguauaaauaauauuuuuuaacucuuuaaucacauuacuuuuuugaaaaaagguuuugcucacaaauugccaagagaauauauuuugaauugaaaagacuuuuuuuuuuuuuuggagacagucucacucuuguugcccagacuagagaguacaguugcgugaucucagcucacugcaacuucugucucccagguucagguuauucuagugccucagccucccugaguagcugggacuacaggcaugugccaccaugcccggcuaauuuuuuuuuuuuuuuuuuuuugagacauagucucacucuuguugcccaggcuguggugcaauggugcggucuuggcucaccacaaccuccgccuucuggcuucaagcgauuuuccagccccagccuccugaguagcugggauuacaggcaugcaccaccacacccagcuaauuuugcauuuuuaguagaaaugggguuucuccauguuggucaggcuggucucaaacucccggccucaggugaucugcccgccucagccucccaaagugcugggauuacaggcaugagccaucgcgcccagccucuaauuuuuuguauuuuuaguagaggcgggguuuugccauguuacucaggcuggucucgaacuccugagcucagguaaucugccuaccucaaccucccaaagugcuaggaugacagaugugagccaccugccuggccuaaguugaaaauaauuuugagucccuugaauaccuuuacgguuuuucugaguaagcucaucuuagauuugauuaugucuuaagaaaaaaaaaaaaaagaaaaaaaacagccugguauuuaugggggauugguuccaggacccucucuagauaccaaaaccuggaugugcucaagucccuuguauaaaaugguauaguuuugcuuauaaccuaugcacaucuacauuuuccuguuacuuuaaaugaacucuagauuacuuauaauaucuacuacaauguaaauacugaguaaaaaguuguuaugcucuauuguuaauuggcaaaaaaguuuguacauguuguacauguuuaguagagaugcagccauccauuuuuaaaaaaagaaaguuuuccggcugggcacgguggcucaugccuguaaucccagcacuuugagaggccgaggcggguggauuaccugaggucgggaguuugagaccagccugaccaacauggagaaaccaugucucuacugaaaauacaaaauuagcuggguaugguggcacagcuauucuugcggcugaggcaggagaauugcuugaaccugggaggcggagguuuuggugagcugagaucacaccauugcacuccagccuaggcaacaagagcaaaacuccaucuccagaaaauaaauaaguaaauaaaaaauguuuuccaucugcaguuaguugaauccguggauguagaaccugugaauauggagggcugacugcacuuuaaauuuuuuuaggccaggcgugguggcucacgccuguaaucccagcacuuugggaggcugagguggguggaucaccugaggucaggaguuugagaccauccuggacaacauggugaaacccaggcucuacuaaaaauagaaaaauuagcugggugugguggcgugagcuuguaaucccagcuacuugggaggcugaggcacuagaaucacuugaaccugggauucagagguuguggugagccgaaauugcaccacugcacucuagccugugugacagagcaagaauuugucucaaaaauaaauaaauaaauaaauaaauaauuuuacuuguguauucauaaugugcugacuggaugaguagaaacauaucuaaugaauauuguuccuuuuuaaagggcauacaucacagaaggaagccauggaaguaagccuugauauaacagcacucagcauucuccaacagccagaaaaacuucagugggagauuguugcaaaugugcuugaagauacuguuaaggaucuugaagaacuuggggcaaauccuuguuuaacaaacucuaagagugaaaagacaaaggaaaagcaccaggagcaacacaacauuccuuuuccauguuuauuagcuggagguuuauuaacauauaaaucuccugcuaccucacccauuaguaguaauucucacaggucacuggaugguuuaagcagaacucagggugaaaguauaucagaacaagggucaacugacaaugaauccugcacuaauucagaacuaaauucuccucugguaaggaggacuuuaccgguuuugcuucuuuauagcaucaaggaaucugaugagaaagcaggaaagaucuuuucacagaugaacaauauuaugaguaaaaguuugcaugaugaugguuuuacuguuccacagauuauugaaauggagcuggauagucaggagcaguuguuauugcaggauccuccugugacuuacauucagcaauuugcagaugcagcagccaaccuuaccucuccggauucugagaaguggaacucuguguuucccaagccugggacuuugguucagugcuugaggcugccaaaguuugcagaggaggagaaucuuuguauagacucaauaacuccuugugcugacggaauucauuuguugguaggacugcggacaugcccuguugaauccuugagugcaauaaaucaaguagaggccuugaauaauuuaaauaaauuaaacucugcacuauguaauagacggaaaggugagcuggaaucaaaucuugcuguagugaauggugcaaauauuaguguaauccaacaugaaucaccagcagauguacagacuccuuuaauaauucagccugagcagaggaauguuagugguggauauuuagugcuuuauaaaaugaauuaugccacucggauagugacuuuagaagaggagccaauaaaaauacaacauaucaaagauccccaggacacaauuaccucgcucauuuugcuuccacccgauauauuggauaaucgagaggaugacugugaggaaccuauugaggacaugcaguuaaccucaaagaaugguuuugagagagaaaaaacgucugacauuucuacucuuggacaccugguaauaaccacucagggaggauauguaaaaauacuagaucuuucaaacuuugaaauuuuggccaaaguggagccucccaaaaaggagggcacugaggaacaggacacauuuguuucugugauuuacuguucuggcacagacaggcugugugcaugcaccaaagguaaguugucugauuaugcuauaaaucuuauaaaauccauguauauauggcauuuguuuaugugcaaaccuaguaugaauuuuagguucaaauagauggggaggaauuaauuuuuuuguaaugaagugguaaauccuucuuuuuaaacuguucuuaaaacuuuuuucuacugcccuagguaaggauucuaacuguaaauaaguuaguaagucacuuagcaaguaucuucugcuuuaaccucaagaaaaucacgugcuuuuauuucagugagucccugacucugcaucugcucaaauuuaugaccuugggcaaguuauguuaaauucauuaaaccuguuuuuauuuauuuauaaacuaggauaagaaaguccauuuccuaggcuuauuagaaugaaauuauguaaaguuucuggcacaguuauugguccuuauuuccuucugaaauaaaaauacuuagcaaacaauuuuuaguuuugcuaaauacauuuuuuugucugauuuauuccugaucuuuggcuaguagugaauuaguuuugcaaauuuugaagcacuauauagauuaagauagugugcaguuauuuuuucuuuuuuucuccuuucuuuuccuuuuccuuuccccuuucccccuuucuuuccccccuccccuuucuuuccccguccucuccccuccuuucuuuuccuuuuauuuuugagaggaaguuucauucuuguugcccaagcugaagugcaguggcccaaucucagcucacugcaacauccgcucccagguucaagcaauucuccugccucagccucccaaguagcugggauuacaggcacguggcaccaugcccggcuaauuuuuuguauguuuaguagagacaggguuucaccauguuacccaggcuggucuugaacuccugaccucaggugauccacccaccucagccucccaaaguucugggauuacaggcaugagccaccaugccaggccuuuucuuuucuuucucagggucucacuguguugcccaggcuggagugcaguggcaugaucucagcucacugcagccucaaccuccugggugcaaguaguccucucgccuuggucuccugaauagcugggacuacagugcauagcugggacuacgcacuaccauguucagcuaauuguuguauuuuuuuguagaaaugggauuucgccauguugcucaggcuggucucaaacuccugaguucaagugaucugccugccccggccucccaaagugcugggauuacaggcguguggcauugugccuggccuauuuuuuuuacuuauauacauuuuaaguuagggagauaaagcaguuuuugaaaaggauuacugacaauaucaggcaaaaugaauaguucuauugauugucuagcaggaauuuaggacuaggagauaguugaagccuaagugacuguaacuaaggcauggcagaggaauuaggaucugagcagaguuacgcaugcaucucaucugugguucugauaguaauuagacuguuuuuccucucuuuaaauagauuucaagaguuuagccaaggaacguaauggugaaauguagugguuagauugccuuuuuugaacuauauguagugaaauuauuuuuuuauuuuuauuuuuuguuuuugagacagagucucacccugucaacaggcuggggugcaguuacgcaaucuuggcucacugcaacuucugccucccagguucaagugauucuccggccuuagccuccugaguagcugggaccacaggugcgcgucaccacacuuggcuaauuuuuguauuuuuaguagugacgagguuucacuauguuggcuagucuggucucgaacugcugaccucgagcgauccgucugccuuggccucccaaaguguugggauuauaggcaugauccacuguacccagugaaauuucuguaauuucuagugaaaguauaauggaaaaaaaucuuuaaauaucauaaaaauccaacuagauuaauuuagaaaaugagcaguguagucuaguaacuuuagacuaaugaaacuuggaauuacaguugagaauuucagaacaaccauuaaaauucugugugguaucagagauaauuugaauuuauuggucauauaugugccaguucauuguuguaagaacuuuaccuguguucguuuagucaucacaccaacuuuaauauacuauuauugucuccguuuuguacauaaugauacugaaggaaagaaagguuaaguaacuuauuaaguaauagagcuaauaaaugucagagccagcauucaaaccugggagucuuccaucagagcacuuuaaauggcauuauacugccauaauacaacaaaagaugaagaaucuuacacugaauucuuugcauucuuuuaaucugaaagauuuaaaaauugacaauuauuuaacuugcuguaggucaucuaaaauggagcuggacuuggaaccuaggugacauggcaccccggugcacaucuuuauaagaaacuacuauuuuccagaaaugcaauaaggguuuuuaaugcuuucaauuauuugaugagcuaugcuuuagguaacucagaagagaaauaguauuuacaccuuaaauauuuaaguuauuaaguuuuuuagcauuuaaauaaaaguauuggccaggugugguggugcauaccuguaaucccagcuacuugggaggcugagacaggagaaucacuugaacccaggaggagaagguugcagugagcugagaucgcgucacuucacuccagccuaggcuaccgagcaagauuccaucucaaacaaaacaaacaaacaaaaaaguauuuaaaauagauggugguuuucuuggaguugguacaguccggaauuccuagaacaugaucucaugugauagggaauuuauccagaugaugaaagauaagaaaaaccugagaaguuaguugcuuucaaaaugagcuccuaauucuucagggauugacugaugaaggugcauuugaaaagauaauaacaaagcggaaagaaaaguugaugccuuaaaauguauguacauguaugauuuuuaaaaagcaucucagacugaaucaaauggaugugacccugucuucugaguauauucaaauaacauaaaacuauuuuucuuguggagaaucaagucuuuucauaaaaauaaaucuauaguuaauauauguuuuaaguuaauuuuauauaggauuaauaauauacuaaauguagauuuguuaagcuaucuuugauaauucaggaauagaauauauacacacuacauauaaaauuuuguaaaaggcauaaaauaaaaaaguaugaauuucaaaaauugagaguuuaaagugaaagauaaauugguauucugcuuggugcaaauacauuuaaaaucaacaggaaagacuuaaaugagaaagaagacuaagauguaucaguggaguauaagauagggugcaguuaugauacuugacaaaaaaugcuuaaaaaauaaaguuuuuuaaaaggccgcaauuaauagggaacauaucaugaaauauaacaauacugaauauaaauaugaccccaacaacauaaagccuauauaccuguacugauauucagaaggaggauaauaaguugagccauaauugcuuugaaagucuuuaauaaucucacuaucugggauuauuggacuguauggucacauccuuguuuugguacuuguuucuuguggaaaacauuccuuuagucuucuguuccugcuuugcuaagaguuuccaauaggaaugaacgucauauuuugucaaauacuuguuuacauccauggagaucauuugguuguucuuuuuaguucaguaugguaaaauauauugauugacuuuuggauaucaaaucaacuuugcguuccugggauaaaacccauuuggucauaaugcauuaccuuauauauuguuggauacaguuugcuaaaauuuuguucauaguuuuugcauaucguucaucagggauauuauauguuccuuguaaucuuucuuuuuuaguuuuugcuuuuuguaaucuuuaucugguuuugauaucaguguaaugcuugccugauagaaugaguugggaaguauucgcucuucaauuuugugguaaaguuuguguauaauuggucuuauuuuuccuuauauauuugguagaauucgccagugaagcucuuugggcccagagauuuuuuuuagugggaagauuuugaauauacacauucaauuauguuuauagagacuuccuaagguuuuuuauuuuuuauuuuuuagugaguucugacagucuuuuugucaguuuuuaaguuaugaaguuuuagcguaaagaauuucauaauauuccccacaaucauuuuauuuacuuuuuauuuuuuuugagacagagucuugcuuugucacccaggcuggagugcaguggugcaguuuuggcucacugcaaccucugccuccuggguucaagugauucugucaccucagccucccgaguagcugggacuacagguacaccaccaugccugguuaauuuuuguauuuuuaguagagaugagguuuuacucuguuggcuaggcuggucuugaacuccugaccucaagugauucaccugcauuggccuccuaaagugcugggauuacaggugugagcuaccaugccuggcuccuuacauuccuuuuaauauuuguagacucuuuagggaugucaccacucucauuugugauacugaucgaugauuuguauuuuuuuuuuccugcuucaucugucuagagguuuaucuguuuuauugauuuuuuuuuuuuuuuucagaacaaccagcuucugauuuaaaugacauuuuuuucuuuguuauuuuucuguuuucccauuuacuggauuuccauuuuauuguuauuauuuccuccccucugcuugauuuggguuuauuuugcucuucucuaguuucuuucuuucuuucuuucuuucuuuuuuuuuuuuuuugacacagaguuucacugucgccaggcuggacugcaguggcucgaucuuggcuaacugcaaccucugccucccagguucaagugauucuccugccucagccucccgaguagcugggacuacaggcccgagccaccacgcccagcuaauuuuuguauuuuuagaagagacagggucucaccacguuggccaggaugauacugaucucuugaccucgugaucugcccgccuugaccucccaaagugcugggauuacaggcaugagccaccgcgcuggccuucuuuaguuucuuaaaguagaagcuuauugguuugagauguuuucuaauauaggaaauuuaaagccauaaauauuuuuggaagcacugucuuagugauaccuccuaaauuuugauacauuguguuuuuccuuuuuuucauuuggaucaaaauauguucuaauuucccuugugauuucuuguuuggcccagagauuauuuaaaaguguuuuguuuagccuccaaauacuugagguuucucuagauuucuuucuguucuggaucucaaacuuauuuccauugcugucagagaauauaauuuauaugaagucaguauuuugaaauuuauugagacuuuuucaugacccagcaucuggucuguccuggagaauguucugugugcacuugaaaagaauuuguguugggcacccaugggguagagugucguauaaauuucacuuguauacguguauguuuuuuaguuguugaagucuuccugauuuuauauugagccuucuucuaucaauuuugagagcaaguauugaaaucccuaacuauguuuuuguugaauuguucacuuuuaagucuguuuuugcuucacuugacuuuuggcucuuuuguuagacuguuucauaauuguuacaucguucugauguauugguucuuuugucauuaugaaauauuccucugucucuauuuugugucauacuaauaaaaucacucugguuuucuuaugguuacaguuuguauuauguaucuuuuccacaauuuuacuuucaacuaacuugugauuuugaaucugaagugggucucuuagaugcauauaauuaggucuugcuuuuuuauacaguuggauaaccuguaccuuuuaaauuugaaugacuuuacgcuuaagguaauuauugcuaugguugcauuuaugucugccauuuugaguuuuuaaaauguucuuuacauuccuuuguuacuccuucacugcauucuuuuguguugaauaaauauuuuuagugugccauuuuaaucccucuguugauuuuuuuuuuagaagaaaauuuacauaacauuagugaagaauaauuuguuagggacacccagagaccuacugucaaaccaagaacuaaagcaguauggauaucuugcaucuaugaaugugucccuccuccccucucccaaacucugcccuuuuccuacagauaauuguuacucaauaauuuuuaugucuuuccuuuuauaaagaaaacugguuuuaugcuuuggaugugaauauuucaacauauuuuauugauuuugcuuguuuuugcccuuuauaagaaugauaccaaacucuaacuaguuuugggggacuugauuuuccucucuuacuauguuuuaagauuacccauuuuguugcaugccuuguagaucauuuaauuuucacuuauacuuaguacuccaaugugcaaaaaacccacaaauaauuuaugcauuuuccugucaguggacaucuuguuuauuucuguuuuuuucugcuauaaacgucuuguguaaguuccuuggugcacauauguaaggggcucucuauuuuuuuauuuuugaggcagagucuugcucuguugccaaggcuggagugcaguggugccgaucucagcucacugcagccuccaccuccuggguucaagugauucuccugccucagccucccaagguuagcugggauuacaggcgucuggcuaauuuuuguauuuuuacaaaacaguugggguuuccccauauuggccaggcuggucucuaacuccugaccuuaagugcuccgcccgccuuggccucccaaagugaugggauuacaggcgugacccacuguucccggccugagacucucaguucuuaagaguagaauuauugggucauggguuauaauuuuuuuuuucuuuuuaaaauguguuaaauauauauaaugagguuuacuauuuuaacuguuuuacagcauguaauguaguggcuguaauacauucacaauguuguauaaccaccaguacugauuuccagaacuuucccaucauccuaaacaaaaacucuguaaccauuaagcaguaacuucccauucauucuacccuccgcugcugguaaccucaauucuacuucuguaugacuuugcuuauuguagauaccucauauaaguggaaucauguauuuguccuuuugugucugguuucuuucacucagcauauuuuuuauguuuuuaaugcucacccauguaucacaucuugguuccuuuuuaugccaaauaauauuccauuacaguagggcccauccacccccccaaucccugccccuuaucugugguuucaguuaucuguggucagcuuuggucuggaaauauuaaauggaaaauuucagaaaucaacaauugauaauuauuaaauuacucaccauucugaguagugugauaaaaaucucuucuugucccauccaggacacaaaucaucauuuuguccagcaucuccaugcuguauacacuaccugucuguuagucacuuaguagcugucuugguuaucagauugucugucacugguaucgcagugcuuguguucaaguaaccauuuuacuuaauaauggcccuaaaguucaagaaugguaaugcuagcuaugggauaugccaaagugaagccguuuugaaguuuuuucuuuauguugaaaaggcgaaauuuuugacuuggaaagaaaaauauuuuaugugcagauuucuaagauuuaugguaagaacaaaucuucuguuugugaaauugugaacaguauauugcuaucauugugcuauuuuguuguuguucaucucuuccugugccuaauuuauaaauuaaauuuaucauauguguguguguauauauaugaauauauauauaugaaaaaacaauauauauacauauuggguuugauacuauccacaguuucagucaucacugcgaggucuuggaacugugacuacuguaaggggugacuauuguaacucagcauuuggguuguuuccacauuuuggcuauugugaauaaugucccuauaaacauugguguacaaauauuugaguacccguuuucaguuguuuuggguauauaccuaggaguggaauuguugggucacaugguaauucuauguucaacccuuuuuuuuuuuuugagauggaguuucacgcuuguugcccaggcuggagugcacugacgcgaucucggcucacugcaaccuuugccuccccggcucuagugagucuccugccucagccucccaaguagcugggauuaggcacgcaccaccacgcccagcuauuuuuuguauuuuuaguagagacacuauuucgccauguugaccaugcuggucuccaacuccugaccucaggugauccucccaccucgcccacccaacgugcugggauuacaggugugagccaccgcgucuggccuauguuuaaccuuuugagaaucaccaaguuauuuuccacagagucugcaccauuuugcauuuccacaagcaguuuggaagggucccaguuuuucuacauccuggccaacauuuguuauuuuuggucuuuuugacaacuagugguugugaagugguaucuguugugguuuugguuugcacuuuccuaaugauuagugauguugagcauuucuucauguguuuauuggugauuuguauuucuauaauagacguagaaauaucuauucauguccuuguccacuuuugaauuuuuuuuuuuuugauugaguuguaggaacauuuuuagaaauucaggauucauaucuuaauagauaugauuugcaaauacuuacuuucucauauucuguggguugucuuuuuacuuucuugguaguguccuuugaugcacaaaacauuggcauuuugaaaaaguccaguuuaucuuuuuguugauaaucuuacauucauacaucauuuuccuguuuuucuuuaguuuuuguccauuguucccuuuagcuaauuggcuauauaaagagaauucauuuaacguuuuugacuaauaauuccaauaucugggcuuucucagguaugcuuucugguaauucuuuuuuuuuuuuuuucuccuguaaaugggccauacuuugcuguuucuuugagugcuuuguaauuuuuuguuguagucagaacuuucugaguauuguaaugugguaccucuagaaaucuuauucucucacucugggagauuuugcuuguuuccagcugcagccauccauuugugacauuuucaaacuauuuguacaaaggcuagagaacccucuccccacucuuauccuuccaaaaaagaguucuaucucuuuaaaucuuccuguagauccuguuucggcuuuguccccuuaaaucuucugguggcugcugcuuggaguagcagcugcagucucagaagggugaaacccaggcaagagucuauucuggucccuuagggaacugcuagaccaaccaaaaugcacaacccuauauauugggaagagaaggucccuccuguccgcccuggcaccagccagcugcuuccagcacaugugccacuuucccccacagcugugucagggcugaguauggagggguagcugguucauuuaggccacccucuuaccagaaaucagucuccucuguuuauuguagauauccuguuaggucccauaguucugaaauaguugauuccaaucauacuuucuaguugagugguugcuuugguggagggacugaucccuagagcuuccuacucugccauuuggcaugaaaucacugguccccguguugauucugguuucuuuuucugauacuacuuuuuuuugaguuauauuuuggugguuuaauuaauaauacaaucuacuucagaauaauacuuuauucuaguaaaauauguaggaacuuugcucuugucucuccccaccccauacauuacauuuaaguauguuauaaacccaacagaauggccgggugugguggcuuacgccuguaaucccagcacuuugggaggucaaggcgggcagaucaccuaaggucaggaguucaagaccagccuggccaacauggcaaaacccugucucuacuaaaaauacaaaaauuagccgggugugguggugggcaccuguaaucccaacuacucaggaggcugaggcagggagaaucacuugaacccaggaggcggagguugcagugagcugagaucacaccauuguacuccagccugggcaacagagcgagacuccgucucaaaacaaaaaacaaacaaaacccaacaaaacauguuacaauuauuuuauacaaccauuaucuuuuuaaaaaguuggcaaagaaaugagaaaaacauuuauuuauuauauucaccuacuuaccauuucuguucuuuauuuuuucagugaauuugauguugcuuuccuuccucuuaaaggggcuuucuuuggggcuuucuuuguuacuuaucauaaggcagguugcuagcauaaaguucucucagucuuuguuuuucuggaaauguguucaucucacauucauuuuugaggauuaaugcuacauagagaaucuguugacaguuucuuucuguacuuuaaaugucauuccauugccucuggucuccauuguuucucauagugaucuguuaauuugugcuguuguuuucaugucugaugaauaauuuuuaucuugcugucuucaugauguucccuuugccuuugacucucaagagcuuauauauauauguguuauuucuuuguguuuauccuauuugagggucauugaacuugagugaauuugugguuuucuaucagauuugguaaguuuuugcccauuauuuuuucagguggaauucucuucuucauggaauucccauuacauguauguucuuaauauuuuaucuguccuguaggucuccaagcuucuuuuaauuuuuauuuuauuuuauuuuuuuuuugagacaaagucuugcucuugucgcccaggcuggagugcaguggcgcuaucucagcucacugcaaccucugccucccggguucaagcgauucuccuuccucagccuccugaguagcucaggggauuacaggcgccugccaccacgccugucuaauuuuuguauuuuuaguagagaugggguuucaccauguuggccaggcugguaucgaacuccugaccucaggugauccgcccgccuccgucucccaaggugcugggauaacaggcgugagccacugcuccuggccuuuaauuuuuuuaaaaauauuuuuguuuguugagucguuuauaccauuauuuccuguaaucucuauaccccugguuuccucuuauucuauaaaaauauuuacaauagauccuugaauucuuugcuaaaucugaaguccgagaagacauuuucagguguguguguguguguguguuuuacaucuugaaugugggucccucuuucuuugcaugucuuguaauguuuuauuuauuuacuggacauuuaaaacaacacuauagcaaucuggauucguaucucccuaccuuuugccaggugguuguugcuuuguuuguuuugugaaaacaaacaaacuguugaaucugugaaaucugaaucuguaaaaucucuucuguauugugcagcugcugauuucugucauuuauucugccuaguuuuaauuuuuaagacuuguuucuuauuuuguuucuuuuggggcagcagagcuuaguauucagccaaagauugauagguuugguguccaaauaccuuuagccaguaaggcugugcucaagugugcccuggcuuuuauuuucuguugugcuuucucaggucucuuuugcauaggcauagaggcuuaguugacugaggauguaauaauggcuucggcucccucuggucuuugcuggacacgugcacagccucugaucaaggugggauuuguggagaguuuaccaggcccccugugcuucucucacuacauguaauucuguguuaaaucccugguguuuccagugcuuugcuugccccacacagaauugugaccucaaguagcagaucuccuuguuuguuucccauugaaaucaccuguuuaaacuggacgcucuccaucaaucaagucccaucuggagauagcagugaaugugcugguuuucacugcuuaccucacccucguuaaauuacaguuuugucuagcuuuauaguugccuuucaggaaggggauuuaucaucuuccuucuucugcuaugcuggaagugaaucuccaaauuagaauguuagaauauacuauuacccauuaauuuuuuugucuuaauuaaagcuaaauuugcugucaguuuuuuuccugugacagagauuuuaaacuagaaauuugaguugccuucauuucauugugaaugcuuuaaaaaauaagaguauuuguuaaguuuuguuauuguugagauuaagagaucuggcuguggauuccaguauagcuagugccucaucuguaaaauggccacaguaauaguucuaccacaaggguuuuugguaaaaaguaaaugaauuaauuaaagcacuuaaaauacugucucauaaaaguaaauacuagauaaauaccuguuuucauguauguuuauguauuuaucauuuucuucauaaaaauuugguuucaauuuguaauuccuuggcaauuaaauuucuaaacucuuggaaauacaucacauugguagcuuuccuuaucugccuaugaagugacauucaguuguuuccuaaguaguauuacauuugaauauuugaauguuuaccuauuuuucauguaucuaugaaauuuacuacacuguagguggugagcuucauuuucuccaaauuggaggaaccugugaugauauugaugaagcugauauacuaguggauggaucucuuucuaaaggaauagaaccaucuucagaagguuccaaaccuuuaucaaauccuucaaguccuggcauuucagguaugauauuaaauuuuuaaaugauuuuaaaaaaagaauagguaguauuuaucauuuuucuaguuguuggaagauguaaacauauuaaaguaagaagugauucucaaccuguaugguauguuacucaauauuugugaagucaucuaagagguuaaaacaaacauuucagccauuaaugagcuuuuagucuaauuagaggagggaaaaaucauauaaaagagaauucauuaaguaagaauaaaauuaguagacuggcucauauuauuaauauuacuacuggaauugaaaaggugaaaaaaaaauacugucacugaggauauauuuaggugguauauucacacauacguugccccauccugaaucucucgauagguuuguuuauauuuguuuguuguuuuugccuuuuuucucccauccuugacccacauugcccuccagagcuaauuuuucaaaagaaguuuugcuagcaugcuacucccugccaaaaaaucauuauuugccuuguagacuuuuaugaaaucauaguagccugcuucucaaucuccaguuacuugaguuaaccaaggugucuugguuaaguauacaacuugguauaaaaagcuaaaauacugaauauucucauauuuuauagguuauugguugaauggagaagauuuuuuauaaaguacagaaaaaugcuuuuuaguagaggaaagaugaauuuuguaaugaagaaauaaauaauggaaagaaagaagauugacaugcuguuaauauuuacaaacuaagcagauuuaaaagggucuagacuuugagaaaaagauguaauuugaauuaaacuuguaauaauuuuauagaacuugcugucauuuuuuuauugugaaaauacucuaaaccuaccagauuuuauauuuuaguauuuuauuaauuuuuuaaaaugggaacaauggcuuagcauuuuuuaauguuauacauuucacugaugugaauacauguauagcauuuguaaagaagccuaauuaguaugaagcacguuauuacucuuauaauacuagcauguaugcaagauuuucuuaacugccacagaaauagaaaaaacaauuuaauuuuucaguuuguaaguauuucuuuaccacauagcuuuugacuguuuuaguguuuuauucauauguuauguacuugcuugaugucuagcauuuuauuuuuuaaaaaauagggucuaaaaguuaauuauuggucugauguacauuggcuugcacuuuaguaccacugcuuuucuugccauccuuauuagggcuaaaguucaguaagcccuuuucuaacagguuggguuuggguuucuucaauagcgaguauugucucuaauuuuaaauauuuaaguuagaauuuucuucuuugcuauuuuuuagccagaguuaguuaucuuaguuauauauagauaccugagcccacuuuauuaacuuucagaauauuuggcaaguguugcaauagaaaaccuacccaugaauuaaaacuucacuucauugucuucuuuuuuuuuuuuuuuuuuuuuccacaccuauuucaaauacugcucucacuaauguuaaggaguugauuuauugguggaccagccauucacccuugaaaucuugacaucccuaguggagcuaacccgcuuugagacuuugacuccaagguuuucagcgacuguuccuccaugcuggguagaaguucaacaagaacagcagcaaaggaggcauccucaacauuugcaucagcaacaccauggugaugcugcucagcauacucgaacuuggaaacuacagaccgacagguaaaagauauucccaagauaauuaauuuuaaguccaucuuguguauuugucagagacaacguagaauuccuagguauauuacuguuuaucuuuuuuuuuuuuuuuuuuuuuuuuuuuuuuuugagacagagucucacucugucacccaggcuggagugcaguggcgcaaucucggcucacugcaaccacugccuccuggguucaagugauucuccugccucagccucucaaguagcugggacuacaggugcgcaucaccacguccggcuaauuuuuguauuuuagguagagaugggguuucacucuguuggccaugcuggucccgaacuccugaucucaggugauccaccuaccucggccucccgaagugcugggauuaugggcaugagccaccaugccuggccuguuuguguuuuaaacugucuaaaagauauacaguaauauacuuaggaauucuguguugucucuaacaaauauauaagcuaauuuuugcauguugaugacuuuguuccuucuauuugucauauugcuuuuggaaauuguuauauucuuauucuuaauuuuaggauaaaauaaugagaguaauuuacuacugcaauuaguuuggucacuuaguccacagauuuauuuaacaaauacucaaaugcuuguuuuguauuuaauaaaagcaggcacucuuauagucacuaguaaugugggucucauggaauuugccuccuaauggcaauagaaaguaaacagauacauauaccaugccauaugggcauaaaagcuaugaagaauguuaaaacagaguauggcaauagaguaguaguuggauaggaaauugcauguaagagugagagagugagagaaaaagagagacaauguguaugguauuuucaauauaagggaccuaagaaaggcuuccaugauaauagcaauacagaacccugaggacuauauuuugugaguucuaggaaaagaaauaugaccauuguuguuggagugcugugaauauaagggagagugguagggagggagauccaaagagguagcugggugccaggcauggucgcucaaaccuguaaucccagcacuuugggaagccaaggcagguaaaucaguugaggccaggaguuuaagaccagccuggccaauauggugaaacgcugucucuacuaaaaauacaaaaaguagcugggugugguggugcacaccuguaaucccagcuacucaggaggcugaggcagagaauugcuugauccugggaggcggaggcugcaguaagccaagauuacgccccacugcacuccagccugggcuacagagugagacuccaucucaagaagaaaaacagagguagagguaccugggagcuggaucaugaaugccuuuauaaaaggucaggcaugguggcucacaucuguaauccuagcauuuugggagacugacgcaggaggaucacuugagcccagguguucaagacccaccugggcaauauagggagaccucgucucuauaaauaauaaaaaaaaauuuagcuggacauggugguaugugccuguggucccagauacuugggaaacugaggugggagaaucacuugagcccaggcgguugaggcuguagugagccgugauugugccacuguacucuggccugggugacagagugagaccccauuucggaaaaaaaaaaaaaaaacuuucaugcuacgugagaugggaaaguguuagcagguuugaauacaggagugaugugguauaauuuauauuuuacaaagauuacuuugacuucuguauuuagaaugaugguugugguggggagggcagugauagauugguuuuaguuugguugcuguugugcugauucaggaaugcugaugguagcuuggaccauugugauagugauggagguagugaaaagagucguuagauucuggauauaauuuggagguacaaggaauagaauuugcugauguauugaacauauugugugacaggggagaauaaaggauagcuuucagguuuuggccugaguucacugaaaaaugaaguuucuguuuacugagauuuggaaguggguuuuuucauaaugaguuugagaugucuaguagacauuuggauaugagccuuaaauuuaguggaggaguuuggagauuuucauuuuccagcauauauauagcauuuaaaacccaagaaugaauauauauaagaaauacaauaaauuguuguuuugaaaugaagauucugggacccuacucauagaucuaggguggguaccaggaauuugcacguaauucacauuaaauuguucacacuuugaggaauaagaauguauugguauaugcaagucucaaggcagguguagauuucuaaaguaagauuauucauugcccuuuguuuaaccuucuccauugggagcuauuuucucucuugaucccauugagaaacacuagauuuuguuggaagcugcaaagcaaaaaguaggaaaggugaccuuaaugauaauaugguuguggcugaagaaagauuuuugcuuuauuuagcauuuuuccccuuauuugacagcaacagcugggaugaacauguauuugaauuaguacuaccuaaagcuuguaugguuggacauguggacuucaaauucguuuugaacucaaacaucaccaauauuccacagauacaagugacacugcugaaaaauaaagcuccaggauuagggaaagucaaugguaagaauguaucaaaauuuaucuuugaagauuuuauuuugugguugauuucugaaaacuaauuuucaccuuggcuaaguuucgugucccuuucugucccuuguugccauuugccugcuuuacuuuuugugauuuuauuuaaaaaaguaauucagagaacauuucagaacuuuucaguaacccaguaauguucagaauugcauaaacuugaaucauauaauuauacuuuuuuggaagugagauuaguuccuuuguaaauuaguuugacuuuuagcauuacuagcuuuauguauuucuuuuccuaggagaagacuuaauugugaauagaacuguuauggaaguuacuuuuaagguuauuagugaagccagccuuucauguaaugcuaaaaauacacucauuuuuaucuuucuuacaaguucagaauuuguugcauugaguuauuaaaguagauuauacacauuuagcaugguuagaaacuagauguuacuacugaguguuuucuccuuaauaaguuaguuuaagaggcuggggauaauuucacgguaaaauggcaacuuaaccccaguuucaaacauugaaacuugaaaauuuuccuuuuugaaaaauuacauauacgccuggcacucucuaucuguggguuucacaucccaggagucaaccaaccucagaaacaaccaaucguggauugaaaauacuuugggggggaaaaaauaaaaaaaauuacgacaguaagaaaauauacaaauaaaaaauaguauuagaccacaugugguggcucaugccuauaaucccagcauuuugagaggccaaggcaggaggaucacuuuagcccaggaauuugagaccagccugggaaguauagcaagcacaugucuacaaaauuuuuuuaaaaaaauuagcuggguguaguggugcacaccuguggugcuacucagguggcaguacucaugaggcugaggcaggaggaucacuugagcccaggauuuggagguuacagugagcuaugacugcaccacugcacuccagccuaggugacagagugagacucugucugaaauaaauaaauaguauuugcauggcauucacauuguauuagguuuuauuaguaaacuaaagaugauuaaaaguauacgggaggauaugaauaagguuauauacaaauauuaugccauuuuauauaagggacuggaacaucuguggauuuugacaucuguggggguccuggaacuaaucccccacagauacugagggauggaugacuauaugugugucuguauauuuaugugagucuguguguauauggauauguucauaugugugcagucuuuugacagauuuugaauuaauuggguggaggacucaggauuugguaguuucaaagcucugcaagugcuuguaccaggcagccuaggguaagaacuuuuaguuuaguugccagcagauuguuucuuuaggcaaauauuuuauuaccguuaaaagagagaagaauguauaaaacaauugaaucaaaauuuuccuccaaucauuuuauagcaucugugaugaaaaucacagaaguucccaaguuaacaggaaauuuuagauuuuucaggcacauaaaucauugauauuaaagaaaauuaaguuuacuaauauuuuuauccucuagaaacagcaguagauaggcagaucaccuuuccuuugucuccagcucuuaacauugaaguggaacaaaaugggaaaccgucccugguugauuugaaugaagaaaugcagcacauggauguagaggaaucacagugugaguuaaauuauagagcuguuguccaugacaguaaaaggaguagugaucugaaugcaacaugucgggcaagauuuccuuauggcuugcaaaaacuugguuucaagaacacaauuaaaaaauaaccuauaauucugcuuuggcaauaugcuuuaacuuucagcucaucuuuugugaccacagcugcgcuaaugcauucuugguuuuuaauaccuugggauuugaaaucaagucgugguuuauaauuuuuuugaaaauaaaggugaacuguaaaauaauaugggaauggaaagcaacauaacaaauaauugauuauaguuccuuagcaugacaauucuuauuuuaacacauucuaaguaugauauuuuguguggugguauuauauguaaaugggaugauauuugcuuauuaaauauuacauuuuaaaugaaugaauuuaaaagaaaaauauguauuuuucuuuuuaggucuuagauuauguccauuuuuggaggaucauaaagaagacauucuaugugggccaguauggcuugcuaguggccuugaucuaucagggcaugcuggaauguugacguuaacaagccccaaacuuguuaaaggugaaguaauacauuuuacaaaagcagaauuaauaauaccacaguuguaaaaaagacgaaaaaaaacugaucucaaaaaaaauaagauuguuuucuuugggacuuucguucgaaauuucaucaguuuucugguagcugaggucauuuccugucauaaaguaacuaacuguaugguuaucugauccuacuuuuugugucuuaagaggucucagugcuuuuugaaaaaacguugaagaaaugacuacaggaugacuuagugugacauaacagagcucuuuugaguaagcagacauaauguucugccauuuuuacccuucccaucacaucagagucccgucucuucagaguuuuauuauauauuauuacaguaucuucccuuaaaagagguauuuuguuuguuuguuuuuguuuuuuugagacagucucauucugucacccaggcuggaguguaguggcgcuaucuuugcucacugaaaccuccgccuccuagguucaagugauucucuugccucagccucccaaguagcagggauuacgcccagauaauuuuuguaguuuuaguagagaugggguuucaccauguuggccaagcuggucuggaacuccugaccucaaaucaucugcccaccuuggccucccaaaguguugggauuacaggcgucagcaccgcaccuggccaagagagguuuuuuuuguuuuuucuuuuuuuuuuuuuuuuuuuugagacagaguuuugcucuguuacccagguuggagugcaguucuguuaucucagcuugcugcaacacccgccucccaggcucaagcaguucucgugccuuagccuucugaguagcugggacuacaggcgugugccacaaugccuggcuaauuuuuuauuguauuaguggaggcgggguuucaucaugucgcccagggugauguggaacucuugagcccagccacucugccugccucggucccccaaaguguuaggauugcagacguaagccaccgcuccaggccaaaagaggauuuuuauuagaagagcuucgccaguaucauauacaaugauuugagugucauaaacaaaugcagauuauaaugaauguuuugagauaaugggcuaucauguugauaauuuagaaauaucagugguaggacguuuucagcuuuuguauucuggggguaaauaaaaaaaaccaacacaaaaugacuaguucaauuguuaaagaaauuugggguggggugggauguagagauccuucuccaacccaagaaaauaacugaccaacuauauaucagcuauuuacauuuguguacauuugcuuccuaauguuuguccacauucacacauaaccauuuaauugcagacauaguacaggucaaguaucccuuaucugaaaugcuugggaccagaaguguuucagauuucagauucuuuucugguuuuggaauauuugugauauacuuaacuaguucaguauuccuaauccaaaaauccaaaauaugaaauguuccaaugagcauuuccuuuuagcaucauaucggcucucaaagaguuuugcauuuuagagcauuuuggauuuucagauuagggauacucagccuguauauaugcaaguuuugugcuuucuuauugucauuagguuuucgagauguuauguguuagguuucaugcugggauacaguagugaacaaaaacuaaucucaaauuguuuagauuauagguuuuguucaaugagagugugcaucuuaaauuuuuagguggaaauagaaauauugguguuuuuaaaaauuuuuuauuuuuuagagacacagucucccuguguugcccaggcuggucuccaacuccugggcucaagggauccuccuaccuuggccucccaaagugcuaggauuacaggugugagccaccacgucuggucaaaaauacugauuuugacaaaauggaguguagaauuacauggcauguguuuggaaaguauuaauuuucuuagaauauacuaagauauuuuuuuccauaaaauucuccccagcaucuuugaaacugaauaagauaagugcuaaguuuuuuuggacgaguaaagggguaacauuggccaaagaaauuuugaaacagaaugucagauaccacaacacagagaauaguacaguaguguuaagaaaaauguaacaguguagugcuagcacagcaggcagguagcuaaguagagugauagcauuuauaaucaugaaagauuuaauaccugguaaugcaacaauagacugauaguuugcuggcagauguaguaauuuaaugauaauuaagaaauguauuuuauauauagauuguauaguaugaucccaauuugguuaauaucacauacuagugauaauaauuauuugaguguucuuuuuuuuuuuuuuuuuuugagacggagucuugcucugucgcccaggcuggagugcaguggugccaucuuggcucacggcaagcuccgccuccuggguucacgccauucuccugccucagccuccugaguaguugggacuacaggcgcccgccaccacgccccacuaauuuuuuuuuguauuuguaguagacgggguuucacuguguuagccaggauggucucgaucuccugaccuugugaucugccugccucacccucccaaagugcugggauuacaggcgugagccacugcgcccggccuauuugagugcuuucuuugugccaagcacaguuaacagugguuuaguugacucugagguaggaaauauuacucuuauuuuacauuagaagaaacugagccacagagaggauaauuugucaugugccuaauaaauggcagagccauuuuucaaacccagguagugacuccaaagccugcaugcacauuuuuaaccgucaguacuauaaugcuauguguauaugugcacauauauauggauguguguacauguaugcauaagaagacuggauggauauacguucuguuauuaucuagaugauagcuuaaugacaguuuugugugugugugugcguguguauguguguguguaguugaugacauuuuuaccauuaaaaugaauaauauuggggaaaaaacaugccaaauguuuaucucaauuagucaaagauaaugguuuuaugcuauucauaucauuccuuuguugguuguuuuuugcugacagcgugugaaggugguucaacuuucuucugcucaaacaguauaauuugaaaguucuggccuacuguacuuuuuguggaguuaguuguugaucuuguucuaugaagaugaaaaacaguggaauuuauuggugauucaguuauuuuccccauucuacuccacuucucuagguauggcaggaggaaaauaucguucguuuuuaauccaugucaaggcagugaaugaaagaggaacagaagagauuuguaauggugguaugcguccuguaguaaggcuuccaucccuaaaacaccagaguaacaaggguuauucacuugcuucacuuuuggcuaaaguugcagcaggcaagguaugaaacugucauuuugaacaauaacaauacaguuuuaaacauuguggaucagauuuaacacacuauuagaaguaguaugaccuuucagugauguuuuacuauacgcuugguuuguuuguauuuugucuuuggagugacuuaaauauauuugggaagaagaauguuugaguuaacuuuauuauuucauuuuauuuauuuuagaguuuugagacggggucucacucuuucccccaggcuggaaugcaguggcgcaaacucggcucacugcaaccucugccucccagauucaagccauccucccaccucaacuucccuaguagcugggaucacaggcgugugccaccaugcccagcuaauuuuugucuuuguaguagagacgggguuucaccauauuggccaggcuggucucaacuccuaaccucaggugaucugcccaccuuggccucucaaagugcugggguuacaggcgugagccacugcacccagccugaauuaacuuuaggcaaauuaccuagcuuuuguaauguauacugaauagggaguaauuguuagcagauauuucccuuuauaauuauuuuagaccauaauauuuauuucuuuugguaugagaguuucuucauaugcccucuguuggcaacucacaaucuuguuuuuggugacuauuugggaguauacagaaagagaaguuggggcguaauuuuaagacagguucuaauccucaugguugauuuucugaaaguagcugugaaccaugcagcuccuuacaauugacuuaucuuggauuuccuggaagucaggaaggagguuuuguuuaucaucauuauuuauaaggaaucauacugauacugaucaguaauaccaggcauuuuacauauauauaggucuuccaguuuuucaaggacuucuguguacuuuaucugauguaaucuucauuauaacucugaaguaggcauagcagguucuguuaccucccuuuuuuaaauacugaaagugagugaaccuuagcgauuggggagccugacauaucucacguaguuauuuuauuuuauuguguuuauugauuuauuauuauuauuauuauuauuauuauugagucagagucuugcucuguugcccaggcuggagugcagugaugugaucucagcucacugcagccuccacccacugaguucaagugaaucucuugacuuagccucccaaguagugggauuaaaggcacuuacccaugcuuggcuaacuuuuguauuuuuugguagagauaggguuucacuguguuggucaggcuguucucgaacuccugaguucugugaucugucugccucggccucccaaagcucugggauuacaggccugagccacugcacccagcggaauuagacccaggacuuugguuuuaucaucuguaaucauuggguuauugccuuuaaaauaguggcugugucugucuuuuuuuccccuauuauaauucuggagaaaauuagucauuuacugaauaugaggguacaagcuaucauuuuaacuugagauuuauauuuugauggccacaauucaguuauuuuccuuuauuuuauaacuucaaugguaaaugauuuuuaguuuaguuuauuuuuuaaaauucauuauuauuuguaauguuuaggaaaaaucaucuaauguuaagaaugaaaauacaaguggcacccguaaaucugaaaaccuccggggcugugauuuacuucaagaggucucagucaccauucgaagauuuaagaaaaccucaauuucuaaggaaagguaauuucauugcauuaucuuguuauucuuacaguaaugaaagugcagagcauaacaccacacacauacacacacaaauaaaaaaucuuuuaccugaaaauuuuuuuuguccauuuuucuuaaauaauuauaauuuugaugagaauaugaguugucuuuauacuucauugguuuaucucuaguguccgcacagugcuuguuguauagcaggaauggaugauaguuauuaauuugacacguacucgucaggcaagggagcauguaucuauaguccuagcuacucaagacguggggguaggaggaucacuugaacccaggaguuugaguccagccuggacaacagagggacacccaaucucuggagaaaaaaaacaaaacaaaaagaaauuauacacauuccauguuacauuacaacacauuauuguaaauguuauuaaaaaauuuucuacaaaugaaauacuugacauauagcuauugauuguuuuuaaauguacuugagauguucaugaauuaaaauuaaacauugccuuuccagccagguugugauagcuuuaguuguucuguuuuguuugguaauguguuuauauuuucuuuuuuuguagagugcaacgaugugccauguuacaguuuucagaauuucaugagaagcuuguuaauacucuuugcagaaaaacagaugauggccagaucacagaacaugcccagagccuuguguuggauacucucuguugguuagcuggaguucauucaaauggacccggaagguuaauaauuaaaauuuugcuuaccacuguugauugccuuuuagauguuaugauugaaaguucaggaugagucuaaaugucugcuauuguuuugcagcucaaaggaaggaaaugagaaccuacuuucaaaaacacgaaaauuucugucagacaucguacguguuugcuucuuugaggcaggacgaaguauagcccauaagugugcccgauuucuagccuugugcauuagguugguauguuuuuaaguugaaagcauacuuucuagguacaccugcaauuuagugggugauaccuuguuuauagugugauuugauccuuguuuaauguauguauaauuuaagagaauuucaaaaguugaugaagauuguugauaaucuuagcaagaauuuuggguucuuaggggaaagugucauguuaaauaagucuauuuaacuuuuaagaaaagaagucugcugagcuucucugccuguuaguagcaguuuggagaauuuggcaagggaacucuuaaacccuuuucacuccuacuuuccuugguugucuuuucuugcccuaaaguguuuucucuguuauguaacaaucuuaccgacuuuuuuuuguagcauugugcagacccuuuuuuucuaaacccugaaacaaauuagaacagucugcccugauccccagggcaugugucccaagaccccuccccuccccaguggagaccugaaacuguagcuaguacugagccauauauauaguauuguuuuuuccuauauauacauaccugcaauaaaguuuaauuuauaaacuaggcauaguaagagauuaacaauaacuacuaauaaaauagaacaguuauaauaauauacuaugauaaaaguuacaugaauguggucucucaacaugucuuauuguacuguacucaccuguguuuagacugcacuugaccauguguaacugaaacuuuagaaauugaaacugcauauacggguucuuaauguuuaaagguuccuacuugcuacuguaucuaggaagugucuaagagcuaauggucaguauugacuguuguaaagauaaggguuuaaugcauaagaaaauauuuacaacccuccuuaguauaaucaguucccgcuaucuuuugguauuuuauauagcuuuaaggcagguuuuucuuuuaaucgguauagaauacauuuuaaagauuuuuagguaccacaccagguuuaggguugaauuuagaccuugaguaaugucuuuacaauuuuucuuuuuaaaaauuuuucaguaauggcaaaugugacccaugucaaccagcauuuggaccuguucuguugaaggcuuuacuugauaauaugucauuuuuaccugcagcaacaacuggugguauguaaaauuaauuuaaucacaaauaguuauagucauauggaacaucucauauguauacuuaggauuauuucauaacuacuuuuucucuauuaaaguucacuuuucuguggcuuaucuguauuuuuugaagggaucgauagauuguagcuggguggucauauacuccgucaauaguacuccaaggaaaagguucauggagcaguuacguuaauaucaagucaucucaauucauaacuauuuuucuguacuucauuacaaucauugaguuguuugguuguuuacugacuguaacagaucagaugccagaaaccagaauuccagcaugugccagggaggugacauaaauaaguaaaacgguccaggugucauugcacaugcauauguuuugugugauugguagggacuauggcaaacuggaauuuccuaaaagggaccagugguuuuuuuuuuuuuuuuuuaaagcaccugaggacucuguggaaaugccuuucaagaaugaauguaauuggagguagagaguagaaugauggauaccagagucugggagggugagugggauuugaagagagguugauaaauuaguaugaacauaugguuagaagaaauaaguucuaguguuugauagcacaguagggugacuguaauuugugguauauuucagaauaguuaaaagauuuaaaguguucccaaugcagagaggugauggauauccuaaauacccugguuugaucauugugcauugcauccauauuucaaaacaucacauauacccccuauauaugugcaauuauuauguaucaaaaaagaaugaagguaguuaucaaguaggaauucauaaagcaguucucuaaaauagcacauauauaagguaaugaagauuuuuaaagauucuuacuguuuuugcuaguacaugguguuacuaugaagggcuacuaacuuggccuuuuaagccaaauuuuauuuauugauagacauuuuucacaaucuguuuuauuaaaaaacaaaccauucaggcugggcacaguggcucacacuuguaaucccagcacuucgggaggccauggagggaggauugcuugaggccaggaguuuaaaaaaacaacccauucaacaaguuaccucagugaguuauauauuucauaaagauuucaucuuuguguuaaacaaaaaaaaugcuuguuuagaguuguugaaaaguuauaucauuuucuuaauuuagguaaagcguguuuauauuuacauugaacauauuuuggcuacaaccauuaacucuauggaauagaacauuuugacucaguugcucauuacgauagucucuaauguuuaaaagcuucuuaaggauaguuuuaaaguugggacgcuuaaguuuuggcauguauguagcaguuaauaaaaguaaaaauacacugucaugauaaucuuuuaagcaaugucgaucuguaccuaacgcauuauagaauaauuuuauuccccauucauucacuaaaaugggcuguuugaagcucacugccauccacuauuuuuuaaaguuuaguacagagaaacaguauguugguaaggaugauuugaaggaccuucagucuccucacuuuuucagcuauuucgaagugucccucagaggcaucucacauuauuauacaccuaaauaaauacacauuauuauacaccuaaaugacuuuauaaaacucuccagaaauauuugaaauucuuaguguaagacugugccucaguguguuguuuauauuuuaaguguccucuuugaucccuccaaggaguuaucuuuguaaauugccuauaagauugucuuuccagaaaagggaguaucuuucuagcaaaaggaaguauucugauaaauagguaaucuuaaauucucauuguuagaggaaaaggaggaaaaagaaacauuuauuuuguuuuuauuguuuccagguucugucuauugguauuuugucuuacugaauuaugugaaagaugaagaucuggcuggaugcaguacagcuugugcaucuuugcuuacugcaguguccagacaguuacaggacaggcuaacaccaauggaggcuuuacuucagacaagguauuuuaguauaucuaaugacuaauaauaggcgucucugaguaugaucacgcuuuugcagagaacuguuauuuaauauauauaugcugauaacagucuuuuucuuacaaaaauguuuaguuuauaccuuacuuuuuccauacgauaauagccugagguuuuacuuucuucuguuuugucagaaauuacucuuuuuuuuuuuuaucgagauggaguuuuguucuuguugcccaggcuggagugcaauggugugaucucagcucaccacaaccuccaucucccggguucaagcgauucuccugccucagccucccgaguagcugggauuacaggcaugcaccacaggccuggcuaauuuuguauguuuaguagagacgggguuucuucauguuggucaggcuguucgcaaacucccaaccucaguugauccgcccgccucagccucccaaagugcugggauuacaggcaugagccaccgugcccggccagaaauuacucuuuaacaguuugauaaauccuuaugaugguuauucagagggcuaauuuuauuuaauaaugaaaagugguaugcccugcuaauggaagaagaauguaaugugucuguuucucugugcacuuuauagguggaauuaugugagucacuuauugucccauaacuaguauucuucuaccugcuacuuguauuucaaaacuucuaacgugaugaauuaagcaauagcaaaagguuagauuuaaguucuugccugauugucuacguuugaaguaaggcguuccuuuauuuagagcagugauuuuauaauuuccuagguuagauguucugauuuugaugacauuuuacucaaagccuuuguacuugaggcuaugucguaaugauucacgggagagaauggugccugauaccccucgcuucaaucugcagguggcagucuuaguaccuuaguugccagcuuauuggaaucacauuuguugagucucuggacagugucuuuuagaguauagauugcagggaacauaguugagauucacugaauuugaugggucaaaucuagucagcaucucccucugcgcuguuuuuuuuuuuuuuuuuuuuuuuuuuuuuuuuuauugaucauucuuggguguuucucgcagaaggggauuuggcagggucauaggacaauaguggagggaaggucagcagauaaacaagugaacaaaggucucugguuuuccuaggcagaggacccugcggccuuccgcaguguuugugucccuggguacuuaagauuagggaguggugaugacucuuaacgagcaugcugccuucaagcaucuguuuaacaaagcacaucuugcaccgcccuuaauccauuuaacccugaguggacacagcacauguuucagagagcacaggguuggggauaaggucacagaucaacaggaucccaaggcaggagaauuuuucuuaguacagaacaaaaugaaaagucucccaugucuaccucuauccacacagacccggcaaccauccgauuucucaauuuuuuccccacccuucccgccuuucuauuccacaaaaccgccauugucaucauggcccauccccaaugagccgcugggcacaccucccagacggggucguggccgggcagaggggcuccucacuucccaguaggggcggccgggcagaagcgccccucaccucccggauggggcggcuggccgggcggggggcugauccccccaccucccucccggacggggcggcuggccgggcggggggcugaccccccaccucccucccggacugggcggcuggccgggcggggggcugauccccccaccucccucccggacggggcggcuggccgggcagagggguccucacuucccaguaggggcggccgggcagaggcgccccucaccucccggacggggcggcuggccaggcggggggcugauccccccaccucccucccggacggcgcggcuggccgggcagggggcugacccccccuccccccucccggacugggcggcuggccgggcggggggcugaccccccccaccucccuccuggucggggcgacuggccgggcagaggggcucuucacuucccaguaggggcggccgggcauaggagccccucaccucccggacggggccgcucgccgggcgggccccccuauccccccaccucccucccggacggggucgcugccgggcggagacgcuccucacuucccagacgggguggcugcuggacggaggggcuccucacuucucagacggggcgguugccaggcagaggguuuccucacuucucagacggggcggccgggcagaggcgcuccucacaucccagacagggcggcggggcagaggugcuccccaccucucagacgaugggcggccgggcaaagacgcuccucacuuccuaaaugggauggcggcggggaauaggcgcuccucgcuuccuagaugggauggcggccgggcaaaaacgcuccucacuuuccagacugggcagccaggcagaggggcuccucauaucccagacgaugggcggccaggcagagacgcuccucacuucccagacgggguggcggccgggcagaggcugcaaucucggcucuuugggaggccaaggcaggcggcugggaggugguuguagcgagccgagaucacgccacugcacuccagccuuggcaccauugagcacugagugaacgagacuccgucugcaaucccggcaccucgggaggccgaggcuggcggaucacucgcgguuaggagcuggagaccagcccggccaacacagcaaaaccccgucuccaccaaaaaaaaccgaaaaccagucaggcguggcgacgcgcgccugcaauggcaggcacucggcaggcugaggcaggagaaucaggcagggagguugcagugagccgagaucgcagcaguacaguccagcuucggcucggcaucagagggagaccguggaaggggaccguggagaggggagaggggagaggggagaggggagagggagagcccucugcgcuguuagucagacugcuuuuaaaacuaaguaaagguaauuuguuaauuagauggcugaaaggaaaauuguuagugcauuauuuuauuuuucagauauggauuauauagcucaccauuugauccaguccucuuugauuuggagaugaguggcucuucuuguaaaaauguuuauaacagcagcauugguguccagucagaugaaauugauuuaucagauguccuuucagguagugauuucuuuuauuaaaggaaauucugaauguuguaucuuggauuuaaguugccauuugacuuaauagauuauagucaugauguuuugucuuuagaaaacuaaaauuccuuagaacuuaucauaugaauuauuaaaauguuuccuagaaguucuuaacuuccucuuucccucugaagaaaaucccaguauauuaaagucauauuugaaaggguugugacuuuaauuuuuuguuuuuguuaugcauuucauuucagugugauuuuaaugcuuaugagacuauuuaaaauguauuuguuguagccuuuucaguuuuauuugauguaucuuugcugccucuauaaaguuaaaaaagauuuccuauuucaaaaauacaaaauuaguaauauauacuuacuguaauaaggaugcacaaacaaaagauaauuuucugcaucugucacuuucuugagguaagcuuuguauacauuacguauauccuuuuauacuuucuaaagaauguguuuuucggauguaugcaugacacuauuuuuauaaucuuuuuaagugcuaaaauuugcuguuuauuuuuguuagauaaaagagugaccauuucauuuuuuucuuccgucuaauuguacuuauugcagauguuguuaggauacaaaaauguuagaaaauuugcaaacagauuaagguaauaaccagauauaaguaaauuuugagagagaaguucaauuuuguugaaaaguaacuuaugagguguaauaaaagcaaaauuaaaaagaucaaauacaaaaauauaaaugaaauguaaaaugccucaaccccaaccuuuccacccucuuagguuacuauuguuaacuggauguuuagcuauuuaaacuuguuugcaaccuguauucguuaauauaguuucuaaugaaagagcauacuacacauacuggucugucacuugcuuuuuaauugcuuaugcugccuugaauauauguguuauuacuauuugaugacuuaggcucuugauugccuuacacgcaucucaccauuuucugucuucucuauccaagugaugcaucaauuagaccauuguaauuuaugauuggaacuaguaggagagacuagaacuggagauaccaaugccuucaguauaccaaaagaagcagugaaaucuguuagggugaaagcguaagggaaggacuguaagguucauuccaagcucugaggucaucaaguuugcaaaugaguaaagaagacucagaacaaggaauuuagaaaucaugauaugucggccgggcacgguggcucacgccuguaaucccagcacuuugggaggcugaggugggcagaucacgaggucaggagaucgagaccauccuggcuaacacggugaaaccccgucucuacuaaaaaugccaaaaaauuagccaaaugcggugaugggcaccuguaggcugaggcaggagaauggcgugaacccgggaggcagagcuugcagugagcugagauagcgucacugcacuccagcccgggcgaaagagugagacuccgccucaaaaaaaaaaaucaugauaugucuccacuuuaaugucucauuguguuguuccucauuauuagucucucuacagcauuuuuuguuguuguuguuaauggcaucaguggcacaagacagaaauguaaaugucauucaugauacuuauaucuuucuuaucacccacauugaggauaucaccauauggcaccuauuuuuccaccaguguaugcaguuguuccucucuauccguggggaauugguuccaggacuccucgcagacaacaaaaucuguagauacucaagucccuuaugaaaaaugauguagugcaguuuguguauaacuuacacacauccugcugugugccuuaaaucauuucuacaucacuuauaauaccuaauacgauguuaaugcuacaugaguacuucuuauacuguauuguuuagggaauaaugacaagaaaaaaaggcuguaacagacucagccauucauuuuuuuccccugaauauuuucugucuguaguugguugaauccauggaugccaaacccacagauacagagagcugaguguaugucaaguuugcucacucuguuaccucccaugaucacaaguuacagucaucuugaacccauacuacaaucauagcuuucacacuggucugccuacaucuguucuugccucacuuuagugcauucuccacauugcauugaguaugaucuuucaguuacuuuaccuuucuccuuagaguacuuuucaggucuucccaucuucugaaguucaaaguuucuaauacagcauauaaaauccuaaaugauuuggcucucuuuuccuugccacuuuaucuugugucauugccccguuuagucuuuuuuggcccugugauucucaaaguguguucuauagacccccaaaggguuccugagaucauuaaggggaucuauauggucauaacuauuuugaugauaguagaaugauguuauuugucuuuuugauuucguugacauuuuuaucgauugugaaaaagcaugguguuauucacugugcacuuguaauaaaaaugucgguuucauuuuaaaaugcccuugacguugcaguaaaaauuauuaauuuuauuaaaauuuuaacccaugaauacacaucuuuuauucugagaugaaugauacauaugcauagaguacuucuguggcaugccaaaguaccaugcuuguuucagggagaugugaaguucaguuacaagcugaacuacuugcuuguuucuuggaauaccauuuuuauuugcaguaaugacugacagacaaacuacgcccauuugcacugcguuauuugacaguuguuuuuugaaaagugaaugagaaacaucucccauagugagcuugauagcuucccaguauguagacuuuucucauggagucugauauuagagaguguaauuuuccaauacuggauaaugaaaugugucaacauuuggaauauuuguauacaguggugaaccaauauuuuccaaaugaucaaugcaugauguuucaccaguaugcauggguaaaguucuuuaaaaguauaaaauauaucaguugaucuuaauguaacagaguuugagaaguucauugguaagauuucagauaccacauuguaaccuuuaagaaauuaccacuugucaaguuuuugaauaugcaagcauuuuaaaauauucuuuuuccaacuacauauuuguguugggucagauguuuucacccacuucugcuaaaacaacauuuuauaacacgucgaauacggaggcagguaggagaauccaaguauccucugauacuucacauuuuaaagagauuuuuaaauagguaaaacauugucacuuuuuucauuaaauuauuuuuuucuucagaaaacaguuauuuuucaucaaauuaugcuauuuuaacauuuaauggguuuauuauuaaaugaauuaauauuuaaauuucacaccuugaaauuucuacuaugguaaauaccaguaaaacaaggaaacaaaagcucuucagggugcuuaauauuuuaaagauauguagagggaucuuagaauugagaacuguuccucuaggcauauuguucuuucaguuccuuaaaugugccauguuucuuugcuauggggauuucacucauguucuuucugcauggcuuuucugccacuucaagggagcaaauguaugaaacucucuuauucuuccuaugaauccccucauuuuguuagagaagcauuuuauuaucccauaacuuaggacugauugccccuugacuuacuaguccuuuaaauuucucuuaaguaaaaccuugcagcuuaaaaaaaaguugcguuaauuccuaauaaccacuaacauagaauauagucuucgugaggacugggacuuaccuuuuauucuucugucucccaauucuuguauugaguaagugugcaauaagcauuuuuuggagcaugugucaggcccuaugcugacccccaauaagacauuggaaaacaagguuaugacaguuuauucuuguguuugauaguccuucagcuguuaaugacaguuuuuauaccuccccauucuuuucaucugugaauucuguuuugcuuugugauuuaaauaauucuguuuaaaugagugcuaauuccaaaaaaaaaaaaaaauugcaaaguagugaauauaauccuugccuucccaagcugcauacgcagucccugugaauucauuuguguucuucccucuagacuucuugcugugguuuuauuggucauauaguuguggcuacaugguuuuuucuuuuaaaaacuacuuaugcuagcuuaaacuauuuuuaugaccaugaaguagugugccucauucuauaaaacugauaauaugaacaaaauacaagaaacaauguguagauaaaccuuguuaauauuuugaaauguucauccuuuguuuugugucuuauauuuaugcaguugacaucuuagaauguauucugauuuuacauauagccaacagauuaggugauagcuaaugugacuagcugauuuacuacuuuuuucaccccauuugagauugaaauuuuucaccccauuugagauugaaaucacuuguuacuaaauguaaguuucauguuacaggaaacuaccacucauguuucuguuaaugugaggagcuacuaaguugcuuuuauccaaaucugcuuuuguagcagggaaacucgugccugcuguuuugucaguuuucuuaauaccaugcccaugauucaagcacuguguaagaguuguguauuuauauguucuaauuaaaauugaaguugcagcuauaauuauuguugugacuauugcuuuuuaaaaauuaucuucacguguuauaaaacuugucuuuugccauuaggaaauggaaaggucaguaguugcacagcugcugaggguaguuucacaucucucacuggacuuuuggaaguugaaccucugcacuuuacuugugugucaacuagugauggaaccagaauagaaagggaugaugcaaguacguuuacugguauauaccuucuuuuauuauauacuuuaugcaguaauaaagugauauuuauauauuuaaacauuauuucuaauuauguaauuuucauugcuguuaaguggaaauuuauuugugggaggggcauuugggggaaauauaaaucguuuuauauucuuuccuaagucaauucacaggguuauuuuucccccuguacccacuuagaacagugucuuaaaucauucuguuuuuauguguaugcacuuucagaaauuuuuuaauuugaaaaauaucaaauauguuggaaauggaagaguaaaaauagacuacguguuucuacuacugaaugauguuuuugagaagguugagaugaguaaagagggaauacuguuucucgaacuaguuuaaaacaaccuugaauaugugaggaacuauuuggguuuguugaauaugugauguucuugguguguuaaauaccuucacuuaaaaauuaaguuuuugaccaucaaucaguggaaacuuguuuauuuucuuucuuguuuucugugauuuuuuuuuuccuucucacguaggaagaucgguauuuauuuacaguuacuucuauugcagcauaaauaauagaagucuuucaguuaagauugguuuaugauuuuauaucuguauuagucacugaaggguuugacuguugucuuaacgugauucuucuguugaugguuuugugucauuggguaccaucuuagucuccucaacaguuuaacaaaaagcaaaaacgguuugcuagagaagucgugaaaaauauaaucuuagcugguuccagaauagcaggagguuuuaaaaggaauuuaucaguucuuuauuugagugucuuuuuguuaggaauugccuuauauauccaauuguggagguagcuacuaagugaaauucacaguuuauguagugaauaugagcuuuuuagauuaaaaaccuaauauuuccuuuauauggugauucuagaaaggucagaauuaauuuguauuuguuuucuuggacuauauagucauuuuguagaaacuuuuacauuuacacuagaauagaaacaugccaugacaaaaaauuugaacuuucagaaaauuauuuuauuauaaaucaggaccuuucguggaacuguauugaaauuaauuauccugggccuggcgcgguggcucaugccuguaaucccagcacuuugggaggccaaggugggcggaucaugaggucaagagaucgagaccauccuggcuaacacagugaaaccccgucucuacuaaaaaauacaaaaaaaauuagcugggcauggugguggugccuguagucccagcuacucaggaggcugaggcaggagaauggcgugaacgugagagguggagcuugcagugagcugagaucgcgcuacugcauuccagccugggcaaacagcaagacucugucuccaaaaaaaaaaaaaaaaaaaaaaauuaaguagccugguuugagacaagccuggucaacauggcgaaaccucgucucuacuaaaaauacaaaaaguauugcugggugugguggcaggcaccugccuguagucccagcuucuugggaggcugagguacgagaauugcuugaaccugggagguggagguugcagucagcugagauugugccgcugcacucuagccugggugacagagugagacuccgucucaaaaagaaaaagaaauuaaguauccuggauuuuuauuuuauuuuacaaaaauucauguguuugcaaaaggcacauaauuuuuaaaagauaaaagguuagguuugaaaaaguuuuucuccacacuccccacccauuucucccccugcaaagcaagcaauggaacgaguuucuugucuuuacagggcuagucuguguauauauaugccaucaccucuuuauuucacccaaaaugaaacugccuaaagagagauuuuuauuaaauguugaggcaaagugcugacuagugauuauaaggagcugaaagaugauuguagucucucaauccuguuuacuuuuuugaaacauguuaauauuaauauaauaucuaugcggaaaagugcagaaaauaauugcauagcucggcaguuuaucaugauacacauugucugugugaugaccaauaaguaaagaaagaacauuuccagcaccccaaaaggugucuucgugaccacuuccauuuauuucuuccucauuuucuccagaagcuaaacaucauccuuuuggaguaguuacuuuuugguuuuuguuuauuucuuugaauaaccacuuaaugaugcauucuugaacagugguugaguaaggucuguauaacauagaauugcacauguauguauauuugguuugccuucuuuucaauccuaugauuauggcauuaaucuauaucauugcauauagacaguugguucuuuuucauugcuguuuaggauucuuuuguccgaaugcaacaaaauuuauguauccacuauugguuuguauacugcugauagacauuugaguuguuucauuguggagcuaauaguacugauggauauauuuuugucuugaauaugaauguggaaguugauucacugcuucauaggguauucauauauucagcuucaguaaguaaguaaccuuuuugcuacugguuccucuuuaaauacuguggagucaaauacucagaguauugaucuugcaaauuuguugagaauuguagagggucaaauucuauaaauauuccauccauacuuaauaauguuaacucugcacuuguuggugaaguguacucuauauauccuuuuggucaaguuugcuaguuguguucuucaaauucucuaucuuuauugguuauuuuaccuguuuguuuuuuaguuaaugaggccaguauguuaaaaaaugguagauuuguuuauuuuuugucaucaaguuuuauacacuuugagaccaucauauaaauuuagaaugguugugucuuucuugggaauucuucgaucauuaugaauuaucuuuuauuauuauuuuuugagauggggucuugcuauguugcccaggcuggucuugggcucgaaugucccuccugccccugucucccaaguaccugggauugcaggcacacaccacugcaccuggcauuaguuaucuuuuuaucuuuaaguuugcuauuucuccgaggauuuaccucgucugauguuuacuuagcuaacaccagccuucuuuggcugcuauuuguaugguauauauuuuuccaucuuuuuacuuucaacuuuucaguguuuccuuauguuuuagauauacuuuuuauaaguggcauguaguugcauuuauuaaaaauccagccugacauuuuugucuuucaaugggagaauuuaauucaguuacauuuaaugugauuagugauauauuccuguuuaagucugccaugauuuuuuauauguacuauucuauuucucauuguccugaugguugguuacaugcuucuuuuuccuccuuuucuguuuuuagggcugauuauauuuuuuacuggucaauuuuuccauuuuuuucuugaaccguucuuuuaguaauuguaucauugagaucacaguauguacucugauuccagaaguauauguuuuuucccauaauacauuauuaaugcucauaauccagauuauauagucuagauuccagaaguauauaugaauucccaugauacauuauuauaauuuuuuauauucaguauucacuuggauuuaccucauaauuccauuuucauugauuuuuauuccuuugucuuugagcuuuuaucugguaugauguuucuuaggucugaaaaauacucuuaagaucucuuuuuguacuuaucuacugaugacacauucaauuagguuuuuugggaaaaaguucaaaguuuuaugaauaaucaaaugaacaaacagcauagccauuauccagauuccaauaucauuguuauuuuuucacauuugucuauucuuuuuucuuugccaaaauacuucaaaacagaucuaauaucugauaauuaccuaaauuaauuauaauuuauuaugaaaccaguguuguuguaaacaaucaguuuugcagugucaucugauuuucaauacaugauuaaacaauauaauauagaauucuauagggauucuaaguuacuaguuauuuuuacuggugauuuaaagguaaucuuuccuugucucuuagcuuaguuuguauuuguucgaagucaucugucagucuuauuauugcuuuuuaaaggucauuucucaaacuuucugagauugcccuucugcccuuuuuuugcuuucagaauuuuucugugauguuucuacaugugguuucauuuguguuuauucugcuucagauugauaggacuucuugaaucuuuaguugauagccuccugaaguuuuagcugauaccuuucacagcuuuagggaaauagccaguuaacucuuuaaauauugcuucugcucuauuuugucuccugucuuuuugagucuccauuuuuauauauguuguaucucaucaucauaacugauagaauuuucaauuguuuuaucucuccuuaguuaauuauggauauuuucuucuaauccaucuuuuuuuuauacuuguucuaucuucugcuaucuaaucauuuaugggaaaacuacucugcucccacuuuacugcaguguugccucuguaguaaguaucucauauauauauaugggucuguuucuguuucauuggucauuuauuuggccuuuuguuaauacucuauugccuuuuuuuuuuuuuuuuuuuuuuuuucugauacagagugagacacucuguaucccaggcugaagugcaguggcucaaucuuggcucacuguagccucaccuccugggcucaagugauucuuccaccucaaccucuugauaguugggauuauagacaugcaccaccaucagugaauuuuuuuauguuuagcauaaaugagguuuugccauguuggcucagcuggucuugaaucccugaucucaagugauuugccugccucggccucccaaagugcugggauuacaagcgugagccaccgugcccagccucuauugucuuagcguaacaauagucuuaguguuuauaucugauaguaaaaaucuaccaacguucuuuuuagguagguuuuaaaaauugauuuucuaauuuuuuuuuaaaauaaaacucacaguguuaugcaguuaucaccacuaucuaauucuagaacauuuccaucacuacaggaagaaacucuucauccauuagcguuuucucccauuccccccaaacccuuccagucacuuggcaaccaguagauuggaguuucauccauuuagccuguaucaguacauuacuccuuuuucuggcugaauauuccauuuuguuuaggcauucaucuacggguaaagauuuaggcgauuucuucuuuuuggcuguuaugucuaaugcugcugugaacauguuuguguagguuuuguuuuguuuuguuuuuuguuuuuguuuuuuggucaauguguguuuucaguucucuuggguauguaccuaugaguacaaccuacaaauauucuuuuuauuaaagauuguuguugcuauucuaggucuuuuguauuucuguuugaauuuuagauuucauuugucaauuucuacacaaaauacuuguuuuuaaaauuuagggccuuuauguaaaucaguuuaggagaauuggcauccuaauauugacuuuuuaaaugcauuaacacuuguguguguguuuuucuguccccuuaaauccagaauacacacuggugguauauauucuauaauauauuuaggucuuugauuucucuugguuaugcuuugugguuuucaacauaguuuuacauuuuuuuuuuuagauucuuaguuauauauuuaauuguuauguuguuauaagcgaucuuccucuuaaucauuccauucauuugguauuuguguauaaaacuauaauugauuuguauauauuacugucacaucuggugacagugcuauauuauuaauuuuaaaaguaguuuauaguuugcaguuucuuagagaauuuuuaauauguugcaaucauguugucuauuaauaguuuuacuuuuuucuuucucaucauuuuaucgucguuuuuuccuuguguuauuuugugcuuccuaggucuuccuauauguuguugaauagaaaugguaauaguaguacucaucuuggucuuguucauauauguauuauauuauauauaugauauaucugauauagauauauauaucucauaugugauauauaucauauaugauauauauauaucucauaugauauaucucguauaugauauauauauauauauauauauauauauuuuuuuuuuuuuuuuuuuuuuuuugacauggagucucgcucuguugccaggcuggagugauggcacaaucuuggcucacugcaaucuccgccucccggguucaagugauucuucugccucagccuccccaguaccugggauuacaggugcccaccaccacacccagcuaauuuuuguauuuuuaguagagacgggguuuugccauguuggucaggcuggucucgaauuccggaccucaggugauccaccugucuuggucucccaaagugcugggauugcaggcaucaggcaccaugccuggcccagcccuauauuuuuuuauaacuagaguuuuugaggcccuuuguaguauaaaaauagaaaaagauauugaaaacucggauugugcaaaagauuucugauuaguucuauaguaucaggauggcuuauuuuuccuuggauuguuuacgucuucuguuugcuuguagugauucacuuaguuuucccuguguuauuugggcguuagauuuuaaaaucaauuaaauguaaauguucacaguauuaaaaaccauauauauuaccccaaaauacaagcaugguaugaaugauuuagcaagucuaacaguuuccccuugacuguugggauuaauagcugucgauuugcuguggaacacuugaaggagcagaugauuuuauuuugggacuacgcauguuuuaugagaugcaauugcucugcucugcucugcucucuucucuucucuucucuucucuucucuucucuucucuucucuucucuucucuucucuucucuucuguucuccucuccucuccucuccucuccucuccucuccucuccucuccucuccucuccucuccuccccuccccuccccuccccuccccuccccucuccccuccccucuccccuccccucuccccuccccuucccuuuuuucuaacuccaucacccagacuggagugcaguggcaguaucucagcucacugcaaccuacaccuccugaguucaaguguuucucaugccucagccuccugaguagcugggauuggaggcuugugccaccaugccuggcuaguguguguguguguguguguguguguguguguguguguguuuaguagagacaaggucucaccauguugaccaagcuggucuugaacuacuuaccucaagugauccaccuaccucagccucccaaaguguuaggauuacaggcgugagccaccaugccuagccaauugcucauugaccaagcuuacaauguugaauuuguguccacuaaaugaagggcacaguaugacugcacuguaaugagugguguuuuuuuuuuuuuaacauaaggaaauuuaauuauaagaggauaugugcaguuuuuguuauugguauauuguuuauuuuagcuuauuuuuuaauuuuauuagaauucuggcacaauauagcccuuguuugcuuuuaaaaagaugggcuguuagauugccuggauuuuccccuuuauccacuaccuaugagcaaauuacuucccucagcuuuaguuucauuuuguagaaaaugggauuauuuuuguaccucauacguauaauaguagcaacaaaaacuuugccuaguuaguacuuaauacuuuuuucuugccgagauuaaauaagcugauguagcuuccaugcuuaacacuaugcccuucauuggcuuuggcuucacauacgcuuugguucugauccuaguucuacugugaguuuacagguuaauuucucugagccuucuuuacuuaaucagcaaaaaaauaaaaauaaaaaaaaaaaggugggggggaucaugaugccugggccauaaaguugcccauaaagugaauuguaguuauucuuuaaaacaaugccacaugguaaugcauacuaaauauuugcuauucuuauagcaguuaucuuuucccucaauguaacuuuguaguaaaggccuguuagaaauauuuaugcuguuauuaaacuuggcaacuaccuuuuguuuugugcugacauauuggauuaaguugugaaaugaaguuuuuaucccagcuuuuccaauauauuucucauaaauauuggaaaacaaugcagaaagaauuauuuauaauguuguuugaauaacaaugaaauggaaaaucaaagaaaucuguuguaggguuucacagagccuuuauuacugauaauguucauggguaagaagugugugcuaguuuuacugugugugggauaugccucucuccauuuugguguucugggguccuuuugguaggugaagugggguguguuguugcaauaagaaaacuuaguaaagcaaauuuauuucuuacccucaaauuguguaauaagauuacuuucauuuuuaaugaucacuuuacuauaacaaagauauuugcaaacucaucauugcugggcugggcgugguggcucacaccuguaaucccagccuuugggaggccaaggcuaguggaucacuugaggccaggaguuccagaccagccuggccaauauggcgagaccgcaucucuacuaaacauacaaaaauuagccaggcaugguggugcaugccucuaaucccagcuacucaggaggcugaggcacaagaaucucuugaacccagacguggagguugcagugaaccaagaucacgccgcugcacuccagccugagugacggagugagacccugucucaaaaaaaaaaaaaaaaaagucauuccuguauuuccuagaucuugaaugauaguauuaucaauauacuuuauuuuaccauuguuuccuuauuuauacuuuccagauuucuuuuuuagaaugaaaauuaacuauaguuuuagcaucauaauagugccaaaauauuugaacauguuuugucuuuaaccuuuucuucauccugguguuuuuuguuuuuguuuuuaccccuugucuuaugccagugaguuccuucgggguuacuccugcaguagguggacuaucaucugggacaguuggggaagccucgacagcccugaguucagcagcccagguagcuuugcagucucucucucaugcaauggcuucagccgagcaacagcuacaggugcugcaagagaaacagcagcagcuuuugaagcuucagcaacagguuggagacuauuuggcucuuuguucaugcugucucuaaacuucaaaagcugaaaaaguacuuuaaaaaugaccauuauuuucauaaagaaacguagguugacugaucugagcuaaucaguuucaacaaaaauugagguaaagucuuugugauauuuaaauugguuaaaauuguaugaauacaucuuauuugauacauauuugagggaauaugauugauauuuuuugugcaaucuugaaguaaauccauucucuacacacucgaucaaagaauauguacaguuacuaguuacuauuuauauggaguauaguuccuaaaacaaaauuuuauagaacaguuaaauuuaaugugacuuaaaauucacuaauaaugacagaugcuucauaaauuuuauuguggccuaaauuaggggucuccagucccugggccauggaccaguaccaauaaauagccuuucaggaacugggcugcacagcaagaugugagcggugggcaagcaagcaccaccugagcuccaucuccuuuuagaucagcaggggcauuugauucucauaggagcaugaacauuauugugaacugugcaugugagggaucuagguugcauguuccuuaugagagucuaaugccugaugaucugagguggaacaguuucaucccgaaaccaguccccugcgccucugccacaucuccccgcauccguggcaaaagugucuuccaugaaacuggucccuggugucaaaaagguugaggaccgcugguuuaaaugaaaucuuuggcaauuccaggugacaaauuguauuacauuagucaacaugagaauucaacuccuuauaauauuuuguuuugagcagauauuccuuauuuacauuaauuguucugcuuccuuuucaccacuaccuugaaagaguccuaguucccaaaugcacaggaaauuuuguguuaaacauuuaaaguguauauagcaaagcaaugauccauuuauaucgaguccaguuuugauuuaauuucaucuuuaaguaugaucaauuuaaucauguuuaucuucauaauauauguccaugugguauucugccacaauuuagguaggcaggauuagucuauauauguugcuuuuacuucuuuugcagaaagcaaagcuggaagccaaguuacaucagacaacagcugcagcagcugcagcagcaucagcaguagguccuguucacaacucugugccuuccaacccaguggcugccccuggauucuucauucauccaucugauguuauuccacccacuccaaaaacaacaccucuuuuuaugacuccaccacucacuccacccaaugaagcaguuuccguugugauuaaugccgaacuugcacagcuuuucccaggcucagucauugaucccccagcagucaaucuugcugcacauaacaaaaauuccaacaaguccagaaugguaaauuauguuuuaaauagguguuggcuuagacauuuaaaaauaucuugaaauauacucuaacuuuagaaggcaaaauuuuuaauaccaacuagauguaucaaguuauuuucuuuuauaaaauauuacaguacauacauuaagagaagaaacuuauuaauuugcuauuaugguuaguaguuuuuauagaacuauaguaauaucaauauaaaguuagauuuuuuuuuuuucccugcucuagaauccacuugguucuggucuagcccuugcaauuucucaugcuucacauuuucuucaaccuccgccucaccaguccauuauuauagagcgaaugcauucagguaaucuuuuacuuucuuaaauuuuuuuuuuuuuuuuuuugcuuagucugccggccuuuuaaagacucauuauucuucaguucgauuuuuuuuuuuuuuuuuuuugcaaaucgcguuuccucuuggguuaaguacauuuuaucaagaauaagcacuuacauguucaagcuuugugcucaccaaauugcauaaagagugcuguugaguaauggauuugaucuauauaugaaucuugccugcugauacauuauugacauaaauaauuuauuguaguuggucaaaucaccauuauacuagaaauuacacucaaaauauuccuaaaacuagccuucuuauaguagaacucuuucuugagaagagcaaacagaacuacugcuuacuguaauaacuggauaagaauaauaacauauccuaggcucugaauaguuugaauguuaccugaguuugucuucugcuuauaugcuacagaacugacauugggauagaugcuuucaaucacaacauauuugugaauaaacucuaggcaacuuuucucuuaaaacaguugguuuuaacuaccaccaacauuuuugugcuuuagcagcaguagaauucaacaaaauccucagggaaauaacaugguuauaguauacacuguagcauguaucauuauaugaagaauuaaauaguauuugcguucuugcaaugugguuguuuccucuuuguaagagggaguuugaaagcuaaaauaaaagucuuacaguauuuucugcccaacuaaucauucauugguaacaacauuaguguugaugacauuuagaguggaaauuuguuauucugaagucuuaugggagaugagcaguuguuuacacuguaguuuguuuuuuuauacauagcaaugacuguaguacauaagccuccugaggaggauaacuauguucuuucuuuuuuuuuaauaauuuuucuuguuagggaaguauuaguaacugccuuguuuucuuuuaaacuagcucugucgagaauagcacuauuccuagaaguuuaauuuaguuguuuuccuucacuauaaaauguagcugguaagauuacuagcugacccaccccaaaacaauaaggaagaaaaagaauuaugacauuauuaaugaucugccuucuguuuuuuaauugaacuuauucuuguaaugugggugaaaugagggauguaaaucugcuuuuucuuuaccuaucucaucuggcauugagcugaagagacugggauaugucuauacugggaaaaagcauuguuugagauccauuagaggaccuucccaaggccuuuuucagugguauuuugauuauauaugauuguaguccugcuuucacuuuggaucuaaaccccaaugaaugcaauaugcaacuucacaggaaguuaagcagggcuuaaggaaacuaaaucaaauaauacuauuugguauuuaaaugcaucuaguugugaaauuaagaaaaaaaguugccaauggcugaaagaagagcagauugauccuuuacaaaauuaacuaauauacugcauuugcugauuuaauuuuuuaaaacucugauguuuuaaagaagcuuguuuguauagugguugauugccuuaacuguaacaguagcagucuuacuguuguuuuuuuguuuuguuuugguuuugguuuuuguuuuuuaaagagacggguggcuaggugcgguggcucaugccuguaaucccagcgcuuugggaggccgaggcggguggaucacgaggucaggagauuaagaccauccuggcuagcuuggugaaacccugucucuacuaaaacuacaaaaaauuagccgggcauggcagcgggcgccuguagugccagcuacuugggaugcugaggcaggagaaaggcgugaacccaggaggcggagcuugcagugagcagagaucgcgccacugcacuccagccugggcgacagaucgagacuccgucucaaaaaaaaaaaaaaaaaagagggguuucgcuguauugcccaguguggaguauaguggcuauucacaggugcaguagcagucuaguguauugcagccuggagcuccucggcucaagcaauucuccugucucaggucccccaguagcugggacuagaggcacuugccacugugcccagcuacucuuaauuuucuacuuacgucuugggguucaaaacuaacacagacugggauuucagaaaauuuuugaaucaauugacaaggccauuuuuacauauuuacuuuuccucuuauuuauaguuuagugaguugcuuucauauuuuaagaugagugcuccaaauuauuuuugaguguaucauuugguuaauugauauauuuuuggucaacuguuucuucuuucucucauaggagcaagaagauuugugaccuuggauuuugggaggccuauauuguugacugauguauugauucccacuuguggagacuuggccucuuugucaauugacauuuggacauuaggagaagagguggauggaaggcgguugguaguggcaacugauauaagcacucauucacuaauucuucaugacuuaauaccaccucccgugugcagauucaugaagguaaagaacuuuaagaaaguaaauugauacgcuuucuauguuucugacaaguuaugaaaaaugaauauauaauuaaaaaauauaacuaucuuuuuaaauacauugcucagauuuuuauuguggcagauguguauauauguauauuuauaauuuuucauuucagaucacuguuauuggacguuacgggaguacaaaugccagagccaaaaucccauuaggauuuuacuauggucauaccuacaucuugccuugggaaagugaacugaaguuaaugcaugauccucuaaagggagagggagaaucugcaaaccagccagaaauugaccagcauuuagcaaugaugguugcuuugcaggaggauauacagugcagguuaguacagagugcaaauuuuaauguuauugaaacuuuguauuuuauauaaugucuugcuuauaauucugucaagaaaugucuuuucauagguguacagauaagagagcaagaggaaguaggagauuagcacguuacaauaacacuuaaugcgugaaaauauugugauuaauuaaugggcuccauuuauuaguaccuaucaaguggguaauucuuuuuaaugguuguauguuaacagguuuaagagauuuaauucuuaguauuuguacauguacauaaagaggacauuacaagaauuauuuuguucaaucuuuuuuuacuuuagguauaacuuggcuugucaucgucuggaaacccuuuugcaaaguauugaucuuccuccucuaaacagugcuaacaaugcacaguacuuuuuacgaaaaccagauaaggcaguugaggaagacaguaggguuuuuucugcuuaucaagauuguauucagcuacagcuucaacuaaauuuggcucauaaugcagugcagaggcucaaaguggcgcuaggugcaagccggaagauguugagugaaacaucaaauccagaagauuuaauucagacaucuuccacagagcaguuacguacuaucaucagauauuuacuggacacuuugcucagccugcuucaugcuucuaaugguuuguauuuggcuuacauauuuuaaaggcugggaauauacuugaugugauuucgcugcauguuuuaggaucugugucaauauuuucuauuguaaauuuugguauuuuaaaaaaugucaguauuuaugaaaugucucuuuagguuaaucuauuucucccuguuauuuuaaacauuucuuaaaugaaguuguguguguuuuuuuuggguuucugguauugacaugcacaucauugugcuacuggcaaaguauuaaguauugcauugaaguugaacagugaaacuuuucauaaauugcuaaccuaauauagagcuaucauuuucuagccaggagguauuuuugaucauuacacgagcucacacauucacugacacagccaucugacacauccagcuccauaggcaagaaauguaauuuacuuaagugcuaaauauuuucgucuccaaguauguaacagauuucuacauacaaggaguaaauacauugcagaauaaauagaauauaauuaucuacugauuacuagaaaagaggaaaguguauuuaggcaugcguauuuuaauauuauacaauacauuuaaauaggaaaguuuacuguuuucuuucuuguaauaggacacucuguuccugcaguuuugcagagcacauuucaugcccaggccugugaagagcucuuuaaacacuugugcaucaguggaaccccaaagauacgguuacauacuggucuucuucuuguucaacugugugguggugaaaggugguggggucaauuucuuucuaauguccuucaggaauuguacaauucggaacagcuucucaucuuuccacaggauagguaggucagaaaauguuggagguauuuguuauuaaugauguguacuuuucacaguuacugguuagcuuuugaaaucuuugaaauguggauacuaaguugugaauaugaagcagaucucagaguuugugaaaugaccagugaagggcaccagcacuguguaucgaagaagauaauaagugauaauuagagucuacucuuuaguuuucuaauugaacuuguggacuucauagaucuguguuuauaaguauuucuauuagauuauguugcuuuauaugcuaaauguguuuguuuguggcuaauaaaauucucucauucacuaagugcuugauuucuuguuaauaacauuagaaaauguaaccaguaguuagaaaaaaaacuaauuuuagcuucauaccuccagauacaaaucuugcuuucccagucugaaauaugguauguuuuaagaaagcaaauauucuaucauuacucuguuaaauuucuauguaaauuauuuuaaaaauugaacaaucgaauugauucuuauucuuuucuuuuuuguuuguuuuguuuuuagggucuucauguuacuuuccugcauuggucaaagaucacuuaguaauaguggaguauuagaaagcuuacuuaaucucuuggauaauuuauugucaccucuucagccacaguuacccaugcauaggaggacagaagguauuaagagaaagcaguguucuuuaguaaaaacaauauuccugcaaauauuucuuuuauaaaauaucuucucugaaauacuuuaauaauuauuugcagcacauuuaauauuuuuaugauguaagcuuuuaagaaugagcaacccucaugugauugacugccauauaguuaauacuuuuaaaauuuauuccuuuucauuauuugaacuuaguauaguauguuuuuccuguacuauuauaacuaaagucaaacucccuuacauaaguuugagcuguaaggcacaguuguuguucccaucaacaauaaugaguuuuguuugaacacacuuuuuuauaggaauaaaaacauuagaaccuaguuuagugcuauaugaauuauaaguugagaguuagauguuuuauuucaguuccugugaaucuaagaauaguaucuuauaccuugcuuucuaguuuauauaguccauuuuggauucagccugcacuuaaucuguucuuauaccuugaagucuuugucuuucauuagauuugauguucuacucaguuucuggcuguuggugucuauuuuuuagacuuauuacauauaaauauuaguguuaguaaugauaagauauguuuuggauuuauagaauguuuuguuucacuuauauuaucagaucuaauuaggaauccuaaagucaucuggauguuuuuccuuugcugucaucucucuccaggaguacuagauauucccaugaucaguuggguuguuaugcugguguccagguugcuggauuauguggcaacuguugaagaugaagcagcagcugcaaagaaaccuuugaaugguaaagacagggagagguuucugacagguaucagaaguuuauaauaauauguugguggggauuuugagugacuucgcaguuguuccagaacuggcuauuggccuggagcuaccagcuguauguaauuuaaggaaaauacaaaugaacuucacuacaauucuguuuaaagauaacauuuauacuugguggacuuuauagacaagcuccuuugucuggacaugacuuuuaguuucuaaaugcagcuaugacuuuugcaaggugucuucccucaggcuuguuuaaagacuuuauaauagcaugcauguaaguuaguuaugaaagggaaaucagaguuuuuauuuuuucuuaguaugaugugucauuucauuuagcauuauugguaucuacuaauuaacuacaaauggccuguauuuuuaaauacagaaauucucagauuuugaguuguaagcuuucuuuauagguucaaagcacagaaaaauuuaaaaauuaaaggaaaucaaccugcaacauuauuuuauuacccucuucccaguuaacaaggcuuuuuauuuuucuuuauuuuuauuuuuccucagagauucuuguucugaaaauaaggguuuuuaaauaaaggauuugagauaccuaaauccaguauguaagccauugagauauguaagccuacauaugcuuacauauggcuuacauguaguauguaagccauugaaauccauaaaauuuggaauucuguacauugucaggaacucaguauuuuuaagaguucccuugagauguuauaguggaaucaguuguuuauagugcauauuauguuuaggaagaugauggggaauucauauguauaaggaauuugcuuuauauugauuuuuaaaaaauaauguauaucuaugauuaguuuacucaguuguaggauauagagguaagaaauacaauuaacauaaauaaaacuacauucauauugagaaagucuugucucguucuguggcccagguugaagugcaguggcacgaucucagcucacugcaaccaccaccuccuggguucacaggauucuccugucucagccucccaaguagcugggauuauaggcguguaccaccacgcccggcuaauuguuuuguauuuuuaguagggacgagguuucaccauauuggccaggcuggucuugaacuccugaccucaagugacccacccgccucggccucccagagugcugggauuacagaugugagcuacugcaccuggcugagaaacagucuugaaaaaaagaaaaauauaaaauaaacuguaauguaaucuuggaauauaacaguauugggauuguguuuauacauguggcuacuauggaaacauugguggaagaguuuuaggguuugaagaacuugaacuaagauuugauaaguagguaggaaagagagaaaaauguuuuuaggauuaggaaaagauguuuugggauuggaaauggguguaaaguguguuauugggcccaaauugaaugaaacagaauagucuggaaauauuccaaaaaaggagaguaaguauaguuagacaguuaugcguucugaacuauuuaaccuuauuuugguaguuauuaguuaaauuauugaguauccuuuuuugguuccugauuaaaagcgucuguguuugaaauaggcaauaguaguauuuguuguugaaauugaaugacaucaucaaaguuguauagagauuaaucuuaauugcggaggaaaauagcuauuaucuaaaugaaagauuggagacagagggaacucugguuuuaaaaugauuuagggucuacauuagauaauugacaguuauccagucuuuauagaaucagaucuucuagcaauuucuuuacaauguuuuucuuauuaaaacugcuuuucaugauugacacauguauaacuguguuuuuuguuuucuggguaggaaagguacuuuaaaaucacauuuaacagaauuauuaauacaaguuuuccuucgccuguagguaaucaguggaguuuuauuaacaauaaucuacacacucagagcuuaaauagaucuucuaaaggcagcaguagccuugauagauuauauuccagaaaaaucagaaagcagcuuguucaucauaaacagguaauugucaauauauuuaaaaauuuuuaauguuugagaauauuguuuuggaguuugcaugagacagaugugccaucagaugugagguauaacauuuaaugggcucuuagcuuaggaaaaucaucuaacacuuuggagacuucaauuuccuuaauuguuaaaaugacgacaauguauaguuuacagacuuuguugauguuccuuuaacauuuacuguuauacaucucuauuacuacuauucuaaaugagguugucauuaucuuuugccuaguccaaaaaccucucuuccuuuguucugcuuuaauucaauccauuuuccuucauguaauucucuguggcuuuuguuugaccuuuggaugaaggucaaacucuuuaacauggcuucaggguauucaucuucugccccucuaucuagcuuccagauuuuaauuuugguuucuuuuuccaugucuuuuuucuccuuuuucguguguguguguguguguguguguguguguguguguguguguguauuuuuuuuuuuuuuuuuuugagacagggucucauucuauuaccuagguuggagugcaguggaacaaucauaguucacugcagucuccaaauuccugggcucaagcaguccucccgccuuagcuuuccgaguagcugggauuacagcugugugccacagugccaggcuaauuuguaaauuguuucuuguagagauggggucucgcuuuguugcccaggcugcucucaaacuccuggcucuggcgauucuucuacuuuggccucccaaaguguugggauuauaggucugagccacuguguccggccacacaauauuuuuauuauugcuuuaagauguaagaagauucuauaugaaaauccuuagcucuggcauguugugaaagcuuugggcuuuucaaauuuuuuguuuuguuuuuuauauuuaaaaaauuuuuugauuuauggggcuuuuuuuuaaagguagacuuggcaauacguuuuuuauuuuucacuucuaaguuuuucagcuaugagcuaguucaauccuuugcaggaaaaaugagaagcauuuuccucaauuaccuuuucuuuuugagaccuuuaaccaauuuuagguaguaguaauuuguaucuuuuaauguuuauacucagugcauuuaauuaggauacaaaacaaaaccuagugugucucugagugaauauuugucuguaaaauaucauuauuugauucuucauuaugaaugacaguauugggacaguuggcaaaacuuaaaaggugccuugagggauaauugguggucaggugucaguauuacuucucucauuuugaugguuguaacugugauuuguagaagguuuuuauuucuaggaauuauaaacgaaaguaaucagggcgauuagucaucagguuacuaacuuacugccaaauggcuuagugaaaacuaguuguauuuguacaauaauuaaaacuggcuguuucagaaaaaauuaaaaaugauuuuuuucuugauuauauuucuugcauacguuaaugguagaacuuuggaaauuauuuucugaaaauacugauuuguagaaauucucaguuaacguuuuaaaaauuauguguacaugcuaguuuuaauuuaggauagaguuuuuuucaucuauggagauaacagccaaguggauuuuuaaaaauaacguuagugauguuuuuuuuccugauaccaaaaacaggugucaggcagggcucacuuugggagguugaggcggguggaucaguuggcaccaggaguucaagaccggccuggccaaugugguggcgugugccuguagucccaguuacucaggaggaugaggcaggagaauccuuaaaucugggaggcagagguugcagugagcugauaucacaccacuaguccagccugggugacacagcaagacuaucuuaaaaaaaaaaaaaaaaaaaaagugucaauaguaguaauuuagaaaguguucucugagaaggaagacuuaauaagcugcuaacucaauuauuauucauuuauaauuguggcuauaccuuucuaguacuuuauauuuaaaguaacuuucuguguacaugcuguauggagaacacagucaccagauuguaaggucuuuaugaacagagaguuuuuucucuucuuuggucuguuuguucauuguugucaacugcugauugcuguuguuuagggaugggggagauaggauaggagggaaguguggauauacuuauaaaaggauaugagggaaccuugugguggcauuuuuugguauugacuguuguggauacaugaacuaacacauguagaaguguauccaacuaaauacguacacagacaaacacaaaugagugcaacuaaaaauggaaaaauaagguuggcaaauucugucaaugucaauaccuugugauauuauccuauaguuuuugcaaaauaucauuagagaaaauuggguaaaguguacaagagauuucuguauuauuucuuaauuuauuuauauauagcuuaauuauuucuuaagcuacauuguagcaaaaaacuacaaugaucucaauccaaauuuuaauaaaaaauauagacauaccaaaauguguacuacucuugagauuuccauaaaaacaaagcuaagaaauauuaagcaauaaaauauuuuucucauuuauuuaauuaaaaguaaauuuuuuucucucuauuaaaaaauauauaucgcucgauuauguuaguggcuuauauaagaaagucuuccaguuauuucuuacucccauggguaagggagauuuuaaugaaaacagggagagaucucaaagucaggauuugaaaugauuuuuuaaaaaauuaucaucacaguuaaaauuauacuacaucuuucaagauaaugugcauuccauuaguuugauguaugaauucugugaggaguauaauaauuuuuuuguuuuuaacguuguuaaagauuaaguuguuuauuuguuuuauaaagcaacuuaaccuacuaaaagcaaagcagaaggcauugguagaacagauggaaaaagaaaaaauacaaaguaacaaaggaucaucauauaaacuccugguagaacaagcaaaacuaaagcaggccacuucaaagguaugaucuauacuuuucaauauaguuaucucagaaaagucaaggaguuaugaucuuuaauuacgaucgagaaacuuaaauauacauuacucugcuuaacagagaagccaaccuacucuggacuuuuuuuuggugggguaguuuaacugaaggaaauguaugauaaaugugguauuuaaguauuauuguaauguauuaccuucauuguggauugaguuccaguaaauugaagauaaaggauaguggaauguauaguuuugcuaauguggcauugauagagcaguuuauuuccauuuuacaauacaaaauuauacaagaugauugcaaauauuauuguaucagccucacaaauaaaauguauauguaaagugaaaaauguggcauucucuuuacccuuaguauuguuauuggaauauuuugguggcugaguuuagaauugaaacuucuuuggguccaguggugcucacaaggcucaaauguaguaugucuuuuguaagugaaagugaaguucaacugauuuguaaguuuuaaaaccuugguguuuacuuuuuaaaauuuugagggauaccguguauguaucaaacaaguuuguagucuuucuauaacaugaaauuaugauuauuccgccagauuuugaaguaacucgaauuaauauuuuguacuugauguuauauuaguuuucuuuaccuucaagcuuuuacaaauuauguuuaggauguuacgguaauauuuauguuguuagauuugacuuaauaacuuaauauauuaucuacauugaaugucuguagaauuucacuuuucugaaacucuguuacauaucugauacuuuacuccaaauaggaaguaagguauauuggucaguuuagcuuuuaauauucuuacuuuugaaacuuacaguguaucuaaaaauuuugcucuuuagaaguuguaauauggaguggauauuuucauuacauaaaucuauacugaaaaaauuuucauuaaguaaacauugauuuaaacacuauacauuuuugugugcagcacuuuaaggauuuaauucguuuacgucggacagcagaauggucccguucuaauuuagacacagaaguuacaacagcaaaagaaaguccugagauagaaccacuuccauuuacucuggcccaugagcguuguaucucaguaguccagaaacuuguucuguuucuucucuccauggacuuuacaugucaugcagaucucuuauuguuuguuuguaagguauguaaacuauaaguguagacuuacaggguuggccgggcgcaguggcucaugccuguaaucccagcacuuugggagacugagguggguggauuaucugagucuaggaguuccagacuagugugggcaauguggcaaaaccccgucucuacaaaaaaaaaaaaaaaaaagugacuuauagguuaauuaaaaacuagcaaaggaugauguuuuuagucaauuuucauuaagagaaaugaugccucuuuugguuuugcuuuuuugcaguuaguuuuuuuauugugucuuaaaagaugaaaaaaauucuuuucaaauuuuuccuuaaggaaaucugauuuauauuuuaauuuauuuaaaacuugaggguuugaaauguaaguaauguggauauguuuaucuccaaccugccuuucuuauauuaauuaaaauaggaaauacacaaguaagugucaaauuauauuaaagaaggacuuuugacuggguguggugcuucacaccuguaaucccaacacuucgggaggcggaggggcggaucacaaguugaagagauugagaccaucauggccaacauggugaaaacccguccuuacuaaaaauacaaaaauuagcugggugugguggcaugcaccuguagucccaguuacucgggaggcugaggcaggagaauugcuugaaccugggggcgaugagguugcagugagcugaaaucgcgccacuucacaccagccuggcgacagaccgagacugucucaaaaaaauaaaaaaagaagaaggacuuuuaaugucaugauugcuuuucuguggcauauucacuguucguagaaauuuaauucuuaacuauacaauuagaucuuaaaccagauuuuaauauuugauucaugaaauuacauucuuuuuugcauuccaucucaagcaauuuuuuuugauaccagacucauacaucauuguugaaaccuauuguucagugcuaaaguauugguagacuucuguuaguguuugaaaaaacauguaauugcuauuuaaguguaugauuuuauaaaauguauuacagguucuugcacgcauugcaaaugccacgaggccaacuauucaucugugugagauugugaacgaaccccagcuggaaagacugcuguuacuuuugguuggaacugacuucaauagaggagauauaucuugggguggugcuugggcucaguauuccuuaacuugcaugcuacaagauauuuuagcagguguguuaggauuuuucuucauagaguaugucaaaauuaccuugucauugcucaacuaagaaucuucaaagggaucuuuaaccccuagagggaucuuuaacccccuaaaagcauaaaggucuguuuaaucggugugauguuauagcaguagcaaccauugaaaauuacuuuuguauuuaaguauauugauagucgcgauaaaugcaaggcuuuagaaaggcuuuggguuguuaaagugcaugaauauuggagcuagccugcuuuauuauuaacaucagugguaugcugcuuacuggguggggaaaucacuuugccucauuuucuucauauauaacauaaggauaauaaggauaaucuuuguauaagguuguuuuuaugaauaagcguguuaauguauguacaguaauuaaaauaacucuuuguacauguuauguguuuacuggauacuugucucuagcauuugaaaguaauggagugaguccuagcauuccuuacgggggugggaacucauuugccucagauucuuuuauaguuaguagagcauuuauucugucagugacuaaacuggaggaaaaaaaugugcuguaauacauuuucgaaaucuguauaaauuauuaaaacaggacuauccccuuacauacaggagaauuacuggcuccaguagccgcagaagccauggaggaaggaacagugggugaugauguaggugcgacagcuggugacucugaugacucccuucaacaguccucaguucaguugcuggaaacuauagaugaaccuuugacacaugacauaacagguaaaguuuuacauuauguuucuucuuuauucuauuaaauggaaacauguuucaaaauaaagaauguuagagaaaaauaaaguugauuuuuauauuuuucuauuaguucuuuggccuuauaaacuagauccauuauuuuccugguaaauacauuuuaucuugguucucauuacaacaaaaugcuauaauuucauaauauccuaauuauguugauauagugugauuuggcaacgaugaagaaaaugcaauguagaaaacauguaaaaauacaaagugaugaagacagcaguuuuaaaagcucuuauucuuuaagauccagcaugugauuuuuuugguguauuuuuuucuuacuuuuucuuuuuuuuuccuuuuuaaaaaguaucuuuauaaauuagcauguauaauccuuuaucaucuccauaccccuuacuuuucaaaagucuguuuuggguacuaaucuguauaugucagaugcugcagucauuuucaaccauuugucauuccuuaaucuuauguuugcucaugauuuucuauuuuuuacuugauauucucuuuaucuggaguagauuuccugugugcacgaugaacacuucguuaucgaagguucacauaaagcgugccuuucucuaagaggcuuuuucugucauucccagcagaguuagggacuuugccaucuguacuucccuugcgcucucaaauaucucugcuagcacauaucauguuguagucaguuuuaauuauagugcacccccaccucugaauuucucuuaauuuauuggauuggagaguuuuauuaaucuucauguacuuauacucaaacccucauacaggcuggcauuuacuaggcauucuauaaaguuauguugaauaagaggauaggaaugauggaaaaguaagaguuauagagggguacuuauaaggguuauaagaaagcuacuuaaaaauuuggagacaucugagagacaauaauuucuaauucauaacagaaaaauaagguaaauggcuuuuuuuuuuuuuuuuuuuuuuuuuuuuuuuuuuuuugagacggagucuugcucuugucacccaggcuggagcacaauggcgugaucucagcucacugcacccucugccuccuggguucaagcgauucuccugcuucagccccuggaauagcugggauuacaggcggccaccaccacacccagcuaauuuuuguauuuuuuguagagacaggguucugccauguuggucaggcuguucucaaacuccugaccuugugaucuaccugccucggccucccaaagugcugggauuacaggugggagccaccaugccuggccgguaaauggcauucuuacaacuucaguccuguuugcuuuucucuuuaauacuggguaacauuaccuguaauaaugaauuacauguuagauguaauagaauguauauuauuuaguaauguugguaauuauuuuuaauagcaaaguuuaugcaacuuacuucaauaagagcuaauacuguggucuuuucucuaggaaagcaaauaucaaugaaucuuuguuuuuaucguguauuauggagcgaaauguuugcauacauagaguuuuuuuuuuuaggcauauguaacaugcaaguaaaauaacuuuuuuuaacuaaaagcauuaugucaucuaaauuuuaugugauacacuccaccaauaagaucacuuuuaauuauuugaaggugcaccuccucuguccucuuuggaaaaagauaaagaaauugaccuugaguuacuucaggaucuaauggaaguugacauugauccuuuagauauugauuuggaaaaggacccucuugcagccaagguuuuuaagguaugauacaugagaauagucuuugaaaggaggccgggcgcaguggcucaugccuguuaucccagcacuuugggaggccaaggugggcagaucacaaggucaagagaucaagaccauccuggccaacauagugaaaucccgucucuacuaaaaauagaaaaaauuagcuggacgugguggcgggcaccuguagucccagcugcuugggaggcugaggcaggagaauggcaugaacccaugagguggagcuuggagugagccaagaucaugccacugcacuccagccugggugacagaacgagacucugucucaaaaaaaaagaaaaaaaaaaauucuuugaaagggaaguuuucagucucauacuuuuggcuuaguaauuacuuaaaagaggaaaauauacauacauuaccacuaaugcaacucauuauucagcauuuucaaaaugaaauugcuauagguacuacuauuguaguuuaaaaacaaucaauggaauaguauaaagaaaacuuacauuuuuauuaauguagcuacucauaauuaucauacaauaaugagaacuacauuuaaguauacagaaguauaguuauagaucaccaacauuucagacagccaucuaaacuucauccgagcuguguucauugcagagucuacuuguauguuagccuacuuuuuuuuaaaggagaaucaccuguaauaauuuauggugguacaguucuuugguccauaagagauuuuauuagggaugcuacuuucaguuucuaaacauauaagguauuuuuagauuuuggcagaaagugaggagaaaauuacuggaccauucuuauaaaucauuaaaauuauaaggggauuugggaaauuuaaaggguggauagaauauuuauuuuguaguucuguuuggguuuagauaauguaaauaacgugucauucagccaagaggcaaaaauaaaccacaguuuuuuuuccauucuuuuaagccaauaagcaguacaugguaugauuauuggggugcugauuaugggaccuacaauuacaacccuuacauuggaggucugggaauuccuguagcaaagccaccagcaaacacggagaagaacggaucacagacaguuagcguuucagucucucaggguaaguguauguuuauauuuuaagacauaugcuauucuuaaaacaagucugucauuuauguauacuuugucccuugagaaguugagccuggguguaugccaguggguuuaguaucacagcugugccgugaguaccauucagagcuguuucuuuguagucacuuuagaggaacuucuaucuuuuugguucucugucagaauaacaccuagcaaguguuguaugggauuggcaaugauuuuaaugaacugugcuguauuuuaauuguugacuuuaauaguaaacuuguauuuuauuuauaaagagaaugaaacuacauuaaauaaguauuauuuuugcaguuuuuuuuuuuuuuugagauggagucuuguucuguugcccaggcuggggugcagugaugugaucccaucucaccgcaaccgcugccucccaggucgaggggcuucucuugccucagccucuugaguagcugggaguauaggugcaugccaccaagcccagcuauuuuuuguauuuuuaguagagacagguuucaccauguuggccaggcuggucucgaacuugugaccucaaaugaucugccugccucggccuccaaaagugcuuggauuacaggagugagccaccaugccuggcuuuauuuuuacacuuuuuuagucauguagaauauaugagauguguuuaauuuuuuaauaaaauacauuuuuucccuuuucaacgcugcuccuucuguuauaaaauauuuuuuaaaaauuugaaacacacauuuaccagaauguuucaaguuaaaugcggagaauguuuauucucuagaaccauuugagaguacguugguaauuugaugucauuuuuguuuuguuuuguuuuacaaaucaggacauucuuccauauauacauaucaagaaguauauucccucaaaaucaggaaauuaacguuacugcugucaaauacugagagcccauucaaauuauagcgguugucaaaauaauguuccuuaugcacaagagcccagggaaaauaaugcauugcauuuaaucgucacgucucuuuagucucauucagucugcaguaguuccucauaguugaccuucaugacauugauacuuuugaagauggcaggccaguuauuuuguagaaugguccucaguuuguguuuguaugcuauuuccuugugaauagaauauugaguuaaugcaucuucgaaggaauauuccacaaauaaugcucccccccaacauuucauucaauuaggguggcccaugauuuugaucucucucauuauuggugauguuaaguuuaaccacuugaugaaugaguugucuucugggcuucucccuuguaaaguuauucuuuuccccucuguaaaaauguuuuguucucauuggguuuuuggggguacacacauggucuugcucugucacucaggcuggaguguaguggcaugauuuucaguucccugcagucacugccuccuagaaucaagaagcaguucaccauuuugaccaggcuguucucaaacuccugagcucaagcaguccgcccuccucagccuuccaaauugcugggauuaaaggugugagccauugugcccggcugcuguaaaaaguuuuuugggggcuggggagcagaaugguacucggaaacuauaacuauccuguuccucacaaaguuucuuuuugaaaaaauuacuggccaggugcgguggucacgccuguaaucccagcacuugggaggccgaggcagguggaucaccugaggucaagaguucgagaccagccuggccaacauggugaaaccccaucucuacuacaaauauaaaaaaauuagccagacaugguggcggguaccuguaauccuugggaacugaggcugagguaggagaauugcuauaacccuggggcagagguugcagugagccaagaucgugcugcugcaguccagccuggacgauagagcaaaacuccaacucaaaaaaaaaaaaaaaagaaagaaagaaagaaaaaauuacuguaauaguuuauucguucaguuuugaacggacucaugguugccuuuuuuuauucagugaauuauaccuuaccauuuuuuuaaauuguggaaaaauguaaauaacauaaaauuuuucuuuuuuauuuguugagauagggucucacuauguugcccaggcuggucuugaacuccugggugagcccaguccuucaaccccagccuuucaaguagcugagauuacagcaugcuguaccacaccuggcaaauuuauuauuuugaccauuuuuuguguguguauaguucacuguuaaugaagauauucacaauguugucaucuguuuuuugauguucagauugucucaaauuugaccaauaggaucccccuugagauuuucucaucauuuuagcacuuccuuguucucuggcaaaacaugauagcccaggcucauccuuuacuuuaaucugccccaccccgggaauuagucacuucuuaaaggagcaugguauuucaaaaccuuuuaaaggagaaaugugguuaacaaaccaugauuucgucauggauauauguguugcuauuuugggacuguuuucauuuccucgugguggacagagcuagggaguauguguuugugugugcgugugaacacacacacuuggcaucuauauuucuguaucugucuaucuauucugaauaugaugaauucacaucaguguaucuggauuuaaucuaacuccauaggguucauuuuagcuuucuucuugucuguauuuauagcacuuuauucugacagugagaaaccugguucucauuauccuuaaugucuuuguuuccauuauuguuacuucacuuauuuaauauuucugucucuauauaaccaaucgccugucucuacccuccuuuccacagauauucuuccccugcuguggcuccgauacugcauguuagguggcuguucuguaagaacacacucuucauccucucuuggguucagaugucaucauuuuauuguaggagguaggacaugaguaauaauugucaauguuuucuuuuucuuucaauugcuuuuuguagcccuggaugcucgccuagaaguuggacuugaacagcaagcagaacugauguugaaaaugaugucuacucuggaggcagauuccauuuuacaggcauuaacaaauacaucuccuacauguaaguaaaaugaccauuuuuagaguauugcagugaaugauucagcucuucaucauuuucagguggauucaucaaggacagauuuuuaaauuccaugaugugagucugaggggacuuaguauguagcacuuuccuggcuccgaguuaguagcaaguugaaaacuaagacaaaggauuaacaaaugcagagaguaucaugcaaaauacuuccauguagugcugucaguucagugcagaaaccuccauuguguuuuguuuacuguauuguuguaagguuaauaaaauuccuacagaagccuucauaccugccugugaguucauugcacuauuccaaauuuaugaugaaguagauuuuuuguaguaacaucuuuaucauccuuaaagacuaggauagagaauauaguguaggaugacagccaaauaggccuguuaguugaaagccagaauugagaggauuuacuaccuaauaaccuacagaaaagaaaggccaacuuuuucguaaaggacuaauaguaaauauuuuaggcuuuccuugccauaugguguguauugaaacuacucaacucugacuugguugcaggaaaacagccauagacaauauguaaaugaauggguauggcuguguuacaagaaacagguagccugccagagcuggccaucacauuacgguuuguuuuccuugaugaggucuacacaagucuggaacuggguagaccucggaggaguacaguugaaauagcacgguguuuuucaaggacagauuggggagcugugcuuagaagagggugcugguuuuuguuuucuuaggccugcauauugcuucaccuucucuaggucagagugaagaagggguagagauaguagguagaaccgaauaaaauuacagaugcuucucuuauggagaguucacaacccauuucaauagagaaauuugaguuuuuacaucuuccuuauguuaaauugaauucuuucagucugcaaucuucauuuguuucuugcuuuagaggguaucaaaagaagggaaaaaagaaaaacagaaggaauggucuaguguucuauaaucucaguauugguacacaaauauucuuguaucuuaucucccaggcaauauggggaucccuuuuguaggguccagugucugcaugauuagagauaacucgguacugcccaaaguaacccuuuucuuuguuagacauuucuuauuuaaaagcacuuauuagaauaucuuuucguaauucugaaaggauauuugaaaaaaaaaagaauaaaaaagaaaaucuguuugaaauuggugucuccucuuuaucuuuugauuauccugcacacagcugucucucuuuuuaguauaauaauaaaauaaggcucuaaauauaugauaaagcucuuaguauccuuguauuucucugguucccaugaauauauucucauuuaauuaguuuuguguguaaccugggcaucagaacuucugaaagcuccccagaugauucuaaucuauagucaagguuaaagaugaaugaacuagaaucuagauuauucuaaaacuaccuuaucaauaauuagucaggagucuuauuucuuucccuuuacuuucccuccuuuauuaauuggaaaaaaaugcaaauaaaaauugcuagaaaaguucuuugccuuuuuuuguugguuugaguccuaugaauuugggaacuucucucuuuggucauugucuuuuuuacuuucaaguaauguuauaaaaacacguuuuucaaauacuaaauauuguuuugaaccauucuaaagaaugcaguuuuaauuuuuaaaaacaauuuaaccuauuuauacauaugaauaaccaguuaacacauauccugauacuuuauguauaaaauuauacuuguguuuaauuuucaguaucacagucucccacuggaacagaugauucacuucuaggggguuuacaagcagcaaaccaaaccagccagcuuauuauacaguuaucaucugucccaauguuaaauguuuguuucaacaaacuuuuuuccaugcuucaaguccaucauguucagguaugaauucaggagaaaugguguauuuuuacauauuauuguuagccugguaaaagaugaaacuaauugggaaguucauucuaauccugucagggaugauuucuuuauuauauucaguuggaaaaauauuagaaauacuuugauuaccaaaguaaucacaguuucucaaugauggaacauugauaauuuuuaagauuuuuagcuucaguacuuuaauuccuacuacacauacacacagcugugauuagagauugaaucacagggcaugguggcuugaguuuguaguccuagcuacucaggaggcugaggcaggaagauugcuuaaggccaggaguucgagaccagcuugggcaacauaacacuagauccugucucuaauaaaguaaaaaaaauuaaccaggugcaguagcacaugccuacagucccagcuacucgggaggcugaggcgggaggauggcuugagcccaggaguucaagauauagcagaccuugucucaaauaaaaaaaaaaaaaugacuugaaucaccuguuuuaauuuagaagaaucuuuuuaugagguaauuucuaacauuuaauucagguaaauuuuguuucuucaagaauuuuaagauguguuugcugaucaacuaauuuaauuaacuagaagaugcuuuuaagugugaagaaguguuuaauagaaaagguuauuuacucgugacaagaauuuaaacauaagauuuuuguuuaaauuguauuucauauuauaauagguacauuuuucuccuguugauuuucauucuuuuucaguuggagucacuucuccaauuguggcucacacugagccugaauucuaguucaacuggaaacaaagaaaauggagcagacauauuuuuauauaaugcuaauaggauaccuguuauuucauuaaaucaagguaagauuuauuaggagaaaaacauuauagucuaaauagcaagcuuaaaacguaauuauuagguuaaaauauaccuaaucuuugucauuagggguuauaacauucuaguggggaaaaaacagaauaccuuuuuaaaaagaugcacuaacuuaccgauuagcaggaaagauacagggagaccuuguugagaauagaagacuccuacucucuggucugugguaugccuguaugcaacuaaaauuuacaauguucuguuacuccuuuauauuuucuugaaguuuugucugaucuguaaaagcaggucaguuuuuuauuauuuuuuuuuuucauuuuuuaaaacuaugaguuagccccuggaggaguuagucagcuggagaagguggucaguuuccuguggaaguuguguguguuucuuggcaaaauaugaguaugggaauggugguaguaaaauaauacaacaggaaaagaauuagcguucagcucuagcuacaggaaucuauuuuaguuauauuuaaagaaaaauaaaaaugagaaucuguuccugaugcuuucucucuauagugaggcauccuguagcuugcuugggucuuacaugguguauuuuccaaugugagugccagcuccacugagucacgcacagauucuacuuacaucugcacugucucagcaccagccagcccuucuuuaauuuauagguuuccaucucuucaacuauauuauuauuauaauaaaauuuguuuucaucuguuuuuaauuuuauuaugagaaauauuaaauauauauaaaaaauaaaagaguaaaaaauaguuauuccuggcugggcacaguggcucacaccuguaaaaccagcacuuugagaggccgaggugggcagaucccuugagggcaggaauuuuagaccagccuggccaacauggugaaaaaaauacaaaaauuagccggcuguguugacgcaugccuauaauaccaguuuuuccaguaucuguuacuguuuucaguugccaguuuuguagagugugaggauuuuuaguaaauuguauugaaguagaaaugccuaugguuuggaaaguacaacauacugagagugauaacaugucauuucagguguugugggcugagcuuuaaaccuuauccuaaaauguuacugauucuuaaugcguuaguuguauuuaauggagaauuccuuuuauuugcauguuuugaagacacugguuaaggagcggauuuaaagaaauagugucuuguuuuuaaauuuauucuuuugacuuaguucuucauaaacauuguuuuucugaaaaauauuuucccuuucucuuuucugcauagcaucaauaacuagcuuucucacaguguuagcuugguaucccaauacuuugcuccggacauggugccuugugcuucauagccuaacacucaugacaaacaugcagcuuaauuguaaguucauaaauuuauucauuuaaaucucugacauauacuuuaguguucuacuauuggauucuuaaaacagaguuuuccaaggagugguauacuugucaaagugguugaguuggccagaugugguggcucacgccuguaaacccagcacuuugggaggccagcacggguggaucacuugaggucaggagcucgagagcagccuggccaacauggugaaaccuuaucucuacuaaaaauacaaaaguuagugggcgccuguagucccagcuacuugggagggugacgcacgaaaaucacuugaaccuggaaggcgaaguuugcagugagcuuagaucacgccacugcacaccagccuaggugacagagugagacucugucuccaauaaaagugacugaguuuuuucuucuaacaugucucuucugaauuaguucuuauauauccuuugugcuuguuuacuuugauaauauagucucauaugucucguuggauguucaaaucauauuuuuuaccuuuuaaaaacugauuaaaagaaaauugauugcuuuuagaguacaaaggcagguuuuuacauuucaucuaaguuuuuauguuauucuuuuaagauaccuuuguacuuaaaaaugauuuauucauuauuauauucauaaacaugcauaacuagauuccuggguuuuguuuaauaauuuaaaucauugcuuagcuuuaaaaugcuauuaucuuuuuucauuuggaauguauuuuccaaaaaugagaucaaaagcaucacugugauacugaagguggauuucaugcaaaggauauuuuauucaucucagaaaacuguuguguuaccuguacguuaguucacaguuaaccuguauacaacuaacaugcaaaaaggaauaauuuugcuacaacuuauuuuagaaaacuugauuaaaguuuaccugaaaaguagaucucugacuguuucuggaagggggaguuaguuagaauaggcuuuccaaauaagagucaggaccuaguuauaucuuuucuguuugacuguacuaaauaagauguacauuaagcucgagguguuuucagaaucagaagggggcagaagagauagaugguagauagagagggaaguccugcuuagucaauauaguagaaacugaaaccccuuuaauaaacuguaauuacuaggaauguaugaauuuuccuuggaacuaaaagaugcuuucagauacugcauuuccauuauuucaugguccauuucuuaagagguuuuuaaaaaauguuuuauagcugguuccagcagugccauuggaacucaggagaguacugcucauuuguugguuucagauccaaaccuaauucauguauuagugaaauuucuuucuggcaccaguccacauggaacaaaucaacacaguccacagguaauaugauguuuagccuggcauaugcccagacuauucaauaaacaguauucguaauguaaagcuauguaacuuuuuuauugcuaaaguauuaaauaauagccuuuuauguaucaauauaauaaaaaagguuuuguuauuuguaauaauagcuauacugacacuaaauaauagcaggugguaaguuaaccucuuagaacagugauacuagguuuucauauagauacauauuuuuggcauuaauuuuggauaauuggaaacauucugaguaaauacugcaaagguagagaagcauuucaaaaauuuuggaaucaauaaauuuuaauaugucauauuugauuacuucuacuaucaagauuaucaauucaccuuaaucauuuuaugauguuaaugauuuugcuuagcaaaagauaacaauauugcucaggacuuauaaacauuuucuguuucacuguaaauuuuccuuuauaucaauuuaauuucuuguuauguuguacugcuucuguguaaauauuuguacuucauuauauuucuuuuaaaguaaaaauauauuuagcauuuauaacaucuuuuaaaaucaagauuauucaagauuaucuugcaaguuuaucauuuuaaacuucuuggauuugccgucagauaaauucuaauuuaguuguccucaacagcccaguuucucuauuaauucacuuauucaguguuuaggaggcuucugugugcuuguucuagguacuagacauacaguauuuaccaagaucaaauaucugccuucauagagcuuuaguuaauacucuaauacuuaauauauuuuaauuuuacagaucuuaauaaaauaaaugagacaaggaacaaguaagagagaagaaacuaacuuacaguuagauugggacaggguuuugguaggggcagagacauguuaucaagugauuauuguacuuaaagauugauugaauuucaaacaggaagacuccucgggaucaccaauucugacuuaauuguuuuacauguaagaaaacaugcaucagcuauauugccccaaauuacauaacuaguuaucuguauagcuagguaucagugaacaaggcauugcaaaaaauaauauuuucuuucuguuuuugaauaaaagaaaggaggaaauaacuuuuuaaaacuuuuuaaguuacugaagaucaagcuuuccuacugauaccuugguuuuauauaggaaguucugauacgaaagcuauaauuuguaugcucaguaucagaaauuaacuuuauuuaacucuaaaauaguuuggaggauuauauuguauuuuauuuuuccagaacuacuccaagguuuuaugaguuguucaucaaaucaaauuaggaucaaauaaaauaauauguagaaguguuagagcacacuucuaccucagguuacuuaauguaguguucacuaucauuucuuucauugaugaauuagaaguuugggaaagcaguuuuuuuuuuuuuugacuugguauaaauuuauuuuuauuuaguuuuuguuuuguuuuucacuuagcuuaaugcuugcuuugcuaguuguuagaaacaugaccuuuuauggaucauuuuaccucucugcuccugaguuauuugauuuugaaaugggguaauuaagaagguuauuugugaaaaucuauguugaaguuauuuauacucuaaaaagcauuauaaaaguauuuauuguguaauucaggugaacuuuuuuuaguauugaguucaauaaaccuaauauaguugugguguauaaacuauaaugaaaaaguauuaacaguauuuuuauuugcaauucaaaauaaauacaucaagaccuaaaaaauucauuuccugcuaucauuguuaauacuuuuguuuuccucguacgaaaaguuacaguguauagcuuuugacuuucuacuugauaauuuuuaaaugaaugauuuuuuacauguuaccaguaagcaguuuucagugaauauacauuucucuuuagguugguccuacagcuacacaagcuaugcaagaauuucuuacucgauuacaagugcaucuuucuucaacauguccucagauauucagugaauuuuugcucaagcuaauucauauacuuucaacugaaagguaaauuuuuguguacuaauuuguuccugauauagaaguaacauguaauucuccaaauauacuuuucuuuaacauuuguugggaauuuaucugugaacaaauaagcaggaggacgguaguaauuaagggggaaggauauauugguguguuuccugauuguuuccauuucauuucauuaugguuuucucaaguccuuauaccucuacucucuuuaauaugaaaggaauacaguugacuugcuuuuaaugguuuuauagauuaguuauuauaagcuuuuuaaaaggugaaauuuauuuugaagcuguuuaaacucuaaagcuaccagugauuuuguauguaagaaaaccugaaaaauagagcuuauaaaagaaaauuguauacuaaucuuguguagaaauucuaaauaaauuuauuaacaaaaucagacuccauguuauaagaauaaauuuugaccauaauggguugauuauuauaaugcaugaaugcuucaauaucauauaucucuuauuaaugucuuuuuuuauucuauauuucuuaaaauccaacauuacuuucugaugaaaacuuuuuuuuuuuuuugacacagagucucgcucugucgccaggcuggagugcacuggugcagucuuggcucacugcaaccuccgccuccuggguugaagcgauucucaugccucagccuccccaguagcugggauuacaggcacgcaccaccacacccagcuaauuuuuguauuuuuaguagagacgggguuucacuauguuggccaggguggucucgaucuccugaccucgugauccgcccgccucagccucccaaagugcugggauuacaggugugagccacugugccuggccgaaaaguuuuaaugaauuauaaaguguuauuuuguuuuugaaguuacaauaaaacugaguauuucaaaaaaauccccauuaauauaaggaauagggcugggcucaguggcucacgccuguaaucccggcacccugggaggcugaggcgggaagaucgcuuaagcccaggaguuugagaguagccugggucacauggcgggaccccuucucuaaaaaaaaagaaaaagaaaaagaaauuagcuaggguguggguauacaccuguaaucccagcuacuguggagccugaugcaggagauugauugaaccagugagcccaggagguggaggcugcagugaguccugauugugccacugcacuacaaccugggugacagaacaacacucuuucucaaauaaauuaaugaucaggaauaagucaguagugacuauugccacuuuuuuaucuaauuuuauucaaauaaacaguauuuauacauacuuugugaggauuuugugaaauuuugaaugacauaauuaaaaucccgugaggaauaaagauuagucaucauuuguuuuauuuuucuuuuaacuaggcuuuuuaauuuuaacucugcaggcuuuagcauaauccgauccacagaguucacaacagugaagauuuucauacuaaacuuuuaauauauuugcucuaacauuuucuaaaggauuauuaaucuuguuuguaguuuagucacaucuaauauuuaagcagagauauuuugagguuuauacgccacagaaacuguuuaggaauuuucuccaccucacuucaccacacauauacccuguacauuuuuguggccuaguuuauuuaagaggguccacaaagcuguggcccaagaagaauguuaguuuauguuuguuuuuaauaaaggcucugguauucugugaaagauccagcagcucuuuaguuagauuaaugauauaauaauauacacugaaagaaauacucgguauaaagaaggcauucaguuuuaucagaugaguguuuugcaaauacuaucuauuggucuuuggacucuguuuucacuuuauuaaguagccuucaaaaagcagaaguuuuaaaauucuagauguaaucuaaauugucaacuuuuauguauuuuuuguuguuguuacccuccucacacaaagucuuaaauacccuccucacacaaagucacacagaauauuauguuuucuucuagaaauuuuacaauuuuauguuuuauauuuaggcuuguuauuuuuugcuuucaggaugaaguuuuuuuuuuuuuuuuuuuuugccuguggauguccaacuguuccuauaucuuuguuucuuuuuuugagacggagucucucucugucacccaggcuggagugcagugguacgaucucggcucacugcaagcgccgccuccuggguucacgccauucucccgccucagccuccugaguagcugggacuacaggugccugccaucacgcccugcuaauuuuguuuuuguaguuuuaguagagacgggguuucaccguguuagccaggauggucuugaucuccugaccucgugaucagccugccaaagugcugggauuacaggcaugagccaccgcaccccgccuucguagaccauuuuuugaaaauacuuuccuuuuuucauuggauucccuuuguaguuuuucaaauaucaaucaaugauacuuguuuugaucuaauucauacacuuuuuuuuuuuugagacaacuuugcucugucgcccaggauggagugcuguggcgugauucagacucacugcaaccuccaccuccuggguucgugcaauucucaugcuucagccuccugaguagcugggauuacaggcccaucaccaugccuggcuaauuuuuguauuuucaguagagaugggguuuugccauguuggccaggcuggucucaaacuccuggccucaagagauccaccugccuccauuucccaaauugcuggguuuacaagcgugagccaccacacccagccucauuuguucauacaguguauuauauagaauuuauguuuuugucuguuuuuuaugcauuaccucacugucuuaguucccuuacaguauuuuuugaaauuuaguaguguaggcucuccaccuuuguucuuuauuuuuagaguuauuuuggcuguuuuaauuccauuccuuuuuccuuauaaauuuuacaaucagcuuauugauuuuccagaaaaaaaucauuuugagugagauugcaucauucuguagaucaguuugggcagauguauugcuuguuuggccauauugucagagaauacgguuaguuuaauuuccuccuuucuuaugcauaugucucauggguuccccuccccccauccaguuguacucguucggacuucaaguaugcuguugaguacauaugguaaaaguuacucuuccuucuuuuucucaaucuuaagaucuuaugaaacauugucuuucauaauuagauauguuacuagcuggagcucuuuuuuagauaugugauaguaaguugaggaaguuccaguuuguuucuaacuugcuaagaccuuaaaaaaauuaugaaugucucuggauuuuguuagauguuucccugcaucuguugaaaugaacauagauuguuucuucuuucaucuguucauacguugaauuauauugguguuuucuaaagaguugagaucucacuauguugcccaggcuggcuuugaacuccugaguucaagcaggcuuucagucucauucuguucuuagcuggcccaaucggcauaugccacuacaccaaguuugauuuuuuuugcuaagugucaguuaaugugcauucucaagguagacacccuuggucauaacauaucaguccauuuuauaacuugcugaauuuauucucugaauuuauucugaaagagguuguguaauauguguauugucacuuacuuaaguauuugguagcauuugccauugaagcauccuguggcuagaguuuucuuugccccaaaaauuuucaacuuauuuucuaggucuuggacuauucagguuuucucuucuugauugagcuuugguaauuuugugaaggaaguuguuccuuuacauuguuguauuuguuaguggaaauauguauauguauuaauguuuauaggaucuauaaguuuccuucauuucugauguugguaauuuuuaucuuuuuuuggggucauucuggcuagaaguucaucaauauuauuucaaaaaaaggcagcuuauagauuauuucuucuuuucuacuuucuuugaauuuaauuugaucuuuauggcuuagauaauugauuuuagaccuuucuuuucuaauacaagcauuugacaaagucagaauuggucuauauagacuauauagacuacauacauuuaauguaauuauugacaugcuggauuaaaauugaucauuuugcuauuuuucuauuuauuucaucuauuuuugauuccuuuuaagaaaucuuuuucuguugacuuuugaauuaagcaacuuuuaaaauaauuucauuuccauccuuauuuauaacugaauuucuuauuuauuuuugagacaguguuuguuugcucugucgcacagguuggagcguaguggugcgaucuuggcucucugcaaccuccgccuucuggguucacgugauuuucgugccuuaacuugccgaauagcugggauuacaggcuucugcuaugcuacuacacacggcuaauuuuuguauauuuuguaggcguaguuucaccagguuggccaggguagucucgaacuccugagcucaagcaauccacccgugucacuggcauuacaggcaugagccacugugcccggccuauaaccgaaaauuuuuaauauuaguuguccuaguuuuacaagauauaccuuuauuuaaucacauuccacuuuaaaauauuauuccguucauguauaaugucagaacuuaacaguguaguuucaguuccuuucuuccgucuuuugugacauaguugucauguuuuuacuguuuauauaugcuauaaacacaauacugugcaaccuuuuuuuuauuuuuuauuuuuuugcuuuagacagucuuuguuuguuuuuugaaauagacuuucgcucugucacccaggcuagagugcaguugugugaucucaacucacugcaaccuccuccuccuggguucaugcaauucucaugcuucagccuccugaguagcugggauuacaggcccaucaccaugccuggcuaauuuuuguauuuucaguagagaugggguuucgccauguuggccagguuggucucaaacucaaaaguauucuuuugccuuagucuccugaguagcuggaauuaacagucacaugccaucaugccuggcuaauuuuuguauuuuuaguaacaaugagguuucaccauguuggccaggccggucuugaacuuccuggcgccacaagugaucugcccaccuggggcucccaaagugaugggauuacaggcaugagccacugcaccuggccuaauuugccuuuuucuugcuguuagacugacuugcuguuagacuuuucagcauucuauaucuuaggcauaaacagaauuugaagagcauucaauuuugauacuugagaaugauuugauugaaucuuaauuuuuauguaucauuaucaguaggaaauguuuacaauagcguuauuugagaauggaaaaaauuagaacucauuucauuauaagaagugccuugugauuuugaaguauuuuugucuguagcuucaaaaucacuuccggauauacuugucccuuaguuuuguauuuggaagggagguuguuuuugaguuugucuaaaauggaggcaagaacaagaauuccaaaagagaugaaaacuauuagcuaccuaaugaaauagugaauaucaagaauuuguuuaacuuucuuguauugugauaaguuacuacuuucagaacuacuuaaaaucguuuaauuuuuaauccuuucucuuguuguaucucucucucucucucuuuuucugucucucucucucucucucugcaggggugcuuuccagacaggccaaggaccucucgaugcccaagugaagcucuuagaauucacucuggagcagaauuuugaagucguuucaguuaguacuauuucugccgugauagaaucgguuacauuuuuagugcaccacuauaucacuugcucagacaaaguaaugucaagaaguggaucagauagcuccgugggugcucgagcaugcuuugggggacucuuugccaaucuuauucguccgggugaugcaaaagcaguuuguggcgaaaugacaagagaucaacucauguuugauuuguuaaaacuuguuaacauuuuagugcagcugccucuuucaggcaauagggaauacagugcaagagugucugugaccacaaauacaacagauaguguuucagaugaagaaaaagucucaggaggcaaagauggcaauggaagcaguaccaguguucaaggaucgccugcauauguugcugacuuagucuuagccaaccaacaaauuaugagccagauuuugucugcucugggccuguguaauagcagugccauggcaaugauaauugguauguauugagaauauuaaucuuaccauugucucugauacuauaacugguuuuuuuuuaagcaauauauggauucauuuucuuuuuacuuuauaguguaaaacugcuuuaagcuuuucaugacugauuuuuauuggugaggacuucuguuuaggggcuucaauuaaugaaugaaagugaaauauugacaaaugucaugucaguuugguuuguuuucuuuuuauugagaugccucccagguucaagcaauucucgugccucagccacccaaguagcugggaccauaggugccugccaccacacccagcuaauuuuuuuuuuuuuuuuaccccgagccagagucuugcucccacgcuggaguacaauggcgcgaucucggcucacuguaacccccgccucccagauucgagugauacuccugccucagccuaccgaguagcugggauuacaggcgugugugccaccaugccccugcuaguuuuuuguuuuuguuuuuguuuuuuuuuuuuuuuuugagaugaagucuugcucuguugcccaggcugaagugcaauggugugaucucgguucauugcaaccuccgccuccuagguucaagcaauucucaugccucagccucccaaguagcugggauuacaggcaugugccaccaggccuggcugauuuuuuguauuuaguagagaugggguuaugccauguugggcaagcuggucuugaacuccugaccucaggugaucugcccaccucagccuccgaaagugcuaggauuacaggugugagccacugcgcccugccaauuuuuuuuuuuguacagacgggauuucaccauguuagccaggcuggucuugaacucuuauuucacaucauuuuguguugaagacaaguauuauuuguucacauuugcuuuaaaaauaaaauguaaaauuuuacucauacuguaacauuuucuaugacacaaaccaguguuaaauuuauaugcuguugcuuaacucuuuuaccucuuggaauguuaauacauuacauuaaauuuuuaaaauaaaugaacauuuguauacuguggcaaaauccuuuucuaauauauuuuugccuguugguauuuuuuucuuugucagugugugagaaacagccacaucuucuguuugauuagauuaaaaagaauaguuacaugcugguaucacauauuuuucuauucauguccucucuucuugauguauguagagugauguucucagucauauaacagaacaacuuauuuuuauuguuggugauauagagguauugucauguaagaagauagccauaaaccgugcucuacugaauauugucauugauauuuuaaucucuaagaguccauucggguuauguguagaggguuuagacagcuauuauauauucauucuucagcaguuuuggaaaaagugacuuuucagcuucuauauuuuaauuauuauuuguuucaccauguuggccaggcugguuuugaacuccugaagucaggugauccaccugccucggccucccaaaguguugagauuacaggcaugagccacugcgccuggcuggauauauauacuuuuaaugugguaucuuuuauuuuucuuaggagcaaguggauuacaucucacuaaacaugaaaacuuucaugguggguuggaugccauaucaguuggggauggauuauuuaccauacugacaacccuuaguaaaaaagcuucuacaguccacaugaugcugcagccaauuuuaacauacauggccuguggauauaugggcagacaaguaaguucaagccaacaacaguugcagugauucaaauaaauuuauugcgauguaaguggaaaauuacaggacaaagauaaauaaguauauuuauuauauaucggacaaugaaaagcaucaguacaagagggcuguggauuauuaauaaaaguuggagaauaaaguuucuuugaagugguauuuucagagaugaccacagugauauaagaguaaaacauuuaauguguuccugaguuuuagauuuuuuaauauagucucaagaaguucuucucuuuuuccuaaaaguagcauaguguaauacugagguguucuccauagauguuauguaagaagaaguaaugugaaaucuuuugaaauuuauguuguguauucagcuucuuuuuuuuccauuaaaagagauuaggcuaauuaaagaaaauagguuacaaaauuuuuccuuuuuguauuucauuuuuacaaaugaaauuguaggaaccagauuauuuuacuuucuuguccauuucccauuuugaaaugcagauauuagaacaguuucuuaugucuuuuauauagcaguguauaauuaucauuuuuguaaacauuuguugaauguguauauuucucuauuagaaaauacaaagguacuuuaaaugguucaaauuuuaaaugaaauuggugucuaaaugcauauuaagagaaaagauaauaauggaugaagacacaugcuuuaaaaaauucucugaguucagggagaugguuuuuuuauucagguaagauuucuuauguauuuuggcagacauuuuguauuuagcguauuuaaggcugucaguuuacaaaaauuaacuaggaaggaauauuacaugcauugaguuuaguucuuauucacaggaauauauaaagucauaauaugcauauuucauuuuuuagggcucucuugcuacuugccaguuaucugagccauuauugugguucauuuugagaguauuggauacuagugaugccuugaaagcauuucaugauauggguaagauaauauuucaauaacuaucauuuaaguguaguuaugugauaguauguuacauuuucauuuuuguagucuuuuguggaaguuuacuuuugauguugaaccaucuguccugagaucgauuucauuucauauucuuuauaaauuuaggugguguucagcucauaugcaauaauaugguuacuaguacaagggcuauugugaacacugcaagaaguaugguaucaacuauuaugaaauuucuugacucugguccaaauaaagcuguugacagcacauugaaaacaagaauacuagcuucugagccugacaaugcugaagggauucauaacuuugcaccccucgguaagaaaaguguuacuaaaucuuacuuaugugaaauuaucuaguuuauuagcugguaugaaacaaaauuaguugaagucaguugaugauguuauauaucacuauuuuaauuacaaacaguuuauuuuagagguaguggauaucucgacauucuacuuaugagagggaaugcuuuguuuguuuguuuguuuguuuguuuguuuugagacggaguuuugcucuuauugcccaagcaggagugcaauggcgugaucucagcucacugcaaccucugccuccuggguucaagcgauuccugccucagccucccgaguagcugggauuacaggcaccugccaccacgccuggcuaauuuuuguauuuuuaguggagacaggguuucaccauguuggccaggcuggucuugaaugccugaccuccagugauccaccugccucggccucccaaagugcugggauuacaggcaugagccaccaugccuggccgagagggaauguuuuaacaguucuuuagcaguaaaguuuguuuuuauuugugagucuaaauagaagcacaauuuaagaaacuaaacagagauucuuccguaaguuuucucuuuaaauguuaaucaauuuuaaaucucauuuuccuucuuaaaguggugcuguguuuuguuuugagagagucucacucucaccuaggcuggagugcaguggcacagugucucccggguucaggcaauucucaugccucagccuccugaguagcugggauugcaggcguguuucaccacacuggggcgggggguggggggguguuuguguguguguguguguguguguguguguguguguguguguguuuaguagagaugggguuucaccauguuguccaggcuggucuugaacuccuggccccaagugaucccccaccuuggccucccaaaguguuaggauuacaggcaugagccacugugccuggccuuaaaguaguacuaucuuuuuuaaaaguuuugaauuuagguauuuacuuuuuuaucuaguuuacauaguuucuuuuaaauuuuucuuuucauauuucuaaaucauagacauugacaucuuagaauaaagaugauuuuuuuaaaggugaaggauauauuggacauuguuuuuuacuuaaagaguuugaggcugggcgcgguggcucaugccuguaaucccagcacuuuggguggccgaggcggguggaucaugaggucaggagaucgagacugucccggcuaacacggugaaaccccgucucuacuaaaaauacaaaaaauuagcugggcgugguugcaggcgccuguagucccagcuacucgggaggcugaggcaggagaauggccugaaucugggaggcggagcuugcagugagcugagaucucaccacugcacuccagccugggcgacagagcgagacuccaucugaaaaauaaauaaauaaauaaauaaauaauaaaaaaaauuuaaaaaaaguuugaaaauuauugagcuacguuuauugcugugucuuuaguuuucguguaucauaugaguacaaaguagacagcaguuaauaaugaacuugucaccuugccaguugacaggauuuccucauguuuugugaauaccuuuacggucaugcuuaggauacuaagugcauuaccagcaucaauuguucauguuuucaauuaauuuuucuaguuuaauuguauuuguauagauuuuaaagcuuuauuauguuucuuuugcaaguucuuauaauuuauguaaaauaucuucucuagguacaaucacaucuagcaguccuacugcccaaccagcugaagugcuauugcaggccacaccuccucacagaagagcucgcucugcugcuugguccuacaucuuucuuccagaggaggcuuggugugaccuuaccauucaccuuccugcagcagugcugcuuaaggagauacauauccagccucaucuugcaucucuugcaagugaguaauauuuuauaaagaagcaucaugagaacaagcuuuaauuuagaaauauuugaaaauaaaaauguuuaguaagcggaaauacacuuaggugugauuaccagagaguguaacuucugaacaguuuuuauugaaauaauuaauacuaccaagucauuuuaggagaaaugacuguuaaccucagacaaaaagauuauguaaugaagucuaaacaaauauguuccaguuauauauuauuucgcuuucucuuuucucucaaauuuacuaagcuucaguauuaagcugaaaugaguucacuacacacccauuuuuuaccauguuaguuuuuucagcccagaccucaguccuagccuuguaaugugaaauuagcauagauuugugugccugcccuccaacuucuuuacaagauaacuaccuuuuugaauaauauuauauuuugacuacuucagugugauuuuaagauucauacuguguuuauuguaauaugucaguauccuuguaauauuguaucauucguuuguugcauguucauugaauacauuuuauugaacuuuguaaggcaaauaauucaaaauaauuuuuacaaaauacuaucacuuaagagcgugaacucuuucaaguauuuauaaagaauaugaaauacucauuugcuuuuuuuuuugaggcagggucucacucuguugcccaggcuggagugcaguuuugauauaucacuguagccuugaccccugaggcucaaaugauccucucaucucagccucauguauagcugggaccacaggcauguaccaccaugccuggcuaaauuuuuguauuuuuuuguagagacgggguuuuguuaugaugccuaggcuacuuucaaacuccugggcucaugggaucuaccugccuuggccuccuaaagugcugagauuacaggugugacuacugcacccagcccauuuuguguuuuauaugguucacaaaugcuuucaauauaguuauaauuuugccagaauuguuuaaauuaauacacaugcuuacauuuauugauugauucucauugcuaucaaauaucacucaauaauugcaugaggagcugugggaaauguuguagauuccuggcaucuuuggagaaaacaauuuuuuucuauguguuugcaagauuagacugauauagcuuaauuacuuguggcauccacacuccuuagauaaaaaacagauaauauaaagguagaaggaaaauaugcuaguacacgguguuuuaggaggucaaaaauaacuauauuaaaaggcaaauauaagucaauguaagacuuaggcuaccucuaaaauuggaaagagauugcuuuuauuuggaaagcaaaggaguuuggucauaagugguggcuuuugaaguucagcuggauuuuucauaugggaauugaaacaggaagcauauuaugaagggggaaccccugugaaaaauuaauugguuuagguguucccuacuuaaguguacuugauuacaaaauuugguuuuauuauuggauuagagcagaaguugaaaauauguugugauacaguggaaauaacagucuuuagaaucaaacauggacuugaaucuaaggugugacauuucuugugggagcguggauuacuuaaucucuuuuugcuaugucugcuuguguaaaauguagauaauacuuuccucaaaagguuuugaaguagaaauuuaaaaauuaacuugacugucuaguaaucaguguaaagcuggcauguaauuccuucuuuuuuuaccacugaaauuaaaaauaaaaccaaauuucaaaaguuuuaguugacauauuuauuagaugggguuccauguuaagcuagaaauaaauaauuuucugguaguucauuggggacuccuuaaauuucagcaagaauugauuuuuuaaaaaaaauccuguggauauuugguuuaauuugaaaaggaggcugggcgcagugggucacaccuguaaucccagcacuuugggaggcugcggcaggugaaucacuugaggacaggaguucaagaccagccuggcuaacauggcaaaacccugucucuaccaaaaguacaaaaauuaccuagauguaguggcaccuaccuguaguuccaacuacucuggaggcuacggcaggagaaucacuugaaccugggaguuggagguugcagugagcuaagaucgugccacugcacucacuccagccugggcaacagagcaagacucuaucucaggaaaacaaaacaaaacaaacaaaaaaaaauuucuaaacucagcugugagguuaaacucaauguuuaaaaaaaucacaaucuaguaguaauagaauaauugguagauaaacaaguuuuauuacauuuuuccccaaauuauuuaaaauaguaaaccauagcauauuaaucaaagguaguuuuguauuauuugugauaauuuugaguaaaauagaaaugaugacauaauuaccuauuuggcugguuuuauucauagggagcaucagguacaugugcaucacacaucuuugguuccucuuuuuuuaggugaauauuagacuguuuaaguauaauuuuuauuguagaucaaauauuuuguguugaaaaauagcuccaacauuaauuauggugaaagucauugucaaacuauauuuuguuguauaaguuuuccuuuuacaaguucaugaugaauacaacugugaaagcugcuauuuuacugggauuuuaauaaacuguucaaucuaguauacuuugucuuuugugaugauucaguuuucucuuuuuauagccugcccuuccucagugucuguugaaguaagugcagaugggguaaauaugcuaccuuuguccacuccuguugucacaaguggccucaccuacauaaaaauucagcuuguaaaagccgaaguagcuucugcugucugccuuagacuacaucguccacgggaugccagcacauuaggccuuucacaaauuaaauuauuggggcucacugcuuuugguaccaccucuucugcaacaguuaauaauccauuccuuccaucugaagaucagguauccaaaacaagguauguuuuguuuguccuuuuuuuuuuuuuuuuuuuuuuuuuuuggcaugguugggagauaggggacuuaauuauuuuguggguuuuuucuuuuuuaggucuuaggaaggucuuuguuccauagguaucuguauaauacaauuuuauuagguguaauagagacaguuuuguggaaacagaaugcugacacugauuaaaauuaagguguauauauguuuagucuuugagaugaucuguaugcuacauguagguguacauuguaauuuucuggcuuguaauuuuuuguaucauacucuguuucgggaauuugcaaaugccuaugaccagccuaugacaucugaaccauaccaacugaccuuagaaacagcgaccuagucuuauaugguaauuccuaaauguuaguuaacagaaggauuaugucugaaccaaacuaacaaggacccaaauauauuuuuuaaucaacauuuuucugauaaauuuugacagcuggauguuuuauagauggauuuuauugaaaguucugccugauaaaaaugaauuuaaggccuggcucaguggcucacaccuguaaucccagcacuuggggaggccaaggcgggcggaucacgaggucaggagaucgaaaccauccuagcuaacagggcgaaaccccaucacuacuaaaaauacaaaaaauuagccgggcauggcggugugcugcuugggaggcugaggcaggagaaucgcuuggacccaggagguggagguugcagugagccacgauuccaccacugcacuccagccugggugagagugaacucugucuuuaaaaaaaaaaaagaauuuaggauuucuauuuucaaggugcuaagacuacacaguuuuagaagucuaugauaguaaucaguuuaucaguauauauaauugcauguaaaagaaaguuucuggaugauugccuaaaaaagcaaacccauggugucuaagugcuaugaauacaaguacuuuuguaugugauuuaucuuucuguuuguuuugagacagagucucacccugucgcccaggauggagugcaguggugcagucuagacucacugcaacuucugccucccgaguucaaaugauucuccugccccaccuucccaaguagcugggauuacaggcgcccaccaccaugcccaacuaaucuuuguauuuuuaguagauaagggguuucaccaaguuggccaggauggucucgaacuccugaccuugucauccaccugccucggccucccaaagugcugagauuacagguguuagccaccgugccuggccaugauuuaucuuauaggggaaacuuacugucuguuuacuuaauuugcagcauucuaaaaaaacaugucuuagauugguuaaugcuguuuaugaaacacaacaugcugaucuuuaaaaaguuauguucuaccccgaagugauuugagcgacuuauauugaucauacaagucauuuuguauuuucaguauuggaugguuacgguuauuacaucauugccuuacucacauaagugaucuagaaggaaugauggcaagugcagcugcaccuacugcuaaucugcugcagacuugugcggccuuauugaugucaccuuacuguggaaugcauucacccaacaucgagguugugcuuguaaagauaggacugcagucuacuagaauuggccugaagcucauagacauucuccugagaaauugugcagcaucaggcagugauccuacaggugauaauuaacuuugauauuuaaauguuuacauaucuguaaaguaacagcaguugaacugugcgaucuucgugcuuaacucuguuuugggaauuauuuuuucuuuuaguuuauguuuaucucuccucucuucucugauggagucucacucuguugcccaggcuggagugcaguggcgcaaucuuggcucacuacaaccuccaccucccuaguagcugggauuacaggcaucugccaccacacccggcuaauuuuuguauuuuuaguagagaugggguuucuccauauugaucaggcugguuuugaacuccugaccucaggugauccacccaccuuggccucccagagugcugggauuacacgugugaaccacugcacccagccuaguuucauuauuuuuagaguuuguucuguguuguuggaauuuauggaagccucauuuuuaaugaauaacuuaauucaauuaaguaaaucuucccaugguuaacuugcuuauuuagcaaacuuuuucuuuggauucuuuguugcaagauuugaauaguccuuuacuuuuuggaagacuaaauggacucucuucugacucuacgauagauauucuuuaccagcuuggaacaacucaggauccugguacaaaagacagguacgauuuuauuuuucauuuaauuaagcacacacaugcacauaaucaugcuauaguaaauguuucugacaguuuuuccuuagaugaucucauaaaagacaauacugugauauauuguauguuuaccauaugccucacacgauguaacuucugcaaguauucaugaacauuagacauacauuuguauguguuuggacauacuuuaagcaaauuugaacuuaaauagaauucuuuguuaauacugcuuuugaggaauggaauaaaacauauauuuuuaaguuggcuacgugugaaaggaaccuuguaaagugaugguaucagagucauacugucuuagguaguacuuuauauguguauaugaauguagggauauugugucuguaguugguacuucaacuguuuuuauaaugguucuguuuauuuauuauugauuaucguauucaucgaaaucuuuucaugacuuucugcacccuuuccugcuguuuacagaaugaaacaauaucauaacauguaaaugacauuugaacacauuggcuaaauauuuagugauuuuuuucuuuucuuuucuuuuuuuuuuuuuuuuuuuuuuuuuuuacauuuagguaauuuuaaugaguuguccuaaugucauucuaccuugaugucuucuacuuccaaauugauaccaacuugaauuuuuguuuguuuuguuuugagauggagucuugcucuguugcccaggcuggagcgcaguggugcaaucuuggcucacugcaagcuccaccuucuggguucaugccauucuucugccucagccuccugaguagcugggucuacaggcgaccaccacuauaacugacuaauuuuuuuuuuuuuuuuuuuuuuuuuuuguauuuuuaguagagacggggcuuuaccguguuagucaggauggucucaaucuccugaccucaugauccgcccaccucaggccucccaagugcugggauuacaggcaugagccaccgcacccggccaacuugaaguaguuuugaaacauauuuuuguugauaaauuuuugagcaaauauuuggcauucucuguuuuuauguguagcauccauauuagaaaaacagagagauuucuuccugauuuauguuacuuuuuaauauuuugauuaauuauguuuaaaaugaagucauuugauguuuuauuaauaucuuuauaaauuauuaaaauuauggauuacauuuaaacauagauugcaauuguuuuugaugaagugaauaacaauuugugccaaauuugaaucauaaucguuaguagugguuaaaauauauuuaaaauaucaguguuaaauauuuuuccagaacagguugcuugaaaucuguuaggauuauuuaauuuuuaaauauuguuguggcuuuuuaauaagaagaaaauuaagcuuaauucauuuucucugcauaguacuuuuuaaaacaugaauguuuguuauauaaaacugacauuaaugacaagguuguuagacugagaaaaaugucuuccuugucuucugaauucucuuuauuccccaucaugugaaauugaaagucuuaucuuucagaauuaguauuauauaccuuccuaucccuguuucuuuuagugugaagccaagaaucuuauauucugaaauagaaauugaaggaaaauaaacaaaauguaaacacaguguuuuaagaacuugagaaaucuaaaagucuuucgcucccagguugugguucaaaauuggguguguuuuacugguucccaacuccaggagauugggauuagugggguuaguugaccuauaaucuuguuauuaauguuaguucuaaaugacagauaccuguauuuuuaaaaguacuaugcagagaaaauaaauuaagcuuaauuuccaucuuauaaaaauuauacuuaaaaaaaauauguaaguguugagaguguauucuguugucagaaugaaugaguguggguggcuauuacuaguauuuaaugcuaggguccagggaugugaaacgugcuguauuucaugagacuuugcacaaugaagaauuagucccagaucacuguucuaguauguuaucucaaaccuuuugaugguugaaauugguaagguuauuggaaaauuggaacuggaacuaguaugucuuuguugccgagagauuuccuuuuuuuccuauuuuagauuaaaauaaucaaaaacaauuagugcauuauucucauaaauacccuacucaccaugcagagaugguauuuaucuauaugaaaugccaauugcacuauauaguugguuauaugaauucguuuucuucguuuaagaauucaggccuuguuaaaauggguuagugauucugcaagaguggcugcuaugaagagaaguggcaggaugaacuacauguguccuaacuccucaacaguagaguauggucuucugaugccaucuccuucucauuugcacuguguagcagccauucuguggcauaguuaugagcugcuuguagaauaugacuuaccagcacuccuggaccaagagcucuuugaguaaguaugauuugugaaaucuuuuuuaucccccaguacuagaucaguuaguguucacuugauaaaacaaaauauuuuacauguuuauuaggagaaacauaauauuuugaaaguagcaaauauaaucaaguauacuuuugaaaugaauugucaaauauuaauuuaucuuuguguuuuaagaagauauguuagcaguacugccuucuuuuuuuuaaccuaaaauuaugcuuaauguagauguugcugugguucauaguguuuauucucaguugcaaauuuucccaccagauuaucuuuaauguacaacucuggcaggauaguacagcuagacaacuuugggggugggcaugguggcucacaccuguaaucccagcacuuuggaggccgaggugggaagaucgcuugagucaggaguucaagaccagcuugggcaacaugcaaaacguugucuguacaaaaaugcagaagucagaaagcugggcacaguggcucaugccuguaaucccagcacuuugggaggccgaggugggcagaucacgaggucaggaguucgagaccagccuggccaacauggugaaaccccgucucuacuaaaaauagaaaaacuagcccggcgugguggcgcgugucuguaaucccaguuacuugggaggcugaggcaggaggaucacuugaaccugggagguggagguugcagugugcuaagauugcaccauugaacucaagccugggcgacaagagcaagacucugucucaaaaaaaaaaagucagccggacacggugguaugcaccugucguuccagcuacuugggaggcugaggcgcaagaauuguuugagucugcagaaguucgccaugcugccucacgccacuguaccccagccugggcaacagagcgagacucugucucaaaaaaaauaacuuuggggagcugagaugggaggaucacuugaaacgaggcguuuaaugccagacuggcuaaaauagagagaccaaaucucuacaaaaaaauuaaaaauuagccaggcaugguggcauguuccucuaucccuaacuacuugggacgcugaggugggaggaucacuugaacccaggaguuagagcccacacugaccuaugaugauggcaccacuggcacugcagccagggcaacagagcaagacgucaucucaaaaaagaacaaaaauguaaagcuagaaaauuugagacuuuucuagauuguccuuuugacaaguaguuuuuauuuacccacauuucuucaccauauuuagcuaagucuuugcugaacuuacugauagcuaacuauuaagucugcagcagaauacauuuuugaagaguuccuguaacacauaaaaaguaggccuauuguucucugguaggucaucauauuuggccuuagcgauuggcauaauccaugacuuaauuacugagccucacugguaguuuuuuauuugcaaacaugaauuuaagccauuugucauguggaauuuaacguaaacauuuguuuggcaugauuuuuuuguuuguuuguuucucuacaugaccuuuucaggucacacagaaugauagaaccauuuuaaaauaauuuacuugauuuucuguacucauugacaagucuaacucaacuugcauuguaccuacauucuucaauuuuaaauauauauaugugugucuauauauauauauaugcagucuuaaaucuuacaauguuuuauuauucaaugucaaauaaaguauauaaugucagaguauacuuugaacuauaacagaaauauuugaaauaguuucuucuaaaaauauacuuguaucauuaauaugauaucuuuuauuuuuuagguuacuuuuuaauugguccaugucucuucccugcaauaugguuuugaagaaagcuguugacagucuacuuugcucaaugugucacguacacccaaacuauuuuucuuugcucaugggcuggaugggaauuaccccuccuccagugcaaugucaucauagacuguccaugacagaugauagcaaaaagcaggaucuuaguucaucuuuaacagaugacucuaaaaaugcacaagcaccucucgcauuaacugaaucacauuuggcuacccuugcuuccucuucucaaucuccugaagcuauuaaacaauuacuagacucagguuugccuucucuucuugugaggagucuggcuaguuucugcuuuagccacauuucuagcucagaaagcauugcccagucaauagauauuucccaggacaaacucaggcgccaucaugucccacaacaauguaauaagaugccuaucacagccgaccuaguugcuccuauucuuagguuuuugacagaaguuggcaauagccauauuaugaaagauuggcuuggugguucugaagucaauccacuauggacagcacuucuguuuuuauugugucacucuggguccacuucuggaagccauaauuuaggugcacaacagaccagugcaagaucagcuucucuuucuucagcugcuacaacaggacugacuacucaacagcgcacagcaauugagaaugcaacuguugcguucuuucuacagugcauuucaugccauccuaauaaucaaaagcugauggcacagguaagacaaaaaaauaacuuacauuuuaguuguuuuauuacauaagaaagggccauguauaaaggccagguaauaauaaauuuagugaggguugagugccuuuaaggaucugaauuuaagcuauaaaguacugauaucuccuuucucccccucaaaauaugcugucacuggaaucacuuauucuuuaugaugagaugacuagcagaugcauugggaugcuagcuagaucauacaacccuuauuuucaaaaauuucuacaaacaaaaagaaaaagcccaaaaaaacauuucagcugcuggaacaguauggacacugaucacugaguacuguaugugccuugaggcauuguguuuuuguguaacgagauugccauacugauaguuugcuucucuuuacaugggcauuagauuagguuucagauaggagacuccacauaaaucacauacaaaauguggaagauaggcugguugugguggcucaugccuguaaucccagcacuuugggaggcugaggcgggcagauugccugaggucaggaguucaagaccagucuggccaacauggugaaaccccaucucuccuaaaaauacaaaaaaauuagccgagugugguggcaugugccuggaaucccagcuacucgggaggcugaggcaggggaauugcuugaaucagagagguggagguugcagugagcugaaaucuuacuacugcacuccagccugggcgacaaagcgagacucugucucaaaaaaaaaaaaaaaaaauguggaagauaauuuaucauacugcacuccagucugggugacagagugagacuccaucucaaaaaaaaaaaaaguggaagauaauuuaucauauauuaugauuaucauaauaagcugggugugguggauugucauauauuaugauaaucauaauuuauuauuuaucauaauaaauuaaauccugaaagguagaauuauuucaagaguaauucuaguuggcuuuuugccaaauuuugcuuuugguuaccucacgugaccuugggcauauugguuaaucuuauaacauggggcuagcaauaccugccucaaggauuuuuugagacaguuaaauauuuuaauuuguguaacauaccuagcauagagccuauaugagauaugguagacacuaguaaauaacuuuucuccuuguuauuuaauagugcucauucaagucaaacuuuaguaguaccuagaaaaauagauaauauaauuuuuauaaaauauugaaggaguuaguuuuauuaagaagaagggcaggucgggugcuguggcuuauaccuauaaucccagcucuuugggaagccaaggcggguggaacacuugagcuuagaaguuugaggccaguuuugacaacauggcaaaaccuccugucuaccaaaaaaagaaaucauaaccaaaauuagccgggcauggugauacgugccuuuggucucagcuacucaggaggcuugaggugggaggaucacuugagccuaggagguugaggcuguagugagcugagaucacaccacugcccuccauccugggcgacagagcgagacccugucucaacaaaaaccuaaacaaaacagaggaagaagagaaagauauuuaacugccuguaguaauuaauuacugggaaaauaucucugcuaaauaugcauuaaaaggaaaugcuuaaauuaccaacuucacccgagggcaugauucuagguauuugaaaauuugguuugugcuucuggguagcaugaacucuuugugucccauugauuucucucuugguuucuuaguaaggcuuuauauacauuuugggggugagguggggcaggaucucucucuguugcccaggccuguagugcaguugcacaaucagugagccguggcucacugaaacuuucgggcucaagaaguccugccucagccucccaaguagcugggacuacuggcacaugccaccaugcccagcuuauuuuuuuuugguugggggaguggguagagacagguuucaccacguugccuaggcuggucuggaauuccugggcucaaaugaucucuucucuuaguuucccaaaguucugagauuaucagcaugaccuuggccuuguuauauauuuuuaauaugcuuuuucucauaauuuuuauuuuaagauaaccacaccaauauugacuaaaguuaacgggaguucguuaugcuagguauucauuaugugcaaaccguuuaguacuaauuuuuucuaacccuggacacguuucuuacacuuuuaucuccuuugguauucauauauuuuaagauaaaaucauuucuuuccuccuuaaaaaaaaaaaacuuaacuacuagacccccagagacauuuguucuuuagcuacugauuugauauguuaaaauaaacuuauucauauuuucuguuuccuuuuuaucuuucaaaauaaaaagcugcauauaaaucuugcauuuaacuuuuuaaauauuuugucuugccagguucuuugugaacuauuucagacaucuccucaaagagggaaccuuccaacaucugggaacauuucaggguuuauacgaagauuauuuuuacaguugaugcuggaagaugagaaagugacaauguuucuucagucuccauguccagugaguauuuaacacuuaaucauuggcuguguauacauguauuuuacaauuuuguaucagagccugcaguuaccuccuauguucuaacuucgaguauagcaaagugaaacuagcacagccuuuauaccuaaugacagaacuugacaauuucaggauagcgcucucccucaugccuaggaauaacauaauuuuaccuuagccugagaaguauaguuugauuuguggaaaaaaaugaaaaaagguacagagugauaaugcaaaaguugaccaacaaaucauggcaacuaugccauaucuaaauuaauuauaucuuguaggauuuauugaguauuuuauucuuagaugcuuuugagauuauuuuauaacaauauguauuccaaaaaguuacuuccugauuucuuugauuucuugauuuucagcuguacaaagguagaauuaaugcuacuagccacgucauccagcauccaauguauggagcaggccacaaauuccguacucuucauuugccagucucaacaacauuaucagauguucuugacagagugucaggcaagucagauuuaaguauuaguuuuuguuuaacuuuauguuugauguauauggagguuuauuguuuuuauaacuuuauuuucugcauccacuuugcaaccauugaugacuaggaaaguucaagacaucuuuauaguuugaagcauaagaagccagucaaguggacaaaauguaaaauacuuuuaggcaccccuaauuuuuugguuuauugugucacagugagaaaugggcagcuagaaauacagacaaauaauugauggcauguucucacaauaaaccaucuggucauuuuauacuagauuaauugcaggauauuugguugaauagcaagauucuaauuaauacacauuuacuaaauugaagguggugaucagugaucaagacauaaauggaguagguagaauugacuggucaccucauuguuuaucguagucagugaagaaagcagacagaacauuuuccccuagguucuugccuguauuuuauaggaugauaccuuuaaacaacauaugggauaguuuuuuaaaaagcaguuuuugauggcaaaggcauaucaacuuuuuauuuuauuuauuuauuuaauuuugagaggggggucucacucugucacccaggcugaagugcaguggaacgaucuuggcucaccacaaccugugccucccauguucaagcaauucuccugccucagccuccugaguagcuggcauuacaggcaugugccaccaugcccagcuaauuuuuucauuuguuuaguagagacugauuuucaccauguuggccaggcuggucucgaacuccugaccucaagugauccgcccaccucggccucccaaauugcugggauuacaggugugagcuaccgcgccuggcccauaucaacuuuagauaguuggaguguauugccacugugaaauucugguuaaucagugagugaacuugcugagcaucugcaaagugcaaucacuauaauuuguccuaagauuauaaacaugagcaagacacacauuccaccucacaagauaguugugaucuuaugucuguugucaacuucuaaaauaaacuagaaaugucuguuugcauuauaacaugaauauaaguagauauauuucuaucuguauacauaagaagggaccuaaguuuuuaauggaagcugugaacugaagcaagaauaggaguaucuaagaaaaaaguuggaaaugucuaucaguuaaaaauacaaaucuaaagcccagaguaaaagagagaguuaaagagauuugggaguuguuaccacacauagaugguaagugaaaccaugugaauggauauaaucauuauagguaggaaagauuguuuucugcuucacaaucgcugugucuaauaugcaugugcauaaaaucguaauucuuuccuaccguuuuacaacuuauacaauagguuguuagcauacuguuauaaauauuaaaaaaaauuuauuugaaaaugacugccuuaucuguuacagagaaacuuuuuugaaaauuugauguuagacaguauuuucuaucaguuuccugaaauuguccauucuacaugaugaagaaaaaugaaaauuaaaaaguaaauaaaugggccaggcuuguuggcucacaccuguaaucccagcacuuugcgaggccaaggcagguggaucaccucaggucaggaguuucagaccagcccugccaagauggggaaacacaugucuacuaaaaauacaaaaauuaguuggguaugauagcgugcaccuguagucccaccuaucugggggacugagguaggaaaaucacuugaacccuagagguggagguuacggugagccgagauugcgccacugcacuccagccuggacgacagagcgagacucucucaaaacacauacaaacaaaauuaaauaaaugaagaaaguggggaggagcacugaagcucaguuauugauauugauauuucauauguuuaacuugaagugcaaaaguagacauucuaauacaaaauaacugaaaauugaacauuuuaauuagucuuuacuguggaagaaugcuauucuaaaacauucuagcauucaaaauauuuuacaaaauaguuuucuguauugcauaaaaauaaaagcuaaucgcuuuggaaguacacgaccucaaaaguuauaugugcugaauguaaccuacuuagcgauuuuuuuugguucuuuaaaguggauuuauacucuuuagccauauuuucugauauauuuacuuguacguuuauauuagaucaacauguauaagaauaaguaauucagaaguauugccucaguaaauuuaccugcuaucuguagcuuuugacaguauacuuucuuuuuuuuuguuugagauggagucuuucucugcauuacuugagcccaugaguuccagaccaccugggcaacauagcaagaccucaucucaaaaaaaaaaaaaaaaaaaaaaaaaaaagcaaagacaacaagagaauauuaaaacuggccaaaaaggaagugaccuauuauuuuuucucucucucuguuuuuuuuguuuuuuguuuuuuguuuugagacggagucucacucugucccccaggcugugcaguggcgcgaucucggcucacugcaaccucugccucccagguucaagcaauucuccugccucagucugcagaguagcugggauuauaggcacgcgccaccacacucggcuaauuuuuguauuuuuuuuuuuuuuuuaguagagaugggguuuugucauauuggccaugcugaugucgaacuccugaccucaagugaucugccuuccucggccucccaaagugcugagauaacaggcaugagccaccacaucaggccgacaauauuacuuucaaauaauaaccuuuaugugucagucuguuugcuuuuacaaauuucugucacugguuuuaagcaguaugaugauugugugccuuacaauuuuuucuucacauuucuuaugauuagaguuugucgaguuucuugaaucuguguguuuuagauuucacuaaauuucgaaauauuuuggcaauuauuucuucaauaauugccuccccuuuuuuuauaauuacaguuacuuauuaggcuguaugaaguuguuugacaccccaaaucuguguuuccucuuuucccccccaucauuuuuuuucucuauuuuuaaauuuuggauaauuuccugugucugaucuguuagacguuuuauaucuccuuguccuuacuuaaaguguauagguuuucuucagcuuucuugaacauaguagucuguuuguacuauuuuucucuuccuuauggauuguauguucucgcuucuuuauuugccuggagaauuuucuuggaugccagacaauguaaauuuuacuuuuuggggugcugaauauuuuguauucuaauauauauauuuuauuuuuucaugaaauauaaugauauuauuugaaaacaguuuguugcuuuuagacuugcuuuuaaucuuuguaaguaggaucagagcagcuuuuaaucuaaggcaagacuuacuguaauuauugguaauuuuuauaaaccaauguugucuaguuugguaacuguuaagcacaugaaaugagacuaagaaacuaaauuuuuagauugaauuuuuaauuuuaaugaauuuuaccuuuaaauauguaccucauuagaauagaauuaagguaccagguuugaaaaugcaguucuaaaucccauuugaccccacuauuaaggcucuguccuuaugaguacucuguuaggaauucacuagaugucuaagagcacaaagcauuuuauucccugaaacccugggguugcuugcccugcuacuuuucgauaguaccuuuccuggccuucagugguuugcucacauagguucgucaguacauguugaagucuugaagacccuguauagaucucuggagauccagggaucuccagaucucuagaugcaaaucugcauagaugcaaauauuuucuuccuggauuuccggcucuuacauccucagucuagggugacaacuagguugugcugagcuguggccuaggaauucuuuuccagacagcucacacaauccuaggggucaccucauugguuuccacuuacccaggcaucacugcccugcccugccugauacucagugucugaaaaguauuguuaauauauauuucuaguuaagguuauuucacgugggagaugaaccugauccuuauaauuccagaaguggaauucuaaaacagagcagcuuuuugcauacguucaaguacagagaaaaaaauaaaacagaaauuuguauuaaaaaauaaaaaaguaaauuaauauuagaaaccagagcauuuuuaaaaggaaguugagaaauuuuuuuuuaguguuugaauggcauuuauucuuuauauuuacuuuugaaauaaggguaauaaaugaaaauuggcuaaacuucuaauugcacuaaguaaauuauuaccuaauauucuuugugugcuuuucuuaccugauuaugcuaugaauuaauuuugugaauuucuuauuauuuaaauguuucacucugaccugugucaguauguuugccauuuuuaguugcuugguuguuuuuguuagaaaguaaaauguauuguugcaccaugcauuuguuauguguauaaaauuuuuuacuucacaaaacugucuauaggcaauuagcaauuaguauuaagaaguuguauaaauugaaaucacuuucauauacuaaaaacuguaaaaugagaguuauuacaaaagauguuguuuauuguuuuauugucucaaccuuuuuaacauaaaagaccgggucauaauugugcuaaauuagggaaguaaaaagagaauugagcuagaugcaguggcucaugccuggaauccuagcacuuuaguaggcugaggcaggcagauggcuugagcccaggauuuugacaacagucugcacaacauggcgaaaccucgucucuccuaaaaauacagaaauucauggcaugugccuguggucucaguuacuugugaggcugaggugagaugaucacuugagccugggauguugaggcugcagugaaccgcgauuacaccacugcacuccagccugggcaacacagcgagaccuuaucuuaaaaaaaaaaaaaagagaauuggagacuugauaacaguuauauagugaaaaaaauuaaaauuucaaaucaauucauucagccuuuaaauuucuuaauaacuaaaucacauuauaugaucacccauuuauuuuauaauuuuuaguggugugcuguaugccacaguaaugaaaggaauauucagaguaauaacuaucuaugagagcccuuaauacucauuuuuuaaaguaaaacacauuaaauuuuaaaacauauuacuuuguugucuaagauuccuguuuuuguccuaaauaaaaauuaacagaacaggaaaucuguuacagaaauuuguucuuuuauacuuucauuuguaauauaagcagaagucuaguuuaaugcuauagacugaaucuugagcuugagucccauauuugccauauacagauuauaucaguagccuuucuaaggcuguuucuucauuuugaaaauaacauucauuucuauguugcgaggacugaauuagaugcaguugccaagcacauugaacuauggcuaaaauaaagcaaguuuucaugcuacugguuuuucauuguuucuggaggugguaccauuaaaauacuguauauaauacuuuacagagauuagaucuuaaauauucuggcuuaaguacaguggugagucuuccucaucaaugucaguaaagauuggguaucaggccuuuaccucaugccauuucuccuaaauuccuuuauauugccuuaguauuaaggauaauauuaucuugcauaaucucccucugaaacauauauuacuucucuucuuaaugauuuggaaaagcaguguauuuuagauaauaucuucuuacagauacuccaaguaucacagcuaaauuaauuagugaacaaaaagaugacaaagaaaagaaaaaccaugaagagaaagaaaaaguuaaagcggaaaauggauuucaagacaauuacaguguuguuguugccucugguaugcuuucuauuuuuuauaaucuugauuuuguuuggguuucuauaaaauauuagaauuuuaguuacaggaaauuuauguaauacauuguacuaauauaaaaagcugacucguaaugauguuuuaauacuagauuuuuaucuuuuuauuuuuauuuuuuuucacuuuccacuaaauagguugucaucuguauuucagagauuauagcagcuagcuacaguuuuuacuuuuuaggaaaauaguuacagaugcaaugccaaaauuauuuauuuguugucaugaaggacgaauagaauugggagauuagauauuggauuagaaggaacauuucuguuuucugacauuagcuaggaaugcaugccuuauuaaaauauuuuaggaacacuguuuuccuucauauuaguguguugacuauguagaaucuuacugauccuuuucuuuuagggcugaagucucaaucuaaacgugcugugucagcuacaccaccucgcccaccauccaggagggggaggacaauaccugauaaaauaggaaguacuucaggagcagaggcugccaacaaaauaauuacugucccaguguuucaccuguuucacaaacucuuggcagguaauauuccucaaugaauaaacgucaaagaaauuuuaguagccuuaaaacuauguaaaucagaggcacagucaccaaaaucauuuuaaucaggugccauugaugagaucagugaguuagugagacuucuuccauacaguuccuccgaagagaagugagagcaaaggaggaguaaucuauuacguauccuuuuuaacacuaucaaguuauuuauuucuacuuuacugguuuucuaaguuuuucugucagugugccaugaaaugauugaugaaauagacauuuagagaguucaugacaaguuauuuaggaaacaccguggggcaaauuuguaggacuaguucaagcaguagaacucuuagaccacugguaguuaagccauauguucuucccagauaaaacacauuuauugagcaccauccugucuguuguucaaggugauaacagguugagcaucccuaauccaaaaauucaguaucugauacuuuuugagugcuggcaugacacaaguggaaaauuccacauccgaccucauaugacgguuacagucuaaacacaggcacacaacacaguuuuuucaguguccacaagaggaaaaagaucuuccagcccccuucagauauuuuuugagcaugcccgauuccucccuacauauccacaguggguaacaaaacugcaaaugugcaugccagacgugccaacagcagguuucccacgaugccccacaugaugccaagaugugugugcauuacuguguuuuuuugcucugugguguuggaaauuuaaaaaaggccccagauacccuuauggguaacaaugauaaaaagaggaaguauuuauguuuaucuguagcacagaaaaacaagcuguuggagaaacuggacagcaauguaagugugaaaugucuuucaagagaguaugguguuggagugaccaccauacaugaccugaacaaacagaaagauaaaccauugauguucugugcugcaaguggugaauagagguuaaugaaaaauagaaaaagcacuccaugaagcuaaaaaugaagauauugauuguguauugaaacagugaauccaucaguguuggcagugaacacgugccucuuaaugguaugcugaucaugaaacaaguaacgaucuaucaugaugaacugaauguugaaaggagcugugaauauucaacacacugguugcagaaguuuaagagaagauacgacauuacauuuuuaaagauuuguggugauaaagcaucugaugaucaggaagcaauggagaaguucauugauaaauuugccaaagucauggcugaugaaaaucugccagaacaguuuauaaugcugaugaaauauaucccuguucugguguuauugucucaaaaagacacugggcuacaguugaugggacagccccuccaggaauuaaggauaccaaggacagaauaacuguccugggaugugcuaaugcaacuggcauacauaaguacaaacaugcucugauaggcaaaaccuuucacacuuguuguuuucaaggagugaauuucuuaccaguccaugguuacucugacacaaaaguauggaucaccacagacaucuuuucugauugguuucauaaacacuuuguaccaguggcuuguauguacugcccauaagcuagacuggaugauguaggaguuuguuauuccuugauaucacccaauucauccuccagcuaaaauucucaaaacuaauguuuaugccauguacuuucccucagaugugacuucauuaauucagccaugugaccaggguaucuuuagaucaaugaacagaaaauauaaauccacuuucuugaacagcaugcuggcagcagugaacagaggcaugggugcagaaaauuuucaaaaggaguuuaguauaaagaaugccauauauguuguugccaauacuuggaacacagugacaaagacacaguugugcaugucuggcacaaccucuggccugcaacuguguuuagugauaaugaugaacugugugugugugacuuugaaggauucuguaugucaagugaaaaaaaaugaugucugaccuccuuacauauguaaaaaauauaccuucagaguucagcaguaagcuggaagaaguagaugucaaagaaguuuugaacuuugauaauaaugcuucaguuauucauucauugacuggugguaaaauagucgaaaugguuuugaaucaggguuaugauagugaugaagaaggucaagauaacaccacagaaaaggugcuuauagaagaagacauggugaaaauguauggugggcauauugaaggauuacggcagcgugcauuaacaacagaaugaaaaaccaugucaguuuuuaaaauugaagagagacuucugagcuaaaaaccauguuaaugaggcagaugacuccacaagaaccauuuuuaaaagccuuccagcagaaugucucuucaucccccguaggauccacuuccuggucccucagcugcuucugauguuucuucuuaacuaaaaaacacaguuuauaguaaccuuugaauaaaaacacagcaucauaggugaagacugaaagccugcuguuguuuguagcugcuuuuuccuuuuuuuuuuuuugagacguaguuucacucuuguugcccaggcuggagugcaauggcgugaucucggcucacugcaaccuccgccuccuggguucaagcaguucuccugccucagccucccgaguagcugggauuacaggcgaccaccaccacgccuggcuaauuuuuguauauuugauagagacgggguuucaccauguugaccaggcuggucuugaucuucuggccuuaggugauccacuugccuuggccucccaaagugcugggauugcaggcaugagccacuacccccggcucugugguugguuuuguuuaauagcugaaacagguauccuggugaugcuacuaugcugcuuaguuguccugacacauuauuuuuucaguguuaaugguaugucauauuuuuacuguuaaguacuuaauguaugaauaaauguaagaaaacaauugccuauuguuagcauguagauuaagagucaggaaugaugacucuuguugacauggguggcugagauagugacaccuuugcuuucugaugguucaggguacacaaacuuuauuacaggcacaaaauuaucaaaaauacgguauaaaauuaccuuaaggcuauguauauaagggauguguguauguguguauacacacaaaaauaaauuuuguguuuccacuuggauccccucccuaagauaacucauuguguacaugcaaauauuagaaaaugcaaaaaaaagaaaaaaaaagaaaucugaaacaguucuagucucaagcauuuuggaugagggauacccauccucuauuuuaucaccauuuucaugcuguauuaaaaugaaauugccaacucaguucaaaggaauuuuucuucuuagcuuuacauuguugauucaugguggaggcgaacaaacuaucgacugguggguuggauaccuugguccagagagguccuugugacauaucucauggcccauuaccuaggugaugugagucuugccuucugccugcaauaaaguuuuguuggaaugcagcuaugcccauuuacuaguguauuguccauagcugcuucucugcuacaauguagauuagcaguuguaacagagacuauauggcccccccagguuaaaguauuuauuagcuguccuuuuauagaaaaaaaugucccacaucagauuuauggaaaugucuguuccuuuguuuacguuuugcccaugacuuuuuaacacuuucacagacauuauuguucauuauuauaugucagaaauaaacucacuuuuuguaaacuuuccaauggcuguugaauuuuuuaauuguuuugaaauugguuucagaaucaaacucuugccuguaauuuaguaaaagcagauaauaauuaaaccaaguaaauguuucuuucucgguuuccagauuuaacuuaguuauaucauuuuaggccagccauugccagcugaaaugacacuugcccagcuuuuaacucuccuauaugaccgaaaacuuccucaggguuaccgcucaauagaucugacuguuaaauugggaucaagaguuauaacagaccccagucuaucaaaaacagauucuuauaaaagacuacacccugaaaaagguaugugcauaauacuacuuuaaaaauuacagacugucauacaaagaggcagagauuucuauagcuaaugacuuaauugacuuguguuuuuauuauaucaacauaagauauaauuuuuuuaugacugaauuuuuguaaauauaaaaaauggccauuauuucauuuggaaacuaaguugcauuauuucuuauaacaucauuuguuuuaugagcgcauguacuuuaauuucugauauuucugugagagcuaugugaauugucauuuuauaauaaaagugagaaacucaacuuacaacuuuguuauaauuuauauugaguggcauuucuugcauauaaacauguuuucucauauaauugggaucacauauuuuuguuuuuuacuuauauauuccauuaauuuuuuuugagacagagucuuuuucugucucccaggucggagugcagaggcacgaucuuaguucacugcaaccuccgccucccgaguucaagugauuuuccugccucagccucccgagaagcugggauuacuggcacccaccaccaugccuggcuaauuuuuguauuuuuuguagagagaagguuucaccauguuggccaagcuacucuguaacuccugaccucaacuuaucugcccgcuucggccucacaaagugcugggauauaggcaugagccaccgcacccggcccuuauauuccauuaaauauuuuugaauauccauuuuugaauuggcuauuuuuucauaaaaauguaagaaaauuuauuuguuccccaaucaucgaaacauugugguuguuuccaauuuuuacuccuauaaaugcuauauaaguaguuuucauagugugaguaugauaugaacuuacuuaaacuuuccaucuuucucaugacuaaaauucagucuuuaguuauuggucuuuuguauucuucagcaaauuuugguacauugucuuugcccaguuuuucagcacgauuauuucucucuuuuguuuuaauguuuaaagggucugguuacgugaccuuuugguuuucuuuggugaguaauucagaguuaaacuaauaugguauaauuuuuuguuuuaaguaagggaagucuuugucauuaauuuuucuuaauaggauacuuuagagcauauuauuugcuaugagaacuuugagaacuuauuuauuuuaacauaggauauacguuaaaguaugcccuaaaggacagugcuucucaaacuucaguaugcuuacaaaugaccagcaucauacuguuaaaauggagauucuucauuucaaacuagcuugcaggugaugccaauacuacuaguccaugaaccauucuuccaauaacaagacuaaagaaggcaguaucagaagucauuuaaaggucauuguaccgucuagccauaauacagcuauaucuaaauaaaugauguuuugugcucuuuuuugaguagcaagaaagcaguaauaccugcuuuuguaaaugaaagaauauuauaaaaauauacccuuucuuaccuauucaguuauuuguaauuuauugucuagaucauggagacuuacuugcuagcuguccagaagaugaggcucucacuccaggugaugaaugcauggaugggauacuggaugaaucuuugcuugaaaccuguccaauucagucaccauuacaaguuuuugcaggaauggguggacuggcucuuauugcugaaagacuacccaugcuauauccagaaguaauucaacagguaagauaagauuuccuaaucgaguauaucauuccauagcuaagcccuucauucuuuuuaauguuuguuuuuuaauguacuuggauuaacuuuguagaaauacccuuugcuuuauauuuuuugaacauuauauaacucuuucaauggucagucuguacagagcuucaugaccuucaguagguauggaagaaauguugaagaucaagcacacuugccagacuuacuacacuguugcauuuaucuugauuucaugguuguaacacuagcauucucuuuucuaugcugcuuuaagugugauauuuauuagagauauuauuggaaauaggagaaguaaaauagcaguguauacugccaccaauauaugucuuuuuguuuaccuuuuauuccuguuucaggugccauuuccauuuuuggugguuuaaaaacaugaccuauucccguguucauuuacgaagcugucaaugucugugcuuuccaugcucuuguaucaaucaguaggaaguauggugcauggagaguuguaaaaacaaaacuuuguguuuguugaaugaaguaggggaauuauucucuuugauuucaugucgugugugugugugugugugugugugugugugugugugguuauuuugguauaguagcucuagacucuauuauaguuuccugagcugcuguaccaaaauaccacaaacgggcuggcuuaaaacaacugaaauuuauucucaauaguugaggaggcuguaagucugaaaucaagauaucagcagggccaugcucccucugaauucaggcuguagggaagacuccuuccuugcuucuuccuggcuucuauugguugccaguaguucuugcuguucauugguuuguagcugaaucacuuuaauuucugccuacgucgucauauggccaucuuuccuguguguccuuguaucucuuucuccuuauaaggacaccagucauuuaauguaggguccugcaaaccauuaucuccucaucuuaacuugauuacaucugcaaaggccccauuuccaaauaaggucaucuucauaggugcuagggguuaggacuugaacauaucuugggaggacaaaaugcaacacacaauaauacuuauucauguuauugcuucccuaguauucaaaaauauaagaugauauaacuauguuauaaggugauugacacagaaugagcaaaauuuucuuacuagacaaugacauaauuacucaaaaguuugaagcagaaaagaccccaacauuuucagcauuauuauugcucaacauaaaugauuuuuucuaauuuaguauucagugugguucacuauauugauuaguaacuggaaaugggguccugguaauacauaccuaagaaugugaaagugacuuuagaauuggguacuuggcagaguauggaauaauuuugaguagcaugauuuaaaaaaaaaaucuagauuaccuugaauagauuguuagauaaaauguggaugauaaagcuucugccagugagggcccagaaggaaguaaggaucauaggggagaaaaccuacagugucuuagagaauaucugaauugucauaagcagacuugguagacauacagguguuuaaagugcugacaaggugguuuagaaggaaaugaggaacauguuaccggaaccugaaggaaaagggaucuuugucauauagaagcagaacuauuaacucauuuguguccuaaauauagaaagcagcacuucugcuguaaugaacuuggauguaaugaacuuacauguaaugaacauguaaugaacuuggauguuuagcugagauuuccacacaaaguggugaaaguacaaccugucuuuuucuugcugcuuauagugaaaugugcgaggaaagauauaaauugagagaagaacuguugaaaaacaagcaaucagugcuugucaauuugugaaauuaccuauccagaucacagaaggugcuaaaauuuagauauuugcuaucagaaaagcaugcuccaaaguauaagccaagagugaggcuggacaaccuuuugcuagugccuuagaaacaucaaaagucagaguauucagucacauagagggcucuuugaagagauuaggcauguaacucauggaucuccucagccgucuaagcauaagcgaggaauagaggauaugaugugaugauggaagcauccaagagccauggaacguaaguugccucuggaagcuggaaaaggugaggaacuguuauuuccuaagagccuccagaagcaaugcauccuuugauuuuagucccauaagaccuguuuuggauuucugaccucuggaauuuuaaaauaauaaauugugcuguucugagccacugaguuuguggcaauguguuauagcagcaguagaaaacuaauacagaguuuggucuguaguuguaaugccuuugucugguuuuggugucaggauacuacuagcuauaugggauggguugagaauuucuaauauaucaaauuaaggauacuguuagguguguuuaauaagagacacugucugggcaugguguaauccuagccuguaauccuguaaucacacuuguaaucccagcacuuugggaggccaaggcaggagggucaccugaggucagcaguucgagaucagccuggccaacauggugaaaccccgucucuacuaaaaauacaaaaauuagcccggugugguagugggugccuguuaucccagccguucaggaggcugaggcaagagaauugcuugaacccgggagguggagguugcagugagccgagauggcuucauugcacucaagcuugggugacaagagugaaauuccaucucaaaaaaaaaaaaaaaaagagacacugcagauugcaacaguagugaacuggaagauguaucaaaagaaaucauucggcuuggcgcggcagcuaaugccuguaaucccagcacuuugggaggccgaggcaggcggaucaccugaggucaggaguuugagaucagccuggccaacauggugaaaccccaucucuacuaaaaguacaaaaauuagcugggcguggugguggacgcuuguaaucccagcuacucgggaggcugaggaaggagaauugcuugaacccaggaggcagaggcugcaguuaaccaagaucgcaccacugcacuccagccugggugacagagcaagacucugucucaaaaaaaaaaaaaaaaaaaaaaaaaaaaaugguucaaauggaagcauagaaaguguaaggaaugagaagaacauaagagcuguauggacugaagugaaaaauucuaacuuacaugaauuuauaguccgagaagaagagugaguugaaacauggacagaaacaguauugagaagaagaaaaauuucccaaauagauguaaaacuuaaaucucaauucaacauguaagaaacuguuaacucaugcaggauaugcaugccuggaacugucaugguaaaagugguuaaaaacaaagacagcuggccacugcagugcaucucugaaaucccagcuacucaggagacugaagcgggaggauuacuugagcccacggguuccagaccaccugggcaacauaacaagaccucauacccccaaaaaagcaaaaaaaaaaaaaaaaaaaaaaaaaagcuaagacaaugagagaauauaaaaaccagcuauaaagaaaaugaccuauauuuucaaaacagcagcaauaacacuaacaacuggccuuucaacagaaaccauaugagccagggaauuacaacuuuauuuuauuuuauuuuuuaaauuauacuuuuaggguacaugugcacaacgugcagguuuguuacacauguauacaugugcaauguugguaugcugcacccauuaacucaucauuuaacauuagguaugucuccuaaugcuauccgucuccccuccucccaccccacaacaggccccggugugugauguuccccuucccuguguccauguguucucauuguucaauucccaccuaugagugagaacaugcaguguuugguuuuuucguccuugcgauaguuugcugagaaagaugguuuccagcuucauccaugucccuacaaaggacaugaacucaucauuuuuuauggcugcauaguauuccaugguguauaugucccacauuuucuuaauccagucuaucacuguuggacauuuggcuugguuccaagucuuugcuauugugaauagugcugcaauaaacauacgugugcaugugucuuuauagcagcaugauuuauaauccuuuggguauauacccaguaaugggauggcugggucgaaugguauuucuaguucuagaucccugaggaauugcuacacugacuuccacaaugguugaacuaguuuacagucccaccaacgguguaaaaguguuccuauuucuccacauccucuccagcaccuguuguuuccugacuuuuuaauguucggcauucuaaguggugugagaugguaucucauugugguuuugauuugcauuucucugauggccagugaugaugagcauuuuuucaugugucuuuuggcugcauaaaugucuucuuuugagaagcauuuguucauauccuucgcccacuuuuugaugggguuguuuguuuuuuucuuguaaauuuguuugaguucauuguagagucuggauauuagcccuuugucagaugaguagauugcaaaaauuuuguccuauucuguauguugccuguucacucugaugguaguuuguuuugcugugcagaagcucuuuagcuuaauuagaucccauuugucaauuuuggcuuuuguugccauugcuuuugguguuuuagacaugacguccuugcccaugccuauguccugaaugguauugccuagguuuucuucuaggguuuuuaugguuuuaggucuaacauuuaagucuuugaugcaucuugaauuaauuuuuguauaagguguaaagaaggcauccaguuucagcuuucuacauauggcuagccaguuucccagcaccauuuauuaaauagggaauccuuuccccauuucuuguuuuucucagguuugucaaagaucagaugguuguagauauguggcauuauuucugagggcucuguucuguuccauuggucuguaugucuguuuugguaccaguaccaugcuguuuugguuacuguagccuuguaguauaguuugaagucagguagcgugaugucuccagcuuuguucuuuugacuuaggauugacuuggcaaugcgggcucuuuuuugguuccauaugagcuugauggggaugacauugaaucuauaaauuaccuuggguaguauagccauuuucaugauauucauucuuccuacccaugagcauggaauguucuuccauuuguuuguauccucuuuuauuucaucgagcagugauuuguaguucuccuugaagggguccuucacaucccuuguaaguuggacuccuagguauuuuauucucuuugaagcaauugugaaugggaguucacucaugauuuggcucucuguuugucuguuacugguguauaagaaugcgugugauuuuuacacauugauuuuguauccugagacugcugaaguugccuaucagcuuaaggagauuuugggcugagacgaugggguuuucuagauauacaaucuguaacaccccauugucaacauuagacagaucaacgagacagaaaguuaacaaggauauccaggaauugaacucagcucugcaccaaguggaccuaauagacaucaacagaauauacauucuuuucaacaccacaccacaccuauuccaaaauugaccacauaguuggaaguaaagcacuccucagcaaauguaaaagaagagaaauaauaacaaacugucucucagaccacagugcaaucaaacuagaacucaggauuaagaaacucacuacaauuucaaaaugcuagaagacaacaagcaacaaaauaagcaaaaaaaucugucauccuagaauuuuauacucauuggagaaaauuuucuacaauucuucacccaccucgcccaucgccucucaaaaaucagugauggcagaauaaaaaguaugggauuaacucuguugucucuauauaguuaaaagcucuaggcaaaauauauuuuaaaacaauuauuuaggccgggcgcaguggcucaagccugcaaucccagcacuuugggaggccgaggcgggcggaucacgaggucaggagaucgagaccauccuggcuaacguggugaaaucccgucucuacuaaaaauacaaaaaauuagccgggcgggguggcaggugccuguagucccagcuacucuggaggcugaggcaggagaauggccugaaccccagagggcggagccugcagugagccaagaucgcaccacugcacuccagccugggcgacagcgagacuccgucucaaaaaaaaaaaagcaaacaaaaaaaacaauuauuuaaaggcuuuaagagcaacuagaagcaggcagaaauuaaagaggauuuuaacacaauauuaauagaaucaauucaguaauauuagcgucuauacugcuuuuuucuggggguauuccucagucuuuguggggugggacagguagaacucagacuuaagccacagucauauuggcuggaguuugauucuucccuacuggcuggaaaauaggaauucagaaaggaggaagcugaagcugaggagcuccaaauucugcacauccauagcuugcuccagaauuauuaaacauaggcauuuugagagcaggcaugaacuagaaugcugaaaaagcugugcagagauuucagcugcugucugucaccgagaggauacaauuuacaguuuuaguccugcucagagauaaaaauguuggcuuuuccauuggaauuccaaauggcccauacauuaggaauaaaggcuacagccuaauaaagauucacuugagaaauaagggaaaaaucaaaauagacucuucuaauaaauuacaaaagccucuaaguucagggugaucucccaauaauuuacguaucugcuaaacaaaacuaaacacacugcaaggaagauuuucaaaucaagaguugauagaagaucucaucaacaauguacaguguauggcugggcaugguggcucaugccaguaaucccagcacuuugggaggccgaggcaggcagaucaccugagcucaggaguucaagaccagccuggccaacauggugaaacccugccucuacuaaaaaauaugauaauuagccagcagugguagcacaccucugaaaucccagcuacuugagaggcugaggcaggagaaucccuugaaccugagaucgugccccugcacugcagccugggugacagagugagacuccaucucuaugauugaacaaaugaaugaaugaaugaaugaaugaaugaaaguguauuaaauaccccauuugaaaagcaaacguuugucagaauagaggaaaaagcaaagcccaaguauaugcugccuaaaagagaugugcuugaaagaaaaaagcugcuaccccuauuuuuuaauguaucacaaaguugaauuauagaccaccugauaagaaauaaagaggaucauuaaaucacuaugaaaguauuaauucagaauaagucauaacaauccuaaauuuguguguauuuaauagcuucaaaguacaugaaucagaaauuuauagaacugaaggaagaauuagauaaaucuacauuucaguaauagauuauaacauuuaucucucaguaaaugaaacaaagugaggaaguaggaguuguugggggaaacgcccaaaacuucuagauggacguaaccaauauuuauggaacaaagcauuuaccaacuacaggauguacuucuuuccaaagaaagauagacaguaugcuggccuauacaaaaagucucaguaaauuuaaaaacauuaaaaucaaacccaguauguucugugaccacaucagaauuaaauuggaaaccaauagcgguaagaucuagaaaaccucaaauauguguaaccuaagcaguauaguuuuuaguaacacauggaugaaagaagaaaucacaauagauacuacaagauauuucaaaacgauaaugccaacaugacaugggauauagcuacagcagucuauagagagauuuuauagcuuuaaaugcauauaauuaaaagaggagauuuaucagugguguacacugccaccucaagaaacuagaaaaacaggaguacaauuaaccaaaaaucagaagcaaggaauuacuacaguaagagccagaaucaauuaaauauaaaacaaaaaaaucaaagagaaacaagaaagucguacauuuugucuuuugagacuucuaguaaaauugauaaacuaugaaaaauuuucaagaaaaagggaaaaccacacaaauuggacauccacaaaugauagcaagcacauuauuauaauuucuauagaauaaaauaagguacuauuauaaccaacuuuaugccaacauauuugauacuuagauauaauggauaaauuccuugaaaaacacaaccagaaucaguagaagaagugcauguauacguuuguauguauacacuuaugcagaauuguaaucaaacauacagaauuuuuagucuguuuucauuuuuaaguaccaugguuaugauuuugaaaucacauuaaucccauguuucuccaauuuaaacugaaacucauuuuuuguucuuaaauuggagcauuugacuacuuuagaaaguaucaugucuucucaguuugcugugacauauaaugaguaucagaauuaaagacaucacaugguuggaauaucguaauuccuaaaagccugugauauaaaucauauccuguucaucuaauuuaaaauaauuuauuuguguuuuagacauuauucaaagugagcacguccuuauuagagucuuuucuuugggaaauugagcuguuuuauccuaguauaucagaaauaaaauuucuuuguuguuaauugagcaaaaagcauguuuucauauacuuuucaguuuugacuuucaaaaugugaaauaauacaagugaauauaauacuuuaaaaaauuaaauccacuuaauauuaauacccuaaaacaguucuguuugaaucguuauacuugugacauuuauguaaauaucaguuuauauucuacuguuuggugcuuuugcugaaccuguauuuugaaauuaaucuuuguugaugccuaagccugugguggucucauuuguauagcucuagcauacuugcuguauauuuaacuauaccuuauuguguguauuagucuuaauguugacuagcauuuuuauuuccaguuguuagcuauaaugaaaaaaguugugaagaauuguauacauaucuaauauaagacuuaaaaauuuguaucuguauaaugggugaugggaaauauaugauagugguuuuaauuugcucuucugauuuucgugaaguugagggucuuucacuuguuaaagaauuugaaugcuauaaauugagagcucuuugauuuugcugucuuuuugcuuucauuguauuuguuuuguuuuguggcaucauaugagaauaguccuuuaagaaaacaauuaugaugagguaaaguucugcuucuguaacaauguucuauuauauagguacuuuuauaugaaacuaucuucugugcagcauaaaauaauaaauauagaggaucuuuaaaaauuugccuauaaaggguuucaaaaugguuuagaagugaaaagugccucaaauuccuauguucuuacaauuaggcuauuucauauugucauucuggccuaagcuucaguagugaaaauaagcuggcaucaaaauugcaccuguuuuauucaguguacagaugcauguaguguagccguagaucaacuuaagacugaucuaagcuguagaucagcuuaagacuucuacauauauauguaaaagaaggaagaaauagugaacuaaucacagaguuaccucaccauucauuuaaaaaucaccccacagaguuaccuaucagucuacuaaagucauacaggaagcuuaggaaucauccugauguuugaagugaauagugagauaacucugugauuagcucacuauucauuuaauuauauguuugaguguggaacuucaaauuaguauuuagugaagugcauuauucauggucaagcaagauaaguagaguauuucuaaaugcaaugagaaguuuguagggcaaccaugcucagaauuggaguuuuucuuugaauuauuaagauuaaauuauagacaugaugcuccuuuauuccuaaguucagaaaacuucucuuggauaaccauauacaguuauacaaaucagaaguucacacugacucuguacuauaaacugcaaaucuuauucagcuuuugccuguccuucuaauguucuuuagggccaaagaaaaaucaauuuucuuuugcgugguuugaggauacugguaguucaggaucauauauugcauuuuguugucuuguagucuugcauauguaacaauucugcuaucuuuauuuaucuuucauggccuucauggccuugacaguuuugaagaauacaugcuagaaauuaugucuauauauauauauauauuuacacauguauacauacauguauuuucuagguauguuugcugauaggacccagaagcagacucccccuagugauauaugcauauauaucucccauauugucauuuuaaaaauuuucuacuaaaggaaaucagggcuccuuggagaaauucuaguacugaggaagaguagguagaacaugagccuagaauguuuugcugugcuagaaagcaaggaagugcucaaagaacgaugggggacaaguuauaaggaaguaggauccugcuuuaauggcgucucagagacaaaaucuuauuccccucaggcaucaaaauuaauaaugauaguaacaguguaauaaaguuagaaucuauacugauaaaaauuaauggauaagaagagaauauuuuuccuuauagcuuggugccaacuaauaaauguagaaagaaugacagaauuagaaaguucuccuuuucuuaaccacuuuaguaauaauuguuucaggcacaauuauaaaaaugcuaagacugaucaaaaguuuggugagaaauaagauguuuaaauagucucaagaaucugcauauagauacuuaacuaauuauaaagguggaauuaauaacuaauguagagacacuuggcagacacugccauacuucugcugucaugugcgucuugauguuuggaagcuuguuuuuauuuuuauuuauuuuuuugagauaguuuuguugcccaggcuggagugcgguggugugaucuuggcucacugugccuuccaccuccuggguucaaguguuucuccugccucagccuccugaguagcugggacuacaggugugcaccaccacaccuggcuaauuucuguauuuuuaguagagacgguguuucaccguguuggccaggcuggucucgaguuccugaccucaaguaauccaccugccucagccucccaaagugcugggauaacaggcgugagccacugcgcccggcuggaagcuuguuuuuuaaagcaagcagcuuuauuaauccuuauaauccuauauuuuaaagagaucauuuaaaguuaagucuuuacuuugaaucugauguugaaaaugugaauggccaagccaacacuuuucuuuuucuuuaggugagugcuccaguuguaacaucuaccacucaggaaaagccgaaggauagcgaucaguuugaaugggugaccauugaacagucaggggaguuaguuuaugaagcaccagaaacuguugcggcugaaccuccaccuaucaagucagcaguacagaccaugucucccauaccugcccauucuuuggcugcuuuuggauuauuucuucgucuuccgggcuaugcggaagugcuacugaaagagagaaaacaugcccagugccuucuucgauugguauugggagugacagaugauggagaaggaaguaaguguuuaguauuaaauuuaucaacacauaugugaauagguuguguaaagguauccagaucauugccuauuauucaucauuuauuuccuucauaguuaagcuguuagaugauuuguaagugguagcucacuuccaguauuaguuauacauaauaaauccuaaagaaucuucauuuucaucucuguguucauucaaaaauuauuuuccuugugcugacaaaacuguugggcaucacuggggggauguaaacaugaagcaguuauuuagagcuacccccaaguagcuaauguucuccaguaauagaaacaagggauguacauaaacauguauacuuagcaaguuauaaaaucccuucaguacucuugagugcaguauuauggagaaacacacaugugagauuauuucuuuacuacucagcaaugugaaugaaguggcaugguaguuuuuaguggggccuugaaggacagauuagauuuagguugggaugaguuaucucagaaaauaaauggaaagagcaguguuuugagguuaaaauguaugagaggggauaaguuagcagaugaaaauuugcacaaaagggagcauugugagcauuuuaaaagcuaauauugguaacagaucauggaaaaaacguacuaaaaacuuuagauuuuauuuugaauagcaauaaagguuuauuaaaauguguuaagauuagugauguguugaauauaguuuuuuucagaaaaugaaucugguagcaauacuuagauuaaagagaacagaauuaggaaaaugaugccauaauauguauuaaugauaacauagaauaauaagagaaagcugugaugauuguuuccauuggguuggcauuguuauuuaauagaaaaacugaagaauuacaggauagccucacaaguagauuuucauuugggugacgucugcauuuucuuuuuucuuucuucuucuuuuuuuuuuuugcauuuucacuuacuauuuauucuauuaauauuuauuagaaaauuaauauuccuuauguuauuuuaaaaucacaugguuuugauuagggucgauuucuuucacaugccauuuagaaagaauaaaauguuaaguucuguacuacaaaguauauuuaaucuaauaaaacuauaugaauuuauguguagaucucaaaacucugaagcuaucaaauauucaaaguaaauauuuuuuccuuuauauuuuccuaacaacaaaaaucccucauaaauguuggcauauaagugggcccauguaguuuaaaccuguguuauucaggugucaacuguauuuauuuuaguaggucaggaauuucuaauuacuugaucugauuuuuuuuuaaguagauagagggguaagaaccauauuuuuuauugauacauaguaguuguacauauuuauguuauacauacgauauuuugauaaagacauagaauguguaauaagaaccaugguauuucaacacuguuaccacagaguguuaaaguagguguaacccuaaacagaaaaggaaaaaaaaauggcuuucuguaauuucacacuauuuuuagugcauauacaaugaauuuuuauuaaaaaggauaguuaugauaucucucucucuaauaauugucucguguaccauccauguagcauugcuuucuuugcauuuaauaccccuuccuggcuagaacacaguagaacacuguugggaaaaaaauaguuuuacuuguucauuaucuguucuugguuaaagcuacucccaagaaaagcaguuacuuucuuacuguuguaagauacuacuaaugcuucuuuucuauuguucagguuuuaguuuaaauucuaguucguaauaauuuugacauaaucuauagcuaugaucauacauauguuuccauuuuuuugagguuuauguauaccgugucugacagaguuuuuccugauacuuauucguuauuaaauuuuaagauauuacuguuguauuugugguauuugguuuucuaaauaauuuagugguauacuuuuguauuacagugucauuauuaauuuaugacccuguauguaacuucuuauguguuuuuaacuguuuuuaaucuugaguccucuucuuucuucaaucuaggucauauucuucaaucuccaucagccaaugugcuuccaacccuuccuuuccacguccuucguagcuuguuuagcacuacaccuuugacaacugaugaugguguacuucuaaggcggauggcauuggaaauuggagccuuacaccucauucuugucugucucucugcuuugagccaccauuccccacgaguuccaaacucuagcgugaaucaaacugagguagguucacuuuuaauuauuucaguuauuaaaaaaacuagauuuaauuagggaguacagaauaaaguuuuuuucugaauuaaucuuucagagacuuggguguuccauuuucacaucuaaaaggauauuuaaaacagaaauuguaaauuaauuguuuucucuauuagucuucuucaguaaaccaaaaagaaaccuaucuacuugaaaagcagaaaagauuuaagcgcuuaauaagcuuucccauuuaccaagauacacugaauuuauacugugauccuucuuccuuuccuuuuugaacuuuuaagaauaauacuauagaauggggguuguggguggggaucuagccagugcaauaagacaggaaauucaagaaagaaagaaaaaaauuccucauuauuucaauaugauuuaauuguauuguagaacauaccagaauaggcuaggugagguggcucaugccuguaaucccagcacuuugggagguugagguggguggauagccugaggucaggaguucgagacuagccuggcuaacaugcugaaacccugucucuacuaaaaaugcaaaaauuugccggacaugguggcgugugccuguaaucccagcuacucgggaggcugaggcaagagaaucacuugaacccaggaggcggaaguugcagugagccaagauugugccauugcacuccagacugggcgacaagagugaaacugugucucaaaaagaaaaaaaaaaauaccaaaauaauuaauggcauaagugaguuuauuaauaauacaucauggggucagucuauaaaaauuaguuaauuucuacauacuagcaacagacauaaaaugagcuuuauaaagauauauuuuagaauaguaccaaaaauagaaaauaucuaagaguaaaucugaaaaauauguauaauaccucuuuaugaaauuuuugacugggcaugguagcucauguuuguaaucccagcacuuugggacauagaggcaggcagaucacuuaaggucagaauuucgacaccacccuggccagcauagugaaacucuaucucuauuaaaauuacaaaaauuagccgggccugguggcucacaccuauauuccuagcuacuugggaggcugaggcaggugaaucugucugugcucauguauaucuucaguggguuagauaugauagugcaauaauauuauuucuucccagaucaauccuuaaguuugauacaauuccagauucauuuuggaggaaguuuacaagccaauuauaaaauguauauaaacaugcaaagggucaggaauagcugagauauccuuuugcuauauuuauccuaaaaagaucugcucauaucuguauucuuuucacuguuuucucaauucaauuuugagucauugacuuuuuaggcucuaaggugguuuaucccuucuuuucuugauaaauauuugaaaauuuguauuuauuuauguguuuauugauucauucauucuuaaauauaagcaguuucucuccauuuaccccuucccccagccccuggcaauuaccagucugcauucugucuccaugcauuuaccuauuuuggauauugcauauaaauugaaucauguaauguguuguuccuugcgucugucuucuuucauuuaguauaauguuuucuagguuuauucguguagcguauaucaguacuucauuucuucuuauggcucaauaaauauccuguuuguugauccauucaucgguuggcaucuaggcuauuuucaucuuuuguuuuaaauggugcugcuguaaacgugugugucuauuucagcaccaguuuuuaucuguuuuaauacuagaaguagaauugcugggucauacagaaaaucuguguucaauuuuuuugagcagccaccaaacuguuuuccauaguagcuucaucauuuuacuuucccagugauaaauauuuuugaagauaagcaaaaacaaauuguaauggauuuucauuuuuuguuauuuuaagccacaggugucaagcucucauaacccuacaucaacagaagaacaacaguuauauugggccaaagggacuggcuuuggaacaggcucuacagcuucugggugggauguggaacaagccuuaacuaagcaaaggcuggaagaggaacauguuaccugccuucugcagguauauuuguaaacuugauauuguucaugauaauggcuuuuuuuuuguauuuauuauuuuaaaauauugauaacuaauccaacuuuccucagcuauguuuaugcccacuugugguccuucuucccagugcauucuaagauaccacuggauaaagauuguucuugcuuacuugugacucuguauuucuucccucucaacuagcuucuucacugagaggaaaguggcagggaugaaauuauccaguagcuggaagaugcaucuuccuacaggcauuuucuuguuuaauguguuguaucuggccuuuuuuuuuuuuuuaaguguuauuuauuuauaugcauuuugguugcuuacuuuuuuuuuuuuuuuuuuuuuugagacggagcucacucuguggcccaggcuggagugcaguggcgugaucucagcucacugcaaccuucaccucccagguucacgguugcuuacauuuuuuaaaauaacuuuucagccgggcgugguggcucaugccuguuaucccagcacuuugagaggcugagguggguggaucaccugaggucaggaguuugagaccagccuggcaaacauggugaaaccugccucuacuaauaaauagaaagauuagcugggcuugguggcacaugccuguaaucccagcuacucaggaggcugaggcaggagaaucacuuaaacccgggaggcagaggucgcagcgagccaagauugcaccauugcacuccagccugggcgauaagagugaaacucggucucaaaaaaaugaauagauaaauaaauaacuuuucuagauucaggcaaguuggacaagaauagaaagucuuuauaccacagaaauguauaggggaaauaaugaaaagguuagcuuugcuuccugcaucagcuaauugaaguucgucagugcuuugaaugugucuucugcaacucuagaaugcuccuucuaguauaaaguucuaagauuuuguuaccuucaaacugugaauugagucuauucaauaaaauauguaaauaauacagaguugcuacuacauuuuuuauguucguaguuguauugcuuuuauaugucuagucauauguaguguaccauccuuuguaagcaacacucucagacaaaacagauccuucucuuuugaaaauuuaaacaaauaauuauuuuaaaacauaguauaagauacugauuaaguagaaaauauguacucuuaguauucagauugaauuucuaaccuacaauaaaaacuuuugaaguaugugaaacugaaauccaaauuaauuucaacaauuuuuagguucuugccaguuacauaaaucccgucaguagugcgguaaauggagaagcucagucaucucaugagacuagagggcagaacaguaaugcccuuccuucuguacuucucgagcuucucagucaguccugccucaucccagccaugucaucuuaucuacgaaaugauucagguaaauaaucccuguaaaugugucuguggaugaauaauuuuguuugcuuauuuuaucauugucuaauaguaaguuucaguugaaauaguugauggauuuauuuccuaaaaaguauucuggaaauauuuaguugguuuuuggugcccuuaauuugauacuuugucaucacuuaccauagaacacagaauaauaaaaguuucauuauuccuuugucuuuaucugugaaaggugaaaguaaacuuuuuuuccuuuuaaucaucuguaacugaaaaugauaggacaaaggcuaacaacuucaugacaucauucugaucugaauauggucaaauuucuauggauuuuaaauauuuuugucaaacacuaucgcagacaacaguuauuuuugaagaaaggcagauacaugaaucaaguccauagguacuugauaagaugaugauuaauuucuuaaaauucaauaauaaaaguacuguagcuacuuguuuugccaguauacaacugauuauugauugaauaauauaguuuauuauuuccuugguuauggaauuaucuaagaaauguguucuuuuccuaagaauagaaaguuacauguucagaaauguauagauauuuccaagagaaacaagcaguuaacaucuauuucuuucagccaaaaccuuuauuauuuauuguuucaacucuguuuaacucauauucuuaucucugucuuuaucuucuuaugaaaauuuacauguauauuucauuaauuuauuaaggaagaauagauaagggaaacaauggaaaugaaucuugguagucuauuuugugguugguagcagcuaagugacacaguuggaugucugguaaaaauauuaguauuucaagggauuauugcccguauuccccaguaucaggaagauuguuguccuuuaaaaauacgcuauuucccagucugucucagacuccuucauggaaguauuagauugauuuuuuuguuuguuuagauugaccuguuugauacaucagacuggucuuuuuuaaaaaguagaugucaaaugcauaauuuuuuuuuauuaaaauguuugagacuauacauuuuaauuuuagauuauauagaacaauugaauagggugcgauagguuucuuuuuaucucacuucucuauuauuaaacuauuauuuucuuaauccuuauacugugaagauaugaccuaccaaaaauuuuaaauuucuguuuuggucugaaauugacucucuuauaacacugagcuuuuaucuuuaugguucauugucaaaaaggaaauccaggauuauuuacauaauauuuacaguaauuguuguucauguaagugcacuuccugggaagguguguauguuaaacugauuuuugguaaauguauggaauugcagagacuuagauauuauaccuuggaacuguuuuagaaauuuaaugugacagaucgaaguuugaccuuucuuuuaugauguauuauuuuccuggaaaaaagaaauuucuuucaucaggcuuuagauguucuugaauuugguaacuuguccagugguuaauucuaauugauauauuuggaugugguaacaaauacuuauuuugagauaauaccuuauauuaagauaaaaugauguaacuuauagucaguagguuaaacgguagcaugccuccuaaaugauauuaaauauggauuguuuucaggaaaacacagcuuaauauaaguauauaaguacauauauaauuaaguaaacauaaauauaaauauauaaauauauaauuaguuaucaguuuugguuagaauaguaauaauuuuuuaaguggcuacuauuuauuuauuugagacaggguuucccucugucacccaugcuggaaugcaguggcacgaucuuggcuuacugcaaccuccaccucucagguucaagcaauucuccugccucagccuccugaguaggugggauuacagacauacagcagcaugcccggcuaauuuuuguauuuuugguagagaugggguuucaccauguuagccaggcuggucucaaauccuggccccaugugaucugcccaccuuggccuccaaaagugcuggaauuagagaccugagccaacacacccugccuuaaguggcauuuaaaaaccugaacaaauuaucuagccagagucuuccuuagacuuaguaaaauuucuauuuuggaaaauuagucuaaaguuuauuuuccaauuuuuucauuugcguauauaguauuauuuuuggcaaugugggaguugagguaaugugauaggauccacuccaccauuuuuuacuacauuuaguugucauguccuuuucuucuguaaucuggaagaguuccuagccuaucuuuaucuuucauaauacugauauuuuuacagaauguaaccauuuauuuuauagaauauucuacagauugguuuguaagugugagaguaguccucauaauuuugccugagacauuguauucaagggaugauuugcuuauauugcuagcagaugauauaaaaaaacgcaggccuaacauaauagccuuuucugagaacuuuaguaaaauaaugcacauuuucuuucuauaacauguuuuuaaaugauuggugagcaagacaagaaaauauaggaacacacuaguuuaugccuuccuuucagugcagagauuggucugccauuaauuuuaaaugucaauugugguuucuuauuacugucccacacccuuuuugcccuuauuuuuuggcuacagguauacguuagauacuuuguaaucuuuaaacuuuaauguuuaaugacuguuaaagauugagaugaauaccagagucugcuccucauuuuaauaaaaccuucaaguucucauauuaaugaguuuacuauguagcugguuagcuaagucuguuuuauuucaauagaaguuuaaaaacuggccugaacauauuaaaugauaauacuaagcugaccauaaggaucaacaauaauugcacauaaaauugaucuucaguuuuaguucugaacaucuuugcaucaaagguaaaaagagaauauuguuaguuguaaaauuauuaccagaauagagggagcauauaagcuccuuagaggaaaggacaaccuuuuuuccauuacuaacuugucacaauucuguaacugagacaccgauccuauucuccagagguaggcacugauuauguuuagugauuuaaucauuaaguauauuguauuuagucauuaaauaauugcguaagaacuuuuuacuugcaugagagguggagguugcaguaagccaagaucgugccacugcauuccagcaugggugacagagggaaacccugucucaaauaaauaaauaguagccacuuaaaaaauuauuacuauucuaaccaaaacugauaacuaauuauauauuuauauauuuauauuuauguuuacuuaauuauauauguacuuauaugcuuauauuaagcuguguuuuccugaaaacaauccauauuuaauaucauuuaggaggcaugcuaccguuuaaccuacugacuauaaguuacaucauuuuaucucuacuaaaaaaaaaaaacaaacaaaaaacaaaauuagccagaugugguggcacaugccuguaaucccagcuacuugggaggcugaggcaggagaaucgcuugaacccaggagggggagguugcggugagccgagauggcaccacugcacuccagccugggugacaagagugaaacucugucucaaaaaaaaaaaaaaaaaaaaaaaaaaaaaaaaaaaaagauaaauuccugauauuucaucuuuuugaauuuacuguuucuagcaaaagauuuuugugacuaacaguaguuuuccuacucuuuugaccucuuuuuguagaucuuaaaauggguggagaggaaaauuuagauacguaaaugaauggagacuuauuuuuuuauuuuauuuuugagacagagucucauucugucgcccaggcuggagugcagugauaugaucuuggcucacagcaaccuccgccucucggguucaagcaguucucaugccucagccacccgaguagcugggacugcaggcacccgccacccacccugcuaauuuuuuuuguauuuugaguaaagacaggguuucaccacguuggccaggccggucucgaacuccugaccucaagugauccgcucaccucggccucccaaaguggugggauuacagacaggcaugagccacaacccagccuguaaaugaauggagacuuuaaaaaaaagcguuugguggcauuacagcagaaacauaaaucuucauauuuaggcuaaauuaaucagauuuaucaaagguuaacauuaugguuccaguuacucaaaauaguaaguuugaugcuuuaauaauuuguuucuuauugcuuacuaaaauaaagacaucuguuaguguucuagauaggaaaauauauuauuuguucauuuuaauuucuuucucaacauuuucacuuccacuuuucauaagaaaugguauucugaaaguugcguuuuguaggccacaaucauuuuuucucuagcccuuguauaguauggaguuaccccucuggccacuagauggagauccuguuucauuuuaagaaguauuugguaauauucacauguuaauguuaacaggcagaauguuacuuuagagacccucaccuauuuuagaaaauaguauguuccuuuuuugagaagagagcauauuaagucucagcacacauuaaauuauuugccauuaacuuagugggguaugcuacaaauucuuauugaaauaaaucuuuaccuuuuuaauaguggucuuauuauauggggaugaauauucuuucagauuaucaagggaaauugcuguuaucuggguuaaucugacaauucacagauuagaaaagaacaaaugaaaucuagagaaauguauucaguugcucaaguuuaacugguuaguaacguggugauuauuaaacucacuuauuuucaaguugaaaagcaagauauaaauggauuuugucauuaugaaaaauaaaaaugaguaagugauguguuagaguaagguagacaugagagagcaggcacaggacuucauugggaaaauuauaaaguaucuacugaauuggcugguuaucuuaguuaaaugauguuauauacuaggauuaaaauuuuuaauuucccuaauauugguuugacaguuuuauaacaaacuauaaugugucaaaacccauuacugcauuuugauauaccaucugauuuuucucacaguguauuuuguauguuuaaagcucuuuuuuuuuuacuuuauguuaccuuuggauauguuucuuuaagaguagguauuuaauuucauaaguauacuguuugagaauaagguuaauucuguugucacgacaaauaucuuaauuuaaauaugaccauauuuauuaaauuugaauuacuuaguaguuacaucaaaguaaaugugcaguuggaaaccuagccaucuugcuaggucucagggcucuccaaauuaaaaaggacauagaaauuguauuagugcucuuacaggaaaagauaagguuugauaccaauagaaaauacauaauuuuuauuauuuauaaaaauacuuuauuuuguugauauacacugccugagaaacaaauaaugaaaaauugucgagcugucguaacaugauacuuaacuguauauccuuauuuauaguuuucaugguaauaguucauaugaaacugucaaauuaugccauuucuuuguacuguuuuaauaaagagucugggagcugugguggugguucaugccuguaaucccuuugggaggccaagaugagaggauugcuuaugcccacgaguuugagaucagccuuggcaacacagugagacuucaucucuauuaaaaacuaaaauaggccgggugaaguggcucaagccuauaaucccagcacuuugggaggccgacccgggcagaucaugaggucgggacaucgagcccagccugaccaacacggugaaaccccgucucuacuaaaaauacaaaaauagccgggugugguggcgcaugccuguaaucccagcuacucaggaggcugaggcaggagaaucgcuugaaaccccagaggccgagguugcagugagccacaacacuccagccugggcgacagagcaagacuccaucucaaaaaaauaaaaaaauaaaaauaaaauaaucuaucagauuauucuacuaauuagaguagcaggccaggugugguggcucacaucugcaaucccagcacuuugggaggcugaagcgugaggaucaccagccugggcaacuuagacccugucucuacaaaagaacaaaaaaucaacacucgccuguagucccaacuacucgggaagugggaucccaggagggcgaggcugcagugagccgugaucauaccacuacacuccagccugggugucagaguagacccuaucucaaaaaaaaaaaaaaaaaaagguagaguaaccugccacuuuauuuuuagcccaaaguauauuuuaauaguauuuuaauauggcucuaguuuuugugacaguuagcugagcaguaccaauaaaaauuaaaacacuugccuauguuuaauguauuuauuucuauauauggucacuagcaaggcauguugauagcgacucagaguaucuauaacguaagugcuuaucaacaaauguuaauuccuuuuauuuagaguuuucauuuuugucaagggcauccaauguggaaaugacuuugguauagaauauaugacucuguguuaaauaauuaugacugguaaguuuuauaaggggaggacagguugcuuaaauuaaaauuuagauggguuuugaauugcuuugauuuguacagauuuguaaaguuaaaguauuaguucacaucucagacacuucagggauaccauucuugacuacccagcguaguccuuucucuccuaugagcugcucacguaccuaauccuuauauugucaccuuucacacuguaguccagcuauuaagaaaagcuuaaucagauuuccacauaacuaccuaccagauuagccauaacucuccauuucuucuaugaaacaucccaguuaagagugagcuguguuuguuuccagauuuguuuaugccaguuguauuuccgcuauauaauuguuuugcaaacuagauguuuuuaugguaaaucaugaaaugcuuuaaaaaaguccuacaggccaggcucgguggcucaagccuguaaucccagcucuuugagaggccgagguggguggaucaccugaggucaggaguucgagcccggccuggccaacauagcaaaacuaaaaauacaaaaauuagccgggugugguggacgggcaccuguagucccagcuacuugggagguugaggcacaagaauugcuugaagccgggaggcagagguugcagugagucaagaacgagccacugcauuccaaccuaagugacagagcaagacuccaucucaaaaaacaaaaagaaagaaagaguuacuccaguuuacuuagagaauauauuaaaauguuaacaaugguaguuuuauuuuguauuacccacauuuaucagagaaauaaugucaauauuuuauugaaacaagaaaguuucuuuucuauguagucuuuauuuuucuauguggccuuaucuuuacaacugcuuaacuaccaaaagucacgcuaaggcucauuucuuuggaguuacuaaaauauaauuuccaaagacaguuuuuaaaauauucaguguucauuaaugcuaacuaaaacuucauuuuucuaaacauuuucauagucuucuuuccuauacugacuaaauuucccuuuccuguauucaguagauuacuagaggcuuaaggaaaacacaaaccuaaaugcaguuuuauuuuaauuaauguguauuuuauauguacucuuagaaaaaugguuguagcauuuuugcuguugugucuuguauacguuacuaaaucuuguauguuuuggaguaguccaucuucaguguccauauucauugcuuuguccuguuuuuuuccucuguguaaaguuaaaauuuaccuguuugcuuuguuauaauuuuauuccucaaacuggaagcaucauauaguaauugcucuuagagcaagggaguuacccugggauguaugucuuaauauucuggaggugugcuuuuaaaggauaguuucuaaaucuuucuuguuagagccagguuuugcccugaaugcagucccuugaacgagaccuucagagugugguauggauguagaccaaaacaaucacuaagagguuaaguacuguuccagcuauaccuaacauagucaagauagauucuucuuuuucuucucuucuugcuucuuaacaucuucugcuguagugaugacagaaguaccaguuuucccagaaaaugucuucaucuagagaaaaagagaaugauugugaagcaaauugcuagaaaauguauuuauuacaaauacuaguacauacuagaaaauugcuagaaaauacuaguaaauacuagaaaauugcuagaaaagaaauacuagcuaguaaauacuagaaaauguauuuacuagcagagagcuaguaaauguauuuauuauacauguugcauuucuugcguaguuuuucagugugcaguccuacuuuagucuguuaacguguuggaaaaugauaguaaaugaguguauuuuaauagaauuuaaaaucuguuguuuuuaacauuugggcugaagagccgaaaauauaaugaaaauguagaaguuagauucugccauuuacguauucuguauuuacuuagauacuuaaaaauuuuuacguaucuaacuaggcugauguauuuaaugugaacugcaauuuauauacaaaaaacuacacauacuuaguguauacaauucgguaaguuuagaacaucaacuccuuuuuaaagcaacucuuuuggggagcaguugagcagaauagggauuuaaauaauuuuuuccuuugaagauuagaggaucauugugucauuaauuuuauaaucuaguauugaaauuaauuccauuuuacuaauauuuugaaaaagcaauuaauagcagaguuuaucucuuaauaaaagauuuauuuccacagauuaaacacaucacauauuuaagcuuaaaauaauggaguuacuaaaugucagaguuuuaaaauaauuaaaagagaagugcugcuuacccuacauugcaucaggaguaaaguguuaucagauauguugcuuuaguccacaauagugaugaaugaaccuuuucucuucacggagggcuugugaacaaaagcugaacaagcuucauaucaaagauggcaaauguuuucaguauauccugaagggauguaucuucgcuguuaguaaucugugguaaauuucacuguaacuauuugauguaaauugcuagccucugcaaguaagucacacuguaaauaggcucuauuuuuuaguuuuuuuagguuuuuuauaugcugaaucacauauuuccuccaaaaugcuaauguuuaugguuauuucuuuugaauuuucugucugaugaaccuuuacacuguucuuuuucuuuucagcuguuugaagauacuuuuccccauugaaauguuuuaguuccaaaugcagaaagugauuuuauuccucucccuacuaccaguuacuacuauaaaaaugaaaaaaauuguuuauuggcauaaguuuuguaaugucacacacccgcaucuguagcuguugaugacaauuccaagauagucuucaagcuaugcauaaaucagcaaacaggcccuuuugaggauuggaaggauagugacuucacuugccugguuguaagcuguaacacugauuaaacaugcauuuggugcuugcugaguaaaggagcugcaagcugcacuuggagacaugguguugcauaacagcguguugugccucuguucuuugucaggcaggcgcacauugaauccuguaauaacaaugaaguauguguaaaggagcuaaauuugaagacaucuaaggguuuucugaugaagcucuucauggcaaaaauagaaugaaagaauucaagauugaaguaguuuuuauguuguuuugugcuuuaacaggcagguuuuuauuaaggguuuauuaucuuuauccauucuuguugcuugcugaccaccgguacacauuaauuuacaauaaaagcacaugucuuaaaaggagagcauaaaucagcucuacauuaguuuuccaaguucuccucuugguugggggggucuucaaaaucuuuaaaaaaaaaaaaaaaauaaggccggcacaguggcucacaccuguaaucccagcacuuugggaggccaaggccgguggaucaccugaguucaaggguuugccuggccaacauggugaaacccugucucuacugaaaauacaaaaaaauuagccagguguaguggcgggugccuguuaucccagcugcuuggaaggcugaggcaggagaauugccugaacccgggaggcggagguugcagugagccgagaucacgccacugcacuccagccugggcaacagggugagacuucaucucaaaaaaauaaugacaacaauaauaauaaauccgauauaaauaacacaugucagguuccagacauaggcauagauugucauaugcauuaauauagaauuugacuuaaagaaaagcauacuuacguaacuaaugguugucaagaaaaauacagaaauacaaaaaacuugauauuuuuaguuuaaaaugaagaaauuugauaucuugagauauuuuuuaaaguacaguaaugaaauuuaaaguucuuuuuaaaauuuuaaagauuuuuguaaaauaaacacacaauuuuaucucucacauuuuuuggacuauucccagucucgugugccagugcuuauuauuaccuuguuuugcuagcuuuugccuucauacuccuugauaugaagagaauaucuucuucuauuuccauaauguaagauucccaguuggccucuccuaaugcuaacucaauagaguaaaauauauaccaguuaaauaagagggaauagcauguuucauuuauuucagaggagcuguguuguuuucucuaugcccuuuuguuuacaugugaauauaauguaacuauauauuuuuucuuuuuucuucuucagucauagucuucucugccacccgggcuggagugcaguggugugcucauagggcacugcagccuucaauucuuaggcucaaacauccuccugauuagcugggacuacaggcaccugccaccaugcccagcuaaguuuuaaaauuuuuuguagaaauagguucucauuauguugcccaggcuaguuucaaaacuccuggccuuaagcaauccucuugucucagccuccugagucacugggauugcauacauaagccacugugcccgacuuuuuuuuuuuuaugcaacaucucgugcuuuauaaauugaccugcaaguaggccgggggcgguggcucacaccuguaaucccagcacuuugggaggccgaggcggguggaucacgaggucaggaggucgagaccagccuggccaacauagugaaaccccaucucuacuaaaaauacaaaaauuagccgggcgugguggcacgugccuguagucccagcuacuugggaggcugaggcuggagaguaacuuguacccgggagacagagguugcagugagccgagaccaugccauugcacugcagccugggugacggagugagacuacaucucaaaaaaaaaaaaauugaccuccaaguaacauacuuuuuuuuuuuuuucuuuuuucuuuuuuugagauggagucuagcucuguugcccaggcuggaggacaguggcacgaucuuggcucacugcaaccuccacuucccaagcucaagugauucuccugccucagcgaccugaguagcugggucuacaggcgugucagcacgccugguuaauuuuuguauuuuuaguagaggcuggguuucaccauguuaaccaggcaggucugcaacuucugaccucaaaugaucugcccaccucggccucccaaauaucugggauuacaggcaugagccacugugcccgcucaugagugauauacuuucuaauuaguauucauuaauuaugaaauuugaaaucguucgauuucauuuuauuuugauuuuuuuuuaguuguaaauuauauucaagguuuuuuuugaaccuaaaguuuuuuuuaaaguuucugggauuaucuuuuauguuuauaugaagaaauaaugcuuuaaucauguauauauauauauauauuuauuuauuuauuucuagauuuugcugggggcagugcucacgccuauaaucccagcgcuuugggaggcugaggcgggcggaucacgaggucaggaguucgagaccagccuggccaacauggugaaaccccgucuuuacuaaaaauacaaaaacuagccaggcgugguggugggccccuguaaucgcagcuacucgggaggcugaggcaggagaauugguugaacccgggaggugaagguugcagugagccgagaucaugccauugcacuccagccugagugacagagugagacuccaacuuaaaaaaaaauaaaauuauuauuauuucuagauuuuaacaauuggaauuaucaguuauauuugugcuugcaaauuugugggaucucuuuuuccccuucucuuccuuauugaacuuuagcaugcuagacugucuucauuauucauguauggagaagaagauucucauuuugugguuuugguuguucuuaauaccuucauaauaauuuaauuuuuaaaacauaaacauaucuuguauuacuuguauucuuuuauaauuuuaucuaaauugcuguugaguauuuuuagguucacagaaaauugagcagauaguacagaguucccauauaugcaguuccuacucacaguuuacuuauucauauuuugcauuaguguaguacauauaauugaugaacuaauagugguauguuauuuuuaacuaaauuuauaguugaaauucgaguucgcucuuuauguucuacaguuguguggguuuugacaaaugcgcaauuuuauguauuccaccaugacaggaucacacagaagaguuuacugcccuaagaaauucuauuaauccugcaucccuuccuaauccccagaccucugguaaccacuguucuuuguacugucuccauaguugugccuuuuucagaaugucauauaguuguaaucauaagaucuagccuuuuagauuggcuucuuucauuuaauaauauacauuuaaguuuuguccauguguuuucauggcuugguggcugcuuccuuuuuuaucgcugaaaaauauuccauuguaugaacauguaaguguuuauucauucaccuuuugaagaacaucuugauugcuuccuuuuuuuggcauuuaugaauagaucugcuauaaacauucacauacagauuuuuauucccaguuuuguuucacugaucuauuuguuuauucuuucgugaguaccacauugucuuaauugucgcagcauuauagucagguggucaagucauauagugucaguccucugacuuuguucuucaauguugugcuggcuaugcuacguauuuugccuuuccauagaaacuuaaucauuugauugauagccacaaaauaacuugcugggguuuugguuggaacaauguguccucuguucuguuucucuuuguauguuacaugaagaggguugagaacggugaaauacuaugugcacuacuuugcuaaaugaguuuauaaagcagugcaaaugguaaucuuuggguaccuggcuauauuuuuaucaguauaaauucugauuuuucaaauauuucgauguagacagggaaaucauucaaaacuguggauuccauuccagcagauguagcuaaaaugggggggcaggagaaaacuguggaauagggaagguuuuuucuaaggcuucauuauugugccagucucaaguugaaaagaggcuacaugauuguacauucaagucuuauguuuuccuauauuugaaaaauaaaaacauuuauaaaauauaugcaauguuuacugggugcuuuuccucguauuaguguuuuaaagcaauugaagaaaauaaauauuucaguauaaaaaggagcaaauguauaugaauaaguacuuaagagaaaaaaauuuuagugacagcuuuaaugguugauaauucgguacccuucaguucacccauuuaaaguauacaauucauugauuuuuauuauagucacaaauguguacaacuguuaccaaagugaauuugauaauuuuuuuuuuucaccucauaaagaacccuguacccuuggccaggcacauuugcucaugccuguaaucccagcacuuugggaggcccaggugggcggaucacuugaggucaggaguucgagaccagccuggccaacauggugaaccuugucucuacuaaaaauaaaaaaaugagccgagugugguggugggcgccuguaaucccagcuacuugggaggcuaagacaggagaaucgcuugaacccgggaggcggagguugcagugagcugagacugugccauugcacuccagccugggcaacaagagugaaacucugucucaaaaaacaaaaaacaaacaaacccuguacccuuuaguuaucaucuuccauccccucaucuucucuagcacuaagcggcugauaaucuacuuucuauccuuauauagaguugccuuuucugaauauuuuauguaaauuggaucauauaauauguggucuuuuuaaauuggcuuuuuccaugcagcaaaauguuuucaggguuuauugauguugaauguaucaguaguugauaacuucuucgggcugaacaacauuccauuuuauggcuguguacuacauuuugcuuuuccaucaguugaugucuauuuguuuuugcauuuuggcaguugcaaaaauguugcagugagcauuagcauacaaauaucuauugguguuucugcuuugaauuccuuugguaauauaccuaggauggaauuguugaguuacauggauuaccugacuuuuaaaauuacaauaaucuuacugggugugagaugguaucucauugugguuuuaauuugcauuucuuugaugacuaaguauguuaagcauauuuucauguguucauugacuauucaccuauccuuuccagagaaauaucuuuucaaauucucugccccaugagugggggcuggcuagaagaggggauugaaugucaacuucuuagccauguguaccuucuaacuuagcagcaggagguugcugugguaggaugggaaaugcugacauccugccccucaccccgcuaggaaggcaggcuuucagcucuguacuaaggcauagcuuuccaacuuggaccucugggagagggaggccuguguucuuggcuguagccagcuagagugguuuuucuuucucauugagcugaggguggggaagaaaggagcagcaucuugauucacauaccacagacucuugcuuuucuuacugaguuuuaguacauuuucuugaauaaacguuucuucauuugcugcauacuguuaggaccacuuccagagauuuuagauaguuguguucuuuuaaagaguauguaccaguuucacuggggaucugaucugcagggaucuucccucucaugcuagcaagaaaaauugaguucucauaaaccaaguaaaauauucaagcuuuccuacuaauuaaauguuuuagaaccuuacaguggaauauuuuguauccaucaaguucuugaaaguagaaaccaucuaucuugauauuggguagaaagaggaaguuagacacuauggaguaucuaguuuuuauaaaauucaacacauaccuaaauauacaauaucauguacuucuccccuauaagacauauuuuauuaauuaaauuacaucagguuuuucuuaaguauucuguucuccacauuuuaaaauucaaaagcuuuaaggugguaucuaauaaauagcuguuuuccugccucuguccuaccaauaacagcucauuagggauaaacuauaguuaucccuauaguacuaaucuaacuaauaguacuaauaguuacagauaguacuaaccagugcuacuaauuucuuauauuucuuuauaggaaaucuauguauaacaaguaaauauaaauacauauuaguucauugucacacugcuauaaagaacugccugagacugggugaauuauaaaggaaagagguuuaauugacuuauaguucugcagggcuggggaggccucaggagacuuacaaucauggcagaaggggaagcaaacauguccuucuucacauggcagcagcaaggaaaagugcagagcaacgcagugagagccccuuauaaaaccaucauaucucgugagaacucacuauuaugaggacagcauggagguaaccacccccaugauucaguuaccucccacuggguuccucccaugacacauggggguuaugagaacuacaaugcaugaugaguuuuggguggagacacagccaaaccauaucacauagucucccucuuuuuauguuuuuguuauuuguguuuuguuuuauguuuacccaaauaaucauuuauuuuuuauuaacauuuauggguuauguuuaccauauaacccauuuuuauaccuuacuguccuauccccaccccaaaaugacauuauaguacuugcgaauuugcuccaguacagcauaaagcauauucuaauuuuuuauggcuacauaaugggcauuuaguaauuaaaacaguugcauauuaauaaacauaaauagguucuuuuuugagauaaggucucacucuaugucccaggcuagagugcagugguguaaucaugacuaacugcagcuucccaugcccggcuaauuuuuuaaauuuuauacagacaggaucuugcccaggcuuggaguacaguggugugauuauggcucacugcagccucgaccuccuggacucaagugauccugccacuucagccucaugaguagcugagacuacuggcgggcacuaccacaccuggcuaauuuuuaaaauuuuguguagagauugggucuuucuguauugccuaggcuggucuugagcuccugggcucuagcgaugcuucugccccagccuuccaaauccugggauuauaggcaugagccacugcauccagcucacauauuuuuuuaauugacauuuuuauucuguuguauaugcccauuguaaauaugauauaccuguuuauugagacuaucaucucuguccugcagcauagauauuuucaucauaaguuuuuuuguguauuuuuguuguauuuccuauugugcaguuucucuauuuuacaguugauuguuauauaaaauuaacaguauucauuuaugugaauuuugcauccacauacuuuaguauucuaauaguauuucuguggauuuaccguauuuuccaaauagagaaucaguuuucugagaaugaagacauuacucuuuucccacuucuuuuuuuguuuguuuguuuugaaacagagucucuguuacccaggcuagaguacaguggcaugaucuuggcucacugcaaccucugccuccaggguucaagcgauucaccugccucagccucccgauuagcugggauuacaggcgcacaccaccacaccuggcuguuuuuguauuuuuaguagagacuggguuuugccauguuggcuaggcuggucuugaacuccugaucucaggugauccaccugccucggccucccacacugcugggauuacaggcgugagccaccacaccuggucuacccacuucuuaugcuuuuuuaaaaaaauguuuuucuuuuggggaauccccauauccacauaccuuuccuggcuuguauuuauaaaacagaaugucaggaauuugucucuugaagaugcuacuuuccaaaagaauuuuuuguugugaugaaaacacucuguaucugugccauucauuaaggacuuguguggcuaugggacacuugaaaugugguuagugcaacugaagaacugaauucuuaguuuucuuacauuuuaguuaaaauuuagauagcguguggccaguagcugccauacuggacaguucaggaaguaucaugggauaaugggaaaagcacuaaagcuaaauguaccaaguuuucacuguuggucuucuuacuuccuauuuagcugcuugugcaacuuaguaaauauuaguuucucauacacacaguggggaugauaauaccuaauccacauaauaguacacacagagaaacaucaucauauagaaaauggauuagauggauguauaccaaaaugauguaccagguaaaagaguggggaaggaggccgggugugguggcucacgccuguaaucccaacacuuugggagguugagguggguggaucacgaggucaggaaaucgagaccauccuggcuaacacagugaaaacccuucucuacuaaaaauaaaaauaauaauuaaaaaauuagccaggcaugguggcgggcaccuguacucccagcuacuugggaggcugaggcaggagaauggcaugaaccugggagguggagcuugcagugagucaagauugugccacugcacuccagacugggcaacagagcgagacuccgucucaaaaaacaaacaaacaagaauggagaaggagagaaauagucaaaagaaacuauagccuuaaaagguaaguuuuaucuuuuuuuuuuuuuuucaggauaaucuauuugaaauauuaaucacuguaaucguaacacguuaggaggccaaggcagguagauugccugagcuuaggaguucgagaccagccugggcaacauggugaaaccccaacucuacgaaaaaauagaaaaaauuaacuggacaugguggcaugugccuguaaucccagcugcucuggaaugugaggcaggaggauccuugagcccaggaggccaaggcuacaaagugcaaugguuacaccauugcacuccagccugggcaacagagugagaccuuggcgcaaaaaaaaaaaaaaaaaggaaaauaauauaaauauuaauguaaaguuauuuuuuagaaguucaccuuuuuuggcugggcgcaguggcucacgccuguaauuucagcacuucgagaguucgaggcgggcagucacuugagaucuguaguucgagaccagccaagccaacauggugaaacaccaucuugaccaaaaauacaaaaauuaguccggcaugguggcaugcaccuguaaucccagccacuugggaggcugaagcaggagaauugcuugaacccuggagacagagguugcagugagccgagauuaugucauagcacuccagucugggcaacaggagcgaaacucagucucaaaaaaaaaaaaagcacacauuucuugcacauagugugaagucugggguuuuaguguacccaucacuggaagaguaaacauuguacccaguagauauuuuucaaaccccacuuuuuggaggagucucccaugucucucucuuuuuuuuuuuuuuuuugagauggagucucccuccguugcucaggcuggagugcaagugcaguggugcgaucugggcucacugcaaccucugccucccagguucaagugauucuugugucucagccucccgaguagcuggguuuacagacacccacaacgaggcccagguaauuuuuguauuuuaguagagaugggguuucgccguguugaccagacuggccuugaacuucuggccccuagugaucuccccaccucagccucccaaagugccgagauuauaggcgugagccaccgcacuuggccuguaguuauucuuauagagaccuuuuacuuccuugguuaaauauauuccuagguauuuuguuuuagauuuuauuauuuuaucuuauuuuuaauuuuauuugacagggucuugcuccgucgcccaggcuagaguacaguagugcuaucagagcucacuguagccucgaccugguaggcucaagugauucuccugccucagcuucccaaguagcugggacuacaggaaugaaccaccacaccugacuaauuuccuuuuugguuuuuguagagauaaggucuuacuauguuguucaggcuggucuuaagcccuuggacccgagcugucuuccagccuggaccucccaaagugcugugauuucaggcaugagccaccacacuuguucauuuuuuuuuuuuucuguagcuauuguaaaugagauugcuuucuugauuuaauccuuggcuagaugauuauugguguauagaaacauuacugguuuucauauauuaaucuuauauccugaaucuuuauugaauucauguaucaaauccaagaguuucucauggagucuuuaggguuuucuagaucauauccucagcaaacagggaaaauguugacuuccugcuuuuugaguuugaaugccuuuuuuuuuucccuugccugauuacucuggcaagauguccaguacgauguugaauaagaguggugaaaaugagaacucuugacuuguuccaguucuuagagggaaugcuuucagcuuuuucccauuaaguauaguguuagcuguggguuuuucauauauggccuuuauuaugcuguguguuccuucuaugcccaguuuauuggggauuuauaucaauuuuaucacaugcuuuuucaacauuuauugaaaugacuauagaguuuuuguccuuuauuauguuguuaugaugugucacauuuauggauuuguguguguugaaccauccuuguaucccugggauaaaucauacuugaucaugauguauuaucuuuuuuuuguuguuuauuuuuuaaaaguuauuuauuuauuuauuuugagaucagcuugugagacuggcuaauuuuuuuauuuuggguagacacaggguuucaccauguuggucaggcuggucucgaacuccuugccucaagcaauucacucaccuuggccucccaaagugcugggauuacgggugugagcuacagugcguggccauuuauuuguuuguuuguuuguuuguuuguuuugagauggagucucgcucugucacccaggcuggagugcaaugguauuauccuggcucacugcaaccuccacuuucuggguucaagcgauucuccugccucagcacccccaaguaggugggaccacagacuugcaccacaacacccggcuaauuuuuguauuuuuaguagagauggguuucaccauguuggccaggcuggucucgaacuccugaccucagguuuuccacccaccuuggccucccaaagugcuggaguuacaggugugagccaucacgcucggccuauuuguuuauuuuuaaggguugaggucuugcucuguugcccaggcuagggugcaauggugucaucguagcccacuuuagccucaaacuccuggucucaagcaguccucccaccuuagccucccaaguagcugggaauacagguuuuugccaucacaucuggcuuauuuuauuuuauuuuauuuuauuuuuguggagacagguuuucuugcucuuuugaccuugcuugucucgaucucuuggucucaagugauccuccugccucagccucccaaaauguugggauuacaggugugaaccaccaugccauuauuguauuaucuuuuugaugugcuguuggauuugauuuacuuguuuuuuguuuuggauuuuugugucugacuuuauuagggauauuggucuuuaguuuucugcuuuuauuauaucuuugccugguuuugguaucagcauauuaccggccucauaaaaugaguuagagagaauaaacuccuccuuaauuuuuuuaguuuugggaggacuuguaucaguauguuguuuuuauauuugguagaauuuggcugugaauucaugugguccugggcuuuuuuuuuuuuuuuuuuuuuuuuguugggagauguuuuauuaugauugaaucucacugcuuguuauuaguuuguuuagaaauucaguuuguuucuuguucaaucucaggagguuguauguuuccaggaauuuacuuguuuccucuagguuuucuagguugaguguagaguugaucauaauagucccugaucuuuuguauuucuguaguaucaguuguauuccuuuuucauuucugauucuguuuauuuggaucuucucucuucuugguuagucuagcuaauaguuuaucaguuuuguuuaucuuuucgaaaaccagcuuuucaguuugcugaugcuuuguauauuuuuguuguggggggcuguauuucauuuaguucuguguuauucuaacuuuggguguggauuguucuuacuuuucuaguuccuugagguacauguaagauuguugauuuguuacccacuuucugaugcaggcuuuuaaggcuauacacuucucucucuuugcacugcauuugcuauaucccacaguuuuucugauguugcguuucauuuucauucauuucaaaaaauuuuuaaauuugccuuaauuucuuuguugacccagugaucauucaguaucaugcuguuuaauuuccauguauuuguacugcuuccaauguuccuguugguauuguuuucuagcuuuauuccacuguggucuugagaagauacuugauaugauuucgauuuucaaaaauuuuguuaagacuccuuuuauggacuaacguggucugucuaggagaauguuucauguguuggugaaaggaauguauauacugucauuguugaguagacuguccuacgucuguuaaguccauuuaguccaaaguccaauuuaaguccaauguuuucuuuguuaauuuucugucucaauuaucuuucuagugcugugaguuggguguugaagucucccacuauuauuguauuacugugaauguuauuguuugauuaugguauuacugguagaucauuuccagcuuucccuauugaaaacaguauuguauugaacauuucuuuguaggguagacaguaacaagugcuauuauugagucauagaauauaggcauuuaaaauuuuaauagauaaugccaguuggcuauaccuguuugcgcuuuuaccuauaugugagucuagcuuuuccacauccucacaaguacugacauuguguuuuaugccuaucaguuaguaacuuuuggauauaauuuugauuuuccugaauaacauaguaucuuauaauacuauaaaauuauaguaaguaggauguugugacauuguucauggguuggaaaaugggcuuucauacucaaguauauguggaaacaaggggaaacaaggaaagaauggcagucauacuacccuguccucugcaucaucacuggaagguguaaaaugaccuucucuuccaucacuuugaacgucacuccaaguagccucacugucauuaagcucugauagucucuauuuuacaucaguuguagagaucucuuucacaucaguuaccauacaaaguacaggaugcuaggugaugccacauccuguuacaacuuaauccccauauagcucugugggcacugaggcaauuccuaccucuaguuggacucccacaauucuccuccccugcuuuaguuuucuauauagcauucagaauacuuacuagcuucugaaaagaauguaacucauguccuucgccuagaauguuagauacuugaugguagagauuuuuguuuguuuucuuuacugcuuauucccagccuguccagcaacagguuuucaguaaauguuuuuuguuuguuuguuuuugagacugucuugcucugucacccaggccggagugcaguauguggucucagcucacugcagccuccgccucuugaguucaagcgauucuccugccucagucuccugaguagcugggauuacagaccugugccgccaugccuagcuaauuuucguauuuaguagagacgggguuucaccauguuggccaggcuggucucgaacuccugacccccggugauccaucagccucagccucucaaaguggugaaauugcaggugugagucaccgcgcccugccaguaaauguuuauggaauggcuguucaguaacugucauuggaagagagauguuagauccuuaucucacguuauucacaaaaguaaauuccaguugguauacaacacaaaacccaacaaaacaacuuauaaaagccuuagaagcaacguguguuccucgaguaaggaauucacucuuagauacaaauaauuuuaauacaaaauucauuugauuuauagcuaguaauuggaaguuaacauaggcaauauuuucuuuuuuacuaaaaagaaaguugauuuauugaaauagacucuggauaaauugcaauucugucauucguuuucacaaaagauaaaauaacuucaucauucaauuuaguuuaaaaaaguuuccacuucauacugauaaauauguuuccagccauaauauauuaucugguguauuuaaucauuucuauauguaauauaacuagauauuuaguuacauuucuuguucuccccuaaacuugauacuuuacuuuuuuuuguuuuccaaaagugccuauuauuauaguuuguauauuggugcuucuuaaauaucugcugcauucuuucauuuagcagcuaaccuauuaaguugacccuugaauaaugcagguauuaaggguaccaacccccacauauuugagaauccaaguauaacuuuuucuuuuuuuuuuuuuuuuuuugaggcgggauuuugcccuaucacccaggcuggagugcaguggcaugaucuuguccuccccaguugcagggacuacaggugugcgccaccacgcccagcuaauuuuuuguuaucuuuuuguagagauggaaguuuuaccauguugcccaggccggucucaaacucccaggcucaagugauccucccaccuuggccucccaaaggucugggauuaugggcgcgaaucacaguguccggccccaaguauaacuccugacucuuccagaacuuagcuccuaauagccuacuguugacuggaagccuuacugauaaucaauuaacacauuuuggauguuguauguauuauauacuguaagguaaggaaaagaaaauauuaagaaaaaaaucauagaaaauauauuuacuguucauuaaauggaaguggaucaucauaaaagucuucauacucagagucuucauguugaguagccuaaugaggaagaagugaugagguuggucuugcugucucaggcuggcagaaaaucuguauauaaguggacuagugcaguucaaaccuguguuguucaagggucagcuguaauuuuuuugagacggaguuucacucuuguggcccaggcuggagugcaauggcaugaucuuggcucacuauagucuccgccucccagguucaaacaguucuccugccucagccuccgaguagcugagauuacaggcaugcgccaucccaccuggcuaauuuuuguauucuuaguagagacaggguuucuacauguuggucaggcuggucucgaacucccgaccucgggugaucugccugccucggccucacaaaguacugagauuacaggccugaaccagcgugcccagccgggucagcuguggaccuugguaagauccagguaaaagcuacauuccuguggaccuacuuuuauauuguacauuugcucauuuugugcuuuuucuucuucuccuuauaguucuggacauggcaagacaugugccacucuaucgggcacugcuggaauugcuucgggccauugcuucuugugcugccauggugccccuauuguugccccuuucuacagagaacggugaagaggaagaagaacagucagaaugucaaacuucuguugguacauuguuagccaaaaugaagaccuguguugauaccuauaccaaccguuuaagguacuauauacaauguucauuucucuugaguuugccucuaacaauguuuuuaaaauaacuccauggguguuuuuguuuuucagugauaugugcuuuuuaaaagcauauacacccucggcugggugcgguggcucacaccuguaaucccagcacugugggaggccgagguggauggaucacgaggucaggagaucaagaccauccuggcuaacauggugaaaccccgucucuacuaaaaauaccaaaaaauuagccaggcaugguggcgggcaccuguagucccagcugcucgggaggcugaggcaggagaauggcgugaacccgggaggcagagguugcagugagccgagaucacgccacugcacuccagccugggugacagagcgagacuccgucucaaaaaaaaaaaaagaaagaaacaugcacacccucacacacaagcaauaaauaaacauacaaagaaaaaguauccacccaaauuauacacuuagaaacauuuauucacaauugcuuauucaguaucucccugugugaucucauagcuauagguaugaaguuuuucccaaauggugucccauuguaccuguuagacaaauagaugcuaguuucucacauaauguugaugucagagacaucuuucagugucaauaaauaccacugacauuguucuaaauacuucaaauucaccuuuguauuuaggugcuauauuuuauuuaacuauuuauuaguagauuuuagguuauuuucaguucauaauaaccucauacauacaucuuuuggugcuugcagaaaucucugcagauagaaucuuagaaguauaauucuuagguuuauggauuacuucuguuuuauuuuagaagucaaaggauucaguauuugauggaauuaaaauaagucuuaaugcuuaucuuuaaggaaaacugaauuguuauuuuuaguuuguuuacaccuuaguagauucagaggaugaguucugucaaaacucuuuuuuaaauaaccuaggagaccuuuuccuuucccuuggcaggaucuguucagugaccuuuuccuuucucauggcagaaucuguucagugguugucaguuuauuccucaaagauggccuaauucugaauuuugaagcauuuauacuguuaauggaaguuuacuccuuuuucaguuaccuuuugaguaaauuaaugucauuuaccguauuuacuguauuuacuuugcuuuuucucacuuauuuuuuaagaaccuaugacuuaagaaauaguguagaucaaaagaucauagagaauuggucacuggaagaauaauucuuguuagucuuugccuaugagggagaaaucaccuugugaaggaauucugacuuuguuggcuuaauguguugucauuaucacuuuauucauuuauuuuaauagcuuuuggcauacaaaugguuuuugauuacaugggugaauuauaugguggugauggcucauugccaggcagucagaaucauaaauuauagaaaagaugaaaugaagagccaguugguagagauaaaaaguuguagacucauacaacucuguuacuaguaauggaaaauguaaagguauauuuucuuugauagugugauauuuuuucuuuuguagagaagagaauaguguuguauuugguccccuccuaucuuguggccccccccagaaucuuucucacugguaaccaaggaagcuaguguaauaauauaacaauagugugguaucauaauugaacugaacaucugauugucucauugagcuaaugccuccuugagaagugucuacuaaaacaucuuauucccuucccuggccaucuguguugcuuauucuuguagaauaaacauaguuuucaguauaucaauauguauaauauauacugagcuuugaaacugccaucaugucuuuuuaggggaaucuugcccuguauuucuguaccuuacauuucuguguuuugagaugacucuguuagcuuauaacuaaaauugaaaauuuauaaaaccuugaguguuuuuuacccagguauauuuugucuuuuagaugaaaaauugcauaaugauuuggaauguuguuuuagguuuagccuugauuaaaaacaguaucacacauuuauaguguuacaaagugaaaauaaaaccaguaaauaauaauauccuucuuuaaacuguguauuuccuuaugcuauaauuucuauuagauccugcaaaaauggaguuauagaguauugaauucuaagguaauuauagaauauucuuauugcaggaaauuuggacaccuauagugccucuuuggucuauuugcuuuucuuagcuuaaucuauuuccuguucacauaacacuguauaauuuuuugagaaaggaaucuucuuuauaaaaauacaccaguuaauucaccaugaaaauuuaauuucagauagaggauaacugaguuucaauuaacuggagcucuuuauuuuucuauuugauuaaccggaugaaauuauuccauuuaaauucuuuuauucuucagccagagaacauucuucagacuuauaaacuauguaccaacaaaauaugcaugugaagauauaaugaguguucguaaagcucauuucauuagauuauuuuaucuuuacagugaccgugugcaguacauauuuuuaguaauucuuuuuacugauaaacauuauuauauuuugcauuaagacuugaauauacuuuuucguugaaacccucauggucucugcuaaucugugcagccucuguuauaagacggcaccgguaaagacuaauaauguuacuacaucucuacuuucaagguuuaccauauagagaauucauuuucagcuucacagagagaguaaaaucuauucuuuuccaguugucacaacuuaagauguauuuuuuuuucuaacagaguucacaaaauaauccauuuuucccuuacaguguauacccacagaaaguggccuuaguuuaauuuuaacacugacucaaagcuccccaccccaccugucugccucauucccaacuguauuucacaaaaauccuagaauacucugagaagagaaugauucaggaaaauguguucuguuaauguaucacuuucagggucuauuuuaguguuuuuugaggguuuggagcuguaacuuuaaaaaugcuguguaucacggccgggugcaguggcucacggcuguaaucccagcacuuugauaggcugacuugggcugaucacuugaggccaggaguucuagaccagccuguccaacauagcaaaacccaucucuacuaaaaauacaaaaauucagcugggugugguggcacauaccuguaaucccaggaacuugggaggcugaggcacgagaaucacuugagccugggagguggggguugcagugaucacaccaucacacuccauuacacuccagucugggcaacagagggaaacucugucucaaaaaauacauacauacauacauacauacauacauacuauguaucacacacucagaaacauuuuacaauauuucugucucuauuacugugaaauccaagggugaauaaaguacauguauuugguaugguucuuuuuuuaaguaagagaaaucguaguuuacuacuuauuuuuauauaccuaauauauauauacacuuaauauauauauauaccuaauauauauauaccuaauauauauauguauaccuaauauauauauguauaccuaauauauauauauuagauaaagaaaauagauucauuguguauucugcagaucucuagguagugauugugguugcauauaaugauuuucauugaaaugauguguauguuguauuuguaauagaauuuuuaccuuccuuuuggggaugagagaaauuaaagaaaaaggucaaguguaaagaggauguuaacugugacugcugagaauauccugucuaucuugaaaucuauccugaggccacugccuaaacccaauuaauuuugaucugauaauucagagaauggaggagauuccauagguuugugcgcccccaagcccaaaacccuuacaagaggagauaaaaagacaucauuaagaaucuggaucccagugccagcacuuugggaggcuuaggugggacgaucacuugaagccgggaguucaagaccagccuuggcaacauagggagacccugucucuacaaaacauaaaaauaaauuagucaauaucgugggcugcaccuguaguccuagcugcucaggagguugaggugggaggaucgcuugagacuaggauuuugagguuacagugagcuaugauuuuaccacugcauucuauccugggcgacagagugagacccacucugcauguguaagaacaaaaauaaagaaaauaaaaaagaaagcuggaaaggcuuaucauuuaccuuacauuuaucuaauuuguaacauauucaugauuauaagaaauucaugauuaacacugauaggugagaucuggccuggucacaaaaucauuacugaugcauucacuuaacagauuuuuuuuuuaaugucugugggcacauaacuagaaaauuggucuucuuucuaaggggcugacauauaaaugggggaaauaauaaccaggcagguuuuuuuuuuuuuuuuuggacagagucucgcucucucggccaggcuggagugcaguggcuugaucucggcucacugcaaccuccgucuccugguuucaagcaauucucuugcuucagccucccgaguagcugggauuacaggcgugugucaccacgcccagcuaauuuuuguauuuuuaguagagacgggguuucaccauguuggccaggcuggucacaaacuccugaccucagguaauccgcccgccucagccucccaaaguucugggaguacauacaggugugagccacugcgcugggccaaccuggcaguuguaacaacauaguaucugacauauuaguagaauucaagacacuacaggaaaaucaauccagauuuggaggccuaaaggauacauaggaauuaaccaagaauagaguacaaaugaagaggggcaagggauuggugucccaaggguaugaaaacaauguuagcagugaaggaaagcaucacauauucaggggaccuugaaaaguuuggugugccugagcauaguguagcuggaagguaguggugggagaugagccuggagaggaaaucaggggcuagaagauaaacaggaauauaucacagaguuacuuaccuuaaaaguaauguugagccacugaaagguuuucagcagcucucaucagguuugcauuauagaaagauggucuucagguguaguugaaugguuggaggggaaguuggaacaagaccaaacuaccauggaagagacuuucaucuguuuugucucagcagauagagcuguauaugucuucucccuguccuacuguuuugggggacugagauuuugguacucaucagcacucuugcucucauauuauggacuuaauagauaguuaguuuccagguagaaauauauuccaugcuccagauauuugucuuaaaaagcaaucuguguucauauuggcaacugcagauuuaucucuagggaucuccuucaauagaguacaagugccauagcauaaauggaucugggaacauggcuuccuuuguucucauauacgaauccgacgucuacaauguuaggcagaaauuuuccaacacuaauccuauuacuugguuauuugacggacucaggcagaaagcuaugauccgucgauugauagaagcuaagucguuaagucaaaaagcaucuuaaaucuuuuguauuaagguccuggaauggcagggugagacuccauacauguucaugucuuccuguuccucuacuguuugcuuaaagcugucacccagcuaaaguuguagacauggaacacuuauacaacauuaaauuuuguguccuaucuacccaaaucuaaaagagaacucauaugauggugagauauuauuaauuuuauuaaauaagucaguuuucuugauugaaaacugaaggaaauuuucuugguagaaauucuuuguuagaaugcagaaccuuggcauuugugaggaagaacuuuuagauguuauaccaccuaugcuacuguuuacuuaaauuuuucuuugccuuuuuuuucuacuuagaauuuuucuucagaucaacuuaaaaaauuaaacaaguuuuucuuaggcuuuuaaagaggaaacuucaaauuacccccauagcggauggaccauuaucauuugccauaaauaggagacaguguaaacaugagugaaccauuuacugugaauaaaauaguguuuacuuauuaauccuugaaauauauuagaccaugugugcaaagcaguacaaucgggaauaaucauucagauuuuguuuguuaaaugaaacacuggaaaaauaaaugcauguccaucaaaaggaggauuguuuauacuacagaauauucauacauguaaaauugugcaacaauggaaaagaaaagugaucuauauuuuauuuuauguauuuauuuauuuugagacggagucuuacucugucacccaggauggagagcaguggugcgaucuuggcucacugcaaguuccgccuccuggguucaagcaauucuccucagccuccccaguagcugggauuagaggcccuuaccaccacaccuggcuaauuuuuguauuuuuaguagagaggggguuucaccguguuggccaagcuggucuugaacuccugaccucaagugaucugccccccuccgccucccaaaguguugggauuacaggugugagccaccgcgcccggccugaucuauaauuuagauguaaaaacagccagcucuuggauguaucauugaauuuuuaaaaggaagcugggcuggauaugguggcucuuguguauaaucccagcacuuugggaggccaaggugggaggaugauugcuugagcccaggaguucaagaccagccugggcaacaugguaaguaaaacccugauauauuaguugaguugccuuguacacuguacuccuuuuagguggugugcuguggaguagaguagguagaaccaauauugcagccauaucacugaacuuucuguucauccaaagguuuugguaagaaugacugcuuagcugggcgugguggcucacgccucuaaucccagcacuuugagaggccgaggcagguggaucaccugaggucaagaguucaagacuagccuggucaacauggcgaaacccgucucuguuaaaaauacaaaacaauuagcugcgugugguggcacgcacccguaaucccagcuaccgaggcaggagaaucacuugaacccaggaggcagagguugcggugagccaagaucccacuagugcacucuagccugugggauagagcaagacucugucucaaaaacaaacaaacaaacaaacaaaaaaacuagaaugacugcuuaaagaaggaacucaggauuaacacugugggauuuucuuuuaugucuuguaguucucuuauuauagaguuuucacuauuauauauaguaauguaucagguacauaauuauauauaauaucucuaauauacauacauacauauaucugaaaaguagccucugaauuuuuauuuuugaaacaguagacuuuaagccguguuuuaaguuguccucaauuacaccuuaauacuaagugauuaaucucuuacaguuuggugcaugauaauuacaguacucugaugggauugauauuuaguguaaacuagcgcacugcucaaggaaugaguguacuuuuuaguuaauuucaucuuuucugacuuaccuguuagaguaaccuauugacacuguaagguggcagcuagggguguuuaauggugauuuagucuguguuuugaaaguugacaauucuuuaggcaguuguuggguauucacuguacagauuguuuuaagagcuucauaaagaugauguuuuaauauuuuuugguucagggcucuguguuucuguaauuuacuaucuuuccuaauacccccuuucaagagucgugauuuguaauaacugcaugguguuaaguguaaaaguuaacacagauaaacugaugaauauugauguuggcugguuuacuaauaaccagaauuugaauuaaggccauuucugagauagcauuccuucuggaggaacaaaagauuaggccaguauuuuaugucaaaauagagauuuuacauucaacacuuugcauuuuuugaacuagaagacaagguuagaguuaaguauucucaggauuuucuucagaaauuaaagguguuuuuuuaaggaauauaugugacauuugguacauuaguuuaauagcauuuugaauguguacuuuaccuauaccuauaaugcuaaaacguauuguaauuuuuuuucccccugagacagucucucacucugucgcccaggcuggagugcagugacauaaucuuggcucacugcagccuccaccuccuggguucaagugauuuuucuaccucagccucccaaguaacuggaacuacaggcucccgccaccacgcccggcuaauuuuuuuguauuuuuguagagacggagguucgccauguuggccaggcuguucacgaacuccugaccucaggcgaucugcccaucuuggccucccaaagugcuggcauuacaggcaugagccaccuugcccggccuguaaauuucacuuagaccauucuucuaauaucaucugucacuuaaaaccuaaagaauaggcugggugcgguggcuuacaccuguaaucccagcauguugggagguugaggugagaggauuacuugagcccaggaguuuaagacaagccuggguaauauaacgagacccccaucucucuucuuuaaaauaauauuuaaauuuaaaaaaauuuuuuuggcugggugcaguggcucucaccuuuaaucccagcccuucgggaggccaaggcagacaaauuaacugaggucauuaguucaagaccagccuggccaacauggugaaaccccaucucuacugaaaauacaaaaauuagcugcgugugguggcgcacaguggguguaaucccagcugcuugggaggcugaggcaagagaaucgcuucaaccggggaggcggagguuguagugagccaagauagugccauugcacuccagccugggcuacagaaugauacuccgucucaaaaauaaauaaauaaauaaaaguuuuuuaaaaccuaaacaauaaaaaguggagcauaucaggaugcuggcauuguauguuuuucuuguucaauuaaaauuauuuuuaauaauaguuugaaugaaaaugguugauuaaacccuaaauauugguucuuuuuaauuuauuugccuguauaauguuaaguaguucuuuauuuuauuucagaggaauuguuuaagaggcuuauuuccucuacuugccuacuaucauauuaggcagaagaaaaaaacuuaguauucacccaucaaggacuugcacucuaggugagauccauucccugggcuaguguuugaaaauuccuguaaccauaaacguuuuauuuuuuuagaugcccuuaggcuggcaauauucaaucgcuuugugauugaaaccccuuucuuucuggcagaaaaaaauauaccagauuaucauuaauucuauccccaaagccuuagauucuggcuuacuucuuuaguuuuauaauuuagucauuuuuguauguaauauuuuugggguuuaggccuauaaagagugggaggaaauaguuuccuaaggaccaagacagaaaaagagacuugaaaaguagcaaaggguauauaucaggugcaagcaauguugcacacgggccaaagacaaccugugaaaagauguuuauugaugcacagacuccaagccucauuccauaccgauugugaggacucaaaauuuggugaaaaucaauuuuagaaauguucugauugacgacuuaggcagauacaaaacaaaauuauuucaugcauuccuuuuguucuaccaauuaaauuuugauuaguacaauauuugguucuuuuguuuuuuuuuuuuugagacaaagucucacucugucacccagucuagagugcuguggcgugaucuuggcucacugcaaccuccgccucccagguucaagugauucuucugccucagccuccugaguagcugggacuacaggcgcgugccaccacacccggcuaauuuuuguauauuuuguagagacaggauuuugccauguuggccaggcuauucgugaacuccugaccucaggugauccacccaccuuggccucccaaagugcugggauuacaggugugagccaccgugcccagccgauuaguacaguauuucuuuuccagccucugugcuuucauuuuuuucucuucuuguuucuugaaaauaagccaaucugcccuaaaucaagcaugcauuguaauaaauacauaguugcguauaguuauauaagaauauaaggaguuaauaauacaguccuaacuuuuauguaggauuuauaguuucugaauugcuuagguauauauugauuuuucugcucuauguagugggcaagaaaguauguacuauucuuauuugauagaaaaugaaucuguugcuuagaauguuacauuacaaacuuaguaauagguaauaaagcugagauuuagcuucuaagccuucugauacuguugauguucaucauggaaaacaguauugaugaagaaagauaguuugauugacccauagucuagcuacuucuauuuuuauauaccacuacuacccacuacccaaauaguucauugaucauuaggauucacgcuuguauaauggcuaaauuuaagccuuaauugguuguuggaaaacacugauuaaaugccuaaauacaacuuacucuguuacuuaagugauuuaaaaaaaaaaacaacuuaaaaaaaaauuauaaauugacuuaguguuucugccucagaagcauaacauauuaguauaaaaugaucacuuuauucuuuaucaaauggcauuauaugagcuuuauguuucacgacaguuuucacuguauuaucucagacaaaaucucaagcaguccuuuuuuuuuuuuuuuuuuuuuuuuuuugagacaggguuaaacucugucacccaggcuauguggcacuauaucggcucacugcaaccuccaccacccagagcgauccucccaccuugacccaaguagcugggacuacaggcguacaccaccacucccggcgaauuuuuguguuuauaguagagaugggguuuccccuugcugcccaggcuggucuugaacuccugagcucaagcaauccaccugccucagccuccugaaguccugggauuacaaaugugagccacuacacccggccaaaaucucaaccagucuuaauuacugaauuugaagucuguugcuaaguaaaauuuacuucguagcaggucuuucugggcacauuacauuuaguaacuuguucauauuaucuauagauuuuagcauucggguaguucaaauuccaccuuuuuauaaaugagaaaaacaaaguucauacagacuguuauuuguucucaguucucugaugguuagugacauagcuaugauaagaacucauaccuccuaaugucucaaaacauuuaucugcuaaauuaaacuucacucccaaauaauaauuagguuuguguguaaaugauuaauuaaaaaucagagcauggagcuucugagcugguucuaauauuuaggauauuuaagaauuauuuuuaaggggccggacauuguggcuuacgccuguaaucccagcacuuugggaggcuguggcacacagaucaugaggucaggagaucaagaccagccuagccaacauggugaaacauugucuuuacuaaaaauacaaaaauuagcugggaaugauggugcgcgccuguagucccagcuacucgggaggcugaggcaggagaaucauuugaacccgggagguggagguuacaguaagccgagauuucgccacugcccuccaaccugggcaacagaacgagacuccgucucaaaaaaaaaauuauuuuuaaaugauggcaaugaaguaaaauauuuuuaguugaaaaaaaucugcuuuugggcuaaguguggcgguucaugccuguaauuccagugcuuuggcaggccaaggcagguggaucacuugagacuagccugggcaacaaggcaaaacccugucucuacuaauaauacaaaaauuagccaggcgugguggugugcaccuguaauccuagcuacucaggaggcugaggcaugagaaucgcuugaaccugggaggugaagguugcagugagccgagaucacgccacugcacuccauccugugcgacagagcgagaaucuaucucagaaaaauaaaaagagaagaaaauaaccuguuuuugauaauuuaaaaaauacauagaauaaugugcauuuuacagaauuuucuuacuguuuuccuuuuacucauguguuuucacuccccugaagaauuuguaauauccuaugauaggagauuaaagggcagcauauuucacuaaauauccauaguauucuagucacgucuaauuacuagauuaccaaacuaaacugagacucauuguguuugguuaucucucuaguaugagcagguagcaacuuuauaaucacuuuuaugaagaguaggucagcuuuagcugucgauguuuuucuugcaguauuaacugaauaagaauuaauaaggcugggugugguggcucacgccuguaaucccagcacuuugggaggcagguggaucacaugaggucaggaguucaagaccagccuggccaacauggugaaaccccaucucuacuaaagauacaaaaaucuagccaggcguggugguaggugccuguaaucucagcuacucaggaggcuugaggugggagaauugcuggaaccuggaaggcggagguugcagugagccaagaucugccauugcacuccagccuggacaacaagagugaaacuccgucucaauaaauaaauaaauaagauuuuucugaaauuuucuuaauuauugauggauguacuuuucuacugucuuuucaagaugauuugguauccacuuucguagauuagggcaaugucuuggugauaaaauggcauuaccaaaagaagcccccugcucccacacacacaguauuauuuuccauuuccugcauuuuauugugguuuaauguacccuauauuucuaauaucuuuagcuccuuugucaagaagagaugguuaaaggauuuaugcagcaguacuugauauuuaaagaguaagcaaaaacacuccccauuuaugaguauuguucaacauuuuauuuuagacuguuagaaaagacagaacuugaaaguaacucucaguuaccuccacuaauaaagggauuucuggcguggauaacauaauacuuuaaaucuguacauacauauuguuuuuacuugaauuuaaauauuauuaucuauugugaaaauucauucuguuacccacaaaauagucacucugugaagaugggacccuuuagcauuuacaaguuaguucuggugaaauuuaucuccugcuggucauuccagcugguauuaucuuaagaugaaauuaaaauauagccauaguaguuuuacuuuugaauaaauaugguauuucauagcuuccuucaagcaggaacaaagccuuuuuuuuauaucugaucuuuugugcagacuuuuucugcuguacuccaauaagcaaaaaucguauuuaguguaguugguauuugaugguuucaccaaaaauuugagagagaaacuuauugugaauaaaaaaaucuuauuugcugccagggcaugacacaaaugacucuauguucaguguaaaguguucuggauauuuaacuucucuuugaacagcauugaagcaagcaucuuuuauugccguuuuuccuagcuaucucaaaguuucuuccuaauggaaaguuguucaucauaguuuuaaauaacugaagucacuuguacaaguaccccacuuccuuuuuauauaccuaagcaaugggagaucacuugauuuacaucuuucaaggcauauuuucuaccagacucuuuuauuuuaacccccauaagcuggaucuucuagcacuuuaguuaaaaaaaauuucaguuccagcccuccuacuuugauuucuguugaaaaacacucuuuuaccucugcuucuuauaccuaaaaaugaaaaaguccugauuucuuagccagauagcauuuguuauacccauauauuucuuuaaacauuccuguuuuugauggugguaaacaaguucaguuguuugucagucuuuuuucacacagauaggcaaauauuuauuuuaacaucucuucuuugacuggcucaguuggguuguccccugguaaacugcugaaacauauuauuuguggcaacucuauuuaacaguagcaugcaguaccuuccguaugucuggugauguuuaauuuggccuaaaaauuaguauauuugugucuaguauagaaaucaagguuuuauuuuuaaaggcuucuuauaacuauuuuaaguauucccuucuuucaugcucacuuaugcuaccaaaauauuuuucuuucaacauucauuuaaaucauucaaaauuaaacugguacuuccacuuagagauuaaguaaaaacaaaaggggaucauagaguuaaaaacuaagcuuuaaauuaaucacagaaaacauuuauaguacggagaucuucgcccguuuacuggugcauuucaagaauuauuuuugugcauccuggagauacuagaagcaguuucccacaguaauauuuuuauuuacucuuucaguuuaccucuaaucuaaacuauaauuacugucaaagagcuuuagaacugaggagcacagugugaucagugcuuuuugguaaauguagaaguuucauucucuuauaguuuuagaaucuucuucugcagugcuaauucuuaauaguugugaaucuacauuucagcauguagucuccagauaacuucuucaaauggcucuccuuuuuuaaauguuuauugcaacuuugcaguauguuuagcuuagauuuaggagugcaaaggguuaaaggggucuuguuuuaucaaggaaauagcuguauuaagcuguuuucaguuuuuggauuauaaaauaccauaauucugacaugguguauuuagucuuacuaauacucaacuuuauuugggcgguagauacugguagaggcaguucaauauaauugaauguugagguauggguuugcuuuuuuguuuuguuuucaggagaaagauuugcccauuuugcucacauccuacuucagauaugugucacagagccaaaauuuguuuaacuaauuagcuauuuaguuggaauucacagcauaguggaaaauguuugcagauaauucugugcaauaguggaaacuucaguugcuuccucguauuucuucagggcagugaucacaaccagauucaacguaugcacaaagcagcggauaccaugguagcggccgucgcugauugcuuuuaccauguuggauccauugucagucucaaagaccuacuuccagcuaggugccuugaacucaaauagcuuuucacacagacuucaggaugugagcuaagguauggccuuuuuucaugagcugggccuacauauggguugacaguaaccugcaacuuuuauagaaaagagacuacuggcuauaguuuaaugucagacaaugacuaguuagaaucauugauaggcagguaguguguguucuucauauauucaaaguauucucaccauuuagagauuuucuuuuuuucgguguguuuuugucagacuauucaaguaaagauuucucauuagaaccuggucaaaggucuaauauauaucugcuuuaugauucaaccauugucuucaauaugaaauauauaucauuucuuucacacauuugauguaaagaauuuuuuuaaacuucugaggauucuugcacaauuauuuuucuuuuacuuuuucuuaauuaugguaaaaaaauaaaauuuaucauccuaaccuuguguacuauuuuaauaaucucuuacuaaucuucuuuuuaaaaguggauuuaggaaauuggcaugaauagagcuugagauuuagaaucaguaguuccaaggguaaucuacacacuggggugguaaauacaauaaagaccuaaacuggauugaugcaguucaugcuccaugcuaaagauucuuguuucaucaaagagaaaauaaccuuucuggaaaaagagcuucacuuucauaucuuccuucucugcaagauauguuucuuuaagugaaaucuuuauugagaguacaguggguuaacucauugauuauaggcuuaggaaacuauauuuuauuauggcuguaaucauaacugcuuucugaaacaaguuacuguuguuuucuuauucaguggcccuguuacuuaauaauuugucaagaccugguaauagagaaucauuuacaacuggggaguaagagucuuuguaaauucaaaguggguacugucaagcagcuuaugcacuucucuucauucucaguguuugacacugauuguuauuagcuauugacaaaugcagaaguugguaaucuguuugaguuacucuaccagaaucaugucuuuauuaagaagugacucacuguuaaacuacagucucaccuuaauuucauagcuguaaaagacacaguauaguaguugacucgagcaguaaaauucucugauauuucagucuucagacguacacuauacucuccuuauauaugcaaaaacauauauucagauacauguacauagacgacaguugaugacugaaaugguguacaguauaacaucugccaagucauuuccugagugguaaaggaaaguggccauguguucucugacuucuuauaacucagggaagauaagaagagagcacaggaaaaaaggcagccauucagugacauauuauaccucuucaguuaagucaggugacauaaguuuuuaccuucuaguuaaagauaucuguagaaacuaguuuuuguuuacacauuguaggaaccaaauucaaaacacaugcaugauacuauuuucauuuauucuuccuacccacuugaguggcuucugaguuuacuguuuaucuaccuugaguuaaggauugaauagcuucugagcagauuuuuguuuuugugacaaggaaagguucauuuguauguagaugacauaguauuauuuguuaaggauucuuuuuuuuuuuuucugggagaugggguuucacucuuguugcccaggcuggaguguaaugacgugaucucggcucacugcaaccuccgccucccagguucaagugauucuccugccucagccuccccaguagcugggauuacaggcaugcgccaccauguccagcuaauuuugcauuuuuaguagagaugggguuucuccauguuguucaggguggucucgaacucccaaccucagguguuccacccgccucagccucccaaagugcugggauuacaggcaugagccaccaugcccagccuauuuguuaaggauucuucuacugucuguuacucuuuuuauaguucucuaaggcuccaugaccacuuugcgagauaguauuuuaauguaaugaccaagucccuuuuuagguagguauacaacuaaaaaaauaagugauguauaguuuagaucauaccuuagcauaaauauuuuaaacacuuuuauuuauauacgauuuuaguuuguuucaaaugaucuauuuaaagaauuauaaagauguagauuuuugaaauucuaagcaguaguguaaagauguuugugaugucaauaaugugcugagaguuggaauagagaaaaggaaauaauguuuaguuguguuuucagugacucuuguauuaaacuacuaguacauuuaucuagaaaauuuaaauaaaaauguaauguccuauauacuuaaaccuugcuguaauacauccuauugugauaacaaugugaaaugaaauuggguacauuuuagauccugauaggaaauaacagaauaauaucuuuaaaaugaauaugcccuaaaacuuagugucucauuaaaagauccaauguauagaaacacauuguauuaagacacccaguaaugaaccuacauuuuacucuaaaauauguuuuuuuuucuuggaaauuuaauucugagugaaauacaaauaguauuaaaauuuaaaaacugcuugugguccuuuaauucucaaauauuuuagguguagaagugauuucugucucugaauauuuauaauuauguguguuuuuaaaagugugucucugaggacaucagguaucuggaucuuuuacaguaugacauuuauauaaugucugucucuucucugauuuuauauuagaagggaaaaccuacccauaacuuuacuagccaguggcuucaaaagcaaguuaauauagaucaugugugugacaaaugaaaugcacacacucauuuguauauugauuuauggagguguuuuaguccuaaaaucuuaauuuuccuugcuuuucuuuccauauuaaaaaaauucagaucuaaaagggaaaauguuaaaacaggaguaaaaccagaugcgucugaucaagaaccagaaggacuuacucuuuugguaccagacauccaaaagacugcugagauaguuuaugcagccaccaccaguuugcggcaagcaaaucaggguacaaaacuuuuccuauuaugccacuuuucauuugauguaaagauguuucauuuacuuacugaaaccugccuuuguguuuuugcuuuauguuaaugauuuuaaagcaaguucauuuaccuaaaaauuuuguucucuguuagauuuuguucuuuaucugauuucaaucauguauagucuaauuuuuaaacauuucuacuauauaugauugcuaaauuuaguaggcugagaacauacauuauaaauauuucuucccccugaaauucaugaaauugaaaaaaugccuuuauauuagauagaaaauaguacauuaagacuaugggugagaauuuaguuuaaauugauaucucuggcuggcgcagugacucacgccuuuaacccccccagcacuuugggaggacuaaauggauagaucacuugagcucaggaguucaagaucagcuugggcaacauggugaaaccccgucucuacgaaauacaggaaacauuaggugggcauaauggcgugugccuguggucccggcuaccuggaaggcugaagugggagaauuaccugagccugggaaguugagguugcaauuagcuguaauugcaccacuguacuccaagccugggagacagaguaauacucuguuuccagauagauggauggauggauggauggauggauggacggauggauagauauuuuccuauguuagcugaagaaagugaucugaauuaucuauuguuucacuuccucuuuucauaaagaugauuauguuuuugcuuuauuguuauguuuauguuauuguuauguuuaugaaauagaaauuuuuuauucucagagcgguuguaauaagauaauugugaagaaguugacaauuuuuuggaauucacaauuugaacucuagaggugaauucuuuuuaguuuuauuuuuuaaaauauauacuuaaaauguauauguuauuuaucuugaaauauuaaauaacagaaaaaaaacugggugaauacuccaagaaggcggcuaugaaacccaaaccuuugucaguauuaaagucacuugaagaaaaauauguggcuguuaugaagaaauuacaguuugguaagaugaaauuuuugauuugcuuaagaucucacuuuccauuuuuuuuuaacagugcuauugaaauguguuuuagcaaauuaaagauuuuuaaaauugcuuguaacaugaauuuuacuucauacauaucaacauuuuuuaucaucuuugccucuugaauuuaugucuguauuuuuaguuauaaacugugacuucaauagaaggacuguaagagccuagaaaaaauaaauccaagccaagugucuacaaaacaggcagaaaauguuuuuccuuauuuaccucuucauuucuguacauccuggccugaaggaagccaagacccagaacuuugaacuaagucuguuacucuugccauuuuagauuuccuugcaauucaccuuuagaaaauguaguuauacauaguucaguucuagcuuuucccauuccaaaacucuugacaaguaagaacuggcaaaaagauuauaucaguacccuuuauaugguucugauuuaugagaaaacacauaccaaauuuugaugaccauuauuaacuauuauugucuaugcugcuuuuucauccuugagaaacaaccuaaaaaucuuggacuguauuuuuuuaaaugcuaaaguaggauucagaaaacagauuuuugucauauugucuuugaaaccucauuauaaaucauuuagcuuuugcucuacuuacuuucagguuugccauaaagagcacaagagauaauauauaugaaagugauuuauacuuuuguuaagaguuuuggucagugucuaaugauauuacagccuuuugccugacucagcuuggcaaucuagucuguuaacuucacucuaaguaauaauauuaacuugguuuuuaaauaauaaauauuuuauugaauuuauuauuuuauugaaaauuccuuuguguauuaaaguacuaaaaccaaauacuuuauuucauuuauaugaauuuaauuagcaauuaccaagguuuuuuauggcuuauuuuaucaaauaguucuauauuauauauugucacauaaauuaccccuguaacuuauuugcuuuaaaaaacugaccuggccgggcaugguggcucacgccuguaauccagcacuuuaggaggccgaggugggcggucacgaggucgggaguuugagaccagcauggccaacaugguguaacuccaucucuauuaaaaauacaaaaauuagcugggcaugguggcaggcgccuguaaccccagcuacucaggaagcugaggcaggagaaucauuugaacccgggagguggagguugcagugagcugagacacuccagucugggcgacagagcaagucuccaucucaaaaaaaaaaaaaaaaaaaaaucaugaccuuuauuaucucacucuuuacaugggucaggaauucagaaaaagccauagugccuguuaugaccuugucuuagaaaguguacagcaucacucacuaaguccagccaacacucaaggggaggggaagagugucagaaaagaguuuccagacauauguuuguguauguguguuucuguuggacauaaauauuuuauugggcuuuagauuucguuccgcuuccugggucaucaaaaauaugucagcuaauggcuuuuaaaaauacauggcaguguucuuguacuugaaggcguuuagucauauuucauaucuacaaauucuuuaacuaguucuuucaauccagaaagucauuucauguauaugaauguguuuauggauccuuaugugugagagauucugguuuaaaguuacuaccugucagaaauuuagaaucauauguccagaccccuucauuaauguuagcuagcuagaagaguucucucauacuacauaaaaucauaaacucuccaaguaugugacuuuaaacauaaucaaguuugcuccccauuggcuuucaaaauaagucugaaaacaugcaaguuuucaguugaugcuuucauaagaaacugcauuuucaaccauauguaucaaacauuuucuaguaucauucuuuuacaacuugauacuuacuaacugccuaaaauuccauaauaugauuggcugccauuuguuuaaccaguaaguggaacuuuaguuuguuuccaguauuuaaauaucauaugcaacaucucaguggcuuucauuaccuguaaauauuugugcauauccaggauuaauucuguaggaugaauuaacagaagagaaaugauugauuaaaacaggcugugcauguuuuaucaaguagccauugucuuugauugaaucauuuauuuaaugaaaucuuugaguuaauagacccuguccucuauaugauauaaaauuuucccacugggcauaguaaugggcccauuucuugcaucuguuagauuguuuuuuauaaaaguuaaagaaaauguaucccuauagcaugugaaagacaagaguccauccaucuggcagugcuaauccaucuggcagugcuaauauauagguguuauguaaacauuuacacuuuugcuauucuuccaugguuggaaguucucuccaguugagugggagaaggacuagugauuguuugugauuuuugucauuauaacaauuuuuugcaguucuggguuuuauuuuuucuucuccuuuuagauacguuugaaaugguuucugaagaugaagaugggaaauugggauuuaaaguaaauuaccacuacaugucucaggugaaaaaugcuaaugaugcgaacagugcugccagagcucgccgccuugcccaggaagcugugacgcuuucaaccucacugccucugucuucauccucuaguguguuuguacgcugugaugaggagcgacuugauaucaugaagguaaaaaauaaugauaauaaagcacucucccuuaucuccuuggcucaucuaauuacucaaauuuuuauacaaaacuggaaauacuauacaaauaaauuauacaaaacacuagaaauuuuggugaccauuuuuagacggcagugaaaggagccuccccaccccucccccccuuuuuuuuuuggcgacaggaucucacuuuugcccaagcuggaguacagugaugugaucacagcucacugcagccuccacaaagagcccuuuucuaauguuaguucagaguguguggaucacgcugcuguugaaaaaaacauuuagaaaauaucaaaagagccaucauccuugagcaaagauugugugaagcuggucacaauaucaaaggauuuaaugcugaucaguuaaaaaauguuacaggauuuccauuuugucauccaagauacuucucucauguuuuuuagugucacucuucaaaacuuagucauuuucugucuuuucuaggaaauuuauguuuuuuuuaaauuccuaacaucugugaauuauagguaauacaauaauauauaaucucuacuuuuauguuuaacacgugauaaucuggccuuaaauuccaagagucugcugcaucaagaaaauguuaaacauuuaacccgaaaaagaaaacuuucuuuauauuuaugauuuaauucauggguuaaacauucugucuuccauagauacgcagcuaaaacuauuggcccauugacuuguagaaaguuuuauuuguuugcuugcuucuuuugauuuuuuggauaggcucaugccuguaaucccagcacuuugggaggcugagguaggcagaucacuugaggucaagaguuccagaccagccuggccaacauggugaaaccccgucucuacuaaaaauacaaaaauuggcuggcugugguggcaggcaccuauaaucccaguacuuggcaggcugugucuggggaauugcuugaaccuggaagguggagguugcagugagcugagaucucgccacugcacugcagccugggcgguggagugaaacuccaucucaaaaaaaaaaaaaaaaaaaaaaaaaggccugguaugcuggcucaugccuguaauccuggcauuuugggaggccaagguaggcagaucaguugagaucaggaguucaagaacagccuggcugauguggugaaaccucaucucuacuaaaaauacaaaaauuagccaggcaugguggugcaugccuguaaucucagcuacucgggaggcugaggcaggagaauuucuugaacccaggaaguggagguugcaaugagccgagaucacaccauuggacuccagccugggccaccaagugagacugucuuaaaaaaaaaaaaaaaaagcuguucuuauuuuggccaggcacaguggcucaagcccguaaucccagugcuuagggaggccuaugcaagcggaucacuugaggcuaggaguuugagaccagccuggacaacauggggaacuggucucuacuaaaaauacaaaaauuaaccgggcauguuggcaggcacguguguucccagcuauucaggaggcugaggcaggagaauugcuugaacucaggaagcggagguugcagugagccgagauugcgccacugcacuccagccugggcgacagagugggacuccaucuccaaaaacgaagguuguucuuauuucauguuggauuguauuuuucuaaauaucaguguuuaggaauguuaacauagacuuuuguauguuuauauauauccagguucuaauaacugguccagcggacaccccuuaugcaaauggcugcuuugaguuugauguguauuuuccucaagauuaucccaguucacccccucuugugaaucuagagacaacugguggucauagcgugcgauucaauccaaaccuuuauaaugauggcaagguaaauuaauugcaauuuuuuguuucaaaugccaaugauuguauacaaagguucuuuguaauuugaagaaaaauuuuguuuuaguuaucugcuaagagggcauggguuucuuuguacuucucuucccuacguccagauuagcuuaagcaauagaaggaacugaaaagagcagaaacaguuaaguguuaauuaagaagcacuuacagucuuaagaaguuacucggggacuuaacguaaaguucuaugauacaugcuauuaggaacuuauuuuaagguguaccuuauauucaaguguuuuuacauuuucuuauauuaaaaguaggaagaugcauuuccauuuacaaaaaagcugaccaaaagacauaauaaaaaucaucucauaugaccauaaaccuuuuaaaauuagauuuaaaagaguaaucuguuuuucagagguauuuuggauacuuugauagaauuucaaugguaaauucugugcugaguauucaauguuuuaaaaucuagaagagaagaauuucaaaagguacagccugccucagauauguggcagauaugugguugcaaauuaucauuagcucaaaucauaaaacuagaauuaguuuuuuggguuuguugcaaaagauuugaccagaggcagaacuuucuuuggaagaacaaagaacagguuuucuguagcugaguagggaagaggaaauagcaacauugacuuuacuugagacacuggaacuugaauagaguguaaguguaaaauauuaagauguauuuaagaaaauaauucucaaggcuucguugcauagagaagaggguaagggcuugggaaucuuaaauuaauggucuuuuaccaucauacuuaccgauguguuccuugauacacacaauuguggacuuauuuuuaaaguuuacacacuguuagcauuuaaucuuagguccuauaucuacagauagguaugaggcuacauaucugccauuguuagucccaagaaugcucuaaagcagggcuguccaauguuuuggcuucccugggccacuuuggaagaagaauaauugucuugggccacacaaaaauucgcuaacacaaacaauauagcuaaugaacuuuaaagaaaaauagcaaaaaaaucucauaauauuuuuaaaaacuuuacgauuuuguuuugggcugcauucaaagccauccugggccgcauguggccugcggguugcacaagcuugcacuaaaggucaaaugguauauguaugacagcacuuugaauaauacacaagacuucacagauacaacucauuaaauuauuaaucaacuaccuguugaaugaauuaacguauuuugcguucuugcuuucacagagcauugaaagaguaguaaggagacagaccuuucugcauuuacgagaaccaccuacgccgggcgugguggcucaugccuauaaucccagcacuuugggaggcugaggcggguggaucaccugaggucgggaguuuuagaccagccugaccaacauggagaaaccccgucucuacuaaaaauacaaaauuagcugggcgugguggcacaugccuguaaucccagcuacuugggaggcugaggcaggagaagugcuugaacccgggaggcggagguugcggugagcccagauugugccauugcacuccagccugggcuacaggagcgaaauucugucuaaaaaaaaaaagaaccaccuauuauccaaaucuguuggccauuauauaaaauuauuaaauuauuaaaaguguacaaaaucugaugaguauauuuuauguugauagaauauaugccagaagaacacaugugauuggcccaguuuuguuuuuauuacaagaguaguuacaggugcagauuaaguguccccaguucucuuccugcuaagugaguaaguaucuaauguuaucuuuaaguauauuuugaggaacccugggaagccugaauacucuuuuagggggucuguuugcgugaggcuagauuugauccauauacuugaaucaaaggaguauauugcaacuaguugaauguagaggcagauaauuaaaucaaggucucuucuguuaagcuauuuugcauuuucagaauuuagaaagaaauacacaaaaauauaaaauaguaccacuuuuauuaaaaauaguuauuuuaguaaaaauagaacuagcauaugaucuaucagucccacuauugaauauauauccaagggaaauaaaucagaaucucgaagagauauuugcacugcuguuuauugcagcaccauacagaauagccaagauacagaaucaacuuagcggccaucaacaggugaauggauaaagaaaacuugguuauacacaguggaauacuauucagccaugagaaggaugagauccuuucuuucauagcaacauagaugagccuggugggacauuauguuaagugaaauacaucaaacauuggaagauaaauauugcauguucucacucacguagaagcuaaaaaaauugaucucaaucaacguagagaguagaauagugguacuaaagcugggagggaaagguagagaggagggaauagggagagguugguuaauggauacacaauuacaacuagauaggaggaauagguucuguuguuguauagcacaguagggugacuguaguaaauaaaaauuguauuuugucaaacagcuagaagagaggauguugaauguuaccaacacucaaagguuugaggcgguggauacaauaauuacccuauuuugaucauuacacauuguauacacauauugaaauaccacacuauaccccauaaauauguacaacuaugugcuaauuaaaaauguuuugcuuuuuaaauaauuuaguuuucauuaaaauguuauuuguguugacauauaauaggugcuggucuguuuugcauuaugaaaaaguuauaaugccucacaaauuugaaucacaucugaagaugccaauuuguuuuaacagacaacccuuaggguuuuaucuaggggacauauaaaacugagauauuuugacaggauagcauuuuguuuuuacuucucguuaugacaguuuguuuuuaagcacucuuuuuucaauucuguuuaugcuuuuuucguucgucagguuuguuuaagcaucuuaaacacguggcauggaagaccagaagagaaguggaauccucagaccucaagcuuuuugcaaguaaacaaaauuucucugacauuuucacuuaagaaauaaagaacuguguaguauuuuaaaaaauuuuuagugaccaagaauaaauauaguaaaccuaaaaaaagauagauuacuaggaaaugcauauuaaauagcuuauaggugagaaguuagcauaauggagucucaucuuauguguaaucuaaaaucucaaguuggggcauaaaacaaaaauugaguuuagccaaaacucccaucaaaaaaaauuccaggccaggcgcagugcccaccguuaccuguguuucuugauuucuguuccugaacagauuaugagagccucuuacaguugugcagaugcuaacaugaagcugaaaaggagagggggcacagguguguuggcacagcacuuugggaggcugagauggguggaucauuugaggucaggaguucgagaccagcuuggccaacgugguaagacccgcaucucuacuaaaaauacaaaauacaauuagccggacgagguggugcgugccuauaaucccagcuacuaggaggcgccucugagguaggagaaucgcuggaaccccggaggaggagauugcagugagccgagaucacggcacuacacucuagccugggugacagagggagacucuaucuaaaaaauaaaaaucaauaaauaaaaacgaaagggacaguaaauuuggccugugaauaaaagucuuuacucugaaaauaucaacaaauugacucaaaucaugagccuacauuauggauuaaaaauaaauauuuauuauuacaucaauauaaauauauguauauauauaucauauauacuguauguuuuuauguuaauuaccaauugauuuuuaacucagauucuaagaaaacacuuuagcuugguauaaguaaaauaaauacuacuuuuugguuugauccaaauagcuuuuuaagugacguucuguugaucagacaguucaugcuggcugcuuuuuugcaugccucuaauauauuuauagaaauuauuuuuaguguagaauugauuuuguucuauauuauaaaguuauguaauucucucauucauccuguaacacaaguagaucuuaugccccuuuuacagaugaugaaaauauagguucuaaauguacagauaacuuuacugugaucccuaugacuucaaauauuguacacuguuucucaggccuaaaguuuuauuuuauaauacugaaaaucagauuuuuuuaaaagaggaaauccuucaugccaaggguuuacuguuucucugcuuauuuccggccuacaguaaaauguagugugcauuaaaaugacuguguccaguucagacaauccagugguccagaaauucccuaaaauauguauuauagcuauuaaauagcuaaguucacuauugaaaaauaaaguggcauuuauacucuuccaaaaagguaaugucugcugggccacccagugguaagauaacccaugucauaaaguauuuuuugaauuuaauugcaggaaguauugaucucugauaaucuuuuguuguuauucuuaucaaauacaaacuuuauauuuuucucucagcagacaauaaauuauagccacauuuauuucucagauguaauuuuuuguuccuuuuuucugguacacaaaacacucauucuuuuuuguuuaacuuuuauguuagguucagggguuccacugcagguuuguuauauagguaaacucacgucacaaggguuugcuauacagauuauuuugucacucugguacuaagcguaguaugcaauaguuauuuuuuucuuuuuucuuuuuucuuuuucuuuucuuuucuuuuuuuuuuuuuugagacagggucucacucuguggcccaggcugggcacaaccuuggcuuacuacaaccucugcgucucggguucaagcuguguuuccaccuuagccuccugaguagcugagaucacagacaugcaccaccacacccggcuaauuuuuguauuuuuaguagagacaggguuucaccauguugaccaggauggccucgagccccugaucucaagugaucugucugccucagccucccaaaguguuaggauuacaggcguuagccaacgugcccagccaguaguuauuuuuuucugaucuuuucccuccucccacguuucaccaucaaauaggccccagcgucugcaaaauauuuuaugcuuccuuuagugggcuuugcuuugcuguuuuaaacaaaauacgccgugaaucuaaaguaauuuuuaaauuguuauaacugacugagaucuauaaaaccauauugugucucaaaggagaugagguuaaauaaauaaaagaguccuuuuuuauaaauuuguaaugaauauuuaauuucuuucugugcuuuuguacaaaaaugcaauuauacccuacuuauauuaacagaagaggacaauuauuuaagagggaagaggacaguaacuaauaacuaugccuuugaaacuuaccucagaagugucaguaaaugugagaugucuggccgggcgaggugacucuugccuguaauuucagcacuuugggaggcaggcagaucacuugaggccuggaguucaagaacagacuggccaauauggagauaccccaucucuacuaaaaauacaaaaauuagcgggauggggucacgggcaccuguaaccccagcuacuugggaggcugaggcagaagaauugcuugaacccgggaggcagagguugcagugagcugagaucgcaccacugcacuccagccugggcaacagagcaagacacugucucaaaaaaauaaauaaauaaaaauuaaaaauaugagaucuuuaucucagaaauaauaugaauuaaaguuuuucccauaguugagcuuggcaucaguauggucacuuucuauuuugggucaaauacguuacuuucgaguacucauuuuuaaaguucucuuuaacuuugacuuauaagaugcauauccaugggacuguuuaaucguugugcccaacaaaaguguaauugcuguucuuuuucauuuaugaauugcguagauaauaucugauguuuuccugccuucaaagauguuacuuuauugacuucuauagauacauuaacuggaaguacuguauucgcuagaaaucaccucucuuaauauauguuacaucugggacaagccuucuaguaaauaaguggugguuuggaaguggucuuagaccauaagaccaucuugucaaucagaauuucuggccggguaugauggcucagaccuguaaucucagcacuuugggaggccaaggugggcagaucaccugaggucagaaguucgagaccagccuggccaacauggcaaaaccccgucucuacuaaaaauuaaaaaaaaaaauuagcccugcuuggugaugcacgccuauaguccuagcuacuugagaggcugaggaaggagaaucacuuggacccaggagacggagguugcaaugaaccaagauuguaccauugcacugcagccugggcaacagagcaagacuccaucucaaagaaauaaauaagaauuucuaauaagguuuuugugauacuguagcaguuaauuguccuuggaauaaaaauuuaaaauggucucaggcauaguuuuuuuauaagugaguauuguuaagagugcauggcuaggccaggcacaguggcugacgccuguaaucccagcacuuugggaggccgaggcaggcagaucaccugaagucaggaguucaaaaccagccuggccaacaugaugaaaccccaucucuacuaaaaaauacagaaauuagucuggcgugguggcaggcaucuguaaucccagauucucgggaggcugagacaggagaaucgcuugaaucugggaggcggagguugcagggagccaagaucaugccauugcacuccagccugggugacaagagugaaacucagucuuauuaaaaaaaaaaaaaaaauaguacauggcuaguuuuaugcuccuuaagaacaguuugagcagaauguugcuaugaguuguuuaaacucauaaaacaacuaaaaaaaaaauaaacuaaacuaaaaaaacgaaauuuuuuuagcauuuuuuggaaauagauucuucauaucuauuauuauuauuaucaucuaucuucauaucuauuauuauucaagaauucaagaguaaaaacagauguguaaguauuacuuauggcucuauugugccuaauuuuauuuugccuuuauaaugaaauauuucaauguuauaaucauaaacauugauuuuauugugauagaaauuuguggaaacacauauuaaagaagagucuuuguggauaaagcaggauaucaguuaacccacaguaaaaaugucccaucauagcuguucuuuuccuuuauucuuuagguguuggugucuguccagucccuuauauuaguagcugagccuuauuuuaaugaaccgggauaugaacggucuagaggcacucccaguggcacacagaguucucgagaauaugauggaaacauucgacaagcaacaguuaagugggcaaugcuagaacaaaucagaaacccuucaccauguuuuaaagagguauguucaauaaaauuagugaaauacuuuguuaaagacauuuuacaauauaggcugggcaugguggcucaugccuguaaucucagcacuuugggaggucaaggcagguggaucacuucaggucaggagucugagaccagccuggccaauauggcgaaaccgcauuucuacuuaaaaaaagaaaaagauaaauuagccaggcaugguggcaggcgccuguaaucucagcuacuuggaacgugagguugaaccugggaggcggaaguugcagagagcugagacugcaccacugcacuccagccugggugacagcagagcaagacuccaucuccaaaaaaaaaaaaaaaaaaaaaaaaagacauuuuaaaauauaguuuguuaguauucuauuugccuuuauauguaucuaguauaugaaacugcagguuuuagaguuaaucccaaagaucauuaauaagucuggacaauauagcaagaccccaucucugcaaaaaguuuaaaaauuuagcugggcaugguggcaccuguagucuuagauacucagugggcuaaggcaggagguuugccugagcccacgaguuugaggcugcaguaagcuguguucacaugacugcacuccagccuaggugacagagucucagaaaaaaaaaaaaugguaguagauaguacagaugaaguauaaaacuaucuauauucuaaaagacaucugacuaaauuuuugagaaguuuuuuuccuuuccuuuccuuuuccucuccucucccucugcucuccuuuccuuuccuccugucccaucccguuucguucucguugcccaggcuggagugcaauggcaugaucuuggcucacugcaaccuccaccucccaaguucaagcuauucuccugccucagccucccaaguagcugggauuacgggcauguggcaccacgccuggcuaauuuuuuuguauuuuuaguagagacgggguuucaccauguuggccaggcugaucuugaacuccugaccucaggugauccaccugccuuggccucccaaagugcugggauuacaagcgugagccaccgccccggccuauucuuuauuuuuauuaguuacccuucuacuagcaaacucucuaaauauguuucugauauauuucucauugaacuguuuuuuauugaagaugguuucuaaaguugucuugcaaauagaaauuuugcccuuauucuaauguguauauauaaggagaaugccauuucuuuuuuuuauuuuuuugagauaggacuuggcucuguugccugugcuggaauacaguggcggaaucucggcuuacugcacccuccgccuccccgguucaagugauucucaugccucagccucccgaguagcugggacugugugcgcauaccaccgcaacuggcuaauuuuuuuuguauuuuuuaguagaggccaguuuucaccauguuggccaggcuggucucgaaugccugaccucaggugauccgcccgccucggccuuccagacuguuggaauuacaggcgugagccacugcgccuggccacguuuccuuuucuuuaggaaaaaaauuggaugauaugaguuuccaaaaccuguauuaauacacugaagugguuuuuuucacgucauccugaaguguggcucuguguguguguguguguguguguguguagcuuuuugccugugauuaguugucucuccauaguauaccuaaauagaauuauacuuuucaccugccauaucaaaugacguuagcaucacaacuugcugugauuguguccagaaacauuuuucuuucuuaaaauuguuucacuugaucauuaauuucuuaaauugugcuggaaaguuaacauuuuagaggaaaaaaugguauauuuaccugauauaaaauugaucuuuaauauaacuaugcagauguucuacaugaauacuaugaagccaccuccuucaucagauagcacugaugaauauuucuuuuucuuuggcuuuugcuguuacugaguaaauuuauauuccaguguccuuugaaugacaaaguuggauacuuuacuuuugcaaagaucgcgccacggcacuccagccugggcagcacggugagacucugucucaaaaaaaaaaaaaaaaaaguaauuuguuuuaugcauaucauuuuuuucaggaaggauaaacacagggaacucagagaaggggaugacuuuuacaaaaagcaaauauguauaauuugagacaaucaacuuucucauucuuuagaaccuagcuugcguuaaaggggccacuccuuggccauguaugcuuucccaguuuuccuaaucaaaugccacucgcuacucuuugaaugcccugggcuuuuugcuuuuguuuauuguuguucuuuaaaauauauuuuuuugguacacucccgucccaucugauucuguuguuaccacuguucuucauuuaaagcugugucauacuuacuucuguaucccagaggcuucaaacccaauaacuauuaaauguggugggaucguauugguguuugacauucauucccagagcuuucuagugauuuucccuuuauagguuugauugucuguucuuuagggcagacaugcucccugggcaaugcucaaccagaauacagagcaauguuuccaaauugauaauuguuuucuaauuuaaauuugucagaaauagacucuuacuacuauauguugguagaaauuuuacucaguuuuucaaagauagaauugaaagauagaauuuaaaaaucgcaaauguaaaucacaguaauaauaaggaaauuuaacuuccuaaaauaaaaucccaucuauaaauuaaacagaagauaaaauuaagcaaguaagaauagugccauuucuggggauuucugugugaaugccuuuggcauuuagaauauacuuaucuagguguucuuugaguuaucuuuuaaaggcagaaauuucucuguugucaauacuuuuuaaaucuuuucgccugguuacuuauuuagcauuugccuucugaguauauuguaucauaugugucuuguggucucuggacaggauuaauuuuccaagugucugaccacaauuguacacucuuuucugcuauaaauuuguuuucucuuuucucuccuccccuccucucuucuuuucuuuucuuuuugauggagucuugcucugucgcccaggcuggagugcaguggcgggaucucaguucacugcaaccucugccuccuggguucaagcaauuguccugccucagccucccaaguagcuggcacuacaggugccugccaccaugccuggcuaauuuuuguauuuuuaguucugaccuugugauucgccugccuugaucucccagaaugcugggauuacaggcgugagccaccacaccgggccauaaauuucauauauuucaacacgucauaucaaaucaugagcuugauuuuucccugcuaauauuguagaguugauuaaauugccuuuuuuuuuuuguuugagauggaggcuugcucugucgcccaggcuggagugcaguggcgcgaccuuggcucacugcaagcuccaccucccggguucacgccauucucuugccucagccucccaaauugaguuuuauggauagaaaaacauugcagugucuguauauuuauuucauuaaauguauuuauaauaauauucuaaauauuaauuuaaauguauuuauagaauaaauuauuuaaauguauuuauaauacauuuuacuucuuuguaaugucauuuacugugucuuuuaaauuugacuguaaacacugcuuguucuccuguuuacuuuuucucaagguaauacacaaacauuuuuacuugaaaagaguugagauaauggcccaaugugaggaguggauugcggauauccagcaguacagcagugauaagcggguaggcaggacuaugucucaccaugcagcagcucucaaggugaguaagccucucuaacaggagccuuguugcuuuaagaguuguguaauuauugacagaaccaugccuaccagaagauaaugggagggagggaauuaaagaaacauaauauguauuuucaguucagaggaauaaauuguuacucagaagucuauagaaaagauacauuuuuuuuugguaguagauugacaguuccuaaaauaaaaaguggguccaaggacugagacaacagaguuuuguaaaguuccuugaagauaaugaugacaagaugugcuccaugaaugccuuuuccuuuuucuuuuuuucuuuugagacuggauuucauucuguugucccagccuagagugcagugguggcaucaugacucucuguaaccuugaacuccugggcucaagcaguccucccaccucagcuucccauguagcuaggacuacagguagcugccacagugcccaguuaaauuuuuuuauuuucaauuuuguagagauggggucucacccuguuuccuaggcuaggcucaagugauccucccaccucagccacccaaaucacuggaauuauaggcaugagcaaccgugccagacuugaaggacuucuuuuauucccuuagucuuucccuaggccuccugccuuccagaauuuuauuacuuggagugaugagggagauuugaguugcagauucucccucagcugaugguggcaguggcuguguuaggggagaaagcaguuguuuucaguuuggacguucauagaauggaaaugugaaaugugauugguuuggaagauuuucugucuacccacggagaucuuucuuuguaacagccuuccuuuuuuccugcaucugaaugucuuuacucauuucauccuccaccaauauccucccuuuucuaucuucagguuuuuccauuucuacuggcuuguuaucuucuaacuuuaaagcugucuucacuucaaacaacuaguugaugauaaggauuuguuaguuuuuuaggugugauuuuuaaaaagaucccuaucuuuucaggacauguacagaaauauuugugaaugacaaaguguaugaugucugggaauuacuucaaaauaaaaugacaaggggaaagugugggaauauagaugaaagaagaugggccaugaguugauaaugguugaagcugugugauagauucaugggacuucauuguacucuucugcccacuucugcauauguuugaauuuuuucacuauaaaaauguuuugaaaaagagagaaaaacacuugcagaaaauuucccuaagcuaguucuauuuugccccuauuauuaugaaacagauugucuucuuucaccgucagacuauagcaguugacacuucuugccuccauuuuuuaaccuuugucucacuaaucaaccuuaugcaguuugacuucuauuuuaccaaaguuaccaucucuccaguucucaacgccagugacccuggcucacuucuccauucacuucaucugcucucccuccuccaggccuuuacacaugguuuccauuuuccucuacuuuucagcucuucugcuugcucaccuccauucauauuucagcuuaaauuucacuucauggaacccugccuugacugguuuguuuguuuguuuguuuguuuguuucugagacacugucucucucugccacucaggcaugaucuuggcucacugcaucuuccgccucccuuguucaagugauuuaucugccucagccuccugaguagcugggauuacaggcaucugccaccagaccuggcuaacuuuuguauuuuuauuuucauuauuuauuuuauuuauuuauuuauuuuagauguaaucuugcucuguugcucagccuggagugcaguggcuugaucucagcucacugcagccuuaaccuccuggguucaagcuauucuccugccucagccuccugaguaucugggauuacagucaccugccaucaugcccagcuaauuuuugcauuuuuaguagagacgggguuucaccauguuggccaggcuggucucgaacuccaggcuggucuugaacuccugaccucaagugagccaccgcgccccgccugacugauagacuauuagaucauuucaguauaagcauuucuaacccucugcgucuaccuguuaaaacacucauaacauuugucuaauguuugucuuuuguacuauacuuuucaucuguagacuaucuuggcuuuucugcuuauacucuucuuaauucuuucaguguguuuuccuuuuucuuuuuuccugagcaauuguuuaccugaaggcuuacuuuuuggccuucagaacuauuuuuuuucugucuuucuguuuuuccuucauugugucuguaacccugacuuuggccauuuacucucuaaaagugacacuucaaacuguugucagcuguuagcuuucucuugaguuguauuacugacauuuuuuacauagauacccugucaucaucuccuuaaaggagauuuuccucaaaucaaguuuucuagcuuucuauuuacuuaauuuuacuugauuuuaaaccauuuuucucugucuuagaaucuucaaguauuauguaucucauccuucauccagcaccccuggucaguacuagguccugucaguauuacuucaugaggggacuguccucuccccaacccaugauuucuguugaguucccacagcuuugucuguuuguccagcuuccuuguaccagguucucccccuuucaguuccuucuuuagugcauuaccaggcugaucuuccccaaauauguauuuagauauguuuuucacuuacacaaaacuggcucaaguccagcuucuuuucauucagugucuugcuuauauccgcauuccuuuauuucuucugugucacugucaccuggaauuuuccaucucugaauuaauccaaauuuauaucauuuuaacuguacauuugcuguugagugcuacacaagaaaaauacacaauuggccaggcgcagugacucacgccuauaaucccaacacuuugggaggccaaggcgggcagaucacuuguggucaggaguucaagaccagccuggccaacauggugaaaccccaacucuauuaaaagaaaauacaaaaauuagucaagugugguggcucaugccuguagucccagcugcuggggaggcugaggcaggaaaaucgccugaacccgggagguggagguugcagugagcugagauugcgccauugcucuccagccugggcaacgaguguaaaauucugucuuaaaaaauaaaugaaaaguauguaguuguuuagcuugacuccacaauaaaaucauaguaucccuguauuaggcuguucuuucuuugcuauaaagaaauccuugagacuggguaauuuauaacaaaaagacauucaaugggcccaugguucuguaggcuguacaggaagcauggaacuggcauuuacucugcuucuguagaggccucaaggaccuuauacucaugguggaagaugaagcggaaucacgaaggcguaggggugugggaggugccacacuuuacaacaacccgaucucgugauaauucacucacuaucucaggacagcaccaauccaugaggaaacuguccccaugauccccauuucucucaccuccaacacagggauuacauuucaacaugagauuugggcagggacaaauauccaaacuagaucaauccccaaccuuaacucaguucucaugauugccagauuuuucuuucuccuucccugguuagugauuucaccuguuguccacaguggaaggaaaaucaaggcuagggaaauucucacuuaccggcauguaaaugugcuuugaaacuuugcaaauagcugcaagguagaguuguuuuuuccuauuuaugugucuuauaauuucagccagaauuuuagacuccauaagcuuaaagauuuuauccucauucuacucauugccuuuauguuguugguauuuaacacagugccucauacauaaaaauuguucuguaaauaaauguuguuuaauuuucaaagucagcuguugacacuauuuaguuuuuauuuauuuuauuuuauuuuauuuuugagauggagucucgcucugcugccaggcuggagugcagugcugugcgaucucagcucacuggaaccucugccucccugguucaagcgaugcuccugccucagccucccaaguaccugggacuacaggcacacaccaccacacccagcuaauuuuuguauuuuuuguagagacgggguuucaccauguuggccaggauggucucgaucuuuugaccucgugaucugcccgccauggccuccgaaagugcugggauuacaggcgugaggcaucagacccggccgacacaauuuuaaaagccuuuggugugauuauuuaaggucauuucucucucaccagaaaauuaugaaccaaaucuuugcauguguuagacaaccagccacucccaauuaacaugccuauauccuuacguaaacugcaauauagagcaaagcaaaguuuauuuaaucucuauagaucuucuuuuuaacucaauuuuguaaaaaguucuaaugauaggcugggugcaguucuuuguucuucuaugaucuuuuuaacuuaauuuuuuaaaauucuaugaucuucuuuuuaacuuaauuuuuuaaaaaguucuaaugauaggcugggugcaguucuauaggcugggugaaucuggguacagauucacaccuguaaucccagcacuuugggaguccaaggcagguggauugcuugagauuaggaguucgagaccagccuggccaagaaggcaaaaccccgucucuaccaaaaacacaaaaaaauuaacugggcaugguggugcaugccuguaauagcaguugcucgggaggcugaggcaugagaauugcuugcgucugggagguggaguuugcagugagccgagauugugccucugcacucuagccugggugacacagugagaccuuguucucaaaaaaaaaaaaaaaaaaaaaaaaauucuaaugauacaauuauuucuaagguuuauucugagcauuaagugggaaaauuagugugaacauuugcagacauuuuacauauggccuacuaccugauaaauauuuuuuucauucgcuaaaguaucaguggauuuauuuuaauuuacggauuugucuuucucucaaaaacguuuagccagagucagcauguaugacaaaucaagggauuacgguguuuaauuugaaagaguguauaggcugggcacaguggcucacaccugcaaucccagcucuuugggaggccaaggcagguggaucgcuuggaccaggaguuugagaccagcuugggcaaaauggcgaaaccccaucuguguaaaaaauuagcuaggcauggugcuucauuccuguagucccaacuacuugggaggcugaggugggaggauugcuuaagcccaggagguugaggcugcaugagcugugauugugccgcugcucuccagccuggaugacaaagcagagcuaucuuaaaacaaaauaagagaauauauguauguaggccgggugcauuggcucacgccuguaaucccagcacuuugggaggccgaggcagguggaugacagucaagagaucaagaccagccuggccaacauagugaaaccccaucucuacuaaaaauacaaaaaauuagcugguugugguggcgcccaccuguacucccagcuacucagaaggcugaggcagaagaaucacuugaacccgggaggcggagguugcaaugagcugagaucgcgccagugcacuccagccugggcaacagagcgagacuccgucucaaaaaaaaaagaguauauguaucuaauaauguccuuuaaauugucaguaaugcuguuucugugacagcuuggcagcauggguaggaucuacugguggguuacugaggucuuuucagcaacaucgguuacuuugagguuaaggauucuugucaguuuugcuuaccuacuauaucaagugccuguaacaguagcuugcauaaggaggggcucaguaaauauuuguaggcuuaaugcuuugggcuuuguugaaauucaguuccugccucaaaugauguugugcuagaggguuugcaguucuaacauuaguccuuuucuccugcauagcgucacacugcucagcuccgcgaagaguugcugaaacuucccugcccugaaggcuuggauccugacacugacgaugccccagaggugugcagagccacaacaggugcugaggagacucuaaugcaugaucagguuaaacccagcagcagcaaagaacuccccagugacuuccaguuaugagcugcauugauguggacuucauagacacaaaggcuucgaagcacaagccaaauaugucaauauuuguauguaagaaacuaauuauguaauagguaaugaaacugaaacuauacuaugcccuuaaggagauccaguuuaauucaaggugaucuuuuauuuaccuguacaggaguguaaacuuuuuugugcuuuuauuuuucaauugugagaaccacugauugguauguucaacaaauuuguguauacaaagaaauggauaaaucacugcuauauaagggaaacuaccuuaggaaagaauguuuacugaauguuuauuuuauuuuauuuuuuuuuuacuauagagugagggguuguuaacaaagaauauauauuggucauucuuacaacuacuauuuaaagucagcaacuuuucacugaauuugauagauuuuauguuuggccauaucuucaugcucacauuugauuucugaagaccuccuacauacacuucaauaaaaguuaaauggacauacucccucuuuuuugauuuacugguacauuuuuaaaauaauaaaucugccauaaaaugcauuauaucuggagacuugcacuuguauggaugaauuuauuacauucaacauauuuaauuuuaugccuucuaauucuaagaugcagaaaaaaauaaaugaacaugauuuuauucuaugccaacauuugggccucugaauguaucuguuauuugaauuuaaguauuugaaaaggaauggucaauuugaaagucauucuaaacugauuuuuuuuuucuaaagggcuccuuuuuuccuggacuaugugguuuuaugacuaaagucacauguauguauuaaacauugaggcucuguagaggagagaggauguaccucucuggugcuguuacaguacauucuguaccugccauacaggcucauuuucaugcaaauucuuccuagagccaaauaaauaaagacuuaggugaauuaguaugucuuguuucuaa

SEQ ID NO: 192723 - RNA, 51907 nt, Homo sapiens
agcagacgagggcuugugcgagagggggccgggcggcugcagggaaggcggaguccaaggggaaaacgaaacugagaaccagcucucccgaagccgcgggucuccggccggcggcggcggcggcggcggcggcggcgcaggugagcagggcagggggcagccgagggagcgcggggagcgggggccggggggccacguacgaggggcugcaggcccagccggggcgggacucgccaauccugcguccccagcucaggacgcggacgcugauccgaagccccuggccccggcugggucagcacugggagagcaggcccagguccgcagcccggguguggggcccuccccaaauccagggaaaggaucguggagcgggguggggacugaaagccauuuccuucccgugaagaauuuuuaucagugcaaguaacaaauauuucccaggcagcaguuguggggcggggucuaguggaagacgaauaggccuaguggcuugacacauggaaaauacggaggccugaaauacucauagacuggcugaacaaucuuuggcuaaaaaucucuuccguggagaguugcaguaguuucccaauugccuggccgcaguuccuguucccacuccguauccucaccccugaaccuccacccccuaccucuucuccacaccucagcaucuggaauguuccuuuaaguaagaaccagacucuccccugcuccgaccuuccccguagcuuuccugucucaucagaauccuauaaacauuuauuaaggcucacaggcaaggccccucgcacccccuacuccggccacgcuggcuuccuugcuguuccuggugcacagccaagcauccuccagccucuaggccuuugcacugcuuguuucuucuuucuggaaagcuucuuccccagauaacugcauggggaaaucccucccuuauccugcacugcuucccaugccagcuuaucagagcagccuuccucaaacaaccugccuauacaagaaaccccgcucugcccuugcuguucccccuuccacuacuucgguugucaacauaguaguuaucaccuggugacauuuucuuucuuuucuuuucuuuuuuuuuuuuuuugagacagauucucacucugucgccaggcuggaaugcaguggcacgaucugggcucacugcaaccucugccucucagguucaagcgauuuuccuuccucagccucccagguagcugggacuacaggugcccgccagcacagccaacuaauuuuuuuauuuuuaguagagacaggguuucaccguguuggccaggcuguauguagucugcuggaaaggaaguggaggcauagccaaaauaauuucugggcauuaguaagauggacaaauauuauuuuuuagugauuaugauggagguuucuuccagaugagugaauaagauguagaaucugcuccccaaagagcucacuaauuaguuuaaaaagcagucagggcuguguugaagguugggcaagguggaguggcaagcccauacuagcugacccuccagcaucaaagaaggcuguguugauccugauagaugaguggauauugguggguacagagagaaugcagauauugcacuauaaauguagagaaaagcaggugacaaguccuggaugggguaucuggagauauuuugguacucacucauucauuauugagccuggucccuuaccuguaguaauucaugcucuauuuuggaaaauaguuaaauaagcaauuuuaauaaaggggaugagcacuguggaagagccugugaaggagugucugggauuuugagcugaaaucuguaggaaguagaaauugaccaggccaagacagcagaaggaauagagucaagggcauuuuaggagggagcagguuggacagaggcaguugggaguucaggagagaguccaugguggaagcgugcuuuugagaaccaucauuguguccguggaauuuaaagccacaaaccuggaggugaucaccaggggagugaguccaaguagaaaagagcaagucuaaggaccgggcccagugaugcuagaauaucuagaaaagaggaaguuagaaccauagaaaagguuaaaaaaaaaaaaauagaagaaaagaaguugaagaugaaccaggaaaggagacagaaaaggaguagcuugucagaacagaagaaaaccaggcccaggugccauggcucaugccuguaaucgcagcacuuugggaggccaagguggguggaucaccugaggucaggaguuugagaccagccuggccaacauggggaaaccccgucucuacuaaaaauauaaaaaauuagccgggcgugguggugggcgccuguaaucccagcuacucggaaugcugaggcaggagaaucgcuugaacccgggaggcagagguugcagcgagccgagaugccaccaucacacuccagccugggcaacaagagcgaaacucugucucaaaagaagaaaacuaggagagugggugucuuaaaaguccaagcuaagacagggagaggagggcgaagaggaugcgcaaccccaucaaaugcugguuguaagucaaguagagaaggacuaagaacugacuacuggauuuagugauagggaagccauugguaaccucgacaaaaacaauuucaguggcuuguggagacugcaugauugaauugauguuuuuuuguuuguuuguuuuguuuuuguuuuuuuuuuugagacggaguuucgcucuuguugcccaggcuggagugcaauggcacgaucucagcucaccgcaaccuccaccuccuggguucaagcgauucuccuuccucagcaucccgaguagcugggauuacaggcaugugccaccaccccggcuaauuuuguauuuuuaguagagaugggguuucuccauguuggucaggcuggucuugaagucccgaccucaggugaucugcccgccuuggccucccaaagugcugggauuacaggugugagccaccgcgccuggccacugaauugauguuuuaaaaagaucaugauguggcuguauuaaaaaagaaaacagauaauaacaagugauggugaggauguggagaaauuagaacccucgugcauugcugguggaaauguaacauggguguaaccacuguggaaaacaauuuggugauucaucacaaaguuaaacagaauuaucaugugauucaauuccacuuauauaccacaaauauucagaaguagggacuuaaacagauauauguauaccaguguucacagcagcaugauucaagauggccaaaagguugaaauaaccaguguccauucauaaaugaaugcaugaacaaaauaugguauauauacacaacggaauauuauucagccuuaaaaaggaaaggaauucugacauaugcuacaacauagaugaaccuugaagacauuuugcuaagugaaauaaccagacacaaaaggacaaauacuguuugauuccacuuauaugagguaccuagaacaggcaaauuuacagagacagaagagagauuagaaaauauaaaaaauuaaccaggcaugcccacgccuauggucccagcuacucgggaggcugaggugggaggaucgcuugagcccagaguucaaggcugcaguaagcugugaucacaccacugcacuccagccugggcaacagagcgagacccugucucaaaaaaaaaaaaaaaaaaaaagauuagcagagacugaaaggacugggaaauggggaguuacuguuuaauggguacacacuuucuguuuggaaagauuaagaguuguggauguggaugugguggcggcuacacaacauugugaauguacuuaaaggcagggaauuaauacauugaaaaauaguacauuucauguuauguguauuuuaucacaauuuuaaaacauaaaaaaaaaaaucacaaugguugcaggguagagaaggaauugaaguagcugucggaacugguucugagauucucacagcaauccaggaaugaggugguguuggcuugaacuaggaugguaaguguagacaucuuugagaaguagaaagauuuuggugacaggacuuaguuauagauuagaaggcagggagaggaaaugucaaggaugccucccagauugauggcuuucagacuuggauagaugguggacucauuuccugugaaaggaaacuucaaaccagcuugggagaagaucauacaugcaguacaggauauuuugaguuuaaaguucguucaagauguucaaguggagaauuuggauagagagaucugaaacucagagcgguucauaaggaauauguaaacuuuagagguaauggcguauagaugaucacugaaaucauggacgugaaagaaaucaccuuaaggagaaaguauagagugaagagaagaggauuguugggccaugccagcauuuagagcuacaaagauuaagguguguuaaaaagaguggcccggccaggcgugguggcccacaccuguaaucccagcacuuugggaggcugaggcugguggaucacuggaguucaggaguuggagaccagccuggccaacaccgggaaaccucaaaaauacaaaaauuagcugggcgugguggugggcaccuguagucccauagucccagcuacuugagaggcuguggcaggaaaauugcuugaaccugggaggcagaugcugcagugagcugagaucauguuacugcacuccagccugggcaacagagugaggcccugucucaaaaacaaaaaacagaaagaguggcccuggaagaaagaagaucaaaagagcuuuccaagaagaauuaagagguuuacaggaucugauuucugccuuuauggauuuaccgauucuggaaguuucauauaaaugggaaucauacaauaugugugaaauuuuaugucuggauuuuucauuuugcauaauguuuuugagguuuauccauguuuuuguuguugugguuguuguuuuuugagauggagucuucgcucugucgcgcaggcuggagugcaguggcgcgaucucagcucacugcaagcuccgccugccggguucacgccauucuccugccucagccucgcgaguagcugggacuacaggcgcgcgccaccgcgcccggcuaauuuuuuguauuuuuaguggagacgagguuucaccguggucucgaucuccugaccucgugauccgcccgccucggccucccagaguguugggaguacaggcaugagccacggcgccuggccuauccauguuguagcauguaucaguacuucauuuuuuuugugacugaauaauauuccgcuguguagauauauuucacauuuuguucaccauuuauccguugauggacacuugguuuguuuccaccuuuuggcuauuguuaacagugcugcuauguacauuccugucuaagucuuuguuuggaaaccuguuuuccaauucuuugaaauaucuaggaauggaauugcugaguuuuaugauaauucaaaguuuaccuucuagaggaaccccagcaaccguauuguuuuacauucuuaucagcaguguuugagggguccaguuucuccauguccucaccaacacuuauuuuuuauuauuuccugauuauuauuauuauugccauacuagugggugugaaauuguauuuaguugugguuuugaauuccauuucuuuaaugacucaugauguugaguaucuuuucaugugcuuauuggcgauuuacauauuuucuuuggagagaugucuguucaagccccuuugccuauuuuuuuaauugggugguuugucuuuuuguuguugagcuguaagaauucuuuauauaucugguuacuagacccucaucagauauaugauuuguaaauauucuauucuguagauugucauuuuauuuucuucauaguguccuuugauacacaaacguuuuaaauuuugaugaagcccaauuuaucucuguuuucuuuuguugcuugugcucuugcugucauagcuaaaauuuuaucaccaaauccaaagucaugaagaucucccccauauuuucuucuaagaguuuuauaguuuucgcuuguacauuuauauuuuauauccucuaaauuuuguuuauaauuuaaaucauugcuauagacuugguccagugagaccuauaaacagaggucuuaauuuacucagugguuaaauuguccuaaaauugauuucugcaaaauucagaggggagauuuuugggauuucauagagaaaucuauauccauacaguuaaauccuucaugauuucauacacuucacuuuuuuaaaguauuaaaacuuuuuuauuugaagaauacguggggagaagagaaauauauuucagcacuuagauauguagauuauuuccaaaauaguuuaccacucaacuagucacuucuguguaaaucaguuuucccugaagcaagcauuguguuguucccggcuacaagcgguccucauuuugcaugguacugugggaccauaaaaauggccaugcaaagcaaucuuaauaaucaauggggaaaaugaugauuguuccaugaccuuuaaaauucugcuaaaauauuaaaacucuuaaggucaguuauaaauguagaaaaaaaugcaaaaaaaauuuaaaaauauuuaguacacuguaauuuaaaacauuaaaaauagaauuaaaguguuuuauuucauugugaaaacuaaguaguuugaauagggauugccuuuuuuuucugccaagugacuuaugauacugaguaagcaucuuuucuauucauggcaaacugucauacuccuuuuaaguuugggugagcuuccagccuuuuauugcuugugcuuucaauguugugaaguauuucuguauucacauuaaaugcucuuuagugugaaguuuguuuuuuuuuuuuuuuuaccgucacuuccucugggacauauuuaucuuuauugcaaucacuuuucuuauuuguguugauaaguuugccuucacuaagcuccuaugaaugcacagcaggaagaacauucccaugaucagugacuucuucuacaaauccauuuauguuugauucaaauuucacuuccaguguuaucauuuuucguugcuuuguuggacuuucaucuuuguuggccaguucuuucgauuguucacuucuauaaaaugucagguggaggacaaagagacaguguaacuacgugcucugcugugagugaacugauuaacagaugcacagggaccaaccacuggaagaauuugaaacaaguaacacgacuggucacugaucaugaagcauaucuguuauuuacaucgugauuuguagacugaagaacuagcagagaaguuuguacuuccuguaauuacucagaguuauacugugcuaccuaaaauuuuaaccuagguuuaaacaacaccaguuuccuuaccaguuuccuuuccuuccugguaaggaaacugguauuuaaacuaaaucuaggucacugaaauuugugccaugggaaccgugcacauugaggaccugccuacacccuacauguuuauauugguccaggcaggcuuaaugcugacuacugagaaauaggcuaucugaauuuauaucaaauagugaaucuuaaagcacccaagaugaaaaauucgugcacauugaggugcuuuuaaaaucuuugucauuugacaaucaagcuuaaaauguaucuuagaguaaccgaauuuuagaaauaaagaccuuuaaaggccccauaguuugauaccacagauuauccagcauguuuauaaugaauuauuucuccuccuucaauuucaguuugcucauacuuugugacuugcggucacaguggcauucagcuccacacuugguagaaccacaggcacgacaagcauagaaacauccuaaacaaucuucaucgaggcaucgagguccaucccaauaaaaaucaggagacccuggcuaucauagaccuuagucuucgcugguaucacucgucugucugaaccagcgguugcauuuuuuuaagccuucuuuuuucucuuuuaccaguuucuggagcaaauucaguuugccuuccuggauuuguaaauuguaaugaccucaaaacuuuagcaguucuuccaucugacucagguuugcuucucuggcggucuucagaaucaacauccacacuuccgugauuaucugcgugcauuuuggacaaagcuuccaaccagguacaagcggucuuccgaauuuugcacucagaaaaguggcaucaucuaagucaauuacaugcaaauucuggggggcuaguuuuuuguguauguuaaaugggucacaacacgacuucuguaaauccucaaaucugucaauauaaauuuuuaugugaugaaagcaaauuguauuguuccuagaaaguguccuuccaguucuaaguugaaguaaaagcaugucauuugaugacaauucuugcaacaucuuaaaaccugugugacaaguauaguagguuuuauggcacucauuuguaguacgaagcuggacugcaacuaucgauccaucauuguugauucuagcauauuuuccuuguuuuauuuugucuagagaucuaggucacgggcugaucacccuuagcuugagcucuccuccgccuggcuuccggcaggauccacguccacacaggcacacuugccugcccguucauuucccagccuguccccaugcuaccacuccacuucacuuauuauauauacucuaaaucuuuuucuucucaacauaaaacauucuacaauccugcagccuuuuuacuuuuuuaagcagguaggcaaacauguaguugauacucaguggaagcacagagcagaguuaaagagaaggacccccuuucacugaccaguugaguuuuuuuucuuuccuuuauuuuuuaaaacaauuucaaaauugagaugggguuucgccauguugcccaggcuggucucgaacuccugagcucaggugauccgcccaccuuggcugggauuauaggcgugagccaccacaccuggccaaguugaguuuuuaaaguagaaaauuuuggagaaauuaacuuuauugugcagugaaugagaaagaaagaacgguuuugaaagaaagucucugcauuuaugugagacugagaugaguccuauaaaggggagucuccccaaccccucugucuccuaaacugcauugggaaacucagauuaaauauguucugugagcaucacucauucaaaugucucuuccauuguaggauacgggaagaagaaauggcuggugaucuuucagcagguuucuucauggaggaacuuaauacauaccgucagaagcagggaguaguacuuaaauaucaagaacugccuaauucaggaccuccacaugauaggagguagguugcuauaaaaaaugauauggcagccauaaaaaaugaugaguucauguccuuuguagggacauggaugaagcuggaaaccauuauucucagcaaacuaucgcaaggacaaaaaaaccaaacaccgcauguucucacucauaggugagaacugagcaaugagaacacauggacacaggaaggggaacaucacacaccagggacuguugugggguggggggaggggggagggauagcauuaggagauauaccuaaugcuaaaugacgaguuaaugggugcagcacaccaacauggcacauguauacauauguaaccugcacguugugcacauguacccuaaaacuuaaaguauaauaauaauaaaauuaaaaaaaaaagaaaaaagauaugaccuuauaaauguaagcugggggaauggcaacucuggcacaacuuugaggucaacacuuuaguuuugugagagugcucuuggcauaaagugggaaccaugguggagccacaguugacuccagagagaaaagaggguagaaaccuuuccaugcuucaacaagacaugcugcuuuacuguuugaggugacugcuuaaaugcuauauugaauguagguucaaacccucaaagguagucauaggagguagugaugacuagaguacuuguuuuuagauagugcaugaguuguauaauauuuuaugaauauucucuuuguaaucagguuuacauuucaaguuauaauagauggaagagaauuuccagaaggugaagguagaucaaagaaggaagcaaaaaaugccgcagccaaauuagcuguugagauacuuaauaaggaaaagaaggugagugauugccuuuuuuccuaauaaaugggaacuugcaaauacauuuucuguuucucucugugagaaaauacuuucauacagaguaaagccauucacacguucccuuacauucaagaguuugguuaagucauucacccuaucuucauuucuaugaaacccugagugagagccacaccuaggacaccaugggcaaagcuggauaauaguuauuuagagugucagcagcaguuaaauacucuaaaguugaacaaauauggaaaggugagaaguguucagugggaaaugagcugacagguucugggaggaguccccuccaccuaaaugaggaaguacaguaaaaaaggaaaaagagaugaaagugauuguagggagaauaauguacaguggucacucacucucuguggggaauugguaccaggacucccuguggaugccaaaauucacugaugcucaaguccuuuauauaaaauggcauaguauuuacauauaaccuauuuacaucuucccauauacaguuaugcauugcuuaacaaggagaauacauugugagaaaugcaccuuugggcaauuuccucauugggcaaacaucauagagguacuuacacaauccugaaugguacaaccaguacacaccuaggcuguguaguauagcuuauugcuccuagacuacgaaccuauacagcauauuauuguacugaauacuguagccaauuguaacacaauguuuaguauucauguaucuaaacauaucuaaacacagaaaaaguacgguaaaaauacaguauaaaagacaaaaggcugggcuugguggcucacaccuguaauccuagcacuuugggaagcugaggcggguggaucaccugaggucaggaguugaaaaccagccuggccaacauggugaaacccugucucuacuaaaaauacaaaaaauuagcugggcguggugguggacgccuguaaucccagcuacuugggaggcugagguaggagaauugcuugaacccgggagaaggagguugcagugagcugagguugugccacugcacuccagccuggggauccuaucucaaaaaaaaaaaaaaaaaaaaaaaaaaaaaaaaaaaaaaagacaagcaaaaguacacccauauaaggcacauaccaugcauaaauagagcuugcaggacuggaaguugcccugaguuugucagcaaguggguggugaaugaaugugaaggccuagggcauuauuguuuaccacuguagacuuuauaaacacuguauacauaagcaacauucauuuuauuuaaauuuuuuuucuucaauaauaaauuaaccuuagcuuacuauaacucuuuuacuuuauaaacuucuuauuuuuaacauuuucacucuuuccaaauaacacuuagccuaaaacacaaacgcggccaggcgcgguggcucaugccuguaauccuggcacuuugggaggccaaggcaggcagaucaccugaggucaggaguuuaagaucagccuggccaacacggugaaacccugucucuacugaaaauacaaaaauuagccgggcaugguggugggcaccuauaauuccggcuacuugggaggcugaggcaggagaauugcuugaacucaggaagcggagguugcagugagccgagaucgugccacuacauuccagccugggcgacaaggcaagacucugucucaaaaaaaaaaaaaaaaaaacccacaaaaccacaaacaaacacauaguauggcuguacaaaaauauuuuguuucuuuacauguuuauucuauaagcuuuuuucuauuuuuaaaauuuuaaacuuuuuuuuuuaacuuuuaaacuuuguuguaaaaaauuaaaucaugguugggcauagcgguucaugccugggaugucgaggagccaugauugugccacuguacuccagccugggugacagagugagacccugucucaaaacaaaacaaaacaaaacaaaggcuggguguggugguucaugccuguagucccagcacuuugguaggucaagguagguggaucacuugaauuugggaguuugagauuagccuaggcaacauggugaaacccugucuguacuaaaaacacaaaacauuagccgggcuugguggcaugugccuguaguuccagcuacucaggaggcuaggcgggaggaucacgugccugagaggucagggcugcagugagcugugaucuucugacugcacuccagccugggcaacagagcaagacccugucucaaaaaaaaaaaagaaagaaaaaaaauuacaacacaaacacacacaucagccuaggccuacacagcgucaggaucaucuacaucaccaucuuccaccuccagauuuugucccucuggaaaguguucaggagcaauaacauacauggaggugucaucuccuauuguagcaauuccuucuuuuggauuaccuaccgaaggaccugccugaggcuguuuuacaguuuacuuuuuuuuuuuuaaguagaaggaguaacuucuaaaauaaugauaaaaaaaguauaguaaauauauaaaccaguaaguuacuuaucauuauccaguauuauguacuauacauaauugugugugcuagacuuuuuuauaagacuguagaacaguagauuuguuuacaguagugucaccacaaaugugugaguaaugcauugugcuguaacccaggaguuuaaaauuauccugggcaauauggcgaaaugcugucuguacuaaaaauaugaaauuuagccauuacaguggcuaugaccucauuagaugacaguaauuuuuuagcuccauuauaaucuuaugggaccacugucauauaugcaguccauuguugaccaaaaugugauuauguaguacaugauuauccuuuagaucaucucuagauuacuuauaauaucucuaauacaauguaaaugcuauguaaauaguuuuuuuguuguuguuguugucguuuuuugagacagggucguacucugucacccaggcuggagugcaguggcaugaucaagggucacugcagccucaaucuccccaggcucaggugauccucccaccuuagcaucccaacuggcugggacuacaggcacgagccaccacaccuggccaauuuuugcauuuuuuguagcgauggagucucacuauguugcccaggcuggucuugaacuccuggacucaagcaaucugcccaccucagccucccaaagugcuaggauugcaggcaugagccaccacacccagcuauaaguaguuguuaugcuguauuguuuagggaauaauacaagaaaaaaaaucugcauauauuuaguacagaugcaaccaucauuuuuuuuccaaauauuuuugauccaugauugguugaauccagggauuugaaacccguggauauagcgagccaaguguuuacagagagcagguaauggagaaccaauauacaugugacugguaucccggaaaauaagaacagaguaaauagugcagaagaaaaugaucugaagagauuucagcagacaauguuuaugaaauaaagaaagacuugacugcagauuaaaacaacuuaauagauacaggaaaauuuagaaccacccagaccaacauugauucuuuuuuuuuuuuuuuuuugagacagagucucgcucuguuguccaggcuggagugcaguggcacaaucucacugcaaccuccgccucccauguucaagcaauucucugccucagccuccugaguagcugagauuacaggcacccaccaccacggccagcuaauuuuuugauauuuuuaguagagacaggguuucacuauguuggccaggcugguguuuaacuccugaccucgugauccacucgcuuuggucucccaaagugcugggauuacaggugugagccaccgcgcccggccccaacauugauucuuaugaaaguacugugcuccagagaugaggaaagaauuuuauaagcaucuagagagaagaggaaaacuauguaaaauguaaaaauuuuuaaaauuucaugcugugcacagcaacauuauaaaccaggagauaguguagcaaugcuuauaaaaugaaacaugaagucauuuacauuuuagacaccagagggccauucucagauuuggaaaauguugggaaaauuuagguuucaagguucuuucuugaaaaaucuacuuaaagauacccuucuaaccaauuuuuuuuuaacucaagcaaaagugcaaaguauaauuauuaaugagguagaaaauugagucaagaaguuagaaaaaacaaaaaacagaauguuuuacccccaaaaagcagaagaaagaaaauaacaaugguugaaauuacuauaaaagaaauaaaaaauaaaaaaaaaagaucaauaaaaccaaaagcuaguuuuuugacaagauuaauaaaauagcaaaacucagccgggugugguggcucacaccucuaauccuagcauuuuggaaggcugaggcgggcagauaacuugagcuuaggaguucgagaacagccugggcaauauggccaaacgcugucucuacaaaaaauacaaaaaaauuacccaggcaugguggugugugccuguaguuccaggugcuugugaggcugagacaggaagaugguuugaacccaggaggucaaggcugcagugagcugagguugcaccacugcacucuagccugggugacaaagugacacccugucugaaaaaaauuaaaaaaauaucaaaacuuuggacaagauuuuugucggacuaagaaaaaaagguagagauaauaauaguagaaaugaugcuauuauauucaucuuuuucauuaaguuaugauccaguauacagcuuuacuguaauaucucuugccuuguuuuuugagauuagaaaggguauaacaagcuagaaaguguuauaguacuuuccaaggacaaacaagaaaaagugacuucuuuccuauuguuaaaaucuaucuucgucgauuuuuuucugguagagggagauacguagucacacuuuugcucaagguaauauaauaggaaaauauauaacauccaaguugucuuucaaauugcucauuuaguaauuuuauuagaagaaugauuuuuaaaagguuaaaucuuuguugucauuuauauuaaacaggaauuuuuuuucuuuguaggcaguuaguccuuuauuauugacaacaacgaauucuucagaaggauuauccauggggaauuacauaggccuuaucaauagaauugcccagaagaaaagacuaacuguaaauuaugaacagugugcaucgggggugcaugggccagaaggguaagacauaauuuggcuuuucuuucuguuucauuguauuuaagcaauaaaguugguuuauuuucgugucuaauuuuccagaaauauguguccuuuuaagcauucuguaugcaagguuuuacaugauugauaaguaauuggauuuauaauuuguaauuaaaaugcuuaauugcugaagccauggaacccauuuaccauaauugaucaaauuaggguaauccuuuauuucagagaaguagcuggaugguuuagucuguggaacacccaagagaguacagggugccacugcucgaagaauacagaaaucuuuucaucauugaggacaugauggugguaacugucugaaaaccucucugccacauguauagaaucacucuucacccuugucagaucagggagcucuuuguccagguauuuguccuucaaauuugauuaaaugaacaaauaccauguaucagaaggaaugagcuuuagcccuagacuaugaggagaccgggauuugagggaucugaugagacagaugaacuagaguuucaaaguuacugagaacaucaccagugagcuaagauguguggaaauaggauaaagaauggauuggaacugaaaaaagcagaaaucaaaugaguaugaggcaauuguuuuucaacuacaaccaaccaguuaaagagaaagaagaaaaaaaauaucuacauggcaaauaguuuaaaucaucacuuuaggauacacuucuaugaauugacucagcuauuuacagucauggcuuuugagccaaaaccaggaagagaaaaauguuauaguauucauuggaaugaaauagucaaaagugaaucugugagucaaucucaauaauuaagagaugauuuuauuuucuguagcucacuuuuuugguuucuuuaaauuaugcuaacauuagauaccuaaaagaaagaagaaaucuguuugcgggggggggcaguaucugaaaaaaauaggagcuauagaaaugauccagucacucaacccagcuauuuaauucagggucuagcggggaagacucacccuguuuggauguguuucucucgauggcuuccaacagaaacauaaagcaaaaggaguucaaauacuggaaucauuuuucaguaauagauaguaacccugugauauaaauugccauguccauuguuuuaucccuuaaaaauaguuauuauauaauuguccaaguauccuugccuaaccacaaauguccuuacaucuaauaggaggagaguguggacuuuaguauagggaaucugcacuguggggauuuucucaaauuuuugugcacaugagcagauggcagacaauggugaaguuagagcagaauccaugcuuugcucuuccccuacacuauaaccucauagcuucuccuguggaagccuacuuucucugcuggcuuuuuccuucccauuugagcaccucugaaaaaauucacuggaucucuuucuuucuuuucuaccuccguaucuuuugaccuuuggggaauuaaaaaaaaaaaaucaccacuuagugccuuugugccagaucuuucagcaaagcaacaaaaaauuagaaauugccuggaaaaugcaagcucagaugucagcugauccuggguauucagagaaauuggucaggcauguuacugaggguuuaaauuaugcaagauaugaacuauaaaucuaucuaauaaauugguguuaucuuaagaucucuguuaauauguuauuuuuuuugaauccuaaguuggauuugcuauauuuuucauguuuggauaaguaccuucuaugauuucuccuagauuucauuauaaaugcaaaaugggacagaaagaauauaguauugguacagguucuacuaaacaggaagcaaaacaauuggccgcuaaacuugcauaucuucagauauuaucagaagaaaccucagugguacguauugccuuuggauuaaauuuuuauguuuuaaaauucccucugaaguugacuugagguuagacuguguuaacauuaugccaagacagccagugauuuagcaaaaugauuccuccauucugugucguaccgaugagccaugcaccauggggccaugaggccucagagggauaaaauuucugguggcaacucaggguaguuuuuaaacuccaggcugggcugggugugguggcucacaccuguaaucccagcacuuugggaggccaaggcagguggaucuccugaguucaggaguuuuuuuuuuuuuuuuuuugagauggaaucucgcucuguugcccaggcuagagugcaguggcacgaucucggcucacugcaaccuccgccucccauguucaagcaauucuccugccucagccuacugaguagcugggacuacaagcgccugcuaccgugcccggcuaauuuuuuauuuuuaguagagaugggguuucacuauguuggccaggcuggucuugaacuccugaccucaugauccacccaccucagccuccuaaagugcugggguuuacaggcuugagccacugcaccuggccgaacucaggaguuucagaccaccuggccggggcaacacagcaaaaccaugucgcuacaaaaaaaaaaaaaaauuagacgggugugguggcauguaccuguaguccuagcuacucaggaggcugaggcgggaggauugccugagccugggagauggagguugcagugagccaagauugugccacugcacuucaaccuagacaacagagccagauccugucugaaaagaaagaaacaaacaaaauaucugcccugugauccagaaaaguaaaauaaaaaauaaaauaaaauccagaccaaacauccaaaaaauguuauuaaucuuguaauuguuuaugguuguggauuugguaaauguguugaaauaaaugugauaguacauagaaacugagccucuguagagaaauaauuaguuguauuuaagccuacuaagggauacuuuuucuuucagaaaucugacuaccuguccucugguucuuuugcuacuacgugugagucccaaagcaacucuuuagugaccagcacacuguaaguguagacaaacaauugagauacuuaacauauucauauuucugucugaaagacagauuuuuauguuuaaggagaauuuagggaaagaaauaagugauaaaaacagaauuaauaaacuaauaguuacacccuuuucuucuagcgcuucugaaucaucaucugaaggugacuucucagcagauacaucagagauaaauucuaacagugacaguuuaaacaguucuucguugcuuaugguaucguauuagucucgaagcuuccuacuuaaucuuauuuuucugugcguuuccucauuuaaaaauaacuuccaguauuccaccauaauuuuuauauuuuuuaucuuaugcacucuuacuaaaugauaauaccucaguagacuuuuuuuuuuuuuuuuuuugagauggagucucccucuguugcccaggcuggagugcaguggugagaucuuggcuaauuaccaccuccaccuccugguucaagcgauucuccugccucagccuccugaguagcugggauuacaugcgcguguaccacaccuggcuaauuuuuguacuuuuaguagagacgggguuucaccauguuguucaggcuggucucgaacuccugaccucguguucugcccaccucggccuccccaagugcugggauuacaggcaugagccaccgcgcccggcucggcagcuuuuugacuuuuuuuaaaauuaaguuccauuccuuacccuuccacacgucacuucugucuuuccucacucauccuuauauuuuaguauauuccuaugauuuugcuuuucucuccuaccaaugggauaauauuuaaagauucacuaauauaguucguuucuguuuuuaaaaauuagaauuaaacuuaaaaguaaacuugaaaucagauaauuuuuuaggcuggugcaguggcacaugccuguagccugcagcacuugagaggccaagguaggaggaucgcuuuagcccaggaguuugagaccagccuaggcaacauagugagacccucaucgcaaaaacaaacaaacaaacaaaaaccagacaauuuuuuugugcacauaagcaggcaauguugaacuuagagcaaaauccaugcuuuuggugauuaguguuacaagaguauucuguuauaaagaacuacaaaucaauaagaaaauggcaagcagcucaguagaaaaguguacaaaauguauaaacagauauucagagaagagauacccaaaugggcaacaaauauuaaaagcugcuuuacuaggaaucaggaaaauuuaaaucaaaacaauuagauacuauuuuaaacucauuagauuggcaaaaaguuaagucuuacaauacuaaguguugauacagggcuugaugagaguacagacauugauggacuaagaaauuggucagagagccaucuagauauacaggaggaaggaaaacgggaaaggaagaugacugauuuagucaucugaaacuauuucucauuuucuuuuguuauagaauggucucagaaauaaucaaaggaaggcaaaaaggugaguaucauuaugcauugaacauauuuugaucugaaguuuuauuucagacuuauuuauuguucuuaauacuuguagaguauuguacacccuuauuugagcagaguuucagaagcagaaagcuugaaaucuauaaacaaauaauuuuagaugugucgagaaaucuuugacuaugugcacaugcuacacuguaaacauaaagcacuuuggggguaucgcuagaguaauuagguuaagggcauuauuuuguacaagacuggcaaggaauugggcuguuuucacuguagaaguguuuucaagagaaguguauuauuuugcagacaaguaagguuaaaauagcauaaaaacuuggauuaaaaaaaggucaaaugcuaugucaauuaacugaagagaaaggcaaagauguaaauauagucagaaaugacaguaagauggcaguaggagccauuaugagccaccaguauauucugagcaguagauagauguauugaagaaacaugguucuugauguggaugcuuggauggagagaagagaguucugcacaugaggugcccucagccacgauuacuguggcagucaggagggaugaggagaaugugugagaaagacuguaaaggaagaguggacaugacuugagggaauagguuccccguagcugagugaaagcaugaaggagagguaaaggagaaaggauuugaagauugcuucacuuugaacaggaugcagucaagaaccauggcacuaaugguguuaaggaaguuaaggaguuaagggcuuagagagaagacagcaguuuggauauguuuaguuuuaggugguauuuaaacuuccauuugcagguggcuuaucaucaguaaggaauaacagcuaggaugaggguguaaggagauguacuuccugagguuuugagucuggaggaggaaaaggagagguuagugacgcaucaacaaugagcacucuaagguggaaaaaggaaccagaggagggaugaaaaaguauuagaggccagaggagaacgguaaguauauaguuuuauaaagaaaaaaguuggcugggugcuguggcuugcgccugugauccccagcacuuugggaggccaaggugggaggauggcuuggguccaggaguucgagaccagacuggguaacaugaagagacccugucucuacuaaaaauaaaaagaauuagccagguaugguggcacaugccuguaaucccagcuaccugggaggcugaggugggaggaucuccucugagcccagaauuucaaaguuguagugagcuaugaucacaccacugcacuccaggcugggagauggggugagaccuugccucugaagaaaaaaaaagaaagaaaaagguuaacauuaacacuaaauaaguuauauuugauuucaauuuuauuugaguuuuacauucaacucuuaauuuuuagaucuuuggcacccagauuugaccuuccugacaugaaagaaacaaaguauacuguggacaagagguaagauuuuaagugcugaagaaagaagaagggguaaugcugucgguggauguuuuugguaguugucugugaaauggccaugauccugucaguuaaaaauauuugaauaagauuaacuacgcaggguaagaacaauagucuuaggcuuaucauuaagagggggcccaggaaugggaugacccauauuaugauuuuguucccaaaccaagaaucuaguugguuguuuugauacucccuuagcuuuuuagcccuuucuuuaaguuuuucaucagcguuucuuacuaggcccaauugguugagauaaaagcaacauuccucacccaaugagaggcagaggucccuuuuuucagccauuauuagaucuaguccccaucuguuuuggaggacuacuccagccgaggagucuaguuugucuuggacucuuauaaugcuucaggcuauaucuucuaaagaacccuguaauucuguggaaagagcuuuaaaguauguuaagggaguggccaaucugccugcucccaauccaagucuggagguuauauccaaggcagccauuaaaggaaugacguggauggcccuccucuuccuaacguauuggauggauggaaugggcaaagguuggcuaggaggaauuaguccaauggagggagaaagauaaacuaggguacagguuccaguccaguuaguggggagacaaagauauguguuggugccacucacacaaaaaauaagccuuugucauaaauacaguuggagauacagaaagaaaacaagugaauuaaagauggguguuuuuucuuuccuaugguucauuacuccagguggucaaggaggaggucaaggagacacccacuauaguagcgauauaggaagaguuauuuuuuacacauuuaauacgauuugauguugcaccauugcauugauguugagccauggauaaaggugggcgcuaggggcagcacaaauuaggccagaggcauugguugagggagaggcugcaaaacgaacagguugcagaaaugcuccauucguuucaggugauacuugguagucaacucgguuaguuugauggucagcaggguguuuaacaaugauaaugcgguugcauugguuagguuuaaggaucuuacacggaaauuucccucagaggcugaaaagcaaagugaggcuuguuguaaaagugggguguguuuaauuaugggcccuucaaugggagggccuuguggcuuaaggcguuguagggaguuguaauagguuugaaauaauguguuggccugauugaccuuggaagugggauaaucgccaaccagacugucagcucuuucaaaaaaggaagcuccuuuuuggaguuuauagauuaggguuacguuuucuguuaaaaggucaugaagggguguaggaagggauguauaagcugaagaagacagcgauaaacacauccagcauucuggagcaaaggaagaguuagcuugcagcaagagggguuguguaagguuuauagaacguucuaguuugauagcagugaggagugguuguaucggugagguugaugugauuagggaauuuagauagaaagaaacaacaaaaggaggaaaaaguuuggguaggaauaaaguccuggaagguuccuugaagccauaaaucccguggaauaguaaggagcugaucaggauguauaaugagaguuucauaaggauaccacugaaggucuguaacaaggcuaguuaggaagcaaugaaaguuugggagagaaagagacauagcugcuuaggugaauuucucuuccuuuuccuccggcauucaugugagaugaagggaaguggauccuguggagacacaagagaggcugaaggugguuuagauuugauuguuuggauguguagugaagggaagucuguguucuugagagaaguauaaugaaaccagcuggggagucccuggagcuuugcugcuguggguguagugaggaagaucugguaaggccccuuccauuuuggugugaggggggaauuggggguagggcugggaccuuuuaccagaacccaguuuccugacuguaggaagggauuaaaggaguuguauuuugucagcauauucccaaaugaaauggcagaugauaugcagaagaggagaaaugagagggguuguuagagguggggcuugacccugagguggaacaaaaggagcaugaguucaaauacuuaugcucaaaacucccauacaugaguucaaaggggaugagcauuaaagguuuacgugagagugcccgaauuuuuaggagggccaaagcuagaaguguaacccagucuuuauguguuuggagugaguaccuggugcgggugauuuuuagaaugccauucauuuuuucaaccuuuccugaagacugggguugauaggggauguguagcuuccaggugauucguagggcuugugcaaguguuugaguaauuugagaaaugaauucaggaccauuaucagauugaaaagaaggaggcacccugaaccuggggaugauuucuguuauuaauuuggaggugacagucgaagcucauuuguugguuuucggaaaagccucaacccaugccgaaaagguaucaaccagaaccaaaagaaaucgaaccuuuuuuacugggggcauauggguaaaaucaauuucccagucuugucuuggaagguguccccuggcuugauggguuggaaaagaagggaguccaguguuggaauggggugaagcuuucuggcaaauagagcauugauggaaaauggcuuucaacuguuccuuuauaucugggguuauguguaugugggaacuuaagaaauguuguagaggggaauggcuagugugcaagagguuguggaugucccauaacagaguuguuuuuuguuuguuuguuuuuugagacagauucuugcucugucacccaggcuggagugcaguggcacgaucucagcucacugcaaucucugccucugggguucaagcgauucuccugccucagccuccugaguagcugggauuacaggcacgcaccaccauggcuggcuaauuuuguauuuuuaguagagacaggguuucaccauguugaucaggcuggucucaaacuccugaccucgugauccgcccgccucagccucccaaaguguugggauuacaggcgugacuaccgcaccuggccaagaguuguuuuuucagggucagguaggacuaauuuguuuuguaugacaguaugggaguuugaauugugcccccgcugugaguaguuguuguauuugguguuugggauaaaaggggauauguugugugaggggaaauagauacuagagaauuggaugguugguugagguguguuuugcccaauagucagccucacgguucccuaaagaaauguggcuuuuaucugauugaaguccuuugcaauggguaacugcagccuuuuuuggaaguagagcugccuuuaguagacaauggauuaguuuuccauuaaugauaggaguucccuuagcugugagauagccccacuugcuccaaauuugggcauuggaaugguugauguuauaaacauauuuagaauuggugguauauauuaacuuguguguuuuuugcuaggguuaaugcuuucauuagggcaacuaauucugcuuguugggaggaugugcccaaaggcaagggggcagccucuacaacucuucuagguggaagacaguggguaucaucacaauaucucucagugacugcauauccugcuuggcggggaggguuuuuugaugcgcugccaucuauaaaucaaucuggggcucccuuuaugugaguggaaguaaggugguaaaacacggcaagagaacuuucaauuagaucagagcaugaguguuggucaggguccaaaaucaguguugaagauaaaagaguagcaggauuaggagugagcaucugugaagagagauggaggguugaauguagggcuugcaugugagaggaugagauggaggugagcgccuuauggcugagcauaucuuauagacugugagaagaaaacaccugaagagguucauagaaugugaguuugugccucagggauaauuaaagaggcuguggacaaaauuuuuaagcaaaggggccagguuuuguaaauggggucuaguuguuuugaagaauaugccacugguuggagggaaucucccauggauugggcuaauaguccaagggccugauuaugagaacuguguaaauauagaugaaaaggucuuaggggguuuggaaggccuaaagugggggccuguaauaaggcacauuuuaggugacagaaagcaugauaaaggucugggguaggagugagugguugaucaagauuuccucuuguguguucauaaagagguuuagugauaguggcaaaauuugcuaucuauaaucagaaauaucccacuaauuugaggaaagaaaauaagucccuuuuugucuuaggaaaugggacuuguuaaaugccuugcuuucaugcuaguggaauuucccugguauuuggaguuaugauuaauccuagcuaugaaacguuuggagagguuaaauugggucuuccuuuuggauaucugguacccacauucagccaaaaaauuuaaaagccuggcuguguguugaauacaguguucuagagaggggcugcaaagaaguaaauuguccacauauugaagcaaaacacuggguuguagagguaguugggaaagguccaaucaaagugccugaccgaaauagugagggcugucccuaaaccccugggggaagacaguccaggugaguuguugggaguagccugugucagcgucaguccaaguaaaagcaaaaagguuuugagaggaggaagauagagggauaauauaaaaggcaucuuugaggucuaaugcagagaaauagcuaguauugggaagaauuugcaauaugaggauauagggguuugggacaacaggacaaacagaacaguaguggaguuauuuguugcaaauccugaaccagucuauaggagccaucugguuuuguaauugggagaauaggaguauuguggggagaauggguggggauuaaaauauuggcagccaggccaggucggugccucacgccuguaauccgagcacuuugggaggccaaggcggguggaucaccugaggucaggaguucaagaccagucuaggccaacauggggaaaccccaucucuacuaaaaauacaaaaauuaguugggcaugguggcacacaccuauagucccagcuacucaagaggcugaggcaggagaauuacuugaaucugggaggcaggaguugcagugagccaagauugcgccauugagcuccagccugggugacaagagcaagacuccaucucaaaaaaauaaaauaaaauaaaauauuggcagccaaaaguugggagaugauggacuugaguccccauaguccauuaggggauauugugggaccacuauuugacauuuaggauccuucauugaaauuugaauuggagaaugguggguagcuaacaugggggagucaguguuccauacuaugggauuuacagggcugaggaauuugggauuuaagucuguuugauauggaaugucugaggaaggguucuguucuugagaugauaauaaauagggguagcuuugguguaggguugauaaaugaaugauucguccccguuuguguaggaugucccuuccuaguaaaggagugggggaaugaggaaugaccaagaaagagugagugagggugacucccugaaaugagcaauauagaggcaguguuuuguaugggguuucuuguaugcccuucauuccaucaacagaaacaaaugaacauucuaaugggccuugguauucaguuaaugccaguagacuugccccaguauccaaaagaaaggaaauaaucuuaccagauaccgucccaauuaaccuggguuuuguggacucacuagaugugggggcgaaggaugccggguacccucagucuuccguugucagcaccaacagugaagagauuuccuccuguaauguuuggggggcuucauuaugagugguacccgaauggggaaggugucccuguugagggcauuccaucguccaguguccccaaagacugcaaguugggcaugguuuggugggaggccaggggauaggacaagccuuuucccaguguccaggguugccuuauugaaaacagacuccuggagaggugggggaguuucccuuuggguuauuaggaggcuuucguauaacugacuuuuggacagcagaggcaagcaucugguauuuuaaauggagauguuuguccucuugaauuuuuuguuccucaucucuguuguuaaagacauggaaggucgcauuuaggagcucccaccaagaugucugggggcccuccucuaauuuuuguaauuuuuuccgaauaucugggguggauugggaaauaaauuggagguagagaaaaguuugaccuucucuagauucuggguccaaauugguauauuuuagcauagcuucagugaggugugauaagaaaagggcaggguuuuacuggugcucuuguguaauuucucugagcuuuucauaauuaacugccuuaugggcauuuuuguccaugcccgugaggagacagguaaucauguggucucuucaccugaugccauugucucccuguuggcaagucccaucugggccucuaugggggacugcaucauuggccacuggauuuuguauaggggcuuuauuauggaguuauuauaaucaaggggaacuuaaaguaguggugcuuguccaagaugguaaugcuccuguucugucaaagauggaacugugaaauagaauuuguuuaaagauguguuguucauucaacagaaguuucuugagggcccauuauaaggcuaaauuauacuuccacccgaacaguuuaauugacauugcacuauccggcgcacgauugaucaugucucuuggagaaguaauaucuagacagauccaaauggaaugugguaauuguagaucuuugugaugcuuauguggauuucucugacaucuauacaaguuauuaauauugaaaacaaguacuccuguaaaucagugauuaaaaaaaauacuucugugggaauuagaauugauccacuuguaucuguuuucuacuuucuagcuccauaucagauuucacuugaaaaaaagucuacucugcuguagacaauauguuuggauuuaaaaugaaaugucugaaacgauggagaccuguuugcaucaguggggcgggucauucaauauaaaacuuuaaaaaacaauacggaaucaaaaguuuauuaagcacccaauauagaauuggcacugugcugggcaucagguuuaugguaggaacaaauaaaauggucccuguugucauggaguuucauggggaugaccgacuuuaaauaaauaauuacaugaacaggccaagcacaguggcucaugccuguuaucccagcacuuugggaggcugaggcggauggaucacuugaggucaggaguucgagaccagccuggccaacauggugaaaccccaucuguacuaaaaauacaaaaauuagcaggugucguggcaugcaccuguagucucagcuacuuuggaggcugaggcaggagaaucgcuugaaccuggaggguggagguugcagugagcggagaucgcaccacuguauuccagccugggugacagaacgagacucugucucaaaaaaaaaaaaaaaaaaauugcaggaacaaacuauggucagagcugugaaaggaaagcaauggcauggagagaaauggaagcaggggugaggcgagguuucucuggggucacaguuguggggaggccugauggaugagugggcacagagcagugggugcuagguggaaggaagggcguaugagaagguaaagauggaaaaggugaugugaaaguucgagaacagacagaagagugugugcuuugagugcaaugaggaggggcacagugccaugagaugaggaugcugagggaggcaggggccuccucauuuggcaccuuauaggccauuuaagggcuuuuuguuuuuguggaaugcaaagguuggcuguuggaggguuucagcaacagagagacauggccagacucaguuuucaucccucugguugcugcauggaucauagauuggagugggggaagagaggaaguggggauccaguuaacgagguacugcuauggccuaauggaagcauggacuggggugaagauguuggaggcagaggaaagcggguggauaccagcaauguguuuuggagguagaauugacaggucuuaaugauggaacacgaagcuugagggagaagagaaaaccaaguagaaaccuaggcaggcuuagagcguaugcccauuucucuuauaaaagcuugaugauaguagcuguggagcacaauauagcaguuccuuugaacauuuuguauuugugauaggauuuuuaucauggcuuuuuuuuuuuuuuuuuuuuuuuuuuuuuuuuucuguuuuuuugagauggaguuucauucuugucgcccaggcuggagugcaguggugugaucuuggcucacugcaaccucugccucccagauucaagcaauucuccugccucagccuuccaaguagcugggauuacaggcacucgccaccacaccuggcuaauuuuuguauuuuuaguagagacgggguuucaccauguuggccaggcuggucuugaacuccugacuucaggugauccaccugccuuggccuccugaagugcugguauuacgggcaugagccauggcaccuggacuuaucaugacuuuugaaaagccaggaguugacugugacugccuggggugauauguuacguuagacuugcccugggaggagugagaggacuacucuuugugagucaagaguuucugccaaguggaucuuucuuauucagaaggagagaaucaaauuuguuuuauuguccauuucacaagugacauuaaagggaaaggaguggggaggcggggggguggggguugagcaugaaaugucaaaauaacagugguuuuuaucuuuaagguuuggcauggauuuuaaagaaauagaauuaauuggcucagguggauuuggccaaguuuucaaagcaaaacacagaauugacggaaagacuuacguuauuaaacguguuaaauauaauaacgaguaaguaguaaauguuuacauuuuuuugaauggcaagguacgcugaaucugcacuauucuuuuuuaugcuucucucuucuuuauuaggguaucauuuauuucuuucugauccucauuaaacauuucauucuaccaagaggaguuuggcuuacuccgagaugaucucacuuuacugugguuauuucaauaaaaauggauauaccauugaucauccuuuuggugcuaucuucagaacugaagcuauagagucauuugcuuuaaagugacaugcaaauucaugaaaugcuccguauuuuaaaaaccguggcaccagauagaaccuaucauuacccacaaaauaggugaucuuugagauguucuagucuuaccuucuuauuuuauagaugaggaaacuaagauccagagaugugaagugauuuugucuaagauaaaagcuagaugguaauuguucucugguugucuguuauuguauaaggcacugcuccaaaaugcagugcuuaaaaacagcaauuuauuguugucucuaaugguuccauggguugauugugcucaucuggacaauucucacuuggggucucagagggauuugcagucaguagucaucugaaaccuugacuacagccuaucuuaggcuggauauccaagcuggcuagcaguugacaccggcugugggcuggaaguucagcugggacugucaaucagaauaccuccacauggccucccuauggggauugggcuucuuacaacuugguggcuggguuucaagaaggauuguccccagaacaagucauccaaaagaucaggagugaguggcaaggcuucuuuugaccuaaucugaggaguuccagaacgucacuaccaucaaguuauauugguuaaacaagucacugaagccagcuuagauucaaggggaggccaaauaggcccuaccccguaauuugucauucuaggggaugaguucuaagaauauuauuuagggacugggugugguggcucacgccuguaaucccagcacuuugggaggccguggcaggcggaucaccugaggucaggaguucgagaccagccucaccaacauggagaaaccccucucuacugaaaauacaaaauuagcugggugugauggcgcaugccuguaaucucagcuucucgagaggcugagucagaagaauugcuugaacccgggaggcggagcuuguggugagcccagaucaugccauugcacuccagccugggcaacaaaagcgaaacucccucucaaaaaaaaauaaaaauaaaaauaauaaaaagaauacuauuuagggaggcugaggugaguggaucacuugagcccaggaguuugagacuagccuggggcaacauggcaaaacuccaccucuacaaaaaauacaguaauuaggccggugugguagccacgccuguagucucagcuacuucagaagcugaggugggaggaccauuugagcccaguagguggaggcugcagugagccauggucacaccacugcacuacagccugggugacagagugagacccuaucuccaaaaaaaaaaaaagaauguuauucaaauuauggauuuauauccaagaagauauaaaucacagugucauucauuaacaguaaaaaguuagaacaaacaaaauauccagcaguaaagaaaugaguauauauauuuuguucuguccccugaucgauggcuguuuugcagccauuaaaaaugacuggcugggccaggcaugguggcucacgccuguaaucccagcacuuugggaggccaagacaggcagaucacgaggucaagagacugaggccaucuggccaacauggugaaacucugucucuacuaaaaauacaaaaauuagcugggcauggcagcguacgccuguagucccagcuacuugggaggcugaggcaggagaaucgcuugaacccaggaggcggagguugcagugagccaagaucgcgccauugcacuccagccugggcgacaaagcaagacucuucucaaaaaaaaugacuggcugggugcaguggcucaggccuguaauccuaccacuuugagaggccaaggcugguggaucacuugaggucaggagugcgagaccaaccugggcaacauggagaaacccugucucuacaaaaaauauaaaaacuagccaagugugguggugugugccugugguccuagcuacuagggaggcugagguaggaggaucgcuugagcccuagggguggagguugcagugagccaacauugccacugcacuccagccugggugacagagugagacccugucucaaaaaaaaaaggaagaaucuaaaauaacauuauuuuaggauugucaaaguaucaguaauuuuuuuuauuuuugcaaauuugugucauauacuuuaaaacuucuugcauuaaaaaauaaaauuguaaaaugauuauucuuccucaucuuugaaaucuccaauuuauuuacugcacuuagcauggaauuuucuuaggucuuggcaacacaucccuguaaagccuuccaccauuucaccuucucugcauaaguuauccucuuuguguauauuugccacacauugaaaauccugaauuagguacuucacacugccuggguuaccuagccuugcugccuaaaugugguuugcuugugaaauacaaagauuuuaacacaaaucuaagcaaaacauaauguaugauuuagcuaugaaaaauugcacuggcuggguccauuggcucaugcuugcaaucccagcacuuugggaggcugaggcagguggauugcuagaucccaggaguuugagaccagcaugggcagcguggcaaaaccccaucucuacagaaaauagaaaaaauuagaugggugugguggugugcuccuguggucccagcuacucaggagacugaggugggagaauuguuugaggcuagaagguugaggcugcaaugagccaagauugugccacugcacuccaaccugggugacagagcaagacucugucucaauaaaauaaauaaauuaauuaaaaugacaucacuggcauuucaagaguacuacagaugauuuuuaaauugucugaugcuuggcauuaagucgcugccuuuuauuuauuuauuuuuugagacagagucuugcucuuuugcccaggcuggagugcaguggugcaaucuuggcucacugcaaccuccgccuccuggauucaagcgauucuccugccucagccucccaaguagcugggauuacagacaugcgccacugugcccagcuaaauuuuuuguauuuuuaguagagaugggguuucaccauguuggucaggcuggucuugaacuccugaccucgugauccgcccaccuucgccucccaaagugcugggauuacaggccugagccaccgcgcccggccacugccuuuuauuuuaucuugagagugagaacugcuauguuuuuuuucaguauguucacuuuuuccuuuugaauguccuggcuuccauucuaaaacuaugugagaaccacagcaaugguuuaauaagggaauguagacaguugucuauuacaugagguguuuugugguuguuaugagggauguacacugacacugccauguucccuguuccuuuuaacuaggaaggcggagcgugaaguaaaagcauuggcaaaacuugaucauguaaauauuguucacuacaauggcuguugggauggauuugauuaugauccugagaccagugaugauucucuugagagcagugauuaugauccugagaacagcaaaaauaguucaagguaacuaaaaauaaauucucauagccauaauaggauggaaggaaauuguuauuuacuauguaugggccacuggauaaggcuauuaaucaucacgauuaauuaucacaauucccucugagagacacuguuaucucuccauuccgaagguaaggagaaagugaaaaucucuuccuugcuccuccucuugcugcagacuugcucucacaacccucuguuacauccucagcugucugcaaaaucucagguucagcuuuccugacuccauuguuucauggagagccuuguucacgugccggcuucagcgcaggcuguuuaaguguagucuugugaagagaguuuuaacauauagaugcugcaucugggggcucccuccucagcuaccaacacuuuucugucccucucuuaggcugugauugguguggugccgucagagggucucuuuggaauguaacuauaccacuuaugcuggggugguggggagugaaaauauuuuuaagaccacaagcugagaugggggcacccucauguuuuaugucaguuaagccauugccaaacaacuggagauccuaaagagcuggcaucugucuuugaaagucacccaaccuauuauggggacaguccucucacuaaaauccugaggccaauggggucccauucauucauuuucuccugccccaccuccaucuccaugucguguaagugagaacauuaucaucaguucaggaguuauugaccgucagcauacaggacuucagcuuucagcaaauucuuggcuaccucuuccuguuuucaagcugacauauauacaaagaauauaaaugaauauugaggcuaacuuaauucagaaaaaaaauaaaacgugguuagcaaaaaaaaaaaaaaaaaaaaucaagccuccaauuuauguaucuuaguaauuuguuggcacuucucuuagaguaccuucccuauuguuuuagguuugcuuucccuuuacucucuccuauuagacuauuauccccgugacggcaaggauauagugucuaacugauuuucucaucucuaggugccuuucaugcuuaguagaucaauggugaauuaaaagguuucaaaguuacuuuauauaauaaugaaauuuaguuuccugcauuguauucauguuccuauuucuaucuguuagcaauggugauugcagaucuucagcaaugaagaauggguggcucauuuuuuuuuucuucucguuuuuuuuuuuuuuuuuuuuuuugagacggugucucgcacugucgcacaggcuggagugcaguggugcaaucuuggcucacugcaagcucugccucccggauucacaguauucuccugccucagucuccugaguagcugggacuacaggcgcccgccaccacgcccggcuaauuuuuuguauuuuuaguagagacgggauuucaccguguuagccaggauggucuugaucuccugaccucgugauccacccgccucggccucccaaagugcugggauuacaugcgugagccaccgcgcccggccucuucuuuuuuuuuuuuugagacagagucuuacucuaucgcucaugcgggagcacaauggcgugaucucagcuuacugcaaucucugccuucuggguucaaaugauucucgugccucauccucccgaguagcugagacuacaggugccgcgccaccacacccagcuaauuuuuguguuuuuaguagagaugggguuucgccaugcugcccaggcuggucucaaacuccugagcucaagcaauccgccagucucggccucccaaggugcuaggauuauaggcgugagccaccgugcccagcccagcucauauuuuauaaauuagcuaaacaaauaaagcucuggacauccgggaacuuaugauugaaauaaaaaauggccuauuauauuuugauucaaauuuguuuauuauauuuagauuucuauuuugugacauguuuugggguucuuuuuuuuucuuuuuuuuuuuuuuuuugugagacggaaucucgcucugucacccaggcuggagugcaguggcgugaucucggcucacugcaagcuccgccuaccggguucacgccauucucuugccucagccuccccggaguagcugggacuacaggcgcccgccaccacgccuggcuaauuuuuuguauuuuuaguagagacgggguuucaccguggucucgaucuccugaccucgugauccgcccgccucggccucccaaaguguuuuugggguucuuaagaagauaagguauaagcuuuuaaaaaguuaugaaaaacuuuaaaaaguuauaaaaaauuuuuuauaaauuuauauuuauuguuacuuuuaacauacugugaauuuuauacccaggucaaagacuaagugccuuuucauccaaauggaauucugugauaaagggaccuuggaacaauggauugaaaaaagaagaggcgagaaacuagacaaaguuuuggcuuuggaacucuuugaacaaauaacaaaagggguggauuauauacauucaaaaaaauuaauucauagagaucuuaagguaaguggaaaauguacuuuauuaauugauauauauauaauauaguaauuuuaaaauauaucuucucagcugggcacaguggcucacgccuauaaucucaacacuuugggaggcugaggcaggcagaucaucugaggucaugaguucgaaaccagucuggccaacauggugaaaccgugucucuacuaaaaauacaaaaauuagcugggcaugguggcgugcgccuguaaucccagcuacucgggaggcugaggcaggagauucgcuugaaccugggagguggagguugcagugagccaagauugugccacugcacuccagccuaggugaagagugagacuugucucaaaaaaaaaaauuauauauauauauaaaauaagauagauagauauauauuuuuuucucuaguuuuagaauagugguugauugauaguuaugagaaaaugguaucugaacauuuccaugcaaauaauuacugugacuggcacagccaacuggcugcucugccccuguuccuccugccuccucuaagugacucagcuuuauuugagaggcagaggggacucuguugacuguugcuuuaggaauaugguucccuaaucucucagucauuacucgcgagggcugucacagcuacuggguccagagucuaauacugucuugguuaagcauuucaaccccaugauuggaaaauugcgguaaucccggacugggaaaguguaucaucccuuaguauuuucauuuuccucuggcuuuuaugguccggacaaggaguuucccuauuuuuuacuucucauuaaaaugacagaaggugagagacagaauagcccuucacagccuuuccuccauucccuauucccugugacuugccuaagccugucacaagcuggccguccugaauccugucccuggaccuuugcucauguucuucucucucaugggacacucuucugccugcccccuuugguuguaauuccuuuacugagccuuuccugaucacucuggaacugccuuuuucuguucuaggcagaaguaccuuauuuauguggcuaucugcuuaucccaccccucuaaaacagcaaggaauaaggaaugaaacaaaaaaauuccuugagagaaauaaguucccauauacacaguuguuuauugggcucagagaggaaugaguagcccuuaaaagguauugcuuccguggucugcccaggggcuggaugucugaugcauugguguuuugagucugucugguuccaauaugucucuucuacaauaucugaaguuguucuuugaagguggaacauugucagaacuauuucaaaaggauaaauguagaguugguuaugcuuucacuuugggauaaaucauacauauaguuaaauaacaaauaagcacaauuauuucuauauaaaauaauuugcaaauaaaugcagaaguguaggcauuaagcuccuaguccucagaaugaauuagcaaaauucugacuggugccuacccacuuaccugccaacuaugccccacaccgugugugcccugugucauggacugaucuuuucuugugucuauuugcagagaauuuuuacucuggcugcaguugcucaagggucagacuuuauuauucuucuuaaauuuuuaauuuuuauuuuuuuuugagacaaggucuugcucuuuugcccaggcuggagugcaguggcacaaucacggcucauuacagccuugaccuccugggcucaagcaguccucccaccucagccucccguauagcugggaccacagguguacaccaccacaccuggccauuuuuguguguuuuuuuuuuguagagacagggucucaccauguuuccgaggcuggucucaaacuuuuagacucaaagugauccuccugccucagccucccaaagugcuggcauuccaggugugcuccacugcacccggccucaagcuuugauacugagacuucuuucaucuucuauaacuuuucaggcucucacuacuacaguuguugauuucucuccucuaagaaaagauacaaugaagguguacaauuuugggguuguguuuugcaaaauagcagcuguaggugguuuugccagagaauggucuuuaccuaacacagccccucuuacaaaagucuccaaguguuuaccacuuucuguuggaaucuuaggaacuagaccaaaggcgcugggaagggacauagggguuucuggagugagggcuucuugugcaaggcugcuucucucuaaaauguucagucuccuaaagcccaggcucuggucauccucagccugagcaucaguccuguuccugugccuccuaggugaaguuugcaucccuuuuauaugaucuacagcccuauauuuugucuaaucauauuauaacugauuagacaaaauguggcauuauuguuuuuauuucuuuuguguuuuacaaggucucacucuguugcccaggcuggagugcaguuguaugaucucagcucacugcagccuggaccuccuaggcucaagcaauccucccaccucggccccccacauagcugggacuacaggugcaggcuaccaaggcaggcuaauuuuugacauuuuguggagacaggauuuugccauguugcccugguuggucucgaacuccugagcucaagugaucugccgaccuuggcuucccaaaguguugggauuacaggcaugagccaccauacccagcuucuuuuucuuuucuuuuuuucuuuuuucuuuuuuuuuuuuuuuugagacagagucuccucuguugcccaggcuggagugcaguggagugaucucggcucacugcagccucugacuccuggguucacgagauucuccugcgucagccucucgaguaucugggauuacaggcgccugccaugaugcccagauaauuuuuuguauuuuuaguagagacaggguuucaccauguuggcaagguuggccuuggacugaugggcccacgcugucugcccgcuucagccucccaaagugcugggauuacaggugugacucaccacgcccugcccacuuuuucuuuugaaugaacuacaaaaagugaucugauauuuucacuagauagccucauccagcuuagauauuuacacggcuucacaaauucaauuuucuguuucuuagagucaggugauagccuuaugugggacuagcaguuucacuugcaauccugacauauuccuacacauugcaacuugaacauagcauaggaauguuuucucuccacauccacuccacaucugucuacagcuuuccaucuguauuacugguguuaggcuccaaucugacuguuaauugaauucuaauccaacugcuaauugcuguaugagccgucaucucaagcuggcuucucggaagcuccuccuucagccuucccugggcuuauggucucuucccucuuagguccuuacuagguaggcccucucauaaguguguuaucccguagagucuguguguuuagccuaagauuguauuaaaaguccagccuuuucaaaaauagcaaaauauuaauuuucucaucaacuaccuuccuguuuuuguggucuuuagaauauuggucaguagagcugggugugguggccuguggucccagcuacuugggaggcugaggugggaggaucgcuugagcugaggaagucaaggcugcagugagccaugaucaugccacugaaauccauccuggauaacaaaaugagacacugucucaaaaacaaacaaaaauaauauuggucaauaccuccuaugggcugggcgugguggcucaugccuguaaccucagcacuuugggaggcugaggugagcagauugcuugaggucaggaguuugagaccaaucuggccaacauggugaaaaucugucucuacuaaaaauacaaaaaaauuagccaagcguuguggcacaugccuguaaucccagcuccucgggaggcugaggcaggagaauugcuugaacccaggaagcagagguuguggugagccgagaucaugccacuacacuccauccugggugacagagcgaggcuccaucuuacaaaacaaaacaaaacaaaacaccucccuuaaaaaaaaaaaaucugcuuaaagaauugcauggauaaaaauauuucagagcuaguuauuagcuuccaguuaacuugguaugcuuucaugguggaagggauguguuuguuaagaaguugucagaggcuuggagaaaagacccccaagagaaauucugcacaggcuaaucugcacuauuguugggaauggacccauuccgagaaucucaaaguuggaagggaucuuaaggaugucugcuucagucccuaucagaucauggacucauauuugcaacauuuccucaagugguuguucagcccuaucuugggauggggaacugucuaacucccauucuuuggacaacacuauuaggauauuaggauauuuuaaagcuaaucuuuaggucauuuccacccuauaguccuggaucuuuucccuuggaccaugcagagugaauccaccuugcacgugacagcuuuucagauauucgagggcagcugugcccagagccaccucuggugucagcuaagaaauccuuacuucuguccaggcgugguggcucaugccuguaaucccagcacuuugggaggccaagguggguggaucaugaggucaggagaucgagaccauccuggcuaacacggugaaacccugucucuacuaaaaaaaaaaaaaaaaaaaaaaaaaaaaacuagccgggcaugguggcgggugccuguagucccagcuacucgggaggcugaggcaggagaauggcaugaacccaggaggcggagcuugcagugaaccgagauagcaccacugcacuccagcuugggugacagagcgagacuccggcccaaaagaaaaaaaaaaaaaaagaaauccugacuucuuucagcuggcauuuuaaagacgagucauauuaaauucccugauuuuggcuaccuguguaaggguaaaggucuuauaaauaauauaaaaauagucuuuucuguauauaauuaagacaugugguaauaguauguuaaguugguacauguaaguuaaauuuuuuuuuuucauagccaaguaauauauucuuaguagauacaaaacaaguaaagauuggagacuuuggacuuguaacaucucugaaaaaugauggaaagcgaacaaggaguaagggaacuuugcgauacaugagcccagaacagguaaggucucuuuccugucugucuauauuuuacuucuuuuauuuugaaaauuauaaaaagaguagacacuacuuauauaauuaaaacuguacagaaguauauacuaaaaauuuuccuuaccauucuuuucuaccccuauucuucuuaucaguuuauucuuuauccuuuuagauaauuuucugaguuauaaaaacauacaaacacaaauauacacccagauuuuuuuuacagaaacauauauauguguacauuuuuucaaggacuuauuuuguuauuuugugacuauauagcauaauuucuccauauuaguucaaauagaucugccacauucuuuuuuuaacaacuguauuauauuucaaaauauggagauaccauaauuuaacuauuuuuuuaaauuuaauauuuuuuguuguuguucuuauuuuguuuuagagacagggucuugcucugucacccaggcuggagugcaguaguaugauuauugcucacugcagccucaaaaucuugggcucaagcaaucuucccaccucagccuccugaguagcuaggacucuagaggcacauaccacugugcccagcuaauuauuuuuauuuuuauuaauuauuuauuuacuuauuuauuguagagacaaggucucacuauguuucccagguuguauuuaacuauuuucuuaucgaaggguauuucuuuagguuguuuacaacuucauacacuuagacauuccuccuuauuuugggucccaagaacaaauaauucugugauaaucuguguuagacuucuugagguaaagugauugaauagauugaccagugcauuucaaacuuaauugcuguuuaauugucauucuaaaaaaagugauucuaauaauacugucccgucaaaauguaugagaauacugcaucaucauacucuccagugaucaguuuuggguaguguguugaauuaggaguaucuugcuauuuuaguuuguauuuuccagauuuuuaguaagguaugcccucuuuucauauauuuacuuaaacauuuucugcaaauucucuacucauauccuuucccaauuucucauaauuaaguucucauuuucuuguguaucuguaaggaaucuugaucuauauuggguguugaucccguaucuguuaacuauauuauagaauuuuucuccuugauuguuacuucuuuguuuauaaugacauuugugguacugcagcuuuuuuuuuuuuuuuuuuuuuuugagauggaguuuugcucuugucaccaaggcuggagugcaauggcaugaucucagcucacugcaacaaccucugccucccggguucaagcaauucuccugccucagucucccaaguagcugggauuauaggugcccaccaccaugcccagcuaaguuuuguauuuuuaguaaagacggguuucaccaugcuggccaggcuggucucaaacuccugaccucagguaauccacccaccuuggccucccaaagugcugggauuacagacgugagccaccaaacccagcacugcagcuuuuaaauugucauauuuaucaauacggcugcuagguuucucauuuuuauuuuggaggcuucuauuacaagauuaugaaaauauuuuuugguuuuacuaacauaaaaauuaacugcaauuugaauuaacuuuuguuuauguaugagaaaggaaucuaacuugauuuuccccgugugaauaugcaguugcuucaucacuacguguuaagcaguuaauuauuuaaaugcuauuuuaaggaaaauucauagagacagaaaguggaacagagguuaucuggaagaagggaggaaugggaacuucuuguuuaauggguauagcuucuguuuggggugaugaaaaguucuggaaauagauaguggugaugguuauacaacauugugaagguaguuaaugccacugaauuguaggcauaaaaaugguuaaaaggguaaauuuuauguuaugucuauuuuaccacaauaaaauauuauuuuaucauauauaaaauucccacacauucauagauguguuucuggacuuuguucuguuuccuuaauuuauuuuauauuucucucuuuaauauuaugcuauuuagauuauuguagcauuauaaacuaggcuuuaguauuugaacagcaggaccugccacauuauucuucaauuuaaaaaugcucucagcuauucacauuuacaauuccaaaugaacucuguaaucacauugucaucuuccauaacugguuuugagguuuugauagcaauugcaucaaauuugaggauucaggugaggaacauugauaucuucauauauuugagacuucuccaaaauugguauuuucucucacuuauucgaguccuccaucagucagcuuuugccagacuaugcugugguaacaaaugaccccaguuucuuaguggugcagaaaauaccaagggucuauuucuugcucacaugacaagucggcagcagucuggcuggcugcaguuuugcucugagugucuccuucauuccaagacccaggcuguaggaaaaaugcuaucugagucacugccguccucaaggcagaaagcaauggcagaaccuugugauggcuuuuacauguucugcucagcaguggcauacaucacuaaacaucauugcccagagcaaaaugcauggcccagcucaaggcaaugaggguggagaagaguaauccucucacuaggaggccagugcagcauugggggcaaucauacaaccuaccucagagccacuuuuauacuguucaaaaucuauauauauauauauauagagagagagagagagagauuuauuaugauauauauauauauauauauauauauauauauauuuuuuuuuuuuuuuuuugagacagggucuugcuuuucacccaggcuggaguacaguggcacaaucauagcucaccacugcgcagccucgaccuccuuggcucaggugauccuccugccucagcccccucaguagcaggacuacaggcucaaaccaccaacaccuggcuaauuuuuuuuuguauuuuuuguagagacuggguuucaccauguugccuaggcuggucucgaauuccugggcuuaagcgauccaccugucuugaccucccaaaguacuaggauuacaggaaugagccacggcgccuggucauauuguuuauauuuuugaagcuuucuccagaaucuguauugcauuuugcuauuaaaaugagauuccaugcuugaacccgggagguggagguugcagugagcugagaucgcgccauugcacugcagccuggucaacaggaaugagacuccaucugaagaaaaaaaaaaaaaaagaaaagaaauuccauaucucuaauuuguuauuaguguagccguuaauuuuaaaaauauaucucuuuauuuuuaauugugguaaaauauacaaacauaaaauuuaccaccuucaccauuuuuaaguguauaguuuaguggcguuaaauguguucacauuguugugcuuucaucaccaccauacauccacagauuacuuuucauuuugcaaaacugaaacuuuacacccguuaaagaacuccuauucuccucucccuacagcccaaucaacuaccauucuacuuucugucuguauauuugacuauucuagaugccucauguaaguggaaucguacgguauuuacccuuuuguuacuggcuuauuuuacucagcauaauauccucaagauauauccauguuguaacaugucagaauuucuuuuuaaggcugacuaaugaauuccauuguauguauacaccacauuuuguuuguccuuuuauccaucaauggacacuuagguugcuuccaccuuuugacuguggugaauaaugcugcugaugaacauggguguacagcuguugaguuuuaaauauuugucucauauauagucucauuauuugaaugugauuuuuuuuuggguugauugcuuuuauuuuuuaccuuuuggguuguuuauccuauuuuaauuucugauuuguaaaugcccguuaaagauuauuuugcugacaauacagcuuucaaaauaucucuacuauuuugucauccaagaauagauauacugagcuaucugaugguuugagagucuagaauggagaaggcauguacuuuuuccuuuuggggagccaguuggcauaaaaaauauagaacacaauaggccaguggcucucuuuaacuuccugcugcuuucaguaucuccugcauccuguauugcugcccucacacuauuugguuaaaaacauucaucauuguacuuuacuuuuuauuaugugugugugguuuuuuuuuccauuuaaaaaccuuuuguuggcugggugcaguggcucaugccuguaaucccaacacuuugggaggcugaggugggcagaucaccucaggucaagggguuugagaccagccuggccaagauguugaaacuccaucuccacuaaaaaaacaaaaauacagaaauacaaaacuacaaaaaugagccaggcgugguggcacgugccuggagucccagcuacucuggaggcugaggcaggagaacugcuugaaccugggaggugggggcugcugugagccgagaccacgccacugcauuccagccuggugacagcgggacuccgucucaaaaaaaaaaaaggcaacauuuuguugaggaacaauuuauacaguauaaaaugcacagaucuuaaguguauauuuuuucguuuugacaaaugcauacaccucuguaacuuauaagacuauaaagauauagaacauuuugcuccuucaagcuccuuuccagucagugccuccuccccacugaucagaagaaaccagcacucugaguucuaucaccauagcuuaguucuucccguuuuugaccuucauaugaauggaaucauacaguagguacucuuuguauuuaauuucuucauucaaaauaauaucuucuggaaaaacuuuguugcucauaccagcagagaauuccuuuuuauugcugagucguaguccauuguaugaauaugccacaacauguuuauccauucuucuguugugguccuuugaguuguuuccaguuauggaauauugugaauaaauacgcuaugaacaguugcaaugcaagccgccuacugggugcuauuuuaacugcuuuaccugcugcaucucacucucacaaucaaacucugugguugauacuguuguuauccuuguuuuauaacugagauuauucccauguugaucguuaauuuacacagaggauucagcuauucggcgguacagauuugaaccuaggcagucagacuccacagauuuugcuaauaaauagacauuguuuugugguguaagauguuuuggucaaauaacuuuuuugggcuuuagaaggcuggauauuuauguaaggagcauaacaaagguaaaucuauuuuggucucuuuagauuucuucgcaagacuauggaaaggaaguggaccucuacgcuuuggggcuaauucuugcugaacuucuucauguaugugacacugcuuuugaaacaucaaagguaaaauuaucucaaagaaagaauuaaacaagaaaaauuacugacuaccaccuucagagugcugcugcagacaguucuugcccucacgugaggaugggcuugagcauauuaguaucugacugcaaaugaaauaugaauuuucugucuuucaagguuuggcagagaccaaacacuuucuuaaagaccaaaaacuuugaucuucccuggaagguaguacaucucauaagacuuguaagacuugucagucaguaacauuuuauugauugacugcuuuguguaagacacugugcuaagugcuguaaggguugcaaaaauaaacaagccuuggcugggcgcgguggcucaccccuguaaucccagcuuugagaggccaaggcaggcagaucacuugaagucagguguucgagaccagccuggccaacguggugaaaucucaucucuacuaaaaauacaaaaauuagcugggugugguggugcacaccuguaaucccaacuacucagggggcugaggcaggagaaucgcuugaaccugggaggcggagguugcagugagccaagaucacaccacugcacuccagccugggugacagagugacauuccaucucuaaauaaauaaaugaauaaagccuuguucucaaggagcuuauuuucuaaaagggaagauaauauaagagaaugccauaagcauuuuaggagaaggcaugaagucuguggaagcagcugggagggagaucuuuccagcuguagggacuuagguuucauggagacaucuaagcugggcucugaaggaucuguuggcuucuaauaguccaaaacagaaaaguugauucuagcauggaggcgggaauguacagaguguauuuggggacagcaggcaguguaaguuguauuggaguauauaaguuacaaggaaguagugguuggugaggcuagaaagauagguugggcuaacuugaggaaaaaauguggaccuucuugcuuagacaguggggagucacuaaaggcaguaggcaaguggauauccuacucuuuuuuuuuuuuuuuuugagauagaguuucacuuuuauugcccaggcuggagugcaauggcgcgaucuuggcucacuguaacuucugccucccagguucaagcaauucuccugccucagccucccaaguaacugggacuacaggcgugcaccaccaugccugguuaauuuuuuuguauuuaguagagaugggguuucaccauguuggucaggcuggucucgaacuccugaccucuggcaauccacccgccucggccucccagaguguugggauuacaggugugagccacugcacccagcuggauauccuacucuuaagcucaggaaagggaacuuuccuggagucaauaaccuuauccucuguaaaacaguuagaaguaccuaucacuuaggguuccaaaaugcaugaagggagauuguaaagaugaugcacuuaacacuucaugucguaaugcaaggaugguuauuagauuggggguaguguaggagagagggaauccugcuugcuucuuggcuaaagagacuuucccaaaaaaucuggaaauauccuacauuucagguauuccucagccuuuaguucugucuuuccucccaaguaaauaauuuccuaauauacaccuaucauuuuuuuuuccaguuuuucacagaccuacgggauggcaucaucucagauauauuugauaaaaaagaaguaagcacuugaaaaucaucagaauuuuauuuauuucaauguuuuauuucuuacuauugacucucacugucauugcagaaaacucuucuacagaaauuacucucaaagaaaccugaggaucgaccuaacacaucugaaauacuaaggaccuugacuguguggaagaaaagcccagagaaaaaugaacgacacacauguuagagcccuucugaaaaaguauccugcuucugauaugcaguuuuccuuaaauuaucuaaaaucugcuagggaauaucaauagauauuuaccuuuuauuuuaauguuuccuuuaauuuuuuacuauuuuuacuaaucuuucugcagaaacagaaagguuuucuucuuuuugcuucaaaaacauucuuacauuuuacuuuuuccuggcucaucucuuuauucuuuuuuuuuuuuuaaagacagagucucgcucuguugcccaggcuggagugcaaugacacagucuuggcucacugcaacuucugccucuuggguucaagugauucuccugccucagccuccugaguagcuggauuacaggcaugugccacccacccaacuaauuuuuguguuuuuaauaaagacaggguuucaccauguuggccaggcuggucucaaacuccugaccucaaguaauccaccugccucggccucccaaagugcugggauuacagggaugagccaccgcgcccagccucaucucuuuguucuaaagauggaaaaaccacccccaaauuuucuuuuuauacuauuaaugaaucaaucaauucauaucuauuuauuaaauuucuaccgcuuuuaggccaaaaaaauguaagaucguucucugccucacauagcuuacaagccagcuggagaaauaugguacucauuaaaaaaaaaaaaaaaagugauguacaaccacuucggaaaacaauuuggcauuaucuaguaaaguugaauccauguauacccacauagcuaucaauucuauuccuacauacgugcuuacaagaauguccauaaaacccuguuuauaauagccaaaagaacagggaacaaccauaaugcacaucaaaagaagaauggauuaaaaaaauuauauucacacacaggaguacuauauaguauugaaaacaauugaaguacagcuaaauguaauaacguaacacaauacaacucucagaaacauaauguuaagcgaacaaagcagguuuucagaaaauauaugcagaauaauuccauuuauauaaaguuccagagcaugcaaaacuaaaucauuuuguauaaaaaacccaacaaaugugaugagacaauaaugggaaggaagggaaugagaaauauuaaauucuggauggugguuaucuuugagggaggggaaugaugugauuggggaaauggacuuucaaagguaaugguaacuuccuuaagcuggaugguagguccacuaguguuugcugcauaguuauaccuuuuaucuuaaauacauuuuguaucuauuguaacaaccacuuuaaagacaaccgugcuguaaggcaguagcuaaaaacagaaaauaguccaucgggaaggguaagauggcuuucugcugagcacagggcuagaagugacagcccagugggccuuccaacuauaugccaggguguuagaugaguagagaggagaccacccaggaagucuggacaaggggucuggcaugagcucuggagaagauauauuugaggaacaugggguaugcuaguuuguuguccugaauugcuguagagaagauaauuuaaauugcaucuuagaagacgacccugagggugaauuucaacuuagggcaauuguuuuaguuuguuucuuauugguuuaaauggauacuugaagcuggauaauuuauaaggaaaagagauuuauaugacuuacaguucugcaggcuguacaagaaacauggcaccagcaucugcuucuuccccggcugcuuccacucaugguggaaggugaaggggagccggaugugcagagaucauauggcaagagaggaagcaagagagcgagggagaaggugccaggcucuuuuuaaauaaccggcucuugagggaacuaauagauugagaacuccuugcuucuccuccccagcacaccccacccccagggacggcauuaauguauucaugaggggucuucccccaugacccaaacaccucccaucaggccccaccuccaacacugggaucaaauuucaacaugagauuuugggggacaaacaugcaaacuauagcagcaaccagcuaccauucuaaaacugccauaugauuuuaggauuuuuaaaaagggccaaauuuagguuaagcaa

SEQ ID NO: 192724 - RNA, 3780 nt, Homo sapiens
ggcgcaaagcaugcuggucucaggcggucuccgcucaacgauccuuccucaaagcaugguugcugaguacccagaguugcgaggaguuuuuuaacugguauuuuucucguuugucaggguuaaacguuaaguaccauuugguuuuuaguacaguguuagguaucguguggcugcaggacaggaccagaaaucuaagcucuagagcuguagccgcuggcccuucguuugugcauccuucaaacaaauuuuaaggggcaguugucauaaaucgggggagccucucgauggcgggauccagcggagacacagagccagagagcgcguggguggauaucaggagaguuuucugguucaguugaggaguggggugaacuccuuugaucgauggaaggaaaagcagaguugaaggguuugagcaucaucugcaggccagagugaaagcgauuuggaaugugguuguggaucggaauagaccugugccagaugaauuuccucagacugcacccgcggcaaaucggugaccccucugcuuuaggccgaauuguacauauuaacuauuuuccuuuuccugauaaaaauucucaagcagccuuuacacguguucuuuuccccaacuauaguaucaguuccuaucaguacaugcauuaauacuuaauuguauuaaguuacuuauuacgaacuugaggcaaaucacagauguucucugucucuaggauaggauggagauuagggauaagacauuugcuuacguggaacauauauuaaccagcacuggugguuguuucagauuuagccagguggcaaucaugagugaauggaugaagaaaggccccuuagaauggcaagauuacauuuacaaagagguccgagugacagccagugagaagaaugaguauaaaggauggguuuuaacuacagacccagucucugccaagugaguaugcauccuacuugccugaaaucuugacaccccuuugugcugccuguauguuauagacaaacuaagaaagcagauaaaugaaaagcuaauuauuaauauuuucauauaagaauuuuuuguuuguuugagacaggguucuacugucacccaggcuggaaugcaguggcgagaucucggcucuuuguaaccuccaccucgcagguucaagcgauucuccugccuuagccucccgaguagcugggacuacaggcauuugccaccacgucuggcuaauuuuuguauuuuuuguggagacggggcuucgccauguugcccagguuggucucaaacuccugaucuccaaggaucugcccaccuuagcgucacagagugcuggcauuacaggcugagucacuguacccggccuacauaugagaacuuaacugccuuugaaucuaaaugcuguucugacuauggauuaccuuaucagaccaggcaacuucauagaaauugggcauagaaauuauucuuacuauauauauauauauauauauauauauauuuuuuuuuuuuuuuuuuuuuuuuuuucgggggugggaugaagucucacucuguugcccaggcuggaguggugcaguuacaaucuuggcucacugcaacuucugccucccagguucaagugauucucaugccucagccuccccaguagcugggguuacacacaugugccaacaugccccacuaauuuuuuguauuuuuaguagagacgggguuucgcuauguuggccaggcuggucucaaacuccugaccucaggugaucugcccaccuuggccucccaaagugcuaggaucauaggcuugagccaccguccccagccuauaauuuuguuuauaaauacuucacuauaucucuuaaaagaaaaggacuuuaaggccgggcaugguggcucacgccuguaaucccagcacuuugggaggccgaggcggguggaucacgaggucaggagaucgagaccauccuggcuaacauggugaaaccccgucucuacugaaaauacaaaaaaaauuagccgggcgugguagcaggcaccuguagucccagcuacucaggaggcuggggcaggagaauggcgugaagcugggaggcagagcuugccgugagcugagaucgcgccacugcacucuagccuggaugacagagcaagacuccgucucaaaaaaaaaaaaagaaaaagauaaggacuuuaaauaaauguaaccacaaaaacuuuuuuuuuugagauggagucucgcuguguugcccaggcuggagugcaguggcgugaucucaguucacugcaaccuccaccuucccaguucaagugauucuccugccucaggcuccuaaguagcugggauuacaggcguguauuuuuaguagagaugggguuucaccauguuagccaggacggucuccauuuccugaccuugcaauccacccaccugaccucccaaaguguugggguuauaggcgugagccaccucaccugaccuuuuuuuuuugagauggagccuugcucuguugcccaggcuggaguucaauggcucgaucucggcucacugcaaccucugccucccggauucaagugauucuccugccucagccuccuaaguagcugggauuauagacaugugcuaccacacccggcuaauuuuuauauuuuuaguagagaugggguuucaccauguuggccaggcuggccuugaacuccuuaccucaagugauuugcccgccuuguccucccaaagugcugggauuacaggcgugagccaccaugcccggccuaguuauuguuuuuuuaacucuaaaaguuaagucuacccugccuucuucuuuuuuuuuuuuuuuccacgacagagucuugcucaggcuggagugcaguggcaugaucucggcucacugcaaccucugccucccagguucaagcaauucucugccucugccucccaaguagcugggauuacaggugacugccaccacacccagcuaauauuuguauuuuuaguagggauuggguuucaccaucuuggccagagguuggucuugaacuccugaccucgugauccacccgccucggccucccaaagugcugggauuacaggcgugagccaccgcgccuggcuacccugccuucuuuucuaauacacauuuaaggcauucauaacuuguuuaauccuuuaacuguaucccacaaugauuggcuguaggcugggcaaaaaguuuaccuauuuaggauccuuagugaauguuuguugaauaaauggaagcauucauuggugacaggauuaauuucaaacagaguagagugucaucuauuauuuuagugaccuacuuggguugaugaugccucuaaacuuacuuuuccuccaaaguauuguccuugugaacuuccuugaagauggcagcaugucugugaccggaauuaugggacaugcugugcagacuguugaaacuaugaaugaaggggaccauagagugagggagaagcugaugcauuuguucacgucuggagacugcaaagcauacagcccagaggaucuggaagagagaaagaacagccuaaagaaauggcuugagaagaaccacauccccaucacugaacagggagacgcuccaaggacucucuguguggcugggguccugacuauagacccaccauaugguccagaaaauugcagcagcucuaaugagauuauucugucgcguguucaggaucuuauugaaggacaucuuacagcuucccaaugagaggccaggaagugugaacauacugauagaaaaagacuauauuuuaucccucauaaaauguuuuaaauguaa

SEQ ID NO: 192725 - RNA, 50986 nt, Homo sapiens
uuacgauuuaacuucaaaguuuucugaaagcaagugaaggacagucaccugauaaacugcagaauuaauguuugucauaacagucaccauacuguucugcaauauuggcccauuggguagaauuugguucccagaugucuggguuucauuccuuuguaccuggcagaucuugguuuugagaaaaagccuaggaaaggcagacuuaggugccugcugugggugaaaagauggaagagucaaguuaccguuauugcacaucuggaggcuacagaaaggcacuuggauuccuuugcaaugcuggcaaaacucaguccuguuggaaucagcauuuuauuauaugaaguuguuauauuauggguauacgaucuugugggugggauauccaaucagagcagccaaagaguugcguaacgauuugauucagguguguuuggaauaagauuuuugcaauaaucuugauauuuucauaguucuaugguuuuauuacaucaauuaccaauauuuauuaagcuagacaaauacaacuacaccaguacaaaugaaaggucuugguguccaccuugucucacuuugaaaggcagacaaacaaaaacaaaaaaggaauuauuuuuauagcacuuuaacuuuugagcggaaguaccuguuggcgucuucuguuucuuccuucauuacgugcuuuucuuuuaauuugggccucuugaaaagaaucaaaguaggagcucuccaggaguugggaacagguuaaucugucaucuggauucaucuucagacaccccuuuggaggaagagaauagcaaagaagauguuaagggaggggcucauuuuguuaccgugcccacaaacugaauaacuugcuaggauaaauaugaguuuagaaaaucuuccaguuuguguauuaucaaguaguuggagcuugcuaauagcuaggauugcucuucuuuuuccuacuucaaagucuuuugagggcagaaugaauggauggucagugucucucugaaagaggccaccuguagaucugguguucccaccaaugacauuuuaaaaucacugcugaaagcaaaucguuuauagcagucugcagaguauagucccuggacuaaaaacaucagcgucgcaggaacuuccuagaaaugcgaagucuuggguccuauaccccgccugccaaagggaaucgaggcacuggagguggggcccggcaguuuguguuuaagaagcucucugggugauuccgaugcccauaugcucagguuugagaaccacuggguuaaggagaugacugaggaagugagaaccucagucaugagaaugaaccuaaaacaaggaaaaauugacuauauauucauauaaaaauaacuacaggcaaaacagaaaaggugacauuaugacccuucuauauuugagaccauuagaagccucuaggucggcuucugagaguggggaggaguaucacagcagaggggucaguggggguccugacacaaagagguuuucucugagaaacacugauacuccagccagacagugggacuuugcccaucaauaaacacagauuaugauccauaaagagcagcuuuaagccagaccugguggcucaugccuguaaucccagcacuuugggaguccagaggucuagaccagccuggguaacauagugagaccgcaucucuccuuuauuuacauuuuuaaaaggagcaguuuuacaauacacaggcacagacgaccugacaauuauugccuuccaucauaagagagaaauaaggcucaccaccagcacaaacauuguuuugaggcauucucaagcccagacaauugcguugccugaggcugccccagccgggcacugcccuguggugucuguuccucccugaccccagcugaccucagauuucugagaucccugaagcugccugccccuaagcagugucaccuggcccuuggcgagggaucugauuaguccuguucuucaagaaacaauccugcucaguaaaacuagacuuacuggucccuccuugucaacugccugguccaagcagaugaccccuaauuaaugacccaugccauauaucaacuccagcugcugcuggaaaaacauucuccucaaauccuaguacuguuagggcuacaaucaggagagaaagacuuuuuuuuuuuuuuuuuuuuuugagacaaagucucguucugucacccaggcuggaaugcaguagcgccaccucggcucacugcaaacuccaccucccagguuugagcgauucucaugccucagccucccaaauagcuggaauuacaggcaugcaccaccaugcugaguacauuuuuguauuuuuaguagagacagguucaccauguuggccaggcgggucucgaacuccugaccucaagugaucugcccaccucggccucccagugcugggacuacaggcgugagccacugcaccuggccagaaauacuauuuugaauacaaacugugauagucucuacuucuuuaucacucuauucuggcuuuugcuuccacuguuccauuaaaguggcucuuguuauuaauaccucugaccucuacuuccauauccuucaacccauuauguauuuugaauucucucucaucucaauaguauuagacacuacugaccaagcccuccuugaaacuuuguuucucuuuggcuucucuaaucucucacuuuccuugcuccucccuccuggccacuccuuuucaaaccagccuuugcuaguuuaucuucuucucuacuauguucuccacuaugguuggauaaaauuccucaaggccaaauccuagccaccccuuuuuuucucaucuguucuugguuucuaggugaucucuuugcugccuauggcuucaauuaucaaaguuuaccagagauuuccacaucuacaauuccauuccagaccuccccugugaacuccagaccugcaggugcaacugcuuacuuaacaucugccucaaggucacuguuauggguugaguuguaucgccgcaaaaauauguauguugaaguucuaacucccaggaccucagaauguuaccuuauuuggaaauaaguucuuugcagauguaauuagugaagacaaggucauaauggcauggaguacacccccaacccaauuacaguugguuuccuuauaagaagagggaagaugguguagacagacacacagagugaaugccaugcuaugauggagguagaaauuggaguuacauugucacaagugaaagaaugccuggggcuacaagaagcuggaagaggcaaggaaagaaccuugccaagaguuuucagagaaagcccagaccugccaauaccugaaaaagcaauacagccacuguacccuugccaccucuucuacuuuauuccccauauaucaaugauaauuaaguccuaucgguuuuccuuucaaauauaucuugaauuuauucacguugauuuuauuuuauuuuuuuuuagagaugagguuucacugucacccaggcuacagugcaguggcauaaucauggcucacugcggccuucagcuccugggcucaagcaauccucccgccuuagccucccaaguagcugggacuaaaggcaaaugccaccaugccugaauaauuuuuauuuauuuuuuauguuuuguagagacagggucugacuuuguuguccaggcuggucucaaaugccugggcucgagugauccuccugccuuggacuccuaaagugcuaagauuacaggcaugagccaccaugcccagccucauucauguuuuuauaugggcuuucaaaacuauugaaaucuaguccaucacuaaauaccuaugaauuuucauuuuaaagaacauuuuuagauucuuagaagacacugcuaaugcugagcucucuccauggagucugagcuggaacaauguccugcuuaauucugaagcauugagaugagcugaguagaauugaggcuucugaguccuugccugccuggauuaauaacuuucuguauaucaagaagcugaagaauuaaucagagguguucccuguagaugugcuccuaacccagaaaacaucuggaagaugagaaaugagaaaucaaaaugguaaaguccaagucaggauccuuuucuuaaauccaaacuucaaauuucacagaaaacgcucugauaaaauuucuaauagucuauagucuucuucuugauggaccagcugaagcugauauagugauaggaucaucaugacuauggaaauaaaugaguaauaaauaagaaagauugugcucauggucucauuuuaaaccuaaugaagagaacacagaagaccugccauagauuggcuacugcaugccaccacucuccuugacucugccauugccaaauacgccauccaccugagcagucccugcauagguuaugauucggucccaugggauaaacaccaguuaugguagccaguacuuauuugccauuaaagaugucuugggcugggcacaguggcuuacgccuguaaucucagcacuuugggaggccuaggugggcggaucaugaggucaggagauggagaccauccuggccaacaugaugaaacccugucucuacuaaaaauacaaaaauuagucuggugugguggcgugugccuguagucccaguuacuugggaggcugaggcaggagaaccacucgaaccugguuggcggagguuacagugagcggagaacuccagccugggcgacagagcaagacucugucucaaaaaaaaaaaaaugucucaauugcaaagaauuaaagucuucucucaucuaauauggggcaggaaucuauaagauagggugugguccaugaaacagcacaauccuugaugcacugagaggauucuugggucuuagguugauacuuaugggucuaaauaaaauagucgaguaacaaaccuagauucaucuaaaaccuuaggcagccaaccagggcucuucaucuuuggagaugaggacagggaacuuguccuauaucuugcaguuuucaugccccagaguugcuuuccagggaaccacagguugucucuggcuuccaucugagaauucguugggcuugcagugcuugaugucucccuucucccuugcagguuuugcuaaauugcaagugggucagaacaaccugucaagaacaaggucagggaacugggcuucuaggacaggaccugcugagugcugggugaaagcagaucugggcaguaagauaggguagauggcagcugaggucagguggagcaaugguauggggagucugagagcacagggguaucaggcucugacucucaggaggacuuagguugaagcacuccagcacucuggauagcaccauggcagugaccagcacucgcacaaaggcuggucuacaaaaguugacucuaggucauccaaauggccccaccgucuagaucagaugagucucaaacugagcuguuuaucauaaucaccuaagggcauguuuaaagauacacaugccaaggucccacucaugaaaauuccccuucugaaucugaggcuagauacuggaaucuguauuuuucaaaaguucccaggccauucugaugaauagccacauuuggaagacacuacuguagacagaacuuaauugauugucaaagguagauacccucucugguauccucauacccuuuguccaaugagcuuuugguauacacaauguaugacagggucacacaccuucuaguguggcgccaugaauggcagacuaggcauagguaaguuucuucugcuuuuuauuugaaucuguccuugguuuggcgucucucuugggccuagugcaggagcuaggucuggugucugcauggcucugauuuugccucaucuacuaauguuaauagauauguuagaacaauuacugcuuaaaccaaugaugucccuuuaacuggaauuguuuuacaguucuuuaucauuuucaaugacuacauccuauuuuggcauuauuuaauccacuguccaccccuccucaaauuaccagcuucagucauuacaauuuauagcuaauaagaguuauaauugauucuuaaguaccuucaugaaguucagagccacaggaugaacaucugagaacuuuuccucaagaguuuccugaaaaacaagguuaaaacauucaauauuacauaagaacaaaguaauauguguguguauauaugugcguauguauguguguguguguguguguguguguauuuagagauacugucucccucuaucucccaggcugcagugcaguggcaugaucauagcuuacuuuaaccuugaacuccugggcucaagagauuuuuccaccucagccuccuaaguaucuaggacuacaggugggugccaccacacacagcuaauuuuuuauuuuucuguagagauggggucuugcuauguugcaugagcuggucucaaacuucuggccucaagugauucuucugccucagucucccaaagugcagggauuauaggggugagccaacucaccuggccuauauuuugaauauauuaguaauaacaacacuuuaaagaaagacucucuaguagguucaauaauucauuuuaaauauauauauauacacacacauauauauacauauauauguguauauauauacacauauguauauauauacauauguguauauacauauauauacacauacguauauauacauauauacacauacguauauauacauauauacacauauguauauauacauauauauacacauauguauauauacauauauauacacauauguauauauacauauauauacacauauguauauauauacacauauguauauauacauauauauauacauauguauauauacauguauauauacauauguguauauauacauauauauauacauauguauauauacauguauauauacauauguguauauauauauauauauauuugagacagagucucugucgcccaggcuggagugcaguggcagcacgaacaaggcucacagcaagcuccgccucccggguugaugccauucuccugccucagucucccgaguagcugggacuacaggcgcccaccacacgcccggcuaauuuuuuguacuuuuaguacagacgggguuucaccauguucgcuaggauggucucgaucucccgaccuagugauccgccugccucggccucccaaagugcugggauuacaggugugagccaccgcgccuggcuuuaaauauauuuuuuaaaucacucuuuuauauaauuguacacuguauguaaagaucugaaauacauaaaacugaaguuaauuuucuuaauuucacaaugucuugcaguugaugcuggguaaaugugggucccaaaugcucccaucugaaauccuacaacagugcuauaaaaucugugccugaucuacuucuaaggaugcuuuugaguauucaugaaaauacauuggacuacaugcauaagagcacuacagaaaucaaaagaaugaaaaacacaacauucagaaugaugaggaaagaaggggauggagaugccugaaagauaauggugggaaacuuaagacacuuaaguuuguuguaguuuauucuuuaaacacacguuauauaaauauuccuuuguaaccuuuaaccuugcaguucaaccuuuaaccuuauauuacauuuguuaaaggcuuuaacaaagacaauaaaaaagaaaaccaguauauaaaucaagauauuauaugaaauaauugauuuaaaaugaacagggugucuagagaugguugggaccauuuggaccucagguuauuuggacaguucacaucuaucauagaucaugauuugccuucucagacuuugccccaucccugcguggcucugacuccagcauaguuggaguguggacacaugcuuuucuugacaguuuuuucuuuuacaggcagauucuggaccauauggagcuuuaaagagcauagccugaacuuagguaacacacacaggaagucaaugucuacagagagcaagagagagagucaaauagucauugauauguuuucaaauaaaggcaaagaccauugcaagaguagagagaugaucccugugauuuggaguuuaaugaguacaauggggaucauuuuguaaaacaaucucccauguaaaaauauauguugugaaaaaagcuuuugauugauuugagcuuuguuuuacaagccgaaaaaauuuuaaaugcuuuuuuuuucaaaauaaagaagacuacuauaaguagucuuuaugagaauauaauuauuuaagggaaaauucuccuaaggcuuugaccaauggauuaaaauuauguaguaucuaagauacuaaauauauuuucacuuuaaauuuaacauuaauuuuugaauagauaagacaaguaaacauuuaaagcauuuuuccuggcucauuguaauguaguuuuuauauaguuucuucaauaugugugauaugguuuggcucuguguccccacccaaaucucaucucaaauuauaaccccauguguggagagagggaggugauuggaucaugacggggguuccuccaugcuguucucaugauaguaagggaguucuuaugagaucugaugguuuuaaaaguagcaguuuucccuugugcccucaccccucucuccugccgccuugugaagaaggugccugcuuccccuccugccaugauuguaaguuuccugaggccuccccagccaugcuggacugugagucaauuaaaucucuuuccuuuauaaauuacccagucucggggaaguucuuuacagcagugugaaaauagaauaauacacugugcuaauaugucacaaggaaaacagaagccaaaaacacaaauauuaaaaaagaaacaggccaggcaugguggcucauaugaguaauuccagcauuggggaggcugaggugggaggaucacuugagucucggagguugaggcugcagugagccaugaccuugccacugcacuccagccuuggugacagagugagacaucaucucaaaauaaauaaauaaauaacaacuaccucuuuaaagaaagccgcaacacaaguaauaaaauauucaaaacagagcagcuuaccaugucuucuggcucagguauacugaugccauggaaaaacccguuacuuuuaaagauugauugaugucuugggauuaauuuuccuguaaaauacaaaccacauaauucaucauaaauuuggcaaagaauaaucaaguguuuaaaugguuaaugccugaaggccaggcaugguggcucacaccuguaauuccagcacuuugagaggcuacggcagguggaucacuugacgucaagaguucgagaccagccuggucaacauggcgaaaccccgucucuacuaaaaauacaaaaauuagccaagcguggugguccaugccuguaaucccagcuacucaggaggcugaggcaggagaaucgcuugaaccugggaggcagagcuugcagugagcugagaucaugccacugcacuccagccugggcgacagagcaagacuccaucucaaaaacaaaacaaaacaaacaaacaaacaaaaaacaaaaaacaggguuaacgccugaagugcaggugugaaagaaauauugugccugauuguucccuccagagaugagaggaaugggauucugcagacgcaugccuucucagguaaggccaguucucccaaaccagucucuuugucacauguggucaccauucagccuccaucaaaaggugaaggcugggugcgguggcucacgccuguaaucccagcacuuugggaggcagagggagguggaucacgaagucaagaaaucgagaccauccuggccaacauggugaaaccccgucucuacuaaaaauacaaaaaauuagcugagugugguggugcgcaccuauagucccagcuacuuaggaggcugaggcaggagaaucgcuugaauuugggaggcggagguugcagugagccaagaucacaccacugcacuccagccuggcaacagagugacaguccgucucaaaaaaaaaaaaaaaaaaaaaaaaaaaaaagacaaggugagagaaugguacuauggucuuuacacacauuaucucauuuaaucucauaaaugagauuuuaugagacuucaucucauaaucucacaacaauaguuguuauuauuuuuucagacagggucucucucuguugccaaaacuggagugcaguggcaugaucauggcucacuucagccucgaucucccagucucaagcaauccuuccaccuuagccucccgaguagcuggaacuacaagcaugcgccaucauguccagcuaauuuuuaaaaauuuuuugcagauauggggucugccuauguugcccagccuggaguaguugcuauuuuaaauccccauugugccaaugaggaaaaugaggcuuagagaaauuuaauaacuuguccaagaucacacaguaacuuaacagauccaggauuuaaacucagguauguaauguaaauuuccagaaucuuuuuagggaaugaaucagacaaacaaaguguggccugcagugguaaucuaccccacauuuuucaugcugcagaauuuuccauaauauguuggaacugaccagggaacuguccagcagccaugcugccaggagagccugugggaagaaauuaacaaauucucauuuuguguguagaggugucacuuucuuugcauccaugcuguuggcaugaagcuguggcucacuuuucggguuaugcugacacauaaugaaagcucacgaaagaaacccuugcagucucauuccuauucugcacuuaccuggcuauaugacuucaggccaaucauggaagcucccuaagccucuguuuccucguuuauaacauaggcacaauuaaaaacauuauaacuuccuuaacagguuuuucuuaagacugaaaaagaugaugcguaugaaaguaauuuguaaauucuuaaguacuauacaaagaagauguguuaacauuauucuaaacuucagcagccaccccuaaucaggaaguaaaaucagacucuuaggaucucgggcaggagugugggccaaaucuggccuacugccuguuucuguacagcuugugaccucagaauugguuuuacauuuuuaagcagauuuuuaaaagucaaaaaagauuuuuugauauuguugcacgugaaaacuacaauaaauuaaaauuucuguguccauaaauaaaguucuauuggaacacagcuaugcucauuuguugacaugcugcguauugcugcuuuugcacuacaauagcagaguuggggaacugcaacagaggcuguacagccugcauaaccuaaaauauuuaccauauagcuuuuuauagaaacaaauuugcugauuccugcucuagaguaaaggggggaaccucuuuuacaguggacagaaauugcauuugaucaaauaucuuagauuaagcucuaggcagcugacucauauccuuaucccuaucuuagucugauauggaaaguaaauguauaguuuauuccauggcuaauugacuuuuccugcaaagggaucugagagcucccugagaggaguuacgguucugcauguuuagaaaaggauugggcuuuggcuacaacccagaacugagaacaaccauccugagugacacuuugaagaagcaauaaaacucuuguuuuuuauuuuuauuuauuuauuuuuuauuauaguaacauaugaaugcuauaacaauucagcaacucuguugccauaaaaugcaauucauaccuaguguucugauuaucagauaaaguugguccacaucugauuuuccaggccacaguggcuggccugucaggagcucugcaaaaacacaaccaauagcccauauaucgacugaagaaccauacugaguaucucccacaagaaguucaggagcucgguaccaucucguagcuacauaaucgguguaggcaucuccuggaacugcaaaugcaucaaucagaucagguaagucaauucucccaacaugugaacugcucccaagaacacaucaggcauucaggcugcaauaaccaucagaggccaugauacucuuaaggguuaaugcauugaggcacuaauugaggaaacaguuacugugcauugagauaguaaauuugacauucaagagcacuuuagauaauuaacaucucuuacuacuccaaacugggguggcggguggugugauagggauggggggaaugagaauuucuggagugugacuuuaagucuaaaccgcauuguugguuuccacuuuaccaucagcauggugguuguugugcacugaauuguguccccuccaaagauagguugaaguccuaauucuugcuaccugugaaugugaucuuauuuggaaauaagguuuuugcagauguaauuaauuagucaagaugaggucauauuagauuaggguggacucuaaauccaaugacuugaauccuuacagggaugcagagacauggagaaugccaagcgauacuggaggcagagauuggagugaugcaguugcaagcacaggaaugccaacuuuucccacauccaucagaagcugggcuagaggccgggcaugguggcucaugccucucaucccagcacuuugggaagccaaggcaagcagaucauuagaggucaggaguuugagaccagccugggcaacauggcaaaacccugucucuacuaaaaauacgaaaauuagccaggcaugguggcacaugcuugucguccuagcuacuugagaagcugaggcaggagaaucacuugaaccuguggaggcugcagugagccgugaucaugccacugcacuccagccugggcgacagaguaagacucuaacucacacauauacaaaaaaagaagcuaggauagagacauggaaggggccucuccuagagccuuuagagggaauguggcccugcugaaaccuugauggcagaugucuggccuccagaauugugagaaaauagauuucuguuguuuucagccacucagauugugguaauguaucauggcagccccaggaaacuaaugcagcacuagacaauugcauaaauuaauuuuucuauccaaaugugacccacugugacaaagaccucaauuugacuccuuguacuauguaugagucaugugugauaugugauagacagaugacagagagcuaggugcacccucacugcccagcccugcccuaugccacagguguggacugccuggacccaaggcaccugccuccaaguggguggaagccaaucccagaaucaucacaggacccugaacgaucaggagcuguacaaaugcauuacagaggaggaacaauuggaaagcagcccgacuugcagagaugagguaaugggcaauucuccuuaguaaagucgucagguagccccaaagacacugccacaaaaggcagcucagaaaguagcggcuacagcucuggucagagaacaguccucauaggagugggaaaaggaaauaaucuuuacuugcucauugcucuuuuauaaaguuauauaaacuuuugaaggauaaaaauuaauaaaugccauaauggaaauuuggaaauuggagaaugagaaggaaaauaacaaccacuaacaauuuucacuauucacaggauaagucagcuguuuuauuuguuuggaacauuuuucgacuuaaaagucauauaugcucacugcagagaacaugaaaaaauacauaaggaaacagaaagaagguaaauauacccaaguuuuaccacccaaagguacuuuguguuaaucuuuugguguauuuuguuggagucuuuuucuuauuuacagcauaguucugaguaccacuuuuuuggaggcagggucaugcugucccccaggcuaaaaugcaguggcacaaucauagcucacugcagcuuugaacuccugggcucacacaauccuccugccucagccuccugaguagcugggacuauaggggcuugaaaccaugccugguuaauuuaaaaaaaaauuuuuuuuuuuuuguauagauagaggucucacuauguugcucaggccuguacaaguacuuuugaucauacuacauacacaauucuguguccugauuuuuuucauugaauucuaugcauuuaucauguuauuauaaacucuuccuaaacuugaguuuaauggcugcauaacagcuuaccaagugcauaugacaggauuuacuuuaccuuccccaaauuuuccaauauuuugucacuauaaauaacaccacauuauuuuucaauaaucccugcacaaagcuuuuucuguauuuagaauuauuucaaggcccggcacaguagcucacaccuauaaccccagcacuuugggaggcaaaggcaggcggaucgugugagcccaggaguuugaggccagccugggcaacauggugaaaucuugucccuacaaaaaaaauaaaaaaaucagccaggcaugguagcaugugccuguggucccagcuacaugggagggugaggcaggaggauagcuugagccuaggagguugaggcugcagugagcuaagaucauaucacugcccuccagccuaggcuacagagcgagacuccaucucuaaaaaaaaaaaaaaaaaaaaaggagccagguuugguggcucacgccuguaaucccagcacuuugggaggcugaacgggguggaucacuugagccuagauauucgagaccagccugggcagaauggcgaaaucucucucuguuaaaaaaaaaaaaaaagaauuauuccuuuaggaugauuuucuaugaguggaauuauuagacugagagguguaaacaucauuuauaaaauuauuauuauuauuauuauuauuauuauuguuuuugagauggaguuucgcucuuauuguccaggcuggaguucaauggcacaaucucggcucaccgcaaccuccaccucccggguacaugcgauucuccugccucagccucccaaguagcugggauuacagacaugcgccaacaugcccggcuaauuuuguauuuuuaguagagacgggguuucuccaugugggucaggcuggucucgaacuccugaccucaggugaucugccugccuuggccucccaaagugcugggauuauaggcaugagccacugugccuggcccguuuauaaaauuguuaaagaaauuuauguucuuuguagaaaacuuggaaaauacaaaaaagcauaaagaagaaaauaaaacaucacccaucacccagagagaaaccaagugaaccuuuuggaauagaauugggaccagucugugugugcagcuauguguucuuuuucacuuagccccauguugugagcuguagcguuucucaugucauuaaaauccuuuaaaaauauauuuuuacaguauuaagucagauaaauucuuuagccauuuccuuauuucugaaugacuggguuccucuuaauuuuuuucucaguaauaaaugguucuacaaugaacauuauguuguauuauuuuggaggguaguaucuuggauuaugggagauuccuaaaagugaaauuaaagauacaaagggcacuuacugcguucucaagaauuuguucgaaauuguguucccacuaaaaacaaucuugugagcucucaguaguuauuguuugaaaaaucuggcugggcacgguggcucacacuuguaauccagcacuuugggaggccgagguggaaggaucacuugaggccagaaguucgagaugagccugggccccauggugaaacacugugucuaccaaaaauacaaaaauuagcccuaucaaaaauacaaaaauacaaaaauuaguauaucuguugucccaacuacuugggaggcugaggugggaggauugcuugagcccuggaaguggagguugcaaugggcugagauaaugccacugcacuccagccugggugacagagugagacucugucucaaaacaaacacacacacaaacaaacagaaaauacucugccagcuucauuggugaagaguaguauuuuaaugugcauuuauuugauaucagugaagaggaagauuauuucauguuuuuagccuuuucuuucaucugugaacugucaauaucuugcuaauuuuucuauucagagcuuuugugguucucuuuuaaaccaauuuauauaagcucuuaucuaucaaccuauuaccaauuuugaaauauucucuccuuugguuauugacuuuaaaauuuuuaucucucuguguauaucuauauaucuauauauaggaggagcuuaaauuuauuuugugguaaaauacacauaauauaaaauuuaccauuuaaccauuuaagagugugcaauucaguggcaugaaguacauucgguguugcacaaucaucaccacuaugcaccuccaaaguuuuuuccaucaucccagccugaaacucuguauccuuuaaacaacaacuccccauucucccuucccccagcccugauaaccacuauucuuuuuugucuccaugaauuugacuauucuagguagagcacguaaauagaaucauacgauauuuguccuuuucugucugucuuauuucacucagcuuagugucuucaaggugcauccaugucauagcauauaucagaauuucauuucuuuuugaguaagauuucauuauauguauauaccacauuuuguuuauccacucauccuugauggacauuuggguuguuuccaccuuuugucauugugaauaauccuacuauaagcauuggcauacaaauaucuucaagucccugcugccaauuuuuuuggguauguaccuagaaguggaauugcugcaucauacagugauucuauguuuaauuuuuugaagagcugccauacugcuuuccacagcaguugcaccauuguacuuucccacuagcaaugaaugagggcucuaauuucuucauaucuuuaccaacacuuguuauuuuguucuguguguuuuuuaaaaauaauagucauccuaaugggugcaaagugguaucuaacugugguuuugauuugcauaucccuaaugauuaccauaagcaucuuucaugugcuuauuggccauucguauagcuucuuuuuuacuuuuuauuuuuuacauuuuuaauuaauuuuuuuuuuuuuuuuuuugagacagggucucacuuugucgccugggcuggaguguaguggugcagucuuggcucacugcaaccucugucuccuggguucaacugacucucaugccucagacuccugaguuagcugggauuacugguuugagccacugcgcccugccuuauauaucuucuuuaaagaaaugucuauucugauggcuucugaggaaaaugguugauaggaggcaggacuaacuugcagcuaugacucagacggacagagcagcguguggagacuuacaucaugaacuuuugcuccaagaacuaccacaggaacauaccagguaagccaagagaauccacagacccuuugaagaagguggauuaccacugcaggcucugugggacagccaaggagcucugaagacaaaagccauauucuccugggagcucuauggccccacccacugccugauccacccuaugcuaccgcagcugaugugcucuugagagcaccagcuccuggcuggaggucaaccaacauaaaacuagugcgcauaacaaaaauacaaccaagucaaccaacauaaaaccagugugcuuaacaaaaauacaaccaaggacccucauagaguccacuucacuccccugcuaccucuaccagagcaggugcugguauccauagcugaaagaucugacaauggaucacaucacgggacucuuugcagacacuuccuaguaccagcccagagccugguagcuucucuggguggcuagauccagaagagaaauaacaaucaaugcaguuuggcucugaggaagccccaucccuaggggaaaggggagagcaccacaucaaggaagcaccccaugggacaaaagaaucugaacagcagcccucaagucccagaucuucccucugacauagucuacccaaaugagaaggaaccagaaaaacaauccaguaacaugaugacaaaauaagguucuuuuuuuuuugagacggagucuugcucugucaccuaggcuggagugcaguggugugaucuuggcucacugcaaccucugcuuccuggguacaagugauucuccugccucagccucccaaguagcugggacuacacguacgugcugccacgcccggcuaauuuuugaauuuuuaguacagacaagguuuagccauguuggccaggcuggucucgaacuccugaccucagguaucugcccaccuuggccucccaaaguguugggauuacaggcguaagccacugugccuggcccaaaacaagguucuuuaacacuuccaaaagaucacacuaacucaccagcaauggauccaagccaggagaaaaaucucugaauuggcagaaaaagaauucagaaggucaacuauuaagccaaucaaggaggcaccagagaaagaugaaguccaaccuaaagaaauaaaaaaaugauacaggauaugaauggaaaaaucuccagugaaacagagagcauaaauaaaaaaacagucacaacuucuggaaaucaaggacacacuuagagaaaugcaaaaugcacuagaaagucucagcaacagaacugcacaaguucaagaaagaacuucagcgcuugaagaccagacuuucaaauuaacccaaucugucaaagacaaagaaaaaaagaauuaaaaaaaugaacaaagccuccaagaaguuugguauuauguuuaacgaugaaaccuaagaauaauugguguucccaaggaaaaagagaaaucuaaaaguuuggaaaacauauuugagggaauaauugaggaaaacuuccccggccuugcuagagaucuagacauccaaauacaagaagccauccaaaucccaagaacaucagggaaauucauugcaaaaagaucaucgccuaggcacauaggcaucagguuaucuaaaaucaagacaaaggaaagaauauuaaggacucugaggcaaaagcaucagguacuauaaaggaaaaccuaucagauuaacagcagauuucucaguagaaacccuacaagcuagaggggauugagguccuaucuuuagccuccuuaaacaaaacaauuaucagccaagaauuuuguaucuagugaaacuaagcuucauaaauuaaggaaagauacagucuuuuucagacaaacaaaugcugagagaauuugccaaugccaagccagcacuauaggaacuguuaaaaggagcucuaaaucuugaaacaaauauuugaaauacaccaaaauagaaucuccuuaaagcauaaaucucacaggaccuauaaaacagcaacacaaugaaaaaaacccaggguauucagguaacaaguagcaugaugaauaguaccucacaucucaauacugauguuggauguaaauggcuuaaaugguccacuuaaaagauacagaauggcagaguagauaaaaauucaccaaccaaguaucugcugucuuuaugagacccaccugacacauaaggacucacauaagcuuaaaguaaaguggggggaaaggguauuccaugccaguggacaccaaaagugagcaggaauagcuauucucauaucagacaaaacagacuuuaaagcaacagcaguuaaaaaagacaaagagggacauuauauaaugauaaaaaaaaaaaaacuaguccaacagguaaauaucacaauccuaaauauauacgcaccuaacauuggagcuuccauauuuauaaaacaauuacuauuagaccuaagaaaugagauaguaacacaauaauaguggaggacuucaacacuccacugacaacacuagacaggucaucaagacagaaagucaacaaagaaacaauggacuuaaacuauauccuacaacaaauggacuuaacagauauuuacagaacuuucuacaccauaaaugcagaauauacauucuguucaucaacacauggaacaucugccaagauagaccauauaauaggccacaaaauaaaaaaauuuaagaaaauugaaauuauagcaagaacucucacagaucacaguggaauagaauuggaaaucaacuccaaaaggaauucucaaaaccaugcaaauacauggaaauuaaaugaccugcuccugaaugauuguucagucaacaaugaaaccaagauggaaacuuaaaaauucuuugaacugaacaauaauagugacacaaccuaucaaaaccucugggauacagcaaaggcaaugccaagaggaaaguuuauagcauuaaaugccuacaucaaaaagucugaaagagcacaaauagacaaucuaaggucacauuucaaggagcuagagaaagaggaaaaaaacaaacguaaacccagcagaagaaaagaaauaaccaagaucagagcagaaguaaaugauauugaaacaacaaaaaaaacccacaaaagauaaaugaaacacaaaucugguucuuugaaaagauaaauaaaauugauaggccauuagcaagauuaaccaauaaaagaagagagaagaucaaacuaagcucaauuagaaaugaaacaggagauauuauaacugauaccacagaaauacaaaagaucacucaaggcuccuaugaauaccuuuacgugcauaaacuagaaaaccuagaggaggauggauaaauuccuggaaauaugcaacucuccuagauuaaaccaggaagaaauagaaccucugaacagaccaauaagaagcagcgagauugaaaugauaauuaaaaaguuaccaaugaaaaaaaguccaagaccagagagauucacagcuaaauucuaucagacauucaaagaaaaauugguacuaauccuauugacacuauuccaaaagacagagaaagggaauccucucuaaaucacucuaugaagacaguaucacccuaauaacaaaaccagaaaaggacauaacaaaaaaagaaaacuacagaccaauguccuugaugaacauagaugcaaaaauccucaacaaaauacuagcuaaccaaauccaacagcaugucaaaaagauaauccaccaugaucaaguggauuucauaccagggaugcagggaugguuuaacaucugcaaucaauaaaugcgauacaccacauaaacauaauuaaaaacaaaaaucacaaggucaucucaauagaugcagaaaaagcacuugacaaaauucagcauugcuuuaugaugaaaacccucagaaaaaucagcacagaagggacauaucuuaagguaauaaaaaccauugaugacaaacccacagucaacauuauacugaauagggaaaaguugaaagcauuuccccugagaacuggaacaagacaaggaugcccacuuucaccacuucuauucaacauaguacuggaaguccuagcuagagcaaucagacaagagaaaaaaauaaagggcaucuaaauugguaaagaggaagucaaacuuuugcuguuggcugaugacaugaucauauaucuagaaaacccuaaagacuccuucaaaaagcuccuagaacugguaaaugaauucagcaaaauuuuaggauaacaaaauuaauguacauaaaucaguagccccgcuauauaccaacaacaaccaagcugagaaucaaaccaagaacucaaccccuuuuacaauagcugcaaaaaaauaaaauacuuaggaauauacuuaaccaaggaggugaaagaccucuacaaggaaaacuacaaaacauugcugaaagaaaucauagaugacacaaacaaauggaaacacauccuaugcucauggauggguagaaucaauauugugaagacgaccauacugccaaaagcaaccuacaaauccaaugcaauucccaucaaaauacccccaucauucuucacagaacuugaaaaaacaauccuaaaauucauauagaaccaaaaaaagagcccacuagccagagcaagacuaagcaaaaagaacaaaucuggagggauuauccuaccugacuucaaacuauacuauaaggccauagucaucaaagcaguaugguauugguauaaaaacaggcauauagaccaauggaacagaauagagaaaccagaaauaaagccaaauacuuauagucaaaugaucuuugacaaagcaaacaaaaacauaaagugaugaauggacaccuuauuaaacaaauggugcugguauaauuggcaagccacauguagaagaaugaaacuggauccucaccucucaccuuauacaaaaaucaucucaagauggaucaaagacuucaaucuaagaccugaaaccauaaaaauucuagaagauaacacuggcuuaggcaaagacuucucaugaccaagaacccaaaagcaaaugcaacaaaaacaaagauaaauagauggaacuuaaacuaaaaaagcuucugcacagcaaaagaaauaaucagcagaguaaacagacaacccacagugugggagaaaaucuucacaaucuauacauccaacagaggacuaauauccagaaucuacaagcaacucaaaucagcaagaaaaaacaaacaaucccaucaaaaagugggcuaaggacaugaauagacauucucaaaagaagauauacaaauggcuaacaaaaacaugaaaaaaaugcucaacaucacuaauuaucagggaaacgcaaaucaaaaccauaaugugauaccacuuuacuccugcaagaauggcuauaaccaaaaaaauaaaaaaaaaaaaacuacagauguuggcauggauguggugaaaagggaacacuuuuacacucuggagggaaucuaaauuaauacaaccacuaugaaaaacaguguggagauuccuuaaagaacuaaaaguagaucuaccauuugauccagcagccccacuccuggguaucuaccgagaggaaaagaagucauuauauaaaaaauauauuugcacacgcauguuuacagcagcacauuugcaauugaaaaaauauggaaccagcccaaauguccaucaaucaacaaguagauaaagaaaaugugguauauauauaccgcagaauacuacuuagucauacaaaggaacaaaauaauggcauuugcagcaaccuggauggaacuggagaccauuauucuaaccauuauucuaaccauuauuccugaaauaacucaggaauagaaaaccaaacaucuauguuccaauaagugggagcuaagcuaugaggacacaaaggcauaagaauaauacaauggacuuuggggacucagccgaaagggucgggcggcgggugagggauaaaagacuacacauugggcacaguguacacugcucagguggugggggaaccaaaauuccagaaaucaccaccaaagaacuuauucacauagccaggugugguggcuaacacauguaaucccagcacuuugggaggccgaggcaggcagaugacuugagcucaggaguucaagacaagccuggccaacauugcaaaaacucaucucuacuaaaaauuuaaaaauuagcugggugugguggcggguuccugaagucacagcuacuugggaggcugaggcaggagaauugcuugaacccaggaaguggaguuugcggugagccgagaucacaccgcugcacuccagccugggcaacagagcaagacucuggacacugucucaaacaaaacaaaacaaaacaaaacaaaacaaaacaaaacaaaacaaugaacuuuuucaaguaaccaaacaccaccuguuccccaaaaaccuauugaaauaaaacaacaaaaaagaaaugucuauucaaguccuuugcccacuuucaaauuaguuuuuguuauugagucauaguucugaacauucuggcuauuaauucuuuauuagguauaaauuuacuaauauuuucucccuuuccauggguugcuuuucauucuguuuauaguguccuuugaugcacagaaguuuuuaauuuuaaugaaguccaauuuaucuauuuuuccuuuuguugcuugugcuuuuggugucacauccaagaaaucacuguuaaauccaaugucaugaggcuuuuugucuauguuuucuuuuaagaguuuuguaagcuuuauuucuuauguuuaaguuggugauucauuuugagugaauauaauguaagguaaagguccaacuuccuucuuuugcauguggauauccaguaggagcuuacauuuuuauguggaugucuauugagccaguguuagcauuuuaucacauaaugggacccccuccuuugccuuucucauuauaaauggccaacaaugaccccagcaaugacucauaccaguacuuagaagacuugagcuguaaccagugccugagcucaugucuuguggagguuucagccagcacuaacaaguuggcagugucuuguaguaccacuuuguuuauaauaauauggcaaaagguaucauuauuggaauugccacaguggguucaccauucagacuucuggauguguucaugcagucaaaauuucugagacagaugacccuaacauugaacucaguucuaagguucuucauucagacaagaaugacuauguuugcuacaggaaaacucaguaggaaagcugacuugcauauucagcucagaaaugcaaaggaaaaugaaaaaggaaaggaaaaaaagaaugcauauucaugaaaaauuaaaaauauuuauacguuuggaaguauugccaguuuaagaagcuuugccagcccauggagaaaaauccccaaaaggaacaauuaugaaguaacuuuuauaugaaaugcugcucuuauguucuuaaugcuuguaauggcguaucuguguagguuuuuucacuuauuuuugugacaauuggguauuuuggugguauauaauggauuuccaggaaaaaaaccccaaaucuaugacaccgcaucuauaccaugcauuggaugacuaucauucacuuaauuuccuaaauugagggucauauauauuucaguaauuuuuuucuauguauuuccuguauaguugagaucauacugaauacauauguuuucacuuuccuuuuucucuuaccaugucuuaaacauuuuccgaugccacugaaacucugcaaacaucccuacuaauggcagcccagcauuucaugauacugaugcaccaugguacuaugugccgcguuuguaacucgauaguuuuccaguguuugucuauuucucuuuucagccgcauggcacagggaccaauuaucauuaggauccuauuaucuuuaccacaaagcacagcaaccucagaaagccuugaucggguuuuguuuuugcccaacccuuccaaaugcauugccaaaucacucguguuugggucccaucaggauaccgauuauguccacacccagacugcgagguguauguugcuaauacauauauuugucugcuguaaaguucuagauugagggagaaacaauuauuugucccccuuucccuucaguuccuccuugccuggaaugauuuccguuuucuuagcacucucucugaauccucucucuuuaauuuucaguuuacucuucuagucucaccagcucugugaaguuuuuuucaaccacucucgcccacauuaauaucucccuccagggaaccgucugcaccuucacuuuaguacuuuauugccaaucaucuuguauuauucuuuguuucuuuuacuguagauuauaagugcaugaagaacagaaaugcuuuuagaaaucuuuuccuuuccuauggggcaaagcacagaaaggugacaucugauaaauucuagcugaauggagcagaguugaagugcaaacgaauguacugacuaaaaggcuaaagugagauuuuccuuuuugaauaacaacaauacaauauuuggcauauguccaauauccaauguaagaauuuaaacuaugucauuuuaucaucaucugaacuggguauuaguaaaaaaaauugcuacuuacucagaauuugugcaaacccgaagucacaaaucuugauuauuccuugcuuaguuauuagaauauuuucagguuuuauaucucugugaauacacuguaagaucauuauuugauuauuuuucugaaccaucaaaaugacaaagaauaaacauuaacuacuaguuuaaauaacagauacacagccuaugagauaaaaacaaaugugggcuuccuucacuuuucuaaaagaacuuaaauuggcaauuuuucacuuguaacucuugucauaccaaaauuaaaacuuuuauuaaaauauuguuuuauuauugaaaaaauugaaauuauaauuguauauaaaaacugucuuuuuuuuuuuuuaaagaagggauuuucagacugggugugguggcucauguccauaaucccagcacuuugugaggccgaggcgggaggauaacuugaagccaggaauuugagaccacccugggcaaugcaaugagacccugucucuacaaaaaaguuaaaaaauuagccaggcaaaguggcaugcacuuaugguccuagcuacugaggaggcugaggccgaaggaucauuugagccucgaagguugaggcugcagugagcuaugaucacacugcacagagccugagcaacugagcuaaacccugucucgaaaacaaaaaauaaaaauaaaaaauuaaauucaagaagagaguaacauacaauuauuucuuucacuuuuugcuggguccuauuuaaaccguaagagguaaaacucuaaaugagauuagacuuaagaguaccucuaauaacugcugccacccaagagucacaauucagguugaaaaacuugcagauuugagaaauuacaaaaacauuuaaaugauaacaaaaagcaaaauucacuuauaauuagaaugaccauauuauuuaucauccaaaucaggagacuuccaagugugaaagaggggccuauagccgggcucgguggcucgcgccuguaauccagcacuuugggaggccgaggcgggcagaucacgcggucaggagauagagaccauccuggccaacacggugaaaccccgucucuacuaaaaauagaaaaaauuaaccaggcgugguggcaggcgccuguagucccagcuacucaggaggcugaggcaggagaauggcgggaacccgggaggcagagcuugcggugagccaagauggugccacugcacuccagccuggacgacggagcgagacuccgucucaaaaaaaaaaaaaaaaaaaaagaaagaaagaaagaaagaggggccuauuaauaaucaugccccgacaaaaggcacaaaccaggacugcccugggcgagcuggggcgcacaguccccugcuuagcagagauuccgaagcauuccgcgccaggggauggggaucacuuccaccuccucaccggagcuaaccuggaacgaucagcaacacuccugagacggcccacgaugcugucagaauccauacugggaaagugggacccgaggcacgcugaccucaaagcagcuguuuuuuuuuguuuuuuguuuuuuuuuugagacagagucucacugugucgcccaggcuggagcucaguggcgcgaucucggcucacugcaaccuccgccccccggguucaagcgauucuccugccucagccucccgaguggcugggacuacggaugugucccgaguagcuaggauuacaggcgcucaccaccaugcccggcuaauuuuguauuuuuaguagaggcugguuucaccauguuguuguccaggcuggucuugaauuacugagcucaagugauccgcccaccucggucucccaaagugcugggauuacaggcgugagccaccgcgccuggacccagcuguucuuucauaugcagcggccuuacaacuugcugcgucaucauaaugacccugaaugaaacagaugcuccucgcuggacaggagcggcccggcuaggggccugggugagggcaggcugaguaagcccgcgcgcacaugggcauuccagaaauggguuuccauguugcggaggugcugugagaaaacagcucagaccguacccuucaggacuuuacaguuuauccacgcucccaaaaaagaaaauggaugaaaauaauaucgaucuccacaacugggcccucacagggaacucuguacuuuucaaagcacuuucaauucaaagcauaaauuauuucauccuugcaacaauccugugauugcaaguggccacugacagaauuaacugucaugaauuaaguguccauuaagugucacaauaaucaacuccuucugccuccuuuucuacuaugcugucaggcccuuuaagcauuuuugucaaacugacaauucugaaaugauugucuuugguucuuuaauagcuaucuaggaagagaaaaagagcugagcccuaaaaucauuuuagguugcagaaaugacacugguaacaggagcuuguuccuauuuagucucaauuacugucaauugcuucauaauuuguaugaagagcaguuagaagaaacuuuuuuaggucucuuaaaaguacuaaggccuuagacacuaauuaaaaaaaauacacaggcugggcauggucgcugaugccuguaauacuugcgcuuugggaggccaaggugggcggaucgcuugugcccaggaguuugauaccagccugggcccaauggugaaacucagucucuacaaaaaauacaaaaauuagcuagguguguggcgugugccuuuagucccagcuacacaagacgcugagaugggaggauggcuugugcccaggagguggagguugcagugagccaagauggcaccaccgcacucuagccuaugugacagagugagacccugucucaaaaaaaaaaauuuuuuuuuggaauauaaaugaacauaguuuugauauccuaccuuuuaagcaacacacuuaagaaacuuagacuaacacucugagucaguaacacucauacuuggugauugcauuagaacagguuauauccuuuaaaugaguuugcaucaaguucuagaauuucuagacuauauguguagcauuaccaaguaaauggauuuacaucaauaucuguccauuggccuauacauauguuuucugcaucuaauccaugugaaauuuauagcacuuauuuuucaaccaaauauacaaaaggaaaugaaguauugacauauuccaaagaaacaggaaaauuuauuuuauaggagcagguaacagaaguuauugauaaagagugagaggauacugaagaaauuuaaaagggaguaaaaacaauuggaaccuggcugggcgugguggcucaugccuguaaccccagcacuuugggaggcuuaggcaggcagaucaccugaggucaggaguucgagaccagccuggccaacauggugaaacccugucucuacuaaacauagaaaaauuagccaggcgugguuguggguaccuguaaucccagcuacucgggaggcugaugcaggagaaucacuugaaccugggaggcagagguugcagugagcuguaguugcgccacuggaccccagccugggcgacagaggaagacucugucucaaaauaaauaaauaaauaaaaauuuuuaaaaaauuaaaaaauaaauaauuggaaccauaagaaacagggcauggggggaagaagaugcuuagacauacagcauucaccuacuccacugcaaagccacacucaaugcaaacucucugcaaugccucuugcaaucagcuuauuuucccucgaagaacaagaaacaugcaagucucucuuaauaaaauaauuuuaauaaguugaguuuuauacacagcuuuuuuuuuuuugagacagagucgcucuuuguugcucaggcuggagugcaguggcgugaucucggcucacugcaaccucugccuccuggguucaagugacucuccugccucagccuccugaguugcugggauuacaggugcucaccaccacgccuggcuaauuuuuuguauuuuuuaguagacaugggguuucgccauguuggccaggcuggucuugaacuccugaccucaggugauccaccagccucggccucccaaagugcugggauuacaggcaugagacaccaugcuuggccuuguacacaguuuuuagcaaacaaugcucagguucaguuguuguggcugacgggcaaucuuuuuuuuuuuuuuuuuuuuuggcucacaggccagccuaaagagauauccaugguauuuuaaaacugacuuuuaacuuuaaaaucaucucugcaaacuugcacaccagaaauugcuucuuaaauagccugauaaaaacaauaaaucauuuuuuuuauuaucugagaaauuuauucucuuugagccuuaggcauggaugcucacacaucgaggagagagaaaagcaacccucuccucaacaaccaaaacaugaguaucaacaagaugcugacggagguugcagccugacccacuccuaucucagaagucauuuuugccagcugggcaugguggcucaugcuuguaauccuagcucuuugggaggccaaggugggagaaucgcuugaggucagggguuugagaccacccugggcaacacaaugagacuaucucuacaaaaaaaaaaaaaaauuuuuuuuuuaaauuagccaugcaugauagcaugugccauagucccaguuccuugggaggcuaagguggaaggauuguuugagcaugggaggcugagguugcagugagccgugaaggcgccacugcauucuagccugggaaacagagcaagauccugucucaggaagaaaaaaaaaaaaaaagucauuuuugccauuuugagaugaagccccuguucucuaaucaauacagcaaauauauaaaaaucccuggguucauuauggcguuaaauggaccacuuugguuaccucacucuagugauauuauaggguaaaagagaaccaaaugaauacguauuuucuuaaguccugcgcuucuccaaauuuaaugugcacaugaaucaccuggagcucugguuaaaaugcagacucugauucagcaggucuguaguggaccucagauucaacauuucuaaaagcucccaggugaucucuaugaaccauaguuggaguagcaaggccugaaucccuugguacuuuaaccugcaguguccuguuuaggaucucgacucuggagaugauaaggugcacauggucucuacagguuuaaagcugugagucgucagcaacaccacuaggucagauugccuuuucuacucuuugagacuaucaugggaguuccuuuaaaaauaaggagaguauaaagguuuuaguuguauuauugugacagcuuuauauauggcuuagauuuuuuucuuugcaagcauuuuaauuauagauaaauaaaaaggcagauacacaaaggcuuaccauaagaaaaugagaaguaauuuccaucuuggaggagggaaguuagucugaaaaauuaucuuuuuuugagacagacucuugcucugucgcccaggcuggaguacaguggcccgaucuuagcucauuguaaccucugccucucgaguucaagugauucucccaccucagccugcugaguaguagcugggauuacaggcaugcauugccaugcccggcuaauuuuuguauuuuuaguagagacaggguuucaccauguuggccaggcuggucuugaacuccucaccucaggcaaucugcccaccucaaccucccaaaguccugggauuacaggcuugagccaccacaccuagccugaaaaauuaccuauuuuuaauagaggccacauauuaucagucagaaguuuucaguguuuuaaagcuuaggguauagaacguguuguuccaagcacagaaaugauggcaguugcguuggucuacaauaauguuuggcuccacuggaaauagucacaaucaguuaggcaguuuggguugacugacugauugacucauccaaccauccacccaucccuccauccaguuauucaauaaauauuuauugaucacccuguauauaaaaauauccaauuuagguauuaaagagauacaaagauaaagcagccacagacauugcauucaagcuuauaaccaaguacccaggaaagugucugguuauauagggauaaaguauaaacacuugugguaagugguauuuuuagaaaucauuuuaacuacccauaaaacuccugcagcaacuuugauaucuccuauagcaugguggaaagcaacagagauaaggauuccauuuggcaucaucuuuauuaagcaucagaaagcacaauuugcaucaugaaaaauagguuuauguauuuugugaaaaauaucccucuacauuaauagaaaauaaaagcuuuugauuuaaccuaauaaaaacuucacugacuuuccuaaaacuaaagaaagcuuccccuccguauugaaauguauucucaugaucuuguacuuucuuuuucagcaauccuagacugcuaugauagacauucugcuggcaucaaaacugaccauaugguacucuguaucauugccucagcacugucucugucuaggcaccaacucaaaagggcuagauauauuuuuuuaaaagcuaucauuggcugagugcagugguucacaccuguaauccuggcacuuugggcagccaaggcaggaguuugaggccagccugggcaagauagugagacccccaucucuacaaaaacaaaaauuggcugaguguaguggcaugugccuguagucccagcuacucagggaggcugaagugggagaaucacuugagcccaggaguuugaggcucaagggugcuaugauaacaccacugcacuccagccugggcaguagagcgagacugucccaaaaauauaaugauauauagcaaagguaccaggagccaacuugaagaagcucauguuggccuaagaugggaaaaucugagcaugggagagaccaaugacagcaaagaauugaaaacaccacaauacaaaauuuguguuuauaauggugcuccagccaccucuccccaaaacuugucauuguugcuaagauaucaucucaucacccugaguguugauaaauaaaaguaaccagaguccaugaggaugaguucuuuuccauacaauuccaauuauuaaaugcagaaggaauaacagaauuagaaaauuacugucacgaaauacuagauacaggcaauaaucaucacuggaugcuaaaaccaucagggaaacaacguugacagggaaaaugauaauggaggggaccaaacgaauaccuccugagcccacucaucaauuuuaacauuaucgaaagugggacaaguggaugcuauacaccucauaauggggaugcgauaugaaguguacagcaccacauagcaggcauuguuaacuaaaaaaagcugaaccugaauaugaucaagccucuagauauaaacuccaauuuacaggaaauacaagugaaagaacacguuaaauuacauacaagaaaaagucagccaaaauuauuucucuaacauagugguucuugaaccaacagcuucaguagcaucugggaaaauaugagaaaugcacauucuuggggcccuacccaagacugacugaaucagaaacucuggggguggggcccaggaagcuguguuuuaacaagcccuccuugugauuuugaugcaugcucaagcuugagaacuacggcuauaaaaaauuaaugaauuuuuuuuuuuuuuuuugagacagagucucacacugucgcccaggcuggagugcaguggcacgaucucggcucacugcaagcuccgccuccuggguucacaccauucuccugccucagccucccgaguagcugggacuacaagcacccgccaccaugcccggccaauuuuuuguauuuuuaguagagacaggguuucaccguguuggccaggauggucucgaucuccugacuucgugauccgccugccucggccucccaaagugcugggauuacaggcgugagccaccaugcccggccggaaacgguuuuuaaaaaggaaaggaaaggggcacuuagauugcuaucgaguaaaggacuuaagagacuuaaaaauaauaguuaaaaaaaaaaguaccaugggggauuacaucagcaauauccugaaaacuuacuauuauuuuuggagacagggucucacucuguuguccaggcuggagagcaguggugugaucucagcucacugcaaccucugccuccuggguucaagugauucuccagcuccagccucccagguagcuaggauuacaggugcgcaccaccauggcuggcuaauuuuuauauuuuuucauagagauagaguuucuccauguugcccaggcuggucuugaacuccugagcucaaagccaucugcccgcauuggcuucccaaagugcugggauuacaggcaugagccaccauaccggcccugaaaaauuauucucgcccaauuuaaaaauaguuucaggggucacuggcacuauggcaaaaggaaucauuauauuuauucaaauuuuuaauucauaaggaauuagcaauuugauucuuacagaaauuggaaagagccaugaauaaugcaucacuuuuuucucauauuuugaacuuucuuuuguuauucccuuuucuucuuuuuugcagagacagggucuugcuauguugcccaggccugucucaaacucuggggcucaugugauccucccacuucagccucccaaggugcugggauuacuggcugaacuuccuuuuguuuugcuucuuuggcucuuacuuucccuuugucuucagcucuccaaacaaaacccugagcuauuuagaagaaaagagucaucaugaagaaaugaauaaauacauuagaaaauguuacuuacguuauguauaugacagaaauuaagagcuugaaguguuugccauaauacgcuuuugaucacuccaucagcaacucugagggaaaaaauaaaaaaggaaaugaaaacucauaggauagaguuccagaagcaagggcugggaauagaaguggaguggugagggacuguccucuucaaggaacaccaugcggaaggguccuaaaaauauauuuuagugaaaauugggcuuuacuaucuuuuuauuaugguuauguaauuuccuuuuguaauuugaauuuuuuacauccauaaaaugaugcaugcuuaugaagauucaaaaaauauagaaaaguaaaggaauaaaaaaaagaaaaggaaaggaauaaaaaaaagaaaaguaaaggaauaaaauguguugggucaaaucuugcuaccccaaaauaacugcuauaacuucugguggcucucuucaggcaucucugcuccucucucucccugucucucucuguacuuuuuuuguuuuguuuuguuuuguuuuguuuuguuuuguuuuguuuuuugagacagggucuggcucugucacccaggcuggagugcaguggcaugaucucagcucacuguaacuuccuccucccagguucaagaaauuugauucuccugccucagcuucccaaguagcuaggauuacaggcacgugccacgauacccggcuaauuuuuguauuuuuaguagagacgggguuuugucauguuggccaggcuggucuugaacucucgaccucagaugauccaccugccucgcccuccuaaagugcuuggauuacaggugugagacacuaugcccggccaguauuuacuuuuuaacuuuaauuuuaaaauaaaaacauucguaugguucaaauuuuaaacauauaaaaguauauacaugaagucucucugacaccugccuagccacccauuuauuuucuucaauuucaccccugaccacuuugagaauuuuaugcauagagguacaaauaccaacauguacacauauauuuuagaggcuccagaggagaucauuauauggauauaucauaauuuacuuagucucuauugaugagcaguuaaguucagccaauuuuuguuucuagaaagucuucaaugaauaucuguaaucauccaucuuaugauauuuacacaauuaccuucuuaagguaaguucuagaagugggauuucugagaccaaugguaggcacccauuacauuucgauccugcauggaugaaauucagguagaccggagacuugguuuugcaggaaaaaagguauacuuggaagauggcucuucaauuuaucuaauucauggugguagacacucaaguuauuuuguaauaguuacuugucccuguaagcagauagcccaaaaggcggccagggagaauaaggaucccauaagaaugagaggguguaagcuucuugucccuggcagacucaucccucuguauagaaaauacugggaaguaucaugggcagguguauuuuccacuggggauugggggucugggaaacuuacucugggaguauucuacuuuauguaacaucuccaugaauuauagcaauuacauucucuguaacuuuucuguugguagcuuuccaucacucacaucacugucccaugaugaugccuucacauuuacacacugccaaacuacccuuucugaggaagguuauacccauuuucacucccaccaaacaucugugcaucaaagucccugucuccucauugucuugccaacauuugguuuugccaauguuauguuugccaaucugugguuaaaauaaaaagaugucucacugugguuuuuauuugcauuuuacuaauguuuagugauuauuauuuuucacacccuuauuggauacuacauuucuucuuuuguguaauuccauuuuaugccuuuauugcuuuuuaaauuggucuguucacuguuuuauuauugauuuacaaagacucaauguauaucauggucuguuauauaugcugcaaauauuuugcucaguguuguuugucuuucagcccuguugauggagaugcggcuguuguuuguauauuuuucaaaaaucugaaacauaagaguuucuuuuacuaaaugucaacuguaaggauuuucuuaauuuaaaaaaauuauauuauguaauaccccaaacauauccaucacucagauuuaauauuuuaucauauuuggauauuuaaaucauauauuuagaucacuuuuuaaaaauugaacaugugcagauguagcugacuuuacagaacagugggaaggccuaggcaugacucaguuaugacacuagcuacaagagucugaaguauaugcagagaaacagcaagugauguacacgguauuuuccucagagcaguuuccugaucuuguaccacaauuaugguggcauguccuugacaucaguggcccaguggcaacccuugaccccaguucuccuaauuauuaauauugcaaauguaccuaauuuucaugauuaaaucccuuucgacuugaagugucuauuuccagcacugaauacugauauaacuguauucuucuccccacuucaccuagagccaaaccugaaacaacauugcguacacuuucaaaauaugaggcaggaagaauaguauagccauguugagcacugugagacagguugcuugaguucaaaucccagauaugcugcuuccuacuuuauaaucuugaacacguuauuuaagcucucugcaccuucaauuuuccucauguguaauacuagaauaauaucuuauaaguuauuugaguaaucuauccccucaaugucugguuuuaacacccacaugaguucuggagauacaggucugagauuagauaaggccagucgaugggauugagaccccuguacaaagagggaagaggugcagaauagcaagaggcccugaggagagaaagaacuggagguguggggaaagcaguaugaggccaggguggcugaaacuugagugaagaagccaggaagguuggcagaaaucaguccauggagggccucggagaucuagaucucaauaagaaauuuggauuuuaugcuaaauucaaaaccauugaaagaaaucaagcaaggaagugacauaauauggagaauggauuucugggaaggcaacauacauacagagagagaaauuaggaggcuaauucaauaacccaagugagauuuggacacuuagauuaugguggcagcagugagaggaagggaaauggauuucaguccuugagagggacuagcgaggguggaguacaugcuccugcugacaugggaacagaacgcuagucugguugggaucuaagagccuacaggugcaggagaguaaguacuggaauugggaaacaagguaggggcuaggauugagaaacugcaaaacgccaauuacuagccuuaauaacagggaauggagaaugaaguaauuucauaggaaaguaauuucauaggauguuaaagaugacuuuaacaugaaagaggauguuuaaaggcaucucacaggaagugucauauucaguucaguuagcuuccaagaaggcagauuccgucaggggcaaaacaacaccacugaucgugcaaagagaagauagccaucaaagagaaccacaaaccaacaccacagaucgugcaaagagaagauaaccaucaaagagaguacacaucgacgcggcgcccaguccagaaagauagagcgcugcagcaccauucagccacaggcagcauuuuucaaagcaucuuggagcaaaaugaaccucuggugaaaucaaaagaugcucaguguuuaaauauuauauuuugggccagugcaaaaccaaauauucgguugguacaaaaguaaccgagguucuugccacugaaaguaauacuaaaagucguaaugaaggccuuaaagcaaacaugagacaucacaguucaagucugaaugggcuaacaagauaggguaacaugaugggggaauucagacugaacugcucagaauaugcucuuugaaccacucagaggaagaccugaugcugaaaucagaagucauuaccuggaaguuuguuauaaaaacguaauaggggaagcuugauuucauuauuauuacccaagaugaauucaguccuucucaguaaaucuuuacuauccuagaauaaaauccagccuuguuacuauggccuacaaggcuguuaauaacauuuuacuuccauuucccuucccaacuuuaucuccuaucacaucccuaaagucacuccaucccagcccauuauuuucugcuauucucugaacaugccaggcuuauuuuauuauuuauuuauuuauuuauuuauuuauuuauuuauuuauuuauuuuuugagauagaguuucgcucuuguugcccaggcuggagugcaauggcauaaucuccgcucgccgcaaccuccgccuccuggguucaagcgauucuccugccucagccucccaaguagcugggauuacaggcaugugccaucacacucagcuaacuuuguauuuuuaguaaagaugggguuucuucauguuggucaggcuggucuugaacuccugaccucaggugaucugccugccucggccucccaaaguguugggauuacaggcgugagccacugcgccuggcccccaaggcuuauuuauacuuucaaucaggcuguuaauaacauuuuacuucuauuucuauguuuacuucuauuucuacuucuauuaacaguuuauuguuccuucuacuuccuuuuaguuaugaguaauuuucuguguuaacuugacuagguuaagggaugaccagauagcugcuaaaacauuauuucugccaggugcaguggcucaugccuguaaucccagcacuuugggaggcugaggcaggaggauugcuugagcacaggaguuugagaccagccugggccacauggcaagacccuaccucuacucaaaguuuaaaaauuagccagacauaauggugagugucuguggucccagcugcucaggagacugaggcaggauuugcuugaguuugggaguuugaggcugcagugagccauguucaggccacugcagagagugagacaagugaaugagaccuucucucaaaaaacaaaaaaaacccaaaacaucauuugugggugugucugugaggguguuucuggaagggauucacauuugaaucaguagaccgcguaaagaagacccacccacaaaggugagggcaggcaggcaggcaucaucaaacccguugaaggccuggauacaacaaaacgguaggggaagggcugcuucucucuccuugagcugggacguccaucuucuccugcccuuggauguggaagcuccuggcucucaggccuuuggacuuugaaacucucuguccucuggggccuuaggacuuggccugaauuagaccaucggcuuuccugguucucuagcuugcagauggcagauuguggaacuucucucccuccauaaucacaugagucaauaccaauaauaaauuuccuguuaucaguaccucuauguaucccacugguuuuguuucucugaagaaccuugacuaauacaccuccugggcauucucuaacuccacacugugcuuuauuuuucuucaaagacucauaacucuucuuuauuguuggacuacaucagaauguaaauugcacaagggcaaggacuuucucuuguccguuauuauagccccagcaccuagaacaggaccugguaccuaauaggagcucaauuaagcuuguuucucuggcacucccagaaauuuuauaaacuaaaacccugugacaaaucucuuucucucugaacuagcuagagugaauucuguuguugaauccugaccaauucaggacaugguaaaagaaguggaugugggaaacaauccaaggcugugagaaucuaggauuggauaucugauguaaugaggacggaagggcagcaucuaauuaccauuaauggcugggaugcuggcagauggccacucaguaaugaaacagguacuuauuuauuuauuuauuuauuuauuuauuuuuuugagacagagucucgcucugucacucaggcuggagugcaauggcaugaucuuggcucacugcaaccucugcauucuggguucaagcaauucuccugccuuagccuccugaguaggugggacuacaggugccugccaccacaccuggcuaauuuuuuguauuuuaguagaaacgggauuucacccuguugcccagaguggucuugaacuccugaccucaagcaaucugccugccucggccucccagagugcugggauuacagguaggagccacuguucuuggccugaaaagggaauuuaaauaaucaccugaggccaucuggaauaaaaugccuauucaaggcaaggcuuuggugaacuaagugugauagaacaauauggggaacauaaguaguaacagacaugugagguggucugguugcuucuaacuucacuggagaaauuaaagaaaaaaaagcacagguucagagcuuuaauaucuugguucaaggcacaguuaggacgucaggcauuuugauaucgacccuaaaagaaccccuuacuucuuguuucuguaggacccacuucacagauccacugggaucuccaugagauuacuaaaacacugacacagacaauaacccugcagggugcucaaugacaacaaagacugaauuuaugugaggauaauuaguuucucaguuaaugagaugagaaggaaaaauaguccaggaauuggaaugugacacuugaaaguauucauguaacuaagagcacccuaacuuccuuccaaacuucucuucucauaggaaguagcccccaaacuuguacaauaaggcugguucugccuugcugcagacucucagaucucaccugaggcaggugcauuuuguggggaugcccgcucucuucaagccuccucuccccaccuccccucaaggucuccaaaccuuaacuaaagucagaucccagcaugacccagggggccuauaacaaagugaaacagaggaagaggagauuuacauagcaaaaagaacuacaacauuuugcugauuuauaacggggaauguaugaagaaauggauuucauggguguuggaccagaggggaagaaauaugacuuuagauugggcugauuauaacaauaugggcacaacuuauucgagauucugguuuuuuuuuucuuuuuuuugagauggaguuucgcucugucgcccaggcuggagugaaguggcauggucugggcucacugcaaccucugccucccagguucaagcaauucugucucagccucccgaguagcugggauuacaggcaccugccaccacgccuggcuaauuuuuuuguauuuuuaguagagacaggguuccaccauguuggccaggauggucuugaacuccugaccucaagugaucugcccuccucggccucccaaagugcugggauuacaggcaugagccacugcgccuggcccaacucuucuuuaugcuguaauuuagucguugggucccuucauuaucucaccaucccauggcucaauccgcauucacuacaucgacgaucuuuuuuuuuuuuuuuuuuuuuuuuguuuuuuuuuuuguuuuguuuuuguuuuuugagacagagucucgcucuugucgcccaggcuggagugcaguggugccaucucagcucacugcaaucuccgucuccuggguucacaccauucuccugccucagccuccuaaguagcugggacuacaggugcccgccaccacgccuggcuaauuuuuuuguauuuuuuagaagauaugggguuucacuguguuggccaggaugcucuugaucucgugaccuugugauccagccaccucggccucccaaagugcugggauuacaggcgugagccacugcgcccguccacauugaugaucuuaugcccacacaccaguuauuuauccuacguguuuccucuaguaaacaauaguccaaaaggcuugguauguauacuagcugguuguuuaucucuguuugcuauucacugggcuuaggccuuuaaaaauacucucuggccuguuauuuaaauagauuuuaggaagggaguacaaguagaugaaugcuuuaaauuaaucauuguuaucuagaaguacccaacauuucauaaaagagcagcauauucuagauuguuccuauuugcauuacuccaugcauaauagauugaagucucagggcugacgcaacgcacuacugaacaccagcagugcuaagcacauuuguaaaacuuaagagugcaaagugggauaguucagaggucccuggcauugcaaaacacauauucaacagaggaguugcuugaacaugccuugcucuuucuugugucucugcauuccgccagggguguccaucuggccaacuccucuuccuuuucaaagcccaaaugcugccuucucugcagaaucucccucacuucccggggucaacagauguuggaguugcuucucuugugcaucccuugcaucaacauuaacccaaucaacauaaccauuuguaguuguuacuuugaauaucugucucuucaucacauuuuaagcuucuugagggcaggacuguaucauuauaacuguauccucugcaccaguguaaaaugcuccaugaaauauuuuuugagcgaaagaaugcuaggcauaaggaagccauuaagaucaaugagacaugaaguaugcccucaaaaaacuuauacucuagugagagagaguaugcacauaaaaacauauacgguauaaauaccaaguaccacaacagggaugaaaauaaaauucaauggggauucaaaggaaggaagaaauuccauccagaugaaggaaacuuagagauguuacaaauaucuaggauuucacauuuuaaagauuaugauaggccagguguggggacucaugccuguaauccuagcacuuugggaggcugaggcagguggaucaccugagguuaggaguucgagagcagccuggcuaacauggcaaaacccugugucuacuaaaaauacaaaaauuagccgggcaugguagcgggucccuguagucccagguauuugggaggcugaggugggaggacagcuugagcccaggagguagaggcugcagugagccgagaucgccccacugcacuccagccugggcgacagugugagacucugucucuaaauaaauaaauaaauaaauaaauauuaugauagagacagugaaggugaaaaaggcuagaaccuucuagauuaaaaugagaagaacaugagcuaagucuauagacaggaaagcuuaggauacaaguagggaagagaaagauguucaagucaagcaaacugguguaugcauugaauguuuuauaauaguuucagggccuugaacaauacaugaaguaagcauaaauuucuaacuucaugaaaauguauguuaauuuauaaauuaauuuauagaauggcugaacauaucugucuucuaagucaacauacaacauccuauuuagugcaggauaaaguuuaacuaugaauuaauaugccauuuuaauuguuuuuauauuaauuuuuauuuuaaaaguaauauaugugcauucacagaaauuugagaaaauuugagaaaacucaaauuuucaauuauacuuaacauucuaguauguuaucucauuuuuucauauaucaucccaggaacauuuccccaggacauuaacuauuguucuaaagcaugcucucuaaugggcuggcugcauauuguacuauuguauggauggauauaccaaaaugccuguaaccaauuauuuacuguuggaaaauuaggggaguccaauauuuuuguuauaaauaaugacguauugaacauucauauguauaacuuuugcccucaucugauuauuuucuuacuauaaauuucucuaaauggaaucucuugaucaaaggaugaaaacaguuaaaauuuuuucauacauauugccaaauugcccuccuaauggcacucucucuagccaucaaugaggaggucugauucccugacuguugauaagacuggguauaauaauuuuugaaaaaucuuugccaaauuuaacagaugagaaaugguaccuugcuaaaaaguuuugaauuuccuugauuaauagggaaggauaagcauguuuucuuagauguacuggucauuuccuucucuuuuuuuuuuuuuuugaagacuucugucuucaaaaaaaaaaaaaaaagagagauggggucucacucuguuacccagguuagagugcaguggcaugaucucugcucacugcagccuucaccucuugagcucaagugauccuccuaccucagccucccaacuagcugggacaacaggcuagguuaauuuuuguaguuuuuguagagauggguuucaccauguuggccaggcuggucuugaacucccaagcucagcugauccaccugccucagccucccaaagggcugggauuacaggcaugagccacugcacccagccuccuucucuuuuuuaaugauuugcuucccauguucacuggaagguaaggugaggcuccuuuucugugugugcucuguucaaugcuguagacuuagcacuggcugggugcacagucuacauuuaugaaaguuuuuuuugaauaaauauauuuauuaauuggauguuaaccuuuuaaaaaauguuauuuguaaaaucugcauagguagacauaaaauuuauucauucuggcaaauaguuuacccaauaucucauuucuauuuuaguuuuguuuaugguacuuuuuugucaaagggagucucuuaaacuacugugauuuaauauuugacaguuaaaagucccuuuuuucucgauuuagucuuuuucaaauuucaaaaaauacccuauugguauucugauuagaauuuuguuuaauaaacagauaaacuguagaggcaauauuuuuauaaucaugaauauuuccauuuagaaacauguucauuuaaauaaaauccuuacauaucucaguuuuguaguugucuucaugcagagucagaacaacucuuuaucuuuauuccuaaacuuuuguuguuguuaauauuugaaugggauccuucuccacuaauuuuuuuuuuuuuuuuuuuucuugagacagagucuuguucugucaccaaggcuggagugcaguggugugaucucggcucacugcauccuccgccuccuggguugaagcaaucaucgugccucagccucccgaguagcugggacuacaggcacccacaaccacacccagguaauuuuuaucuuuuuaguagagacagggguucaccauguuggccaggcuugucuagaacacgugaguucaagugauccaccugccucagccucccaaaggcaugagacacugcacccagccauucucuguuagauuuucuaaaguguuguuugauacaaaugcuguuaauuuuugcauguggaaucugucguguuauaggggucgcuguacugaauuccacugguuuuaauaacucuuuaggugguucucuuagauuuuguagaucaguaauaucuugcaaauaaugacaauuuuauuucauuuccaaaagcuauguuuuguuuuucuuauuacauuacauuggcuagaguucucagaacaacguugcauuauaguggugacagcugacauccuugucuuguuuccucacuuuaaugaaaguucuuuuaguuuuaccauugaguauaacauuggcaguugauuugaagaggggugugugugccaacacuuugggaggccgaggcagguggaucaugaggucaggaguucaagaccagccuggccaagauggugaaaccccgucucuacuaaaaauacaaaaauuagccgggcaugguggugugugccuguaaucccagcuacucgggaggcagaggcagaggcagagaacugcuugaacccaggagguggagguugcagugagcugagaucgcgccacugcacuccagucugggcaacaaaguaagacuccaucucaaaaaaaaaaaacuauucuuuuaauccuagaugcuagggauuaaaaaaaaaucaggaaaggauguugaauuuaucaacauuucaaauuuucaaauuuaucaaucguacauuuuuuuaucuuauuagugaauuauaugaauagguuuccuaguaucaaaccaugguucauuccuugaacucagauaauccaauacauaauuuagccucaaauucauuuugauuuuauaucugugguagguuuuucuccuaauuauaacuccuauagguaaaucauuguuugccuuuugaagacauccugagacuggaugggguagccagaugcauugugguagaaaggggaauuguggcugggauuugaaauuugccaugguuaauuccacagaaaaugaaacugagaacuggcuguacagaauuucaguuuccagauuacuuacccauuuggguuucuuuccagcucauuuaaaaguguaugaucacaguauucaaaaacuaaaugcauuuuccuuuuucuccugaacaccucgaugagguucacaagauuuggauguuuuaauugcugugaaagaauugaaaugcaaaguuaagugaucuguuacuaguaaaagcuucuacccagaccccuuaaagaaacuuaaaguuggaagaaauuuaagauucauccaauguaccuauaauaagugguaacaaaauugcuugaaucucucuggugauagcaaguaaaguauguaacuuaaaauacugcaauaaaacaaaaaacacuuuauguauuuuauggaaauucuauauauacaagucauaaaauaaccugaguagaaaauugaggaaaugaaauuauuaaggacuauaaaaauaaucaauauccacucagcuuacauauugccauggauuuuauggauuuaaauccagucuggauucuaguguugacucccaguaauacuuguuccuaaccaucaaaucggaauaaacugucuauucuagaaguccccacaauuagucuguguuuuaaauuuacuuauuuauauuuauauaaauuauauauauuauauauauauuauauauauuauauauauauaauauauauuauauauuuucagcauuguucuuugauucuguuguucucucuuaugcauagauauuuuguguguuaaauucuauucccaaacugacgcauuucacaagacagccucuguuuaauaucgcaaacccaaggaaaaaugcugauuagguaggacagaccaucacuacagcgauuagauaauuuuaucuuccaaacuaggguaauggguagaagccaggacuaucguaggcaaaccagcacauauggucacuccgucuguaacuagggugaccacauaauucagcauacacaccaggacacuuuuuuuuuuuccuugcucugucgcccaggcugaagugcaguggcgccaucucggcucacuacaaccuccgccuccugguuccaagugaugcucaugccuuagccuuugcuguagcugggacuacaggugggugcuaccacgccuggcuaauuuuuguauuuuuaguagagaugggguuucaccauguuggacaggcuggucucacguggacaggcuggucucaaacugcugaccucaagcaauccaucugccucggcuucucaaugugcucggauuacaggcgugagccauugggccuggccacaccaggacacuuuugaaaggggaugugaaccaggcaggacacugggacaaaaacuauaaagcagaacucucuugggcaaaucaggauacaugaucacucuuauuccuaacccaucuucccuguuguuuucccaguauaguagacaaaucaacuuuccaaacucucuuccauuuacccagaaagauacugagagagaacacagcauuuugcauauaguagaagcucaacaaauaacaggcccaguagaaaauuuuagguacagagacucacaaugcaugccucuaccucaguaucuauuaacguaagcauggcuugaccaaaacaaaugucacccuaaaacugugugccugcugcuccacagcuggggaaaagagaauccauuauacauuaaaaauaugcccaggcugaggcaggaggaucgcgugaaccuaggaguucgagaucagccuaagcaacauacugagaccccaucucucuaagggaaaaaaaagagagaagcccaaagcaccaaaccaauuuguuuucuaugugcuccacugccuaaaagagcagaaaggcaaagaguggaagagacuaggucaucuaaaaagccaguggcuuugugccgcugcaaaaccacaguauggaagcaaagcaggaucucuacuaggggaguaaaagauuuacagauacuacaguuugaugcaaugucaagguuaaaccugguccaaucuccugucuuuggguaggucagcaauuuauaccgccuuugcaaaugaaguuaaccuagcccaggaaaacaguaacuugccuaaagaaaaacaggugguaaggacagagaggcaagcaauuuaaauaacaagacuaugugaggaaaggaaggucgacugaucacagaaggagcuguucaggaccuacauggacacaacauaccaaaagcagaaagauggacguucugacauucugagggccuucaucagagaccaagcugagucauaaucaggcuaguuuuuaccuuacagccucauucuccaguugggcacuuguaaugcagaagguacuaccugagcauuaacuuuaucugaagacuugggacggagaggcugacagguaaaagcauuauuuuuauuagaaagccacacugcuugguucagacccgcccugcagcuuagcucagugagggugccagagcuggcuagcugaccggcgcgcccucugcuggcugagagguaagagugaacuuuuuuuuaucaugauggauguguuccugaagacuguaucaaguuauauuucaaacaaaacccuaguguguauuaguugaggaaaccugugggaaauaauauuugaaaaugagagaaaacaugauaauuauuagugauaauuauuauccucccuuacaaacugaauuucuggggauuuucuaaaaacagacgacgugucaaaaaugaagguugccuguguguccuugaaaucacagggucuugucacauaauguguagcccacaaaccagcagcuuccgcacuuccugcguacucagaaaugcagaaucucgggcccaccccagaccucccaacucagaaucugcauuucaacaagguccccggggauuccaaugcauauuaacauuugagaagugcugccccagaccuccguuuccucugcggaaaauaugguuguuagauaagaagcaucucuacggucgcuuauagaucuaaaacuguaagauauuuagcguaagaaaaaauuuacauugagaacuuaggaaucuuacaugucaaaucuuaucagagugaaaacaauuauaacaaaaaccuuuauguaaaaaauguguacguuaccgggggugcuauucaguaugucuaagaaccuggggugcagugcaggcaggaaccaacgcaugucgaugccuaccagggcauuggugcgguccugugggacugacucucugugccaggaggugcucuuuuaguugcugguugguaggggaaguauuuggagggauauccagaggagggccaggguugggggcgagcguaaacacuggggugaguggacuuaggauauuuacuaacaagaauaaaaguucuuuucaguauaacaaucuauagcuguauucauacacagacaaaaucagaguggccgaaguccaaagugauaaucaacuuauuacccaaaggugcugauacaaaggaauuuaaguccaauggggggaaaauaacuuuaaaauucuuugcaauuuuaacaugcauauuucacucaauuccaugauauuuuacauauauauaaaguuaacuuaccuucaacauacguauuucucuuagugcuauuuucuuaacaacaggaucaucuucagauuccacaaauuuuuuaacagcuacuacuuguccagagguuuuguuucugcauuugaauacaaccccauaagacccuucuccagucuuagcuaauuuuucauacuuuuccau

SEQ ID NO: 192726 - RNA, 50986 nt, Homo sapiens
auggaaaaguaugaaaaauuagcuaagacuggagaagggucuuaugggguuguauucaaaugcagaaacaaaaccucuggacaaguaguagcuguuaaaaaauuuguggaaucugaagaugauccuguuguuaagaaaauagcacuaagagaaauacguauguugaagguaaguuaacuuuauauauauguaaaauaucauggaauugagugaaauaugcauguuaaaauugcaaagaauuuuaaaguuauuuuccccccauuggacuuaaauuccuuuguaucagcaccuuuggguaauaaguugauuaucacuuuggacuucggccacucugauuuugucuguguaugaauacagcuauagauuguuauacugaaaagaacuuuuauucuuguuaguaaauauccuaaguccacucaccccaguguuuacgcucgcccccaacccuggcccuccucuggauaucccuccaaauacuuccccuaccaaccagcaacuaaaagagcaccuccuggcacagagagucagucccacaggaccgcaccaaugcccugguaggcaucgacaugcguugguuccugccugcacugcaccccagguucuuagacauacugaauagcacccccgguaacguacacauuuuuuacauaaagguuuuuguuauaauuguuuucacucugauaagauuugacauguaagauuccuaaguucucaauguaaauuuuuucuuacgcuaaauaucuuacaguuuuagaucuauaagcgaccguagagaugcuucuuaucuaacaaccauauuuuccgcagaggaaacggaggucuggggcagcacuucucaaauguuaauaugcauuggaauccccggggaccuuguugaaaugcagauucugaguugggaggucuggggugggcccgagauucugcauuucugaguacgcaggaagugcggaagcugcugguuugugggcuacacauuaugugacaagacccugugauuucaaggacacacaggcaaccuucauuuuugacacgucgucuguuuuuagaaaauccccagaaauucaguuuguaagggaggauaauaauuaucacuaauaauuaucauguuuucucucauuuucaaauauuauuucccacagguuuccucaacuaauacacacuaggguuuuguuugaaauauaacuugauacagucuucaggaacacauccaucaugauaaaaaaaaguucacucuuaccucucagccagcagagggcgcgccggucagcuagccagcucuggcacccucacugagcuaagcugcagggcgggucugaaccaagcaguguggcuuucuaauaaaaauaaugcuuuuaccugucagccucuccgucccaagucuucagauaaaguuaaugcucagguaguaccuucugcauuacaagugcccaacuggagaaugaggcuguaagguaaaaacuagccugauuaugacucagcuuggucucugaugaaggcccucagaaugucagaacguccaucuuucugcuuuugguauguuguguccauguagguccugaacagcuccuucugugaucagucgaccuuccuuuccucacauagucuuguuauuuaaauugcuugccucucuguccuuaccaccuguuuuucuuuaggcaaguuacuguuuuccugggcuagguuaacuucauuugcaaaggcgguauaaauugcugaccuacccaaagacaggagauuggaccagguuuaaccuugacauugcaucaaacuguaguaucuguaaaucuuuuacuccccuaguagagauccugcuuugcuuccauacugugguuuugcagcggcacaaagccacuggcuuuuuagaugaccuagucucuuccacucuuugccuuucugcucuuuuaggcaguggagcacauagaaaacaaauugguuuggugcuuugggcuucucucuuuuuuuucccuuagagagauggggucucaguauguugcuuaggcugaucucgaacuccuagguucacgcgauccuccugccucagccugggcauauuuuuaauguauaauggauucucuuuuccccagcuguggagcagcaggcacacaguuuuagggugacauuuguuuuggucaagccaugcuuacguuaauagauacugagguagaggcaugcauugugagucucuguaccuaaaauuuucuacugggccuguuauuuguugagcuucuacuauaugcaaaaugcuguguucucucucaguaucuuucuggguaaauggaagagaguuuggaaaguugauuugucuacuauacugggaaaacaacagggaagauggguuaggaauaagagugaucauguauccugauuugcccaagagaguucugcuuuauaguuuuugucccaguguccugccugguucacauccccuuucaaaaguguccugguguggccaggcccaauggcucacgccuguaauccgagcacauugagaagccgaggcagauggauugcuugaggucagcaguuugagaccagccuguccacgugagaccagccuguccaacauggugaaaccccaucucuacuaaaaauacaaaaauuagccaggcgugguagcacccaccuguagucccagcuacagcaaaggcuaaggcaugagcaucacuuggaaccaggaggcggagguuguagugagccgagauggcgccacugcacuucagccugggcgacagagcaaggaaaaaaaaaaaguguccugguguguaugcugaauuauguggucacccuaguuacagacggagugaccauaugugcugguuugccuacgauaguccuggcuucuacccauuacccuaguuuggaagauaaaauuaucuaaucgcuguagugauggucuguccuaccuaaucagcauuuuuccuuggguuugcgauauuaaacagaggcugucuugugaaaugcgucaguuugggaauagaauuuaacacacaaaauaucuaugcauaagagagaacaacagaaucaaagaacaaugcugaaaauauauaauauauauuauauauauauaauauauauaauauauauauaauauauauaauuuauauaaauauaaauaaguaaauuuaaaacacagacuaauuguggggacuucuagaauagacaguuuauuccgauuugaugguuaggaacaaguauuacugggagucaacacuagaauccagacuggauuuaaauccauaaaauccauggcaauauguaagcugaguggauauugauuauuuuuauaguccuuaauaauuucauuuccucaauuuucuacucagguuauuuuaugacuuguauauauagaauuuccauaaaauacauaaaguguuuuuuguuuuauugcaguauuuuaaguuacauacuuuacuugcuaucaccagagagauucaagcaauuuuguuaccacuuauuauagguacauuggaugaaucuuaaauuucuuccaacuuuaaguuucuuuaaggggucuggguagaagcuuuuacuaguaacagaucacuuaacuuugcauuucaauucuuucacagcaauuaaaacauccaaaucuugugaaccucaucgagguguucaggagaaaaaggaaaaugcauuuaguuuuugaauacugugaucauacacuuuuaaaugagcuggaaagaaacccaaauggguaaguaaucuggaaacugaaauucuguacagccaguucucaguuucauuuucuguggaauuaaccauggcaaauuucaaaucccagccacaauuccccuuucuaccacaaugcaucuggcuaccccauccagucucaggaugucuucaaaaggcaaacaaugauuuaccuauaggaguuauaauuaggagaaaaaccuaccacagauauaaaaucaaaaugaauuugaggcuaaauuauguauuggauuaucugaguucaaggaaugaaccaugguuugauacuaggaaaccuauucauauaauucacuaauaagauaaaaaaauguacgauugauaaauuugaaaauuugaaauguugauaaauucaacauccuuuccugauuuuuuuuuaaucccuagcaucuaggauuaaaagaauaguuuuuuuuuuuugagauggagucuuacuuuguugcccagacuggagugcaguggcgcgaucucagcucacugcaaccuccaccuccuggguucaagcaguucucugccucugccucugccucccgaguagcugggauuacaggcacacaccaccaugcccggcuaauuuuuguauuuuuaguagagacgggguuucaccaucuuggccaggcuggucuugaacuccugaccucaugauccaccugccucggccucccaaaguguuggcacacacaccccucuucaaaucaacugccaauguuauacucaaugguaaaacuaaaagaacuuucauuaaagugaggaaacaagacaaggaugucagcugucaccacuauaaugcaacguuguucugagaacucuagccaauguaauguaauaagaaaaacaaaacauagcuuuuggaaaugaaauaaaauugucauuauuugcaagauauuacugaucuacaaaaucuaagagaaccaccuaaagaguuauuaaaaccaguggaauucaguacagcgaccccuauaacacgacagauuccacaugcaaaaauuaacagcauuuguaucaaacaacacuuuagaaaaucuaacagagaauggcugggugcagugucucaugccuuugggaggcugaggcagguggaucacuugaacucacguguucuagacaagccuggccaacauggugaaccccugucucuacuaaaaagauaaaaauuaccugggugugguugugggugccuguagucccagcuacucgggaggcugaggcacgaugauugcuucaacccaggaggcggaggaugcagugagccgagaucacaccacugcacuccagccuuggugacagaacaagacucugucucaagaaaaaaaaaaaaaaaaaaaauuaguggagaaggaucccauucaaauauuaacaacaacaaaaguuuaggaauaaagauaaagaguuguucugacucugcaugaagacaacuacaaaacugagauauguaaggauuuuauuuaaaugaacauguuucuaaauggaaauauucaugauuauaaaaauauugccucuacaguuuaucuguuuauuaaacaaaauucuaaucagaauaccaauaggguauuuuuugaaauuugaaaaagacuaaaucgagaaaaaagggacuuuuaacugucaaauauuaaaucacaguaguuuaagagacucccuuugacaaaaaaguaccauaaacaaaacuaaaauagaaaugagauauuggguaaacuauuugccagaaugaauaaauuuuaugucuaccuaugcagauuuuacaaauaacauuuuuuaaaagguuaacauccaauuaauaaauauauuuauucaaaaaaaacuuucauaaauguagacugugcacccagccagugcuaagucuacagcauugaacagagcacacacagaaaaggagccucaccuuaccuuccagugaacaugggaagcaaaucauuaaaaaagagaaggaggcugggugcaguggcucaugccuguaaucccagcccuuugggaggcugaggcagguggaucagcugagcuugggaguucaagaccagccuggccaacauggugaaacccaucucuacaaaaacuacaaaaauuaaccuagccuguugucccagcuaguugggaggcugagguaggaggaucacuugagcucaagaggugaaggcugcagugagcagagaucaugccacugcacucuaaccuggguaacagagugagaccccaucucucuuuuuuuuuuuuuuuugaagacagaagucuucaaaaaaaaaaaaaaagagaaggaaaugaccaguacaucuaagaaaacaugcuuauccuucccuauuaaucaaggaaauucaaaacuuuuuagcaagguaccauuucucaucuguuaaauuuggcaaagauuuuucaaaaauuauuauacccagucuuaucaacagucagggaaucagaccuccucauugauggcuagagagagugccauuaggagggcaauuuggcaauauguaugaaaaaauuuuaacuguuuucauccuuugaucaagagauuccauuuagagaaauuuauaguaagaaaauaaucagaugagggcaaaaguuauacauaugaauguucaauacgucauuauuuauaacaaaaauauuggacuccccuaauuuuccaacaguaaauaauugguuacaggcauuuugguauauccauccauacaauaguacaauaugcagccagcccauuagagagcaugcuuuagaacaauaguuaauguccuggggaaauguuccugggaugauauaugaaaaaaugagauaacauacuagaauguuaaguauaauugaaaauuugaguuuucucaaauuuucucaaauuucugugaaugcacauauauuacuuuuaaaauaaaaauuaauauaaaaacaauuaaaauggcauauuaauucauaguuaaacuuuauccugcacuaaauaggauguuguauguugacuuagaagacagauauguucagccauucuauaaauuaauuuauaaauuaacauacauuuucaugaaguuagaaauuuaugcuuacuucauguauuguucaaggcccugaaacuauuauaaaacauucaaugcauacaccaguuugcuugacuugaacaucuuucucuucccuacuuguauccuaagcuuuccugucuauagacuuagcucauguucuucucauuuuaaucuagaagguucuagccuuuuucaccuucacugucucuaucauaauauuuauuuauuuauuuauuuauuuagagacagagucucacacugucgcccaggcuggagugcaguggggcgaucucggcucacugcagccucuaccuccugggcucaagcuguccucccaccucagccucccaaauaccugggacuacagggacccgcuaccaugcccggcuaauuuuuguauuuuuaguagacacaggguuuugccauguuagccaggcugcucucgaacuccuaaccucaggugauccaccugccucagccucccaaagugcuaggauuacaggcaugaguccccacaccuggccuaucauaaucuuuaaaaugugaaauccuagauauuuguaacaucucuaaguuuccuucaucuggauggaauuucuuccuuccuuugaauccccauugaauuuuauuuucaucccuguugugguacuugguauuuauaccguauauguuuuuaugugcauacucucucucacuagaguauaaguuuuuugagggcauacuucaugucucauugaucuuaauggcuuccuuaugccuagcauucuuucgcucaaaaaauauuucauggagcauuuuacacuggugcagaggauacaguuauaaugauacaguccugcccucaagaagcuuaaaaugugaugaagagacagauauucaaaguaacaacuacaaaugguuauguugauuggguuaauguugaugcaagggaugcacaagagaagcaacuccaacaucuguugaccccgggaagugagggagauucugcagagaaggcagcauuugggcuuugaaaaggaagaggaguuggccagauggacaccccuggcggaaugcagagacacaagaaagagcaaggcauguucaagcaacuccucuguugaauauguguuuugcaaugccagggaccucugaacuaucccacuuugcacucuuaaguuuuacaaaugugcuuagcacugcugguguucaguagugcguugcgucagcccugagacuucaaucuauuaugcauggaguaaugcaaauaggaacaaucuagaauaugcugcucuuuuaugaaauguuggguacuucuagauaacaaugauuaauuuaaagcauucaucuacuuguacucccuuccuaaaaucuauuuaaauaacaggccagagaguauuuuuaaaggccuaagcccagugaauagcaaacagagauaaacaaccagcuaguauacauaccaagccuuuuggacuauuguuuacuagaggaaacacguaggauaaauaacuggugugugggcauaagaucaucaauguggacgggcgcaguggcucacgccuguaaucccagcacuuugggaggccgagguggcuggaucacaaggucacgagaucaagagcauccuggccaacacagugaaaccccauaucuucuaaaaaauacaaaaaaauuagccaggcgugguggcgggcaccuguagucccagcuacuuaggaggcugaggcaggagaauggugugaacccaggagacggagauugcagugagcugagauggcaccacugcacuccagccugggcgacaagagcgagacucugucucaaaaaacaaaaacaaaacaaaaaaaaaaacaaaaaaaaaaaaaaaaaaaaaaaagaucgucgauguagugaaugcggauugagccaugggauggugagauaaugaagggacccaacgacuaaauuacagcauaaagaagaguugggccaggcgcaguggcucaugccuguaaucccagcacuuugggaggccgaggagggcagaucacuugaggucaggaguucaagaccauccuggccaacaugguggaacccugucucuacuaaaaauacaaaaaaauuagccaggcgugguggcaggugccuguaaucccagcuacucgggaggcugagacagaauugcuugaaccugggaggcagagguugcagugagcccagaccaugccacuucacuccagccugggcgacagagcgaaacuccaucucaaaaaaaagaaaaaaaaaaccagaaucucgaauaaguugugcccauauuguuauaaucagcccaaucuaaagucauauuucuuccccucugguccaacacccaugaaauccauuucuucauacauuccccguuauaaaucagcaaaauguuguaguucuuuuugcuauguaaaucuccucuuccucuguuucacuuuguuauaggcccccugggucaugcugggaucugacuuuaguuaagguuuggagaccuugaggggagguggggagaggaggcuugaagagagcgggcauccccacaaaaugcaccugccucaggugagaucugagagucugcagcaaggcagaaccagccuuauuguacaaguuugggggcuacuuccuaugagaagagaaguuuggaaggaaguuagggugcucuuaguuacaugaauacuuucaagugucacauuccaauuccuggacuauuuuuccuucucaucucauuaacugagaaacuaauuauccucacauaaauucagucuuuguugucauugagcacccugcaggguuauugucugugucaguguuuuaguaaucucauggagaucccaguggaucugugaaguggguccuacagaaacaagaaguaagggguucuuuuagggucgauaucaaaaugccugacguccuaacugugccuugaaccaagauauuaaagcucugaaccugugcuuuuuuuucuuuaauuucuccagugaaguuagaagcaaccagaccaccucacaugucuguuacuacuuauguuccccauauuguucuaucacacuuaguucaccaaagccuugccuugaauaggcauuuuauuccagauggccucaggugauuauuuaaauucccuuuucaggccaagaacaguggcuccuaccuguaaucccagcacucugggaggccgaggcaggcagauugcuugaggucaggaguucaagaccacucugggcaacagggugaaaucccguuucuacuaaaauacaaaaaauuagccaggugugguggcaggcaccuguagucccaccuacucaggaggcuaaggcaggagaauugcuugaacccagaaugcagagguugcagugagccaagaucaugccauugcacuccagccugagugacagagcgagacucugucucaaaaaaauaaauaaauaaauaaauaaauaaauaaguaccuguuucauuacugaguggccaucugccagcaucccagccauuaaugguaauuagaugcugcccuuccguccucauuacaucagauauccaauccuagauucucacagccuuggauuguuucccacauccacuucuuuuaccauguccugaauuggucaggauucaacaacagaauucacucuagcuaguucagagagaaagagauuugucacaggguuuuaguuuauaaaauuucugggagugccagagaaacaagcuuaauugagcuccuauuagguaccagguccuguucuaggugcuggggcuauaauaacggacaagagaaaguccuugcccuugugcaauuuacauucugauguaguccaacaauaaagaagaguuaugagucuuugaagaaaaauaaagcacaguguggaguuagagaaugcccaggagguguauuagucaagguucuucagagaaacaaaaccagugggauacauagagguacugauaacaggaaauuuauuauugguauugacucaugugauuauggagggagagaaguuccacaaucugccaucugcaagcuagagaaccaggaaagccgauggucuaauucaggccaaguccuaaggccccagaggacagagaguuucaaaguccaaaggccugagagccaggagcuuccacauccaagggcaggagaagauggacgucccagcucaaggagagagaagcagcccuuccccuaccguuuuguuguauccaggccuucaacggguuugaugaugccugccugccugcccucaccuuugugggugggucuucuuuacgcggucuacugauucaaaugugaaucccuuccagaaacacccucacagacacacccacaaaugauguuuuggguuuuuuuuguuuuuugagagaaggucucauucacuugucucacucucugcaguggccugaacauggcucacugcagccucaaacucccaaacucaagcaaauccugccucagucuccugagcagcugggaccacagacacucaccauuaugucuggcuaauuuuuaaacuuugaguagagguagggucuugccauguggcccaggcuggucucaaacuccugugcucaagcaauccuccugccucagccucccaaagugcugggauuacaggcaugagccacugcaccuggcagaaauaauguuuuagcagcuaucuggucaucccuuaaccuagucaaguuaacacagaaaauuacucauaacuaaaaggaaguagaaggaacaauaaacuguuaauagaaguagaaauagaaguaaacauagaaauagaaguaaaauguuauuaacagccugauugaaaguauaaauaagccuugggggccaggcgcaguggcucacgccuguaaucccaacacuuugggaggccgaggcaggcagaucaccugaggucaggaguucaagaccagccugaccaacaugaagaaaccccaucuuuacuaaaaauacaaaguuagcugagugugauggcacaugccuguaaucccagcuacuugggaggcugaggcaggagaaucgcuugaacccaggaggcggagguugcggcgagcggagauuaugccauugcacuccagccugggcaacaagagcgaaacucuaucucaaaaaauaaauaaauaaauaaauaaauaaauaaauaaauaaauaaauaauaaaauaagccuggcauguucagagaauagcagaaaauaaugggcugggauggagugacuuuagggaugugauaggagauaaaguugggaagggaaauggaaguaaaauguuauuaacagccuuguaggccauaguaacaaggcuggauuuuauucuaggauaguaaagauuuacugagaaggacugaauucaucuuggguaauaauaaugaaaucaagcuuccccuauuacguuuuuauaacaaacuuccagguaaugacuucugauuucagcaucaggucuuccucugagugguucaaagagcauauucugagcaguucagucugaauucccccaucauguuacccuaucuuguuagcccauucagacuugaacugugaugucucauguuugcuuuaaggccuucauuacgacuuuuaguauuacuuucaguggcaagaaccucgguuacuuuuguaccaaccgaauauuugguuuugcacuggcccaaaauauaauauuuaaacacugagcaucuuuugauuucaccagagguucauuuugcuccaagaugcuuugaaaaaugcugccuguggcugaauggugcugcagcgcucuaucuuucuggacugggcgccgcgucgauguguacucucuuugaugguuaucuucucuuugcacgaucugugguguugguuugugguucucuuugauggcuaucuucucuuugcacgaucagugguguuguuuugccccugacggaaucugccuucuuggaagcuaacugaacugaauaugacacuuccugugagaugccuuuaaacauccucuuucauguuaaagucaucuuuaacauccuaugaaauuacuuuccuaugaaauuacuucauucuccauucccuguuauuaaggcuaguaauuggcguuuugcaguuucucaauccuagccccuaccuuguuucccaauuccaguacuuacucuccugcaccuguaggcucuuagaucccaaccagacuagcguucuguucccaugucagcaggagcauguacuccacccucgcuagucccucucaaggacugaaauccauuucccuuccucucacugcugccaccauaaucuaaguguccaaaucucacuuggguuauugaauuagccuccuaauuucucucucuguauguauguugccuucccagaaauccauucuccauauuaugucacuuccuugcuugauuucuuucaaugguuuugaauuuagcauaaaauccaaauuucuuauugagaucuagaucuccgaggcccuccauggacugauuucugccaaccuuccuggcuucuucacucaaguuucagccacccuggccucauacugcuuuccccacaccuccaguucuuucucuccucagggccucuugcuauucugcaccucuucccucuuuguacaggggucucaaucccaucgacuggccuuaucuaaucucagaccuguaucuccagaacucauguggguguuaaaaccagacauugaggggauagauuacucaaauaacuuauaagauauuauucuaguauuacacaugaggaaaauugaaggugcagagagcuuaaauaacguguucaagauuauaaaguaggaagcagcauaucugggauuugaacucaagcaaccugucucacagugcucaacauggcuauacuauucuuccugccucauauuuugaaaguguacgcaauguuguuucagguuuggcucuaggugaaguggggagaagaauacaguuauaucaguauucagugcuggaaauagacacuucaagucgaaagggauuuaaucaugaaaauuagguacauuugcaauauuaauaauuaggagaacuggggucaaggguugccacugggccacugaugucaaggacaugccaccauaauugugguacaagaucaggaaacugcucugaggaaaauaccguguacaucacuugcuguuucucugcauauacuucagacucuuguagcuagugucauaacugagucaugccuaggccuucccacuguucuguaaagucagcuacaucugcacauguucaauuuuuaaaaagugaucuaaauauaugauuuaaauauccaaauaugauaaaauauuaaaucugagugauggauauguuugggguauuacauaauauaauuuuuuuaaauuaagaaaauccuuacaguugacauuuaguaaaagaaacucuuauguuucagauuuuugaaaaauauacaaacaacagccgcaucuccaucaacagggcugaaagacaaacaacacugagcaaaauauuugcagcauauauaacagaccaugauauacauugagucuuuguaaaucaauaauaaaacagugaacagaccaauuuaaaaagcaauaaaggcauaaaauggaauuacacaaaagaagaaauguaguauccaauaagggugugaaaaauaauaaucacuaaacauuaguaaaaugcaaauaaaaaccacagugagacaucuuuuuauuuuaaccacagauuggcaaacauaacauuggcaaaaccaaauguuggcaagacaaugaggagacagggacuuugaugcacagauguuuggugggagugaaaauggguauaaccuuccucagaaaggguaguuuggcaguguguaaaugugaaggcaucaucaugggacagugaugugagugauggaaagcuaccaacagaaaaguuacagagaauguaauugcuauaauucauggagauguuacauaaaguagaauacucccagaguaaguuucccagacccccaauccccaguggaaaauacaccugcccaugauacuucccaguauuuucuauacagagggaugagucugccagggacaagaagcuuacacccucucauucuuaugggauccuuauucucccuggccgccuuuugggcuaucugcuuacagggacaaguaacuauuacaaaauaacuugagugucuaccaccaugaauuagauaaauugaagagccaucuuccaaguauaccuuuuuuccugcaaaaccaagucuccggucuaccugaauuucauccaugcaggaucgaaauguaaugggugccuaccauuggucucagaaaucccacuucuagaacuuaccuuaagaagguaauuguguaaauaucauaagauggaugauuacagauauucauugaagacuuucuagaaacaaaaauuggcugaacuuaacugcucaucaauagagacuaaguaaauuaugauauauccauauaaugaucuccucuggagccucuaaaauauauguguacauguugguauuuguaccucuaugcauaaaauucucaaaguggucaggggugaaauugaagaaaauaaauggguggcuaggcaggugucagagagacuucauguauauacuuuuauauguuuaaaauuugaaccauacgaauguuuuuauuuuaaaauuaaaguuaaaaaguaaauacuggccgggcauagugucucacaccuguaauccaagcacuuuaggagggcgaggcagguggaucaucugaggucgagaguucaagaccagccuggccaacaugacaaaaccccgucucuacuaaaaauacaaaaauuagccggguaucguggcacgugccuguaauccuagcuacuugggaagcugaggcaggagaaucaaauuucuugaaccugggaggaggaaguuacagugagcugagaucaugccacugcacuccagccugggugacagagccagacccugucucaaaaaacaaaacaaaacaaaacaaaacaaaacaaaacaaaacaaaaaaaguacagagagagacagggagagagaggagcagagaugccugaagagagccaccagaaguuauagcaguuauuuugggguagcaagauuugacccaacacauuuuauuccuuuacuuuucuuuuuuuuauuccuuuccuuuucuuuuuuuuauuccuuuacuuuucuauauuuuuugaaucuucauaagcaugcaucauuuuauggauguaaaaaauucaaauuacaaaaggaaauuacauaaccauaauaaaaagauaguaaagcccaauuuucacuaaaauauauuuuuaggacccuuccgcaugguguuccuugaagaggacagucccucaccacuccacuucuauucccagcccuugcuucuggaacucuauccuaugaguuuucauuuccuuuuuuauuuuuucccucagaguugcugauggagugaucaaaagcguauuauggcaaacacuucaagcucuuaauuucugucauauacauaacguaaguaacauuuucuaauguauuuauucauuucuucaugaugacucuuuucuucuaaauagcucaggguuuuguuuggagagcugaagacaaagggaaaguaagagccaaagaagcaaaacaaaaggaaguucagccaguaaucccagcaccuugggaggcugaagugggaggaucacaugagccccagaguuugagacaggccugggcaacauagcaagacccugucucugcaaaaaagaagaaaagggaauaacaaaagaaaguucaaaauaugagaaaaaagugaugcauuauucauggcucuuuccaauuucuguaagaaucaaauugcuaauuccuuaugaauuaaaaauuugaauaaauauaaugauuccuuuugccauagugccagugaccccugaaacuauuuuuaaauugggcgagaauaauuuuucagggccgguaugguggcucaugccuguaaucccagcacuuugggaagccaaugcgggcagauggcuuugagcucaggaguucaagaccagccugggcaacauggagaaacucuaucucuaugaaaaaauauaaaaauuagccagccaugguggugcgcaccuguaauccuagcuaccugggaggcuggagcuggagaaucacuugaacccaggaggcagagguugcagugagcugagaucacaccacugcucuccagccuggacaacagagugagacccugucuccaaaaauaauaguaaguuuucaggauauugcugauguaaucccccaugguacuuuuuuuuuuaacuauuauuuuuaagucucuuaaguccuuuacucgauagcaaucuaagugccccuuuccuuuccuuuuuaaaaaccguuuccggccgggcaugguggcucacgccuguaaucccagcacuuugggaggccgaggcaggcggaucacgaagucaggagaucgagaccauccuggccaacacggugaaacccugucucuacuaaaaauacaaaaaauuggccgggcaugguggcgggugcuuguagucccagcuacucgggaggcugaggcaggagaauggugugaacccaggaggcggagcuugcagugagccgagaucgugccacugcacuccagccugggcgacagugugagacucugucucaaaaaaaaaaaaaaaaauucauuaauuuuuuauagccguaguucucaagcuugagcaugcaucaaaaucacaaggagggcuuguuaaaacacagcuuccugggccccacccccagaguuucugauucagucagucuuggguagggccccaagaaugugcauuucucauauuuucccagaugcuacugaagcuguugguucaagaaccacuauguuagagaaauaauuuuggcugacuuuuucuuguauguaauuuaacguguucuuucacuuguauuuccuguaaauuggaguuuauaucuagaggcuugaucauauucagguucagcuuuuuuuaguuaacaaugccugcuauguggugcuguacacuucauaucgcauccccauuaugagguguauagcauccacuugucccacuuucgauaauguuaaaauugaugagugggcucaggagguauucguuugguccccuccauuaucauuuucccugucaacguuguuucccugaugguuuuagcauccagugaugauuauugccuguaucuaguauuucgugacaguaauuuucuaauucuguuauuccuucugcauuuaauaauuggaauuguauggaaaagaacucauccucauggacucugguuacuuuuauuuaucaacacucagggugaugagaugauaucuuagcaacaaugacaaguuuuggggagagguggcuggagcaccauuauaaacacaaauuuuguauugugguguuuucaauucuuugcugucauuggucucucccaugcucagauuuucccaucuuaggccaacaugagcuucuucaaguuggcuccugguaccuuugcuauauaucauuauauuuuugggacagucucgcucuacugcccaggcuggagugcagugguguuaucauagcacccuugagccucaaacuccugggcucaagugauucucccacuucagccucccugaguagcugggacuacaggcacaugccacuacacucagccaauuuuuguuuuuguagagaugggggucucacuaucuugcccaggcuggccucaaacuccugccuuggcugcccaaagugccaggauuacaggugugaaccacugcacucagccaaugauagcuuuuaaaaaaauauaucuagcccuuuugaguuggugccuagacagagacagugcugaggcaaugauacagaguaccauauggucaguuuugaugccagcagaaugucuaucauagcagucuaggauugcugaaaaagaaaguacaagaucaugagaauacauuucaauacggaggggaagcuuucuuuaguuuuaggaaagucagugaaguuuuuauuagguuaaaucaaaagcuuuuauuuucuauuaauguagagggauauuuuucacaaaauacauaaaccuauuuuucaugaugcaaauugugcuuucugaugcuuaauaaagaugaugccaaauggaauccuuaucucuguugcuuuccaccaugcuauaggagauaucaaaguugcugcaggaguuuuauggguaguuaaaaugauuucuaaaaauaccacuuaccacaaguguuuauacuuuaucccuauauaaccagacacuuuccuggguacuugguuauaagcuugaaugcaaugucuguggcugcuuuaucuuuguaucucuuuaauaccuaaauuggauauuuuuauauacagggugaucaauaaauauuuauugaauaacuggauggagggauggguggaugguuggaugagucaaucagucagucaacccaaacugccuaacugauugugacuauuuccaguggagccaaacauuauuguagaccaacgcaacugccaucauuucugugcuuggaacaacacguucuauacccuaagcuuuaaaacacugaaaacuucugacugauaauauguggccucuauuaaaaauagguaauuuuucaggcuaggugugguggcucaagccuguaaucccaggacuuugggagguugaggugggcagauugccugaggugaggaguucaagaccagccuggccaacauggugaaacccugucucuacuaaaaauacaaaaauuagccgggcauggcaaugcaugccuguaaucccagcuacuacucagcaggcugaggugggagaaucacuugaacucgagaggcagagguuacaaugagcuaagaucgggccacuguacuccagccugggcgacagagcaagagucugucucaaaaaaagauaauuuuucagacuaacuucccuccuccaagauggaaauuacuucucauuuucuuaugguaagccuuuguguaucugccuuuuuauuuaucuauaauuaaaaugcuugcaaagaaaaaaaucuaagccauauauaaagcugucacaauaauacaacuaaaaccuuuauacucuccuuauuuuuaaaggaacucccaugauagucucaaagaguagaaaaggcaaucugaccuagugguguugcugacgacucacagcuuuaaaccuguagagaccaugugcaccuuaucaucuccagagucgagauccuaaacaggacacugcagguuaaaguaccaagggauucaggccuugcuacuccaacuaugguucauagagaucaccugggagcuuuuagaaauguugaaucugagguccacuacagaccugcugaaucagagucugcauuuuaaccagagcuccaggugauucaugugcacauuaaauuuggagaagcgcaggacuuaagaaaauacguauucauuugguucucuuuuacccuauaauaucacuagagugagguaaccaaagugguccauuuaacgccauaaugaacccagggauuuuuauauauuugcuguauugauuagagaacaggggcuucaucucaaaauggcaaaaaugacuuuuuuuuuuuuuuucuuccugagacaggaucuugcucuguuucccaggcuagaaugcaguggcgccuucacggcucacugcaaccucagccucccaugcucaaacaauccuuccaccuuagccucccaaggaacugggacuauggcacaugcuaucaugcauggcuaauuuaaaaaaaaaauuuuuuuuuuuuuuuguagagauagucucauuguguugcccaggguggucucaaaccccugaccucaagcgauucucccaccuuggccucccaaagagcuaggauuacaagcaugagccaccaugcccagcuggcaaaaaugacuucugagauaggagugggucaggcugcaaccuccgucagcaucuuguugauacucauguuuugguuguugaggagaggguugcuuuucucucuccucgaugugugagcauccaugccuaaggcucaaagagaauaaauuucucagauaauaaaaaaaaugauuuauuguuuuuaucaggcuauuuaagaagcaauuucuggugugcaaguuugcagagaugauuuuaaaguuaaaagucaguuuuaaaauaccauggauaucucuuuaggcuggccugugagccaaaaaaaaaaaaaaaaaaaaagauugcccgucagccacaacaacugaaccugagcauuguuugcuaaaaacuguguacaaggccaagcauggugucucaugccuguaaucccagcacuuugggaggccgaggcugguggaucaccugaggucaggaguucaagaccagccuggccaacauggcgaaaccccaugucuacuaaaaaauacaaaaaauuagccaggcgugguggugagcaccuguaaucccagcaacucaggaggcugaggcaggagagucacuugaacccaggaggcagagguugcagugagccgagaucacgccacugcacuccagccugagcaacaaagagcgacucugucucaaaaaaaaaaaagcuguguauaaaacucaacuuauuaaaauuauuuuauuaagagagacuugcauguuucuuguucuucgagggaaaauaagcugauugcaagaggcauugcagagaguuugcauugaguguggcuuugcaguggaguaggugaaugcuguaugucuaagcaucuucuuccccccaugcccuguuucuuaugguuccaauuauuuauuuuuuaauuuuuuaaaaauuuuuauuuauuuauuuauuuugagacagagucuuccucugucgcccaggcugggguccaguggcgcaacuacagcucacugcaaccucugccucccagguucaagugauucuccugcaucagccucccgaguagcugggauuacagguacccacaaccacgccuggcuaauuuuucuauguuuaguagagacaggguuucaccauguuggccaggcuggucucgaacuccugaccucaggugaucugccugccuaagccucccaaagugcugggguuacaggcaugagccaccacgcccagccagguuccaauuguuuuuacucccuuuuaaauuucuucaguauccucucacucuuuaucaauaacuucuguuaccugcuccuauaaaauaaauuuuccuguuucuuuggaauaugucaauacuucauuuccuuuuguauauuugguugaaaaauaagugcuauaaauuucacauggauuagaugcagaaaacauauguauaggccaauggacagauauugauguaaauccauuuacuugguaaugcuacacauauagucuagaaauucuagaacuugaugcaaacucauuuaaaggauauaaccuguucuaaugcaaucaccaaguaugaguguuacugacucagaguguuagucuaaguuucuuaaguguguugcuuaaaagguaggauaucaaaacuauguucauuuauauuccaaaaaaaaauuuuuuuuuuugagacagggucucacucugucacauaggcuagagugcgguggugccaucuuggcucacugcaaccuccaccuccugggcacaagccauccucccaucucagcgucuuguguagcugggacuaaaggcacacgccacacaccuagcuaauuuuuguauuuuuuguagagacugaguuucaccauugggcccaggcugguaucaaacuccugggcacaagcgauccgcccaccuuggccucccaaagcgcaaguauuacaggcaucagcgaccaugcccagccuguguauuuuuuuuaauuagugucuaaggccuuaguacuuuuaagagaccuaaaaaaguuucuucuaacugcucuucauacaaauuaugaagcaauugacaguaauugagacuaaauaggaacaagcuccuguuaccagugucauuucugcaaccuaaaaugauuuuagggcucagcucuuuuucucuuccuagauagcuauuaaagaaccaaagacaaucauuucagaauugucaguuugacaaaaaugcuuaaagggccugacagcauaguagaaaaggaggcagaaggaguugauuauugugacacuuaauggacacuuaauucaugacaguuaauucugucaguggccacuugcaaucacaggauuguugcaaggaugaaauaauuuaugcuuugaauugaaagugcuuugaaaaguacagaguucccugugagggcccaguuguggagaucgauauuauuuucauccauuuucuuuuuugggagcguggauaaacuguaaaguccugaaggguacggucugagcuguuuucucacagcaccuccgcaacauggaaacccauuucuggaaugcccaugugcgcgcgggcuuacucagccugcccucacccaggccccuagccgggccgcuccuguccagcgaggagcaucuguuucauucagggucauuaugaugacgcagcaaguuguaaggccgcugcauaugaaagaacagcuggguccaggcgcgguggcucacgccuguaaucccagcacuuugggagaccgaggugggcggaucacuugagcucaguaauucaagaccagccuggacaacaacauggugaaaccagccucuacuaaaaauacaaaauuagccgggcaugguggugagcgccuguaauccuagcuacucgggacacauccguagucccagccacucgggaggcugaggcaggagaaucgcuugaacccggggggcggagguugcagugagccgagaucgcgccacugagcuccagccugggcgacacagugagacucugucucaaaaaaaaaacaaaaaacaaaaaaaaacagcugcuuugaggucagcgugccucgggucccacuuucccaguauggauucugacagcaucgugggccgucucaggaguguugcugaucguuccagguuagcuccggugaggagguggaagugauccccauccccuggcgcggaaugcuucggaaucucugcuaagcaggggacugugcgccccagcucgcccagggcaguccugguuugugccuuuugucggggcaugauuauuaauaggccccucuuucuuucuuucuuucuuuuuuuuuuuuuuuuuuuuugagacggagucucgcuccgucguccaggcuggagugcaguggcaccaucuuggcucaccgcaagcucugccucccggguucccgccauucuccugccucagccuccugaguagcugggacuacaggcgccugccaccacgccugguuaauuuuuucuauuuuuaguagagacgggguuucaccguguuggccaggauggucucuaucuccugaccgcgugaucugcccgccucggccucccaaagugcuggauuacaggcgcgagccaccgagcccggcuauaggccccucuuucacacuuggaagucuccugauuuggaugauaaauaauauggucauucuaauuauaagugaauuuugcuuuuuguuaucauuuaaauguuuuuguaauuucucaaaucugcaaguuuuucaaccugaauugugacucuuggguggcagcaguuauuagagguacucuuaagucuaaucucauuuagaguuuuaccucuuacgguuuaaauaggacccagcaaaaagugaaagaaauaauuguauguuacucucuucuugaauuuaauuuuuuauuuuuauuuuuuguuuucgagacaggguuuagcucaguugcucaggcucugugcagugugaucauagcucacugcagccucaaccuucgaggcucaaaugauccuucggccucagccuccucaguagcuaggaccauaagugcaugccacuuugccuggcuaauuuuuuaacuuuuuuguagagacagggucucauugcauugcccaggguggucucaaauuccuggcuucaaguuauccucccgccucggccucacaaagugcugggauuauggacaugagccaccacacccagucugaaaaucccuucuuuaaaaaaaaaaaaagacaguuuuuauauacaauuauaauuucaauuuuuucaauaauaaaacaauauuuuaauaaaaguuuuaauuuugguaugacaagaguuacaagugaaaaauugccaauuuaaguucuuuuagaaaagugaaggaagcccacauuuguuuuuaucucauaggcuguguaucuguuauuuaaacuaguaguuaauguuuauucuuugucauuuugaugguucagaaaaauaaucaaauaaugaucuuacaguguauucacagagauauaaaaccugaaaauauucuaauaacuaagcaaggaauaaucaagauuugugacuucggguuugcacaaauucugaguaaguagcaauuuuuuuuacuaauacccaguucagaugaugauaaaaugacauaguuuaaauucuuacauuggauauuggacauaugccaaauauuguauuguuguuauucaaaaaggaaaaucucacuuuagccuuuuagucaguacauucguuugcacuucaacucugcuccauucagcuagaauuuaucagaugucaccuuucugugcuuugccccauaggaaaggaaaagauuucuaaaagcauuucuguucuucaugcacuuauaaucuacaguaaaagaaacaaagaauaauacaagaugauuggcaauaaaguacuaaagugaaggugcagacgguucccuggagggagauauuaaugugggcgagagugguugaaaaaaacuucacagagcuggugagacuagaagaguaaacugaaaauuaaagagagaggauucagagagagugcuaagaaaacggaaaucauuccaggcaaggaggaacugaagggaaagggggacaaauaauuguuucucccucaaucuagaacuuuacagcagacaaauauauguauuagcaacauacaccucgcagucuggguguggacauaaucgguauccugaugggacccaaacacgagugauuuggcaaugcauuuggaaggguugggcaaaaacaaaacccgaucaaggcuuucugagguugcugugcuuugugguaaagauaauaggauccuaaugauaauuggucccugugccaugcggcugaaaagagaaauagacaaacacuggaaaacuaucgaguuacaaacgcggcacauaguaccauggugcaucaguaucaugaaaugcugggcugccauuaguagggauguuugcagaguuucaguggcaucggaaaauguuuaagacaugguaagagaaaaaggaaagugaaaacauauguauucaguaugaucucaacuauacaggaaauacauagaaaaaaauuacugaaauauauaugacccucaauuuaggaaauuaagugaaugauagucauccaaugcaugguauagaugcggugucauagauuugggguuuuuuuccuggaaauccauuauauaccaccaaaauacccaauugucacaaaaauaagugaaaaaaccuacacagauacgccauuacaagcauuaagaacauaagagcagcauuucauauaaaaguuacuucauaauuguuccuuuuggggauuuuucuccaugggcuggcaaagcuucuuaaacuggcaauacuuccaaacguauaaauauuuuuaauuuuucaugaauaugcauucuuuuuuuccuuuccuuuuucauuuuccuuugcauuucugagcugaauaugcaagucagcuuuccuacugaguuuuccuguagcaaacauagucauucuugucugaaugaagaaccuuagaacugaguucaauguuagggucaucugucucagaaauuuugacugcaugaacacauccagaagucugaauggugaacccacuguggcaauuccaauaaugauaccuuuugccauauuauuauaaacaaagugguacuacaagacacugccaacuuguuagugcuggcugaaaccuccacaagacaugagcucaggcacugguuacagcucaagucuucuaaguacugguaugagucauugcuggggucauuguuggccauuuauaaugagaaaggcaaaggagggggucccauuaugugauaaaaugcuaacacuggcucaauagacauccacauaaaaauguaagcuccuacuggauauccacaugcaaaagaaggaaguuggaccuuuaccuuacauuauauucacucaaaaugaaucaccaacuuaaacauaagaaauaaagcuuacaaaacucuuaaaagaaaacauagacaaaaagccucaugacauuggauuuaacagugauuucuuggaugugacaccaaaagcacaagcaacaaaaggaaaaauagauaaauuggacuucauuaaaauuaaaaacuucugugcaucaaaggacacuauaaacagaaugaaaagcaacccauggaaagggagaaaauauuaguaaauuuauaccuaauaaagaauuaauagccagaauguucagaacuaugacucaauaacaaaaacuaauuugaaagugggcaaaggacuugaauagacauuucuuuuuuguuguuuuauuucaauagguuuuuggggaacaggugguguuugguuacuugaaaaaguucauuguuuuguuuuguuuuguuuuguuuuguuuuguuuuguuuuguuugagacaguguccagagucuugcucuguugcccaggcuggagugcagcggugugaucucggcucaccgcaaacuccacuuccuggguucaagcaauucuccugccucagccucccaaguagcugugacuucaggaacccgccaccacacccagcuaauuuuuaaauuuuuaguagagaugaguuuuugcaauguuggccaggcuugucuugaacuccugagcucaagucaucugccugccucggccucccaaagugcugggauuacauguguuagccaccacaccuggcuaugugaauaaguucuuugguggugauuucuggaauuuugguucccccaccaccugagcaguguacacugugcccaauguguagucuuuuaucccucacccgccgcccgacccuuucggcugaguccccaaaguccauuguauuauucuuaugccuuuguguccucauagcuuagcucccacuuauuggaacauagauguuugguuuucuauuccugaguuauuucaggaauaaugguuagaauaaugguuagaauaauggucuccaguuccauccagguugcugcaaaugccauuauuuuguuccuuuguaugacuaaguaguauucugcgguauauauauaccacauuuucuuuaucuacuuguugauugauggacauuugggcugguuccauauuuuuucaauugcaaaugugcugcuguaaacaugcgugugcaaauauauuuuuuauauaaugacuucuuuuccucucgguagauacccaggaguggggcugcuggaucaaaugguagaucuacuuuuaguucuuuaaggaaucuccacacuguuuuucauagugguuguauuaauuuagauucccuccagaguguaaaaguguucccuuuucaccacauccaugccaacaucuguaguuuuuuuuuuuuuauuuuuuugguuauagccauucuugcaggaguaaagugguaucacauuaugguuuugauuugcguuucccugauaauuagugauguugagcauuuuuuucauguuuuuguuagccauuuguauaucuucuuuugagaaugucuauucauguccuuagcccacuuuuugaugggauuguuuguuuuuucuugcugauuugaguugcuuguagauucuggauauuaguccucuguuggauguauagauugugaagauuuucucccacacuguggguugucuguuuacucugcugauuauuucuuuugcugugcagaagcuuuuuuaguuuaaguuccaucuauuuaucuuuguuuuuguugcauuugcuuuuggguucuuggucaugagaagucuuugccuaagccaguguuaucuucuagaauuuuuaugguuucaggucuuagauugaagucuuugauccaucuugagaugauuuuuguauaaggugagaggugaggauccaguuucauucuucuacauguggcuugccaauuauaccagcaccauuuguuuaauaagguguccauucaucacuuuauguuuuuguuugcuuugucaaagaucauuugacuauaaguauuuggcuuuauuucugguuucucuauucuguuccauuggucuauaugccuguuuuuauaccaauaccauacugcuuugaugacuauggccuuauaguauaguuugaagucagguaggauaaucccuccagauuuguucuuuuugcuuagucuugcucuggcuagugggcucuuuuuuugguucuauaugaauuuuaggauuguuuuuucaaguucugugaagaaugauggggguauuuugaugggaauugcauuggauuuguagguugcuuuuggcaguauggucgucuucacaauauugauucuacccauccaugagcauaggauguguuuccauuuguuugugucaucuaugauuucuuucagcaauguuuuguaguuuuccuuguagaggucuuucaccuccuugguuaaguauauuccuaaguauuuuauuuuuuugcagcuauuguaaaagggguugaguucuugguuugauucucagcuugguuguuguugguauauagcggggcuacugauuuauguacauuaauuuuguuauccuaaaauuuugcugaauucauuuaccaguucuaggagcuuuuugaaggagucuuuaggguuuucuagauauaugaucaugucaucagccaacagcaaaaguuugacuuccucuuuaccaauuuagaugcccuuuauuuuuuucucuugucugauugcucuagcuaggacuuccaguacuauguugaauagaaguggugaaagugggcauccuugucuuguuccaguucucaggggaaaugcuuucaacuuuucccuauucaguauaauguugacuguggguuugucaucaaugguuuuuauuaccuuaagauaugucccuucugugcugauuuuucugaggguuuucaucauaaagcaaugcugaauuuugucaagugcuuuuucugcaucuauugagaugaccuugugauuuuuguuuuuaauuauguuuaugugguguaucgcauuuauugauugcagauguuaaaccaucccugcaucccugguaugaaauccacuugaucaugguggauuaucuuuuugacaugcuguuggauuugguuagcuaguauuuuguugaggauuuuugcaucuauguucaucaaggacauuggucuguaguuuucuuuuuuuguuauguccuuuucugguuuuguuauuagggugauacugucuucauagagugauuuagagaggauucccuuucucugucuuuuggaauagugucaauaggauuaguaccaauuuuucuuugaaugucugauagaauuuagcugugaaucucucuggucuuggacuuuuuuucauugguaacuuuuuaauuaucauuucaaucucgcugcuucuuauuggucuguucagagguucuauuucuuccugguuuaaucuaggagaguugcauauuuccaggaauuuauccauccuccucuagguuuucuaguuuaugcacguaaagguauucauaggagccuugagugaucuuuuguauuucugugguaucaguuauaauaucuccuguuucauuucuaauugagcuuaguuugaucuucucucuucuuuuauugguuaaucuugcuaauggccuaucaauuuuauuuaucuuuucaaagaaccagauuuguguuucauuuaucuuuuguggguuuuuuuuguuguuucaauaucauuuacuucugcucugaucuugguuauuucuuuucuucugcuggguuuacguuuguuuuuuuccucuuucucuagcuccuugaaaugugaccuuagauugucuauuugugcucuuucagacuuuuugauguaggcauuuaaugcuauaaacuuuccucuuggcauugccuuugcuguaucccagagguuuugauagguugugucacuauuauuguucaguucaaagaauuuuuaaguuuccaucuugguuucauuguugacugaacaaucauucaggagcaggucauuuaauuuccauguauuugcaugguuuugagaauuccuuuuggaguugauuuccaauucuauuccacugugaucugugagaguucuugcuauaauuucaauuuucuuaaauuuuuuuauuuuguggccuauuauauggucuaucuuggcagauguuccauguguugaugaacagaauguauauucugcauuuaugguguagaaaguucuguaaauaucuguuaaguccauuuguuguaggauauaguuuaaguccauuguuucuuuguugacuuucugucuugaugaccugucuaguguugucaguggaguguugaaguccuccacuauuauuguguuacuaucucauuucuuaggucuaauaguaauuguuuuauaaauauggaagcuccaauguuaggugcguauauauuuaggauugugauauuuaccuguuggacuaguuuuuuuuuuuuuaucauuauauaaugucccucuuugucuuuuuuaacugcuguugcuuuaaagucuguuuugucugauaugagaauagcuauuccugcucacuuuugguguccacuggcauggaauacccuuuccccccacuuuacuuuaagcuuaugugaguccuuaugugucaggugggucucauaaagacagcagauacuugguuggugaauuuuuaucuacucugccauucuguaucuuuuaaguggaccauuuaagccauuuacauccaacaucaguauugagaugugagguacuauucaucaugcuacuuguuaccugaauacccuggguuuuuuucauuguguugcuguuuuauagguccugugagauuuaugcuuuaaggagauucuauuuugguguauuucaaauauuuguuucaagauuuagagcuccuuuuaacaguuccuauagugcuggcuuggcauuggcaaauucucucagcauuuguuugucugaaaaagacuguaucuuuccuuaauuuaugaagcuuaguuucacuagauacaaaauucuuggcugauaauuguuuuguuuaaggaggcuaaagauaggaccucaauccccucuagcuuguaggguuucuacugagaaaucugcuguuaaucugauagguuuuccuuuauaguaccugaugcuuuugccucagaguccuuaauauucuuuccuuugucuugauuuuagauaaccugaugccuaugugccuaggcgaugaucuuuuugcaaugaauuucccugauguucuugggauuuggauggcuucuuguauuuggaugucuagaucucuagcaaggccggggaaguuuuccucaauuauucccucaaauauguuuuccaaacuuuuagauuucucuuuuuccuugggaacaccaauuauucuuagguuucaucguuaaacauaauaccaaacuucuuggaggcuuuguucauuuuuuuaauucuuuuuuucuuugucuuugacagauuggguuaauuugaaagucuggucuucaagcgcugaaguucuuucuugaacuugugcaguucuguugcugagacuuucuagugcauuuugcauuucucuaaguguguccuugauuuccagaaguugugacuguuuuuuuauuuaugcucucuguuucacuggagauuuuuccauucauauccuguaucauuuuuuuauuucuuuagguuggacuucaucuuucucuggugccuccuugauuggcuuaauaguugaccuucugaauucuuuuucugccaauucagagauuuuucuccuggcuuggauccauugcuggugaguuagugugaucuuuuggaaguguuaaagaaccuuguuuugggccaggcacaguggcuuacgccuguaaucccaacacuuugggaggccaaggugggcagauaccugaggucaggaguucgagaccagccuggccaacauggcuaaaccuugucuguacuaaaaauucaaaaauuagccgggcguggcagcacguacguguagucccagcuacuugggaggcugaggcaggagaaucacuuguacccaggaagcagagguugcagugagccaagaucacaccacugcacuccagccuaggugacagagcaagacuccgucucaaaaaaaaaagaaccuuauuuugucaucauguuacuggauuguuuuucugguuccuucucauuuggguagacuaugucagagggaagaucugggacuugagggcugcuguucagauucuuuugucccauggggugcuuccuugauguggugcucuccccuuuccccuagggauggggcuuccucagagccaaacugcauugauuguuauuucucuucuggaucuagccacccagagaagcuaccaggcucugggcugguacuaggaagugucugcaaagagucccgugaugugauccauugucagaucuuucagcuauggauaccagcaccugcucugguagagguagcaggggagugaaguggacucuaugaggguccuugguuguauuuuuguuaagcacacugguuuuauguugguugacuugguuguauuuuuguuaugcgcacuaguuuuauguugguugaccuccagccaggagcuggugcucucaagagcacaucagcugcgguagcauaggguggaucaggcaguggguggggccauagagcucccaggagaauauggcuuuugucuucagagcuccuuggcugucccacagagccugcagugguaauccaccuucuucaaagggucuguggauucucuuggcuuaccugguauguuccugugguaguucuuggagcaaaaguucaugauguaagucuccacacgcugcucuguccgucugagucauagcugcaaguuaguccugccuccuaucaaccauuuuccucagaagccaucagaauagacauuucuuuaaagaagauauauaaggcagggcgcaguggcucaaaccaguaaucccagcuaacucaggagucugaggcaugagagucaguugaacccaggagacagagguugcagugagccaagacugcaccacuacacuccagcccaggcgacaaagugagacccugucucaaaaaaaaaaaaaaaaaaauuaauuaaaaauguaaaaaauaaaaaguaaaaaagaagcuauacgaauggccaauaagcacaugaaagaugcuuaugguaaucauuagggauaugcaaaucaaaaccacaguuagauaccacuuugcacccauuaggaugacuauuauuuuuaaaaaacacacagaacaaaauaacaaguguugguaaagauaugaagaaauuagagcccucauucauugcuagugggaaaguacaauggugcaacugcuguggaaagcaguauggcagcucuucaaaaaauuaaacauagaaucacuguaugaugcagcaauuccacuucuagguacauacccaaaaaaauuggcagcagggacuugaagauauuuguaugccaaugcuuauaguaggauuauucacaaugacaaaagguggaaacaacccaaauguccaucaaggaugaguggauaaacaaaaugugguauauacauauaaugaaaucuuacucaaaaagaaaugaaauucugauauaugcuaugacauggaugcaccuugaagacacuaagcugagugaaauaagacagacagaaaaggacaaauaucguaugauucuauuuacgugcucuaccuagaauagucaaauucauggagacaaaaaagaauagugguuaucagggcugggggaagggagaauggggaguuguuguuuaaaggauacagaguuucaggcugggaugauggaaaaaacuuuggaggugcauaguggugaugauugugcaacaccgaauguacuucaugccacugaauugcacacucuuaaaugguuaaaugguaaauuuuauauuauguguauuuuaccacaaaauaaauuuaagcuccuccuauauauagauauauagauauacacagagagauaaaaauuuuaaagucaauaaccaaaggagagaauauuucaaaauugguaauagguugauagauaagagcuuauauaaauugguuuaaaagagaaccacaaaagcucugaauagaaaaauuagcaagauauugacaguucacagaugaaagaaaaggcuaaaaacaugaaauaaucuuccucuucacugauaucaaauaaaugcacauuaaaauacuacucuucaccaaugaagcuggcagaguauuuucuguuuguuuguguguguguuuguuuugagacagagucucacucugucacccaggcuggagugcaguggcauuaucucagcccauugcaaccuccacuuccagggcucaagcaauccucccaccucagccucccaaguaguugggacaacagauauacuaauuuuuguauuuuuguauuuuugauagggcuaauuuuuguauuuuugguagacacaguguuucaccauggggcccaggcucaucucgaacuucuggccucaagugauccuuccaccucggccucccaaagugcuggauuacaagugugagccaccgugcccagccagauuuuucaaacaauaacuacugagagcucacaagauuguuuuuagugggaacacaauuucgaacaaauucuugagaacgcaguaagugcccuuuguaucuuuaauuucacuuuuaggaaucucccauaauccaagauacuacccuccaaaauaauacaacauaauguucauuguagaaccauuuauuacugagaaaaaaauuaagaggaacccagucauucagaaauaaggaaauggcuaaagaauuuaucugacuuaauacuguaaaaauauauuuuuaaaggauuuuaaugacaugagaaacgcuacagcucacaacauggggcuaagugaaaaagaacacauagcugcacacacagacuggucccaauucuauuccaaaagguucacuugguuucucucugggugaugggugauguuuuauuuucuucuuuaugcuuuuuuguauuuuccaaguuuucuacaaagaacauaaauuucuuuaacaauuuuauaaacgggccaggcacaguggcucaugccuauaaucccagcacuuugggaggccaaggcaggcagaucaccugaggucaggaguucgagaccagccugacccacauggagaaaccccgucucuacuaaaaauacaaaauuagccgggcauguuggcgcaugucuguaaucccagcuacuugggaggcugaggcaggagaaucgcauguacccgggagguggagguugcggugagccgagauugugccauugaacuccagccuggacaauaagagcgaaacuccaucucaaaaacaauaauaauaauaauaauaauaauaauaauuuuauaaaugauguuuacaccucucagucuaauaauuccacucauagaaaaucauccuaaaggaauaauucuuuuuuuuuuuuuuuaacagagagagauuucgccauucugcccaggcuggucucgaauaucuaggcucaagugauccaccccguucagccucccaaagugcugggauuacaggcgugagccaccaaaccuggcuccuuuuuuuuuuuuuuuuuuuuuagagauggagucucgcucuguagccuaggcuggagggcagugauaugaucuuagcucacugcagccucaaccuccuaggcucaagcuauccuccugccucacccucccauguagcugggaccacaggcacaugcuaccaugccuggcugauuuuuuuauuuuuuuuguagggacaagauuucaccauguugcccaggcuggccucaaacuccugggcucacacgauccgccugccuuugccucccaaagugcugggguuauaggugugagcuacugugccgggccuugaaauaauucuaaauacagaaaaagcuuugugcagggauuauugaaaaauaaugugguguuauuuauagugacaaaauauuggaaaauuuggggaagguaaaguaaauccugucauaugcacuugguaagcuguuaugcagccauuaaacucaaguuuaggaagaguuuauaauaacaugauaaaugcauagaauucaaugaaaaaaaucaggacacagaauuguguauguaguaugaucaaaaguacuuguacaggccugagcaacauagugagaccucuaucuauacaaaaaaaaaaaaauuuuuuuuuaaauuaaccaggcaugguuucaagccccuauagucccagcuacucaggaggcugaggcaggaggauugugugagcccaggaguucaaagcugcagugagcuaugauugugccacugcauuuuagccugggggacagcaugacccugccuccaaaaaagugguacucagaacuaugcuguaaauaagaaaaagacuccaacaaaauacaccaaaagauuaacacaaaguaccuuugggugguaaaacuuggguauauuuaccuucuuucuguuuccuuauguauuuuuucauguucucugcagugagcauauaugacuuuuaagucgaaaaauguuccaaacaaauaaaacagcugacuuauccugugaauagugaaaauuguuagugguuguuauuuuccuucucauucuccaauuuccaaauuuccauuauggcauuuauuaauuuuuauccuucaaaaguuuauauaacuuuauaaaagagcaaugagcaaguaaagauuauuuccuuuucccacuccuaugaggacuguucucugaccagagcuguagccgcuacuuucugagcugccuuuuguggcagugucuuuggggcuaccugacgacuuuacuaaggagaauugcccauuaccucaucucugcaagucgggcugcuuuccaauuguuccuccucuguaaugcauuuguacagcuccugaucguucaggguccugugaugauucugggauuggcuuccacccacuuggaggcaggugccuuggguccaggcaguccacaccuguggcauagggcagggcugggcagugagggugcaccuagcucucugucaucugucuaucacauaucacacaugacucauacauaguacaaggagucaaauugaggucuuugucacagugggucacauuuggauagaaaaauuaauuuaugcaauugucuagugcugcauuaguuuccuggggcugccaugauacauuaccacaaucugaguggcugaaaacaacagaaaucuauuuucucacaauucuggaggccagacaucugccaucaagguuucagcagggccacauucccucuaaaggcucuaggagaggccccuuccaugucucuauccuagcuucuuuuuuuguauaugugugaguuagagucuuacucugucgcccaggcuggagugcaguggcaugaucacggcucacugcagccuccacagguucaagugauucuccugccucagcuucucaaguagcuaggacgacaagcaugugccaccaugccuggcuaauuuucguauuuuuaguagagacaggguuuugccauguugcccaggcuggucucaaacuccugaccucuaaugaucugcuugccuuggcuucccaaagugcugggaugagaggcaugagccaccaugcccggccucuagcccagcuucugauggaugugggaaaaguuggcauuccugugcuugcaacugcaucacuccaaucucugccuccaguaucgcuuggcauucuccaugucucugcaucccuguaaggauucaagucauuggauuuagaguccacccuaaucuaauaugaccucaucuugacuaauuaauuacaucugcaaaaaccuuauuuccaaauaagaucacauucacagguagcaagaauuaggacuucaaccuaucuuuggaggggacacaauucagugcacaacaaccaccaugcugaugguaaaguggaaaccaacaaugcgguuuagacuuaaagucacacuccagaaauucucauuccccccaucccuaucacaccacccgccaccccaguuuggaguaguaagagauguuaauuaucuaaagugcucuugaaugucaaauuuacuaucucaaugcacaguaacuguuuccucaauuagugccucaaugcauuaacccuuaagaguaucauggccucugaugguuauugcagccugaaugccugauguguucuugggagcaguucacauguugggagaauugacuuaccugaucugauugaugcauuugcaguuccaggagaugccuacaccgauuauguagcuacgagaugguaccgagcuccugaacuucuugugggagauacucaguaugguucuucagucgauauaugggcuauugguuguguuuuugcagagcuccugacaggccagccacuguggccuggaaaaucagauguggaccaacuuuaucugauaaucagaacacuagguaugaauugcauuuuauggcaacagaguugcugaauuguuauagcauucauauguuacuauaauaaaaaauaaauaaauaaaaauaaaaaacaagaguuuuauugcuucuucaaagugucacucaggaugguuguucucaguucuggguuguagccaaagcccaauccuuuucuaaacaugcagaaccguaacuccucucagggagcucucagaucccuuugcaggaaaagucaauuagccauggaauaaacuauacauuuacuuuccauaucagacuaagauagggauaaggauaugagucagcugccuagagcuuaaucuaagauauuugaucaaaugcaauuucuguccacuguaaaagagguuccccccuuuacucuagagcaggaaucagcaaauuuguuucuauaaaaagcuauaugguaaauauuuuagguuaugcaggcuguacagccucuguugcaguuccccaacucugcuauuguagugcaaaagcagcaauacgcagcaugucaacaaaugagcauagcuguguuccaauagaacuuuauuuauggacacagaaauuuuaauuuauuguaguuuucacgugcaacaauaucaaaaaaucuuuuuugacuuuuaaaaaucugcuuaaaaauguaaaaccaauucugaggucacaagcuguacagaaacaggcaguaggccagauuuggcccacacuccugcccgagauccuaagagucugauuuuacuuccugauuagggguggcugcugaaguuuagaauaauguuaacacaucuucuuuguauaguacuuaagaauuuacaaauuacuuucauacgcaucaucuuuuucagucuuaagaaaaaccuguuaaggaaguuauaauguuuuuaauugugccuauguuauaaacgaggaaacagaggcuuagggagcuuccaugauuggccugaagucauauagccagguaagugcagaauaggaaugagacugcaaggguuucuuucgugagcuuucauuaugugucagcauaacccgaaaagugagccacagcuucaugccaacagcauggaugcaaagaaagugacaccucuacacacaaaaugagaauuuguuaauuucuucccacaggcucuccuggcagcauggcugcuggacaguucccuggucaguuccaacauauuauggaaaauucugcagcaugaaaaaugugggguagauuaccacugcaggccacacuuuguuugucugauucauucccuaaaaagauucuggaaauuuacauuacauaccugaguuuaaauccuggaucuguuaaguuacugugugaucuuggacaaguuauuaaauuucucuaagccucauuuuccucauuggcacaauggggauuuaaaauagcaacuacuccaggcugggcaacauaggcagaccccauaucugcaaaaaauuuuuaaaaauuagcuggacaugauggcgcaugcuuguaguuccagcuacucgggaggcuaagguggaaggauugcuugagacugggagaucgaggcugaagugagccaugaucaugccacugcacuccaguuuuggcaacagagagagacccugucugaaaaaauaauaacaacuauuguugugagauuaugagaugaagucucauaaaaucucauuuaugagauuaaaugagauaauguguguaaagaccauaguaccauucucucaccuugucuuuuuuuuuuuuuuuuuuuuuuuuuuuuuugagacggacugucacucuguugccaggcuggagugcaguggugugaucuuggcucacugcaaccuccgccucccaaauucaagcgauucuccugccucagccuccuaaguagcugggacuauaggugcgcaccaccacacucagcuaauuuuuuguauuuuuaguagagacgggguuucaccauguuggccaggauggucucgauuucuugacuucgugauccaccucccucugccucccaaagugcugggauuacaggcgugagccaccgcacccagccuucaccuuuugauggaggcugaauggugaccacaugugacaaagagacugguuugggagaacuggccuuaccugagaaggcaugcgucugcagaaucccauuccucucaucucuggagggaacaaucaggcacaauauuucuuucacaccugcacuucaggcguuaacccuguuuuuuguuuuuuguuuguuuguuuguuuuguuuuguuuuugagauggagucuugcucugucgcccaggcuggagugcaguggcaugaucucagcucacugcaagcucugccucccagguucaagcgauucuccugccucagccuccugaguagcugggauuacaggcauggaccaccacgcuuggcuaauuuuuguauuuuuaguagagacgggguuucgccauguugaccaggcuggucucgaacucuugacgucaagugauccaccugccguagccucucaaagugcuggaauuacaggugugagccaccaugccuggccuucaggcauuaaccauuuaaacacuugauuauucuuugccaaauuuaugaugaauuaugugguuuguauuuuacaggaaaauuaaucccaagacaucaaucaaucuuuaaaaguaacggguuuuuccauggcaucaguauaccugagccagaagacaugguaagcugcucuguuuugaauauuuuauuacuuguguugcggcuuucuuuaaagagguaguuguuauuuauuuauuuauuuugagaugaugucucacucugucaccaaggcuggagugcaguggcaaggucauggcucacugcagccucaaccuccgagacucaagugauccucccaccucagccuccccaaugcuggaauuacucauaugagccaccaugccuggccuguuucuuuuuuaauauuuguguuuuuggcuucuguuuuccuugugacauauuagcacaguguauuauucuauuuucacacugcuguaaagaacuuccccgagacuggguaauuuauaaaggaaagagauuuaauugacucacaguccagcauggcuggggaggccucaggaaacuuacaaucauggcaggaggggaagcaggcaccuucuucacaaggcggcaggagagaggggugagggcacaagggaaaacugcuacuuuuaaaaccaucagaucucauaagaacucccuuacuaucaugagaacagcauggaggaacccccgucaugauccaaucaccucccucucuccacacaugggguuauaauuugagaugagauuuggguggggacacagagccaaaccauaucacacauauugaagaaacuauauaaaaacuacauuacaaugagccaggaaaaaugcuuuaaauguuuacuugucuuaucuauucaaaaauuaauguuaaauuuaaagugaaaauauauuuaguaucuuagauacuacauaauuuuaauccauuggucaaagccuuaggagaauuuucccuuaaauaauuauauucucauaaagacuacuuauaguagucuucuuuauuuugaaaaaaaaagcauuuaaaauuuuuucggcuuguaaaacaaagcucaaaucaaucaaaagcuuuuuucacaacauauauuuuuacaugggagauuguuuuacaaaaugauccccauuguacucauuaaacuccaaaucacagggaucaucucucuacucuugcaauggucuuugccuuuauuugaaaacauaucaaugacuauuugacucucucucuugcucucuguagacauugacuuccuguguguguuaccuaaguucaggcuaugcucuuuaaagcuccauaugguccagaaucugccuguaaaagaaaaaacugucaagaaaagcauguguccacacuccaacuaugcuggagucagagccacgcagggauggggcaaagucugagaaggcaaaucaugaucuaugauagaugugaacuguccaaauaaccugagguccaaauggucccaaccaucucuagacacccuguucauuuuaaaucaauuauuucauauaauaucuugauuuauauacugguuuucuuuuuuauugucuuuguuaaagccuuuaacaaauguaauauaagguuaaagguugaacugcaagguuaaagguuacaaaggaauauuuauauaacguguguuuaaagaauaaacuacaacaaacuuaagugucuuaaguuucccaccauuaucuuucaggcaucuccauccccuucuuuccucaucauucugaauguuguguuuuucauucuuuugauuucuguagugcucuuaugcauguaguccaauguauuuucaugaauacucaaaagcauccuuagaaguagaucaggcacagauuuuauagcacuguuguaggauuucagaugggagcauuugggacccacauuuacccagcaucaacugcaagacauugugaaauuaagaaaauuaacuucaguuuuauguauuucagaucuuuacauacaguguacaauuauauaaaagagugauuuaaaaaauauauuuaaagccaggcgcgguggcucacaccuguaaucccagcacuuugggaggccgaggcaggcggaucacuaggucgggagaucgagaccauccuagcgaacauggugaaaccccgucuguacuaaaaguacaaaaaauuagccgggcguguggugggcgccuguagucccagcuacucgggagacugaggcaggagaauggcaucaacccgggaggcggagcuugcugugagccuuguucgugcugccacugcacuccagccugggcgacagagacucugucucaaauauauauauauauauauacacauauguauauauacauguauauauacauauguauauauauauguauauauacacauauguauauauacauguauauauacauauguauauauauauguauauauacauauguguauauauauacauauguguauauauauguauauauacauauguguauauauauguauauauacauauguguauauauauguauauauacauauguguauauauguauauauacguauguguauauauguauauauacguauguguauauauauguauauacacauauguauauauauacauauguguauauauauacacauauauauguauauauauguguguguauauauauauauuuaaaaugaauuauugaaccuacuagagagucuuucuuuaaaguguuguuauuacuaauauauucaaaauauaggccaggugaguuggcucaccccuauaaucccugcacuuugggagacugaggcagaagaaucacuugaggccagaaguuugagaccagcucaugcaacauagcaagaccccaucucuacagaaaaauaaaaaauuagcugugugugguggcacccaccuguaguccuagauacuuaggaggcugagguggaaaaaucucuugagcccaggaguucaagguuaaaguaagcuaugaucaugccacugcacugcagccugggagauagagggagacaguaucucuaaauacacacacacacacacacacacacauacauacgcacauauauacacacacauauuacuuuguucuuauguaauauugaauguuuuaaccuuguuuuucaggaaacucuugaggaaaaguucucagauguucauccuguggcucugaacuucaugaagguacuuaagaaucaauuauaacucuuauuagcuauaaauuguaaugacugaagcugguaauuugaggagggguggacaguggauuaaauaaugccaaaauaggauguagucauugaaaaugauaaagaacuguaaaacaauuccaguuaaagggacaucauugguuuaagcaguaauuguucuaacauaucuauuaacauuaguagaugaggcaaaaucagagccaugcagacaccagaccuagcuccugcacuaggcccaagagagacgccaaaccaaggacagauucaaauaaaaagcagaagaaacuuaccuaugccuagucugccauucauggcgccacacuagaaggugugugacccugucauacauuguguauaccaaaagcucauuggacaaaggguaugaggauaccagagaggguaucuaccuuugacaaucaauuaaguucugucuacaguagugucuuccaaauguggcuauucaucagaauggccugggaacuuuugaaaaauacagauuccaguaucuagccucagauucagaaggggaauuuucaugagugggaccuuggcauguguaucuuuaaacaugcccuuaggugauuaugauaaacagcucaguuugagacucaucugaucuagacgguggggccauuuggaugaccuagagucaacuuuuguagaccagccuuugugcgagugcuggucacugccauggugcuauccagagugcuggagugcuucaaccuaaguccuccugagagucagagccugauaccccugugcucucagacuccccauaccauugcuccaccugaccucagcugccaucuacccuaucuuacugcccagaucugcuuucacccagcacucagcagguccuguccuagaagcccaguucccugaccuuguucuugacagguuguucugacccacuugcaauuuagcaaaaccugcaagggagaagggagacaucaagcacugcaagcccaacgaauucucagauggaagccagagacaaccugugguucccuggaaagcaacucuggggcaugaaaacugcaagauauaggacaaguucccuguccucaucuccaaagaugaagagcccugguuggcugccuaagguuuuagaugaaucuagguuuguuacucgacuauuuuauuuagacccauaaguaucaaccuaagacccaagaauccucucagugcaucaaggauugugcuguuucauggaccacacccuaucuuauagauuccugccccauauuagaugagagaagacuuuaauucuuugcaauugagacauuuuuuuuuuuuugagacagagucuugcucugucgcccaggcuggaguucuccgcucacuguaaccuccgccaaccagguucgagugguucuccugccucagccucccaaguaacugggacuacaggcacacgccaccacaccagacuaauuuuuguauuuuuaguagagacaggguuucaucauguuggccaggauggucuccaucuccugaccucaugauccgcccaccuaggccucccaaagugcugagauuacaggcguaagccacugugcccagcccaagacaucuuuaauggcaaauaaguacuggcuaccauaacugguguuuaucccaugggaccgaaucauaaccuaugcagggacugcucagguggauggcguauuuggcaauggcagagucaaggagagugguggcaugcaguagccaaucuauggcaggucuucuguguucucuucauuagguuuaaaaugagaccaugagcacaaucuuucuuauuuauuacucauuuauuuccauagucaugaugauccuaucacuauaucagcuucagcugguccaucaagaagaagacuauagacuauuagaaauuuuaucagagcguuuucugugaaauuugaaguuuggauuuaagaaaaggauccugacuuggacuuuaccauuuugauuucucauuucucaucuuccagauguuuucuggguuaggagcacaucuacagggaacaccucugauuaauucuucagcuucuugauauacagaaaguuauuaauccaggcaggcaaggacucagaagccucaauucuacucagcucaucucaaugcuucagaauuaagcaggacauuguuccagcucagacuccauggagagagcucagcauuagcagugucuucuaagaaucuaaaaauguucuuuaaaaugaaaauucauagguauuuagugauggacuagauuucaauaguuuugaaagcccauauaaaaacaugaaugaggcugggcaugguggcucaugccuguaaucuuagcacuuuaggaguccaaggcaggaggaucacucgagcccaggcauuugagaccagccuggacaacaaagucagacccugucucuacaaaacauaaaaaauaaauaaaaauuauucaggcaugguggcauuugccuuuagucccagcuacuugggaggcuaaggcgggaggauugcuugagcccaggagcugaaggccgcagugagccaugauuaugccacugcacuguagccugggugacagugaaaccucaucucuaaaaaaaaauaaaauaaaaucaacgugaauaaauucaagauauauuugaaaggaaaaccgauaggacuuaauuaucauugauauauggggaauaaaguagaagagguggcaaggguacaguggcuguauugcuuuuucagguauuggcaggucugggcuuucucugaaaacucuuggcaagguucuuuccuugccucuuccagcuucuuguagccccaggcauucuuucacuugugacaauguaacuccaauuucuaccuccaucauagcauggcauucacucugugugucugucuacaccaucuucccucuucuuauaaggaaaccaacuguaauuggguuggggguguacuccaugccauuaugaccuugucuucacuaauuacaucugcaaagaacuuauuuccaaauaagguaacauucugagguccugggaguuagaacuucaacauacauauuuuugcggcgauacaacucaacccauaacagugaccuugaggcagauguuaaguaagcaguugcaccugcaggucuggaguucacaggggaggucuggaauggaauuguagauguggaaaucucugguaaacuuugauaauugaagccauaggcagcaaagagaucaccuagaaaccaagaacagaugagaaaaaaagggguggcuaggauuuggccuugaggaauuuuauccaaccauaguggagaacauaguagagaagaagauaaacuagcaaaggcugguuugaaaaggaguggccaggagggaggagcaaggaaagugagagauuagagaagccaaagagaaacaaaguuucaaggagggcuuggucaguagugucuaauacuauugagaugagagagaauucaaaauacauaauggguugaaggauauggaaguagaggucagagguauuaauaacaagagccacuuuaauggaacaguggaagcaaaagccagaauagagugauaaagaaguagagacuaucacaguuuguauucaaaauaguauuucuggccaggugcaguggcucacgccuguagucccagcacugggaggccgaggugggcagaucacuugaggucaggaguucgagacccgccuggccaacauggugaaccugucucuacuaaaaauacaaaaauguacucagcaugguggugcaugccuguaauuccagcuauuugggaggcugaggcaugagaaucgcucaaaccugggagguggaguuugcagugagccgagguggcgcuacugcauuccagccugggugacagaacgagacuuugucucaaaaaaaaaaaaaaaaaaaaaagucuuucucuccugauuguagcccuaacaguacuaggauuugaggagaauguuuuuccagcagcagcuggaguugauauauggcaugggucauuaauuaggggucaucugcuuggaccaggcaguugacaaggagggaccaguaagucuaguuuuacugagcaggauuguuucuugaagaacaggacuaaucagaucccucgccaagggccaggugacacugcuuaggggcaggcagcuucagggaucucagaaaucugaggucagcuggggucagggaggaacagacaccacagggcagugcccggcuggggcagccucaggcaacgcaauugucugggcuugagaaugccucaaaacaauguuugugcugguggugagccuuauuucucucuuaugauggaaggcaauaauugucaggucgucugugccuguguauuguaaaacugcuccuuuuaaaaauguaaauaaaggagagaugcggucucacuauguuacccaggcuggucuagaccucuggacucccaaagugcugggauuacaggcaugagccaccaggucuggcuuaaagcugcucuuuauggaucauaaucuguguuuauugaugggcaaagucccacugucuggcuggaguaucaguguuucucagagaaaaccucuuugugucaggacccccacugaccccucugcugugauacuccuccccacucucagaagccgaccuagaggcuucuaauggucucaaauauagaagggucauaaugucaccuuuucuguuuugccuguaguuauuuuuauaugaauauauagucaauuuuuccuuguuuuagguucauucucaugacugagguucucacuuccucagucaucuccuuaacccagugguucucaaaccugagcauaugggcaucggaaucacccagagagcuucuuaaacacaaacugccgggccccaccuccagugccucgauucccuuuggcaggcgggguauaggacccaagacuucgcauuucuaggaaguuccugcgacgcugauguuuuuaguccagggacuauacucugcagacugcuauaaacgauuugcuuucagcagugauuuuaaaaugucauuggugggaacaccagaucuacagguggccucuuucagagagacacugaccauccauucauucugcccucaaaagacuuugaaguaggaaaaagaagagcaauccuagcuauuagcaagcuccaacuacuugauaauacacaaacuggaagauuuucuaaacucauauuuauccuagcaaguuauucaguuugugggcacgguaacaaaaugagccccucccuuaacaucuucuuugcuauucucuuccuccaaaggggugucugaagaugaauccagaugacagauuaaccuguucccaacuccuggagagcuccuacuuugauucuuuucaagaggcccaaauuaaaagaaaagcacguaaugaaggaagaaacagaagacgccaacagguacuuccgcucaaaaguuaaagugcuauaaaaauaauuccuuuuuuguuuuuguuugucugccuuucaaagugagacaagguggacaccaagaccuuucauuuguacugguguaguuguauuugucuagcuuaauaaauauugguaauugauguaauaaaaccauagaacuaugaaaauaucaagauuauugcaaaaaucuuauuccaaacacaccugaaucaaaucguuacgcaacucuuuggcugcucugauuggauaucccacccacaagaucguauacccauaauauaacaacuucauauaauaaaaugcugauuccaacaggacugaguuuugccagcauugcaaaggaauccaagugccuuucuguagccuccagaugugcaauaacgguaacuugacucuuccaucuuuucacccacagcaggcaccuaagucugccuuuccuaggcuuuuucucaaaaccaagaucugccagguacaaaggaaugaaacccagacaucugggaaccaaauucuacccaaugggccaauauugcagaacaguauggugacuguuaugacaaacauuaauucugcaguuuaucaggugacuguccuucacuugcuuucagaaaacuuugaaguuaaaucguaa

SEQ ID NO: 192727 - RNA, 8111 nt, Homo sapiens
ggagaggagggucaccaacuccaggcagggcugcuaaguuuauuacaaacaggcaagacuagaauauguuuccacuuuagugaguggaaaccuaaucauucauagguauccuguacacacagaacaacuaugaugaagagugaggccuaaaucagaggagacgaggacaauaauaguaguaguggucaugaugauaauaauaacuaccagacaugaagauuaaccaugccuaacauuguguuaaacgucucacuucuuucauuuaauccuuacaauaauccaaugauguagcugcuauuauuuuuauuauacagaugaagaaacugagggcuugagggguauacugcuuugccaaagucguacaaaugguaagugcagaaccaggaucugaauuccgucagucugacugcagaguccacgccgacaccguggaagcuggugaugcccauuaggcccugucugggcaugaagaggaugcccucccucaugagcuggaacacagcauccccuguuguggguguggcucucuuaaagaccaucuggugaauuuugcuugugcugguuucuuauuaaacaaccuucagauuuggcuucacgugcaacucacauagagggaaaggagaccaugauccgccaacaugacagcuguauuuuucauuaguaaauuagcaaacuggcugccugggucaccaugcauaccuguuaaggugagcccgccccagagcuaaaggcuaccaugugccaacuuaacugagauucugagugugcaaggauaacccccgucauggccccgggugccaaggaaaucccuuuuagccuccucuuggcagacuuggccagccuuccccagugacagccuggcucuuuggauucaagcugccuggucagacugcaagggucaucuguacaaagaaggaagcaacagugccagguuccagcgugcguuccaaguuccacauucugugugcagacucccaacgccagagcaaaggcaggccccuggcaggggacugguaaggcuucaccugauauauuucuuccuauauacacguaaccuggggcuuccuagaccuuguacuaugucugcuuucauugacagugguuccuaaagcuggucagcaucacgguuacccggggagccuuaaaacacacacacacacacacacacacacacacacacacacacacacacacacacaaaauugacuugucuuauuuaggagcagaaaaugcuuuugcuguaguuacaaaaugcagguuuuuuuuaaaaguacauccuaaaguaaugaggaguggauggcccaaauaaauuuucuuucugacuucuaaugacauuuuguaagauugaacccaagggcuuggucuuugucacaaacacugggugguuuuuccaccaagcuugggaagugguacggguuucugggauagcauuuguguguguguguguguguguguguguguguguguuguguguguguguguaacaaauguuuaagaguaugguacaguacuguuaacuguauguacguuacuguacagcaggucucuagaacuuuuucaucuugcaucacgaaaacuacacccauugaacagaaccccauuuccccuacccccaccccuggaaagugucauucuguuaauauuuccugguuccaugaguuugacuacuuuagauaucccauaaguggaaucaugcaguauuuaaucuucuaucaugggcuuauuuuacuuagaauuauguccucaaaguccaucuauguuguaacaugugacaggauuuucuuccuuuuuaaggcuuuauaauauuccauuuuauguauacaccacacuguuuuuauccauccaucaguaagcuuguagauuguuucuaccucuuggcuauuuugaauaaugcuucccugaacauuggugugcaaacauuucuucaagauucuauuuucaguucuuuugaacagaagugggauugcuggauuacaugguaauuccauuuuuaacuuguugaauaaccaccauacuguguuccauagcagcugcaucauuuuacauucccaccaacccagugcacaggaguuccaguuucugcacauccuugccaacacuuguuauuuucuuuuucuuucuucuuuuuuuaaaaaauaaugaccauccugucaggaguaaagugauaucucauugugcuuuugcuuugcauuuacuugaugauugauguugagcacaugauguuuuccuaugccuguuggccuuuguaugucuucuuuagagaaaugucuacucagguguuuugcccauuuuaaaaucaaguuuguuguuguuguugcuuuugcuuugaguuguaaaaguuccuuauguauucuggauauuaacuucuuaugagauauacgguuugcagauauuuuucccacuccauuggugaccuuuucacucuguggauuguuugauuugcugcauagaugcuuuuaaauuuuaugcaaucucauuugucuauuuuugcuuuuguugucugugcuuucucugucauauccaagaaaucauuggcaagaccaguguuaugaagcuuuucccguuuguuucuuucuaggaauuuuaucguuucaggccuuacauuuaagucuucaaucaauuuuuaguugauuuuuguguaugcuuaaaauaaggguccaauuucauucuuuugcauguggauaucuaguuuucccaacaccauuuauugaagaggcuaucuuucccccauuauguagucuuggcacccuuauugaugaucauuugauuguaaaugugggguuuauuucugggcucuucauucuuuuccauuggucuauauaucuagcuuuaugccaguaccauacuguuuuaauuacuuuaacuucguaguauauguugaagucaggaaaugugagaccuuuagcuuuguuguucuuucucaagauuguuuuuggcuauuugggguccuuugugauucuauaugaauuuuagaauucucccacccuauuucugcaaaaaacagcaucaggauuuugauagggauugcacagaaucuguggaucauuuugguuaguauggacauuuuaacaauauuaguucuuccaacauaugaacaugggaugucuuuccauuuauuuguuuuuaacuucuuucagcaauguuuuauacuuuucaguaaacaaguauucuaguuccuugagguguaaaguuagguaacuugagaguuuuuuuuuuuaauauagaguuuacuacuauaaauuuuccucuuagaauugcuuuugcugcaucucauaaguuuagguauguuguaguuucauuuucauuuggucucaagauauguucuaguuuucuuuuugacuuauucuuuuaaaaauuuuuuuuagagauagggucucauucuguugcccagacuggagugcacuggcaccucauuagcuuauuacagccucgcacuaccagguucaagcgauuccugcuucagccucccaaaguguugggauuauaggcaugagccauugcauccggccugacuuauucuuuaacccuugguuguucaaaaauguguugcuugauuuccacauaugugugaauuuucuaauuuuccuucagcuauugauuuccgguuucauuccauauaguugaaaagauaccuggugugauuucaaucuucuuaaauuuauugagauucguuuuauaaccuaacaugugaucuguccuaaagacuguuccaugugugcuugagaagaauguguauugugcugcuguuggguggaaggcucugcauauaugucuguaagguccauuuggucuaugguguuguucaaguucucugcuuuuuuacugauuuucugucuggauauucucuccauuuugacaguaggguauugaaauuuccuacuauuauuguauugcugucuauuucuuccuuugguucugucaaugcuugcuucauauauuugggugcucugauguuggguacauauauauuuauaaguguucuaucuuccaggugaauugacucuuuuaucauuauauaaugucuuugucucuugugacaguucuugacuuaaagucuauuuugucugacaucaguauggccaccccugcccucucuuguuacuuuugcauggaauauauuuuuccauccuuucacccucagccuguguguguccuuaauuucuaaaauuagucucuuguagacagcaaauaguaagaucuuguuuauuuuuguuaauccauucagccacuuuauaucuuuucauuggaacauuuaauccauuuauauuuaaaguaauuacugauagagaaagacugacuguugcuauuuguuaacuguuguuuuuuguuuuuugucucacggcuuuuugucucucuuuuccucucuugcuaucuuccuuguguuugacucccccauaccugcccccaaccccugguggcaacauacuucaauucuuuucacauuuucuuuuguguaacuuccaaagguauuuucuuuguaguaacugugggcuaacaugaaacauguuauaauuuuaacugucuacuuuaagcugaugaauuaacuucaaucacaagcaaaaacucuuuuuuuaccccccaacauuguuauuuaugucacaaauugcaucuuuuuacauuauguauccauuaacauauuuuuauaguuaugguuacuuuuuauacuuuugccuuuuaacuucuauaccagaauuaaaagugauuuacauaucaccauuacaguauuacaguauucuguauuugccaauaucuuuaucuuuacuagugagcuuuacacuuucauaugcugucuaguggccuucuguuucaaauagaaagauuccauuuaguauaucuuguaagguaggucuaguggugaugaacuuccucagcuuuuguuuaucuagcaaaaucuuuaguuuucuuuccuuuuuguaggacaguuuuuccaaauauaguauucuugauuagcaggguuuuuuuuucagcccuuugaauauaucaucuuacucuuuccuguacuacaagauaucuacugagaaauccacuguuagucuuauagaagcucccuuauaugugauggcucuuuucucuuucugucuuugacuuuugacaauuugauuauaaugugucuugauaaggacuuuuuuggguuuaucuuaguuggaguccguuagacuucuugaaucuggauagacauuucccuccccagauuugagaaguuuuggccauuauuucuuuaaaaacuuucuauccuuuuuucccagccuucuuuugagacucccauaaugcauauauuggucugcuugaugauguccuguaagucucuuaggcuuucuuuacucuuucucauucuucuuuucuuuuugcuccuuugacuggauaauuucaaauguuauaucuucaagcucacugaucuuuuccuguugaacuccucuagugaauuuuuucaguucaguuauuguauucuucagcuccaaaauuuguuugguucuuuuucauauuuucuauaucucuuuugauauucucauuuuguucauacaucauuuuccugggcuuguugagcaucccagggaaccuuuuaaagauauggcuucccagaccuuacuggcagagauucugauucaguagguguaggguuggggccuuaaaagcuguauuuccuuuuuucuuuuuucuuuuuauuuauuuauuuuuuugagacagagucucacucuugucacccaagcuggacugcaauagucgaguucagcucacuggaaucuccaccuccuggguucaagcgauucuccugccucagcccccugaguagcugggauuacaggcauccaccaccacacccagcuaauuuuuuuauuuuuaguagagaugggauuucaccauguuggccaggcuggucuugaacuauugaccucaguugauccacccaccucggccucccaaagugcugggauuacaggcaugagucaccacacuaaaagcuauauuucuuaaagauccuccaagugguucagauauacauccggguuuggaaccacuucuaguaaaaagaccaccuucaaucucuuccccuucccuuauauaagcuuuagggaaauggggaagucuaggcuuauauaaagaauauaacguguuuuguuguuguuguuguuuuugaaauggagucuugcugugucaucaggcucaaguacaguggcgcgaucucagcucacugcaaccucugccuccuggguucaagcgauucuccugccucagcccccugaguagcugggacuacagacacgugccaccaagccuggcuaauuuuuuuguauuuuaguagagacgggguuucaccauguuggccaggauggucuugaucuccugaccucgugauccacccgucucaaccucccaaagugcugggauuacaggcgugagccacugcgcccagccauaaaguuuuuaaauaaaagcuucggggaagugaauagauaauggauagaauaugcagacagaaaaucaguaaagaaacagagaacuugaacaacgcuauagaccaaauggagcuuacagacauauaugcagaacauuccacccaacagcagcagaaugcacauucuccucaagugcacauggaacauucuuuaggaugaaucucauguuagguuacaaagcaagucucaucucuccaaggugccauuuuccgcuuaguaguacuccuuuuucucuguaucguuugaagguucuuacaacccuccuaccuccaggaaggauucaauccuggcuggauuaaauccuggcugaccaugaguuucuuaagacuuuccccaacccuccugaccccaaauguggauaugcuuuccauuuauguauuaauuugguguuuccauucuguuggcuugcuaucugagucuuaggccacugcuguguagagaacuucuggacuaggucugcccuaacuaccucauuauuauuugauaacaaugagagugaguguagcagggauagaauucuggagauccugguucaagucucauucuucuagaguauaaccuuagauaaauuguguuccuucucuggaccucaauuuccucaucugugaagugagggguauauauacagucucuguaauccuccucuauagccucugacuuucucuuucauccucuuguucacugguauagcugagaaaguggaacuccagagacacuccugaaauuguccuaagucaaaggagccaaacgguguacgagcucccucucugccguccccucugagagcagccauggcccugagugaugucgaugugaaaaagcagauuaagcacaugauggcuuucauugagcaggaagccaaugagaaagcagaggaaaucgaugccaaggcugaggaagaguuuaacauugagaaaggacgccucgugcaaacccaacgacugaagauuauggaguauuaugagaaaaaggagaagcagauagagcagcagaagaaaauccugauguccaccaugaggaaucaggcgaggcugaaaguccugagagcccgaaaugaccucaucucagauuugcucagugaggcgaagcugagacucagcaggauuguggaggacccagaggucuaccaggggcugcuggauaaacuggugcuccagggucugcuccgacugcuggaaccugugaugauuguacgcugccggccacaagaccuccuccugguggaggcugcuguacaaaaagccauccccgaguacaugacaauuucccagaaacauguggagguccagauugauaaagaggcauaccuggcugugaaugcagcuggagguguggaggucuacaguggcaaucagagaauaaagguuucaaauaccuuggaaagccgacuggaucucucagccaagcaaaagaugccagaaauacgaauggccuuguuuggugcuaacaccaacagaaaguucuuuauauaagccucugggaagugaagcuaguguugaaccacuaaaccauaaaaguuuaaguuuuuuggggaaaggaaacuaguaguguuuccuccucuuugaugcucugauacuguucuguuuuucuucacgaaauacccuuuggauagcuaaaguguuaacuuugaaauaaagcccaaauuaaugcucagaa

SEQ ID NO: 192728 - RNA, 80098 nt, Homo sapiens
ggcgggaaacagcuuaguggguguggggucgcgcauuuucuucaaccaggaggugaggagguuucgacauggcggugcagccgaaggagacgcugcaguuggagagcgcggccgaggucggcuucgugcgcuucuuucagggcaugccggagaagccgaccaccacagugcgccuuuucgaccggggcgacuucuauacggcgcacggcgaggacgcgcugcuggccgcccgggagguguucaagacccagggggugaucaaguacauggggccggcaggugagggccgggacggcgcgugcuggggagggacccggggccuuguggcgcggcuccuuucccgccucagagagugggcggugagcagccucuccagugcggaggcacgggggcggaacguuggugcuugugcggauuccgccguccccagguucugcuuggcuccggagggacgccccccucagcccugaaacccgugccucuccagccgccccggaucugaacuugugaucacggaguguuuacgucgugccaggcauuuuaaugcauuguucuaguucauuuuccagcagucgcauuccucgccuuggcccuacauguagcgcucauuacaaacacggccagaaucucuuauuaacaaacagcagccaggagugagauuuaaaauagacuggggguuuaggagacccuuuuaugacacguaauucugcucccacgacgcucccauuuauaccgccgguccagcuaagggucugguaauggagcgccguugaagagcaguaugaugaaguggucaggaccaacggacucuggagcugggcugcuugggaucaagucgcugccccucugcuuauuaacgugugaccuugggccagucauggacgcuaucugcuucagcucagcauucagugcucuccgucacccgaccccaucuauccaggauuaucucucccuggaaagcuacaaacgucucacccuaugugggccaaauguucuggauaggccuaguuaaccucuucucucccuguuuucuuugcgcuuucuugcagcuauguaguuaugcuaaugaaaagagcauccuagggggagcagaguuguggauucuaguccugacuagaggacuagugcaaaugcgauacuccugaugaaaaauguuucauucguuagauauaaauguguuaggcaggguuauggacacuagaugaaaaaagaaauaccucuacuuucauagagaucacuauuggacagcaaggcagaaauaauuacaauucaaguuggaggcuuauggaggugagcuuguaagagguuacaagaggcgccaaggcaggaucgccaaagacggaagacuuuggaagagucucauacaacggaagaggcguuauaugagacaccaaaguccacguugagucuugguggacuagaaguuugcuagggagagggcuugaaacgagguagauuggcguugcugguguagaaaaggaaggagacuggcccaggugggugggguuagaugaccaaaggcuuuuagugugguguugagcuguugaaauuuuaugcuguagccaaugaaaagucugaaauguuuuuuuuuuuuuuuuuucugagacggagucuuacugugucgcccagguuggaguucagugguguaauccuggcucacugcaaccuccaccuccuggguucaagcgauucuccugccucagccaccggaguagcugggauuacaggcacgugccaccacgccuagcuaauuuuuguauuuuuaguagagaugggguuucaccauguuggccaggcuggucucaaacuccugaccucaagugauccacccaccuuggccucccgaugugcugggauuacagguauuagccacugcaccugaccuacauagauuuuacauaagacuuuaaaacagggcgggcgcagugacucacgcuuguaaucccagcacuuugggaggcugaggugggcggaucacaaggucaggagaucaagaccauccuggcuaacauggugaaacccugucuacacuaaaaauacaaaaaucccagcacuuugggaggcugaggugggcggaucacgaggucaggagauccagaccauccugguuaacacugugaaacccugucucuacuaaaaauacaaaaaauuagcugggugcgguggcaggugucuguagucccagcuacuugggaggcugaggcaggagaauggugugaacccggaaggcagagcuugcagugagccgagauugugccacugcacuccagccugggcaacagagcgagacuccaucucaaaaaaaaaaaaaaaaaaaaaaaagacuuuaaaaaaaauuauaagaaaggacagaccaagugcagugguucguuccagcacuuagggaugccaaggugggaggauugcuugaugcuaggaguugaagacuagccuguguaacauagcgagacccaucucuacaaaaaaauuaaaaaguuaccuuuagaacuuacgauuuuuauguguagacuccauauaagcagagggucuaugcuuauucacuauuuauuaccuuccauagucccugcacauauaauaggugcuucauaaacaauuuaaugaaugaauaaauuacugagaaaacacuggaaguuuuuggguuagcauuguguuaggugcuugauauggucuggcuguguucccacccuuaucucaucuugaauucccauguuuugugggagguaccuggugggacauaauugaaucaugugggcagguuuuuccugugcuguucuccugguagugaauaagccucacaagaucugaugguuuuaaaaaugggaguuucccugcacaggcucucucucuuugccugccgccauccauguaagauguaacuugcuccuccuugccuuccucaaugauugugaggccuccucagccauguggaacuggcugcagagucauuaaacuucguucuuuuguaaauugcccagucucagguaugucuuuuuuuauuuuuuuuugagacagagucuggcucuguggcuaggcuggagugcaguggugcgaucucgacucacugcagccuccgccucccggguucaagcgauucuccugccucagccucccaaguagcugggacuauaggugcacgccaccaugcccagcuaauuuuuguauuuuuaauagagacggaguuucacuguguuggccaggauggucuugaucucuugaccucgugaucuucccgccuccgccuuccaaagagcugggauuaccuacccagcuggguaugucuuuauuagcagcgugaaaacagacuaaaacaguaaacugauaccaauagagugggaugcagcugaaaagauacccgaaaauauggaagcaacuuuggagcuggguaacaggcagaggucagagcaguuuagagggcucagaagaagaccagaaaaugugggaaaguuuggaacuuccuagagacuuguucaauggcuuugaccaaaauccugauaaugauauggacaaugaaauccaggcucauguggucucagauggagaugaggaacuuguugggaacuggagcaaaggugacacuuguuauguuuuaguaaagagacugguggcauuuugcccugcccuagagauuuguggagcuuugaacuugagagaaaugauuuuggguaucuggugggagaaauuucuaagcagcaaagcauucaagaggugacuugggugcuguuaaaggcauucaguuuuaaaagggaaacagcaugaaaguuuggaaaauuugcagccugacaaugugauagaaaagaaaaucccguuuucugaggagaaauucaagcuagcuacagaaauuugcauaaguaaugaggaucccaauguuaauccccaagacaaugggaaaaauguuuccagggcaugucagaggccuucauggcagccccucucaucacaagccuagaggccuaggagaaaaaagugauuucaugggccagcccgggguccccaugcugugugcagccuagugacuuggugcccugcaucccagcugccccagcuguggcugaaaggggccaaccuagagcucaggccauggcuucagagggugcaagccugaaaccuugacagcuuccaggugguguugagccugcaggugcacagaaaucaauaauugagguuugagaaucucugccuagguuucaaagauguauggaaacgccugcauguccaggcagaaguuugcugcagggguggggugcucauugaguuccucugcuagggcaauguagaagggaaauguagggucagagcccccccacagagucccuacuggggcaccaccuaguggagcugugaaaagagggcuaccauucuccagaccucagaaugguagauccacagacagcuugcaccaugugccuggaaaagcuguagacacuuaacgccaucucaugaaagcaaccaggcagugugcuguacccugcaaagccacaggggcagagcuguccaaggcugugguugcccagcucuugcauccgcaugaccuggacaugagacauagagucaaaggagaucauuuuggagcuuuaagauuugacugccaugcuggauuuuggacuugcauggggccuguagccccuuuguuuuggccaauuucucccauuuggaauggcuguauuuacccaauuccuauaccccauuguaucugggaaguaacuaacuugcuuuugauuugacaggcucauaugcggaaaggacuuaccuugucuugaaugagacuuuggacuggaauuuugaauuaaugcugaaaugaguuaaggcuuugggggacuguugggaaugcaugauugguuuugaaaugugaggacaugagauuugggaggggucauggcagaaugauaugguuuggcuauguccccaccuaaaucccaucuugaauucccauguauugugggagggaccuggugggagauaguugaaucauggggauggaucuuucccaugcuguugugauagugaauaagccucaugagaucugaugguuuuaaaaacggaagucuaccugcacaagcucuuucuuugccugcugccauccauguaagacaugacuuguuccuccuugccuucugccaugauugugagaccuccccagccauguggaacuauaaguccaguaagccucuuuuucuucccagucucggguaugucuuuaucagcagcaugaaguccagcuaauacagugcuugaacauguaauaucucaaaucuguaauguacuuuuuuuuuuuuuaaggagcaaagaaucugcagaguguugugcuuaguaaaaugaauuuugaaucuuuuguaaaagaucuucuucugguucgucaguauagaguugaaguuuauaagaauagagcuggaaauaaggcauccaaggagaaugauugguauuuggcauauaagguaauuaucuuccuuuuuaauuuacuuauuuuuuuaagaguagaaaaauaaaaaugugaagaauuuaauuguguuuuaguauuuuaaguagauugugauaguagaaugguuugagacacuuuaauagcaauuagcaugugguuuuuaaaaaguugcaguuuggcuggucgcaguggcucaugcuuguaaucccaguauuuugggaggcugaggcagguagguugccugagcccaggaguucaagaccagccugcccaacgugguaaagccccaucucuacugaagauaaaaaaauuuaaaaaaauuagcuggggcuauuggcacacaccuguggucccagcuaaucaagaggaugagguuagaggaucacuugagcccaggagguugagguuacaguuuaacuuucagaggccaaggcaggaggauugcuugaguccaggaguuugagaccacccuggggaauguagggagaucccaucucuauagagggauagauuagauagauaauuucugaggggaggggagggggagggccagggaaggggagggaaaggggaggggagggcagggccagcaguaaggucauaauagagacauguaucuguaagauccuuauaauaggugaggauggccacaaauuagcgccacagauuuguauuuuuaguagagacaagguuuuaccauguuggccaggcuggucuugaacuccugaccucaagugauccgccugccuuggccucccaaagugcugagauuacagaugugagccaccaugcccaaccacaagcauuuauuuauuuauuuauuuauuuauuuauuuauuuauuuagagacagucuugcucugucgccaggcuggagugcaguggcgccaucugggcucacugcaaacucugacucccugguucaagcuuuucucccgccucagccucccgaguagcugggauuacaggugcaugcugcaacacccggcuaauuuuuguauuuuuaguagagaugggguuucaccauguuggccaggacggucucgaucuccugaccucgugauccgccugccuuggccucccaaaguguugggauuacaggcgugagccacagcacucagccaguuauuuuuuuauaagaaaacauuuuacuggccaggccugguggcucacaccuguaaucccagcacuuugggaggccgaggcaggcggaucacgaggucaggaguucgagaccagccuggccaacauggugaaaccccaucucuacuaaaaauacaaaaauuagccaggcgugguggugugcgccuguauucccagcuacuggggaggcugaagcaggagaaucgauugaacccuugaggcagagguugcagugaguugagaucgcaccauugcacucuagccugggugacagagcaagacuucaucucaaaaaaaagagaaaacauuuuauuaauaagguucauagaguuuggauuuuuccuuuuugcuuauaaaauuuuaaaguauguucaagaguuuguuaaauuuuuaaaauuuuauuuuuacuuaggcuucuccuggcaaucucucucaguuugaagacauucucuuugguaacaaugauaugucagcuuccauugguguuguggguguuaaaauguccgcaguugauggccagagacagguuggaguuggguauguggauuccauacagaggaaacuaggacugugugaauucccugauaaugaucaguucuccaaucuugaggcucuccucauccagauuggaccaaaggaauguguuuuacccggaggagagacugcuggagacauggggaaacugagacagguaagcaaauugagucuagugauagaggagauuccaggccuaggaaaggcucuuuaauugacaugauacuguuucauuuaaggaaaaauaauaaaaaaacucuuuuuuuuguaucuaauuaaaauaauguucugauguuuacagaaacuuuguauauuuaauuggacauuagaacaagcuguuuguuguguaagauuuauuuuaccucagaucuuuucuccccccuuuccuuucugucuuguguuccaaaagaguaauuauuacgguaaauauuacuguaauuauggauuuaucaaauaagaugcaguucuuuagcauuuuuugauaaaucgaguggaacuuuagccuguuauuuuacuauuuguuuuauuuuaacuaaauucugauugugucauuuuuuuuuuuuuuuuuugggaccgagucucgcucugucgcccaggcuggagugcaguggugcgaucucggcucacugcaaccucugccucccagguucaagcaauucuucugccucagccuccugaguagcugggauuacagguguguaccaccacacccagcuaauuuuuguauuuuuaguagaggugagguuucaccaucuuggccaggcuggucuugaacuccucaccucgugauccacccaccugggccucccaaagugcugggauuacagccaugagccaccaugcucggcuuugauugugucauuuguauaggcaugugguuuauuauuuaguuauuuuuuuuuuuuucuuugagguggaguaucacucuuggugcccaggcuggaguguaauggcgugaucucagcucacugcaaccucuaccuccuggguucaagcaauucuccugccccagcaggaguagcuugggauuacaggcaugccccaccacaccuggccaauuuuguguuuuuaguagagacaggguuccaccauguuggucaggcuggucuugaacuccugaccucaggugaucugcccaccucagccucccagagugcugggauuauaggcaugagccacggugcccagcauauuuagauuuuuuuuuuuuugagacugagucugacucugucacccaggcuagagugcaguggcacgauccacgaucuuggcucacugcagccuccaccuuauggguucaagcgauucuucugccucagccucccaaguagcugggacugcaggcacaugccaacacgcccggcuuauuuuuguauuuuuauagagacgggguuucaucauauuggucaggcuggucucuaacuccugaccuugugauccacccgccuuggccucccauaguucugggauuacaggcaugagccacagcgccaggccuagauguuucuuaagguauguaucucccaaagauucuuuuugugguccucaaguaccauaagcaccgcuggagauaacacaugugaugggcauuuuuagcauagauuguaucuaagcaacuuuccacaaguaauaguucuguuaaggguuguuauuguggccgggcgcgguggcucacaccuguaauccuggcacuuugggaagcugaggcggccggaucaccugaggucagggauucgagaccagccuguccaaugugcugaaacccugucucuacuaaaaaugcaaagaaaaaaaaaaucuagccaagcaugguggcuugcuccuguaauccuagcuacuugggaggcugaggcaggagaauugcuugaaccugggaggcagagguagcagugagccaagaucgugucaccgcauuccauccugggcgacagugagacucugucucaaaacaaaaaaagaguuguuaccguugggacuauuuuuugaaagcuuuaugugaacguaauuuuauauuuugaugaaaauuuaguuuauugauguaaaaaguguaucaguacaucauaucagugucuugcacauuguauaaacauuuaauguaggugaaucuguuaucacuauaguuaucaauguuauaauuuucauuuuugcuuuucuuauuccuuuucucauaguaguuuaaacuauuucuuucaaaauagauaauucaaagaggaggaauucugaucacagaaagaaaaaaagcugacuuuuccacaaaagacauuuaucaggaccucaaccgguuguugaaaggcaaaaagggagagcagaugaauagugcuguauugccagaaauggagaaucagguacauggauuauaaaugugaauuacaauauauauaauguaaauauguaauauauaauaaauaauauguaaacuauagugacuuuuuagaaggauauuucugucauauuuaucucaaaaccuaaacuguguaucaaugauauuaagcuuuuuuuuuuuuuugagacagaguuucacuuuuguugcccaggcuggaguacaauggcgcgaucuuggcucaccacauccucugccucccagguucaagugauccuccugccuuggccuccugaguagcugggauuacaggcaugugccaccacgccuggcucaucuuuuuuguauuuuuaguagagaugggguuucucuauguuggucaggcuggucucaaacuccugaaccucaggugauccgcccgccucgggcuuccaaagcgcugagauugcaggcaugagccacugugucuggccuauuuuuauaguuuauguacuuggaauuauauaauauauucugccuagcuucuuucauucaauauuuguaagauuuauccauauuauugaguguaguuguggauuuuugcauuuauauuucauagcacgagcaugucagaauuuauccauuuuacuucccuucugcccgccacugcuacucuccccauuuuaccuuuuuuuuuguuuuuuugagauggagucucagaauuucgcucugucgcccaggcuggagugcuguggcacggucucagcucacugcaacuucugccucuggguucagcugcacgccaccaugccuggcuaauuuuuguauuuucaguagaggggauuuugcuauguuggccaggcuggucuugaacuccugaccucaggugauccacccaccuuggccugccagagugcugugauuacaggcgugaaccaccgugcccgacccccauucuaauuuugauggacauuuggguaauuuucauuuuuggcuguuauaaauacugcugcaauuacaguuaauuuucacaguuuuuuuuuuuuuuuuuuuuuuuuuuuuuuuuugaggugaguuucgcucuuguugcucaggcuggagugcaguggugcgaucucagcccacugcaaccuucaccuucuggauucaagcaauucuccuuucucaucuccuaaguagcugggguuuacaggcaugugccaccaugcccagcuaauuuuuguauuuuaauuucacaguucuggaggcugggaaguucagaauuaaggcacuggcugaucuguugucuggugagggcccacuuguucauagauaaccauuuucucacucuaaccucacaagguugaaagggccuaauuuuuguguuuuuaguagagacgggguuucacuauguuggcuaggcuggucucaaacuccuagccucgagucauccacccgccucguccucccggagugcuuggauuacagcaugagccacugcgcccggcccccauuuuaguuuugauggacauuuggguaauuuucuuuuuuggcuauucuaaauaaugcugcaauuacuguuaauuuucaccuuguaaaaaccauuuucaaaucucaagagauuaaccuuuaguuuucuugguuuggauugggaaggaacaccaaggaaaaugagggacuucagaauuuauuuucauuuugcauuuguuuuuuaaaaucuuuagaacuggauccagugguauagaaaucuucgauuuuuaaauucuuaauuuuagguugcaguuucaucacugucugcgguaaucaaguuuuuagaacucuuaucagaugauuccaacuuuggacaguuugaacugacuacuuuugacuucagccaguauaugaaauuggauauugcagcagucagagcccuuaaccuuuuucagguaaaaaaaaaaaaaaaaaaaaaaaaaaaggguuaaaaauguugaaugguuaaaaaauguuuucauugacauauacugaagaagcuuauaaaggagcuaaaauauuuugaaauauuauuauacuuggauuagauaacuagcuuuaaauggcuguauuuuucucuccccuccuccacuccacuuuuuaacuuuuuuuuuuuuaagucagagucucacuuguucccuaggccagagugcaguggcacaaucucagcccacucuaaccuccaccucccaaguaguugggauuacaguugccugccaccaugccugguuaauuuuuauauuuuuaguaggguugcggggacaggguuucaccauguuggccagguuggucucaaacuucugaccuuaggugauccucccaccucggcuucccaaagugcugggauuacaggcuugagccaucgugcccagccuacuuuuuacuuuuuuagagacugggcuugguggagugaaguggcaagaucauagcucacugcaguauugaacuccugggcucaagcgaucuuccugcuucaaccucaugaguagcugggucuacaggcacaagccaccaugcuugccuaauuuuaaaauuuuugcagaguuggaguuucacaguguugcccaggauguucgcucacuccugacuucaagugauucuucugccuuagccucuagagugguagcugggauuacaggcaugaaccaccaugcucugcuauuuuuuuucaagguuuuuuuuuuuuuuuuuuuuuuugagagacugguaugacuauguaugcucccuaggcuggagugcaguggcuauucacaggaagugccaucagaguguacuacagcuucaaacuccugggcucaagcacuucuaucauagucuccaaaguagcugggacuacgagugugucucauugugccuugcucucgaauugcuuuuuuuuuuuuuuucugguuucaagcuaucuaugugguauuaguccucacuuuaugaauaauuuuguauacuacuaauagcaauuuuuuuuuuuuuuuuuuuuuugagacggagucucauucuugucgcccaggcuggagugcaguggugugaucuuagcucacugcaaccucugccucuccgguuugggcaauuagcugggauuagaggcgccugccaccaugcccagcuaauuuuuguauuuuuaguagacaugggguuucaucuuguuggcuaggcuggacucuaacuccaggugaucugccugccucggccucccaaauugaugggauuacagguguaaaccacugggccuggccuagcaauuuaaaaugacauucuaagaaguuuuaugucuaaaucugcaguaaguggcugggugacguggcucaugccuguaaucccaacgcuuugggaguccagggugggaggaugacuugaggccaggaguugagaccagccugggcaacauagugagacucugucucuacaaaagaaaaaauuagcggggcuuaguggcgugcgccuguagucucagcuacucgaaaggcugaagugggaggauucuuugagccccaaggguucuggcuugccgugagccaggauggcaccacugcacuccagucugggcaauagagucagacccugucucaacaaauaaaauaaaacuguaguaauuauaaagugguuuuggcugggggagaaauguacaguugaacauacggauuaagagguugaaaguuggucuuaggaagaggaacuuuuuguggaaauuucuuaauauuugaagaauauuauguuauuguuccucuguuuuucauggcguaguaagguuuucacuaaugagcuugccauucuuucuauuuuauuuuuuguuuacuaggguucuguugaagauaccacuggcucucagucucuggcugccuugcugaauaaguguaaaaccccucaaggacaaagacuuguuaaccaguggauuaagcagccucucauggauaagaacagaauagaggagagguauguuauuaguuuauacuuucguuaguuuuauguaaccugcaguuacccacaugauuauaccacuuauuguaauaugcaguuuuggaaguauauguuaccauuuaacuguacagaguacauaguaauagagugguaauuauuuagauugauuaaagaacucauuuuuuuaaauaaguuuuuuuuuuuucacuauaaaaguuuauuuuauuugagaugguaugguaucgaacauguucauauuguguguaaucguggguaaauuacucaaccuuuaugucauaguuucuucaccuuuaaaaugacauuaauaaaagagcuacuuaauaggauuauaagcaugagaugauuuaauauacauaaaauacuuacagucugauauauaggaagcacuuaacucuuuauccuagaaaagauuuaaggugaccuuaacauauaugucagaaaaucuuuaaaauuguggaaauaaaagguuguauaauucugcuauccuaaaauuacuaguauuucaauauauuuuauuuuagucuuuucuuuuagauacaaguuuuaaaacuuuuaagugaaguguaauauacguaaguacugcuugaugaauuuaaggugauuucuaaagccagguuuguuggggaagaggagugggauuuagugauuuagaaccagaaauuggggcugggugcgaugucucaugccuauaauuccagaacuucgggaggccauagugggagaauuguuugugccccggaguucaagaccagccugggcaacucagugagacgccaucucuacaaaagaaaaaaaaaaaaaauuagcucaguguggugacauguaccuguagcccgagcuacucgggaggcugaggugggaauaucacccuggcccagaaguuugaggcugcagugggcuaugauugugccacugaacuccagccugggcaauggagugaaacccugucucaaaaaacaaacaaaaaaagaaacugaggcugggcacgguggcucacacauauaauccagcacuuggggagguugaggcaggauaauugcuugagcccaggaguuugagaccagucugggcaacaaaaugacaccccauuucuaccaaaaaaaaaauuguuuaaaauuagcugggcaugguggcaugugccuguggucccagcuacaugggaggcuaaggcuggaggauuguuuagcccaggagguugaggcugcagugagccauauucaugucccugcacuccagccugggugacauagugagacgcugucucaaacaaaaaucaacaggccagaugcaguggcucaccccuguaaucccaacacuuugggaggccgagguggguggauuacuugaggucaagaguucgagaccagcccggccaacauggcgaaaccccaucucuacuaaaaauacaaaauuagaugggcaugguggugugugccuguaauaccagcuacucuugaggcugaggcaugagaaucgcuugaguugggaggcaaagguugcagugagccaagauugugccacugcacucuacccugggugagaaacgagauuuuguaucaaacaaacaaacaaacaaaaaaagacgcccaaaaucaacaacaacaaaaacgauauuggaaugauuggauccccaaagauaaauguuugaggugauggauaucucaguuacccugaguuaaguauuauacauuguauacguguauuaaaauauuacaaacccccaaauguguacaauuaugagguaucaauaaaagagauuggaaggacuggguaauuugcaaguaauuaaggcaauuuacaauuuuuaauuuuuauuugugaauaaguaguuauacgugucaaaauucaaaaaggacagguggauauacagugauaagucauccccccuucucugucagcuccauaaagagccccugucuugcauggcuccagggucacauuuccuauuguauuuugccaccaccugcccugggagcaacaguguuaguuucuugaacauccuuccaagcagagucugggccuacacaagcaaaacaaguaugucuauucucucuccucuuuaauuuuuuuaaaggaagugauugauaauuuaacacucaagcuauaggucauugguuauauuuuuaauuuccaauuuaugggaauagaggaagugucagugauccccuucugguuuaagaacuggaggaugcauguguuuagacccuuuagaaaccugaaaugucaccuaauauaauuaucagaguaacacuuuuuaguaagcaagcuaucuaucaaaaguagguuuuugaagaagaggguaaggaaagguuacuuucaugggacauagcaauaauuucuaaaaucuaaugguuuuacaagacuuguucauuagaaguaacaucugugaggauggcuuuaugagucaaaauauuaucugcuuaauaccccaccuguaggguaagaagaaauguuuuuuucuuggugacaauuuuuagcagcaagcggggagggccuguggcuuccaaggccaaacguugaaauaccacagacuaggaagaaaaagauccacuccuuauacaggauuuguuuguuucuucuuuuuucuucauuuuuguagagaugaggucucacuauguugcccaggcuggucucucuuuuuuuuuugagcccgaguuucacucuugacgcccaggcuggagugcaguggugugauuuuggcucaccgcaaccucugccucccggguucaagcgauucuccugccucagccuuccugaguagcugggauuacaggcaugcgccaccacguccggcuaauuuuguauuuuuaguagagauggguuucuccaugugggucaggcugcucucgaacucccggccucggaugauccacuugccucggccucccacagugcugggauuacaggcgugagccacugagcccagccaugcuggucucaagcaauccacacccaccucagcuuccaaaagugcuggcauuacaggugugagcccccgugcccagccuguuucuuauaauuauuccucuuucucaacucugucugcugugguaccucaugcuuccuaguuuaagccuucuugggaguucucaggagaaaucuguuaucucccuuacuaagcauuugggauugauguuccuuccagguuacuauaaaaccaaguuuuuuuugguucuuuuuuuuuuuucuuuuaaaagaaaugagauuuugucaugguuagccugguuucaaacucccaagcucaaguaauccaccuuccuuugccucccaaagugcuaggauuacaggcaugaaccacuacacccgaucuguacuguuccucuuuccauucacuaaaaccuacuugcaacuaugagcauauguuauugccaucuagaaaugaguuucuagggacuuguuccuuuuuguacuuuauuuaaacagucgaauuagaaauuauuauuaucauuauuuauuuuuugagauggagucuugcucuguugcccagguuggagugcaguggcgugaucucggcucacugcaaccuccaccuccuggguuuaagcgauucuccugucucagccucccgaguagcugggacuacaggcauguaccaccacaccuggcuaauuuuuauauucuuaauagaaacaggguuucacuauuuuggccaggcuggucucgaacuccugaccucagaugauccacucaccuuggccucccaaaguacuggaauuauaggcguaagccaccgugcccggccaaaauuauuuauaauaagcaaggcaugguggcuugugccugaagucccagcuacuugggaagcugaggcaggaggaucacagguucagguccacccugggaaaauagugagaaccuucccuauccccagucuucaaaaaagaaaaaaauuugcuggagaaggucacacaaugcugauaggucccauugugcuuucaugcuuucuaguuuucaaugauaacugguuguuacuuuuauugucugacucauuauagugaccaacucccgauuuuuuacuuugccuuaagccuucagcuaucuccuaccucuaagcggaugauuucuuccuuaacacuuaaaaccucaaaauuuaucuguacuuccacucuuuuacucucuggcucuuucucagaagaagaaauaacacuuuuauuucuuuucaaagccaaccuuuccauacuuuacuuggagacauauuucuuuuuuuuuguuuuguuuuugugaguggagucucacucugucgccuggucuggagugcaauggcgcaaucuccacucagugcaaccucugccucccagguucaagcgauucuccugccucagccugcugaguaccugggcuuacagguuagcacaccacacccggccaaguuuuggguuuuuaguagagacaggguuuugccguguuggccaggcuggucucuaacuccugaccucccgauccgcccgccucaggugcaagccaccgcgcccagcccuaguguagcaaucuuaaucagaaauaugucucuggcugggcgagguggcucaugccuauaaucccagcacuuugggaggccaaggcaggcagaucaccugaggucaggaguucaagaccagccugaccaacauggagaaacccugucucuauuaaaaauacaaaauuagcugggugugguggcauaugccuguaaucccagcuacucaggaggcugaggcaggagaaucgcuugaaccugggaggcggagguugcggugagccaagaucucaccauugcacuccagccuaggcaacgagcaaaacuccaucucaaaaaaaaaaaaaaaaaaaaaaagauugcuauguuaaucuuauuuauuuauuuauuuauuuugagacagagucucacacuauugccagggcuggagugcaauggcauaaucuuagcucacugcaaccuccgccucccggguucaggugauucuccugccucagccuccugaguagcugggauuacaggcgcccgccaccacgccuggcuuauuuuuuguguuuuuuaguagagacgggguuucacuacguuggccaggcuggucuugaacuccugaccuugugauuugcccaccucagccucccaaagugcugggauuacaggcgugagccaccgugccuggcuuauguuaaucuuauuuuauauaaaaagaaauaauauuaaacuagaaggcaauaaaaaugccaaauucaauacacaaauuauuuugucagcauuuccacaagaauaaacuauuuuauaugcuaacauauguucaauguuccuuacagaauucugacauuaaaaaugaaaaauuaccaaagcuucagaugaaucuauaaauggacaaaagaaaaagcuuaaaaggauaaagagcaacacuccaagugcauguauaaacauaaggacucuugggacuuaaccuuuuuaaaaaucuuuaggccuagcacaguauuugcuauuuaauguaucaaaugggugguuuugacuucauuaauccauauauaggacagaugaaaaaaagaauuauagacuuguaauuacaguucuuuaggaaccauauuugcucucagccuuuuaaauacgcugucaggcaauuccagucagcacuuuugaaaaaaaccuaccuaccuaccuaccuaccuaucuaucuaucuaucuaucuagagacugaguuauaagacuagcuaguuuuuguauuuuuugcagagacaggauuucaucauguuuucuaggcuguucuugaacucccaggcucaagccauccacccgccucagccucccaaagcgcugggauuacaggcgugagucaccaugcccaaccaauuccagucagcucuuaaaaugaaagccuagaaaugguaggguuaaagaggggacagaauguugauuuuaaaauaccuagaauuuggccaggugcaguggcuguaacccagcacuuugggaggccaagguggccggauugccuuggccugccucagccucccaaagugcugggauuacaggugugagcucaggaguucgagaccagccugggcaacacggugaaaccccuucucuaguaaaauacaaaaaauuagcugcauguggcggcgugcaccuguggucccaguuacuugggaggcugaggcaggagaauugcuugaaccugggaggcagagguugcagugagcugagauugcgccacugcacuccagccugggcaacagagugagacucugucuccaaaaaaaaaaaaccccaagaauuugauuaauucuguuggaauuuuaagaguuaacugauccccaaaaugacucagcuguaugcaauuuaaugcaauauuaauucgcauguugacucucagaauugcauacagcugagucauuuuauugaguaggauugauaaguauacuauguuaugccaacaguaacugugaugcuucuaaaauugugauuuuuaaauuggcauugucacagaaacagcagaguaguuguuuuuuucuuuaagcuucuuuuagccagaaacauaaacugaaacuguaauuauuacugcaaucguauguugaauagacuugugaaacuagcaauuuauuaggcuuuuaaugauaucuggaccaaaggcugagggagcugugcuguguguauguugcuuugugcuuuguuuuuuagaagcuugucguuucuuugccauuuuacuucuuucuuuuuuuuugagacggagucuugcucugucccccaggcuggagugcaguggcgcaguuuccgcucacugcaagcuccgccuccuggguucacuccauucuccugcuucagccucccaaguagcugggacuacaggcgcccaccaccacgcccggcuaauuuucuguauuuuuuaguagagaugggguuucaccauguuacccaggauggucuugaucuucugaccuugugauccgcccgccucggccucccaaagugcugggauuacaggcuugagccaccacgccuggcccauuacccauuacuuguuucuuaauguuacauucucuuucccucuuuuuuuuuuuuuguuuuuugagauggaguuucgcucuuguugcccaggcuggagugcaacggugccauuuuggcccacugcaaccucugccucccagguucaaaugauucuccagccucagccucccaaguagcuaggauuacaggcaccugccaccacgcccagcuaauuuuuguauuuuuaguagagauggggcuuugccauguuggccaggcuggucuugaacugcugaccucaggugaucugucugccucagccucccaaagugcugggauuacaggugugagccacugcacccaguccuuaaugcuacuuuauaggugaaaauugugaaauaacuuaaauuucauuuuaauuaaaguuaauuuuugggaaauuaacgaaagguugacauuuuauucuuuugaauauugcaguuguuauuuggguuuaaauuggggggcuuaggaaggaaagaagccugaugguuguuucugaauuuucugaaaauuauguuugauaugcuguauaugaaauccagcuuggagagaauauguccauuguuaaggaaaaauuaaugaagauuugaucuagauaaggcauuccaaucauuuggaagugguuugaguaucuuuuuuucuuuuuuuaauuugagacagagucuugcucuguggaguguaguggugcaaucuuggcucacugcauccuccaccucccggguucaaucaagcaauucuccugcuucagccucccgaguagcugggauuacagguaugggcuaccauccccagcuaauuuuuuuuuuuggauggaaucuugcucccgucgggcaggcuggagugcaguggugugaucucagcucacugcaaccuccaccucccaguuucaagcgauuaagugauucuccuuccucagccucccgaguagcugggauuacaggcgugugccaccacgucgccaccacgucuggcuaauuuuuguauuuuuaguagagacaggguuucgccauguuggccaggcuggucaugaacuccugaccucaggugauccaccugcuuggccucccaaagugcuaggauuacaggugugagccacugugccuggcuuaaguuuuguauuuuuaguagagacgguguuccaucauguuggucaggcuggugucaaacuccugaccaugcgauccgccugccucggccucccaaagugcugagauuacaggcgagagccaccgugcccggccuguuugaguaucuuuuaaaaccaguaaggacaaacuagaggugucagcucucuucaugggcuuuggagaaacaagacaaaaaggaaagagauguuucgccgggcgcgguggcucacuccuguaaucccagcacuuugggaggcugaggacagcggaucacccgaggucaggagucaagaccagagccauugcacuccagccugggcaacaagagcacaacuuuaucucaaaaaaaaaaaaaccaaaaaagaaacaggaaagagauguuuugauuuuuuaagucuagaguguucuguucuuacucuacagcacuuagcaguaguccaucuauccuccuuguuuguucuuuacaacaaaaccccauugguucucucuuaccaaguuugcuuuauucuugguuuauccuuuguaagaugugaaagggauaugaagagcaaauaggaaguguuacucuugcugcuugagagaaagcuguuuuacaauuuguuggcaaacaauuuguaaaaguacaacaaaagugugcauuuuuggcuucuuauuuauguuuuaucauugcuauaucucauaauuugugauuuuuaaaauaacuuuuuauuugaaaagcacuacagggucacgucauguuuuuaaaaaauaaauuaagaagguaaacacccguacuucuacuuuaccucuaguccuagucuauggugguaaucaguguuaacaguuuaguuuguguucuuacccuuccagggguuuuuuuucucuauguauacagauauaugcauuuuuaaaaacauaguuaacacuuaaaaacaauaugggaucguauuaggaauacaaucuguauuccuucccaacaguauauacaguuuuuuuccauuucacuauguaucuauuuauaaauuuuuuauuucuaauaauuucucuugaauaggugagacaucauauaguauaaaauucaguagaaaaucaguuuuucagagguacaaaauuggcugacuuugcacagacuccuuucauuucacagguagggaugcacagccaccucuuccaccgacgagaggaaaggauaugugugccugugggcucuucaacucuguugauuaguuaugauuuauuuucuggucaguuugagaggaaacagugauaaaauacugggaacagggaagaagcauaagauuauuauuguuuuuuuuuuuuuuuuugagacagagucuugcucaguugcccaggcuggagugcaguggugcgaucuuugcucacugcaagcuccgccucccggguccaugccauucuccugccucagccucccgaguagcugggacuacaggcgcccgccaccacgcccugcuaauuuuuuuuuuguauuuuuaguagagacaggguuucaccauguuagccaggauggucucgauuuccugaccucgugauccacccgccucggccucccaaagugcugggauuauaggcgugaaccaccgcgcccagcuuuaauuuuuuuuuuuuuuuuuuuuuugagacagagucuugcucugucgcccaggcugaagugcaguggcgcgaucucggcuugcugcaagcuccgccucccagguucacgccauucuccugccucagccuccugaguagcugggauuacaggcacccgucaccaugcccagcuaauuacgggaccucgcucugucgcccgggcuggagugcaguggcacagucucgcucacugcaaucuggcaagugauucucuugccucagccuccagaguagcugggacuacaggugugcgccgcuacgcccagcuaauuuuuguauuuuuaguagagauaggguuucgccauguugguuggccaggauggucucgaucucuugaccucgugauccgcccuucucggccucccaaagugcugggauuaccggugugagccaucgcaccuggccuuccuacuuuauuaagauaccuaagggauuucugugauuguuaggauucaaauuucugugagcauaagaaucaagcugugugcauaauaauugcaugggauuucacagcugggccccauucccagggauuuuguauuaucuaccuccaagugauuuugaugcuggugauccuuggaccagacuuggugaagcucaaugcuuagcuaggaaagccccaaaaauuugcuuuauuggauuguguaauuugacuacauccauuguuucuuuuuucaaauguagaguuauaugccacaaaaauauuuuccguagcaguaggcauccuaauuaaucucgauguuuguuuauagccccauugauggggcuauaaacuuggcagcaaauuguuuucccacuaauuuggcauuuuccauaaauguuuguuuauagccccauugauggggcuauaaacuuggcagcaaauuguuuucccacuaauuuggcauuuuccauaaaaaacacguaucuguuguuagcugccuagacguuagcuggacaugguuuagguuacuuuucucuuaaaaaguaaauuuuaauucaaguuccuuuaagccagcagucucaaccuggggcaguuuuucccuccaggggacauucagcagugucuagagacauuuuugguugucaugcugaggaagagaguguauaguggguagaauccagggaugcuguuaagcauggaacagccccuuacaacaaaaaauuauguagccuaaaauggcaguguugccaagauugagaaauuaugcuuuaaauguguuuuuauauauggccauuuuguguuuacucuggagauaacaugcuuuuccucauauaacaugcuugauaaacauuuugguaacacaggaauuguaaaugcuggugaugucaguaaauaguuaagaaauuuagggcugugcgcgguggcucacgccuguaaucccagcacuuugggaggccgaggcggguggaucccgaggucaggagaucgagaccauccuggcuaacauggugaaaccccgucucuacuaaaaauacaaaaaaaugagccgggugugguggcaggcaccuguagucccagcuacucaauuuagaaagcagauuuguuuccuuucuauaccuguguaauuugagguuuaguuuacugucacaucguuuauaaacauaaggaagaucguugcucaucugauagcauuccgaaccuugagucaucuguaaugccuauggccuccagaaaagcuucucuaauacuguacuuagagauguguaaaauauguaggaacauuuucccaccuucgauuguuaguuuaccuuucagcuucaguaauuuaccuuucagcuauuacuuuaguaacaucuucaacauuguuuuucaaacugcaaggugugacccaguagugggucguuaaauuaguaggugacagagcauuuuugaagaauuaaauacaauagaacauagcagagugggcucacgccuguaaucccagcacuuugggaggcgaggcuggcaggucacaaggucggcaggucacaaggucagaagaucgagaccuuccuggcucuaacauggugaaaccccgucucuacuaauaguacaaaaaauuagcggggugugguggcaugcgucucuagucccagcuacucaggaggcugaggcacgagaaucacuugaauccgggagcuggagguugcagugagccgagauugcaccacugcacuccagccucagcaacagagcaagacuauuucaaaaaaaaaaaaaaaaaaaaagaaagaaagaaaaaaagaaaauagaguguaucacauaauuagaguagcaaguauugauuugugaaaccuauuuuaaucauagaucuauguauguaugugcuggauugugauguaaagacauuucuugcugugguuacacugaaaaaaaugaaaagucacugauuuccaauaacuuacagaagcaguaugaacuacauauucugucguucuugaaacaagcugagauuuuauugacuuugggaagcaguagaauuauuuuaguuuuuuaauuaacaguuuuuggcuuuguacugucaagagguaauuuuagaaagcauucuaaaaauguaaguacuggauuuggcaacauucuugaacuguaauucuguuucguuaaacaucacuauuuacaugugcaacagcgugucuguaacaaugucccaguaaugaaauucuuucuucuauuuaaggcaugucuguuugauaaaagucaaacaaaauuggguauaugucagugucuuaugauacugcuuaauuaaacauuaauuugacucuuagcuaaucaggaaauguuugccucacagucuuacagagcuuuccaccuucuaaaaaagcuaacguuucagaauagauucaggauucaaccuucuuucugucuuuuuuuuuuuuuguuugagacagagucuugcucuguugcccaggcuggaguacaguggcgcuaucucggcucacugcaaccuccgccuccuggguucaagcaauucuccugccucagccucccgaguagccgggguuacaggcgugcgccaccaugcccagcuaauuuuuuuguauuuuuaguagagacaggguuucaccaugcuggguggccaggcgggucucaaacuucugaccuugagaucugcccaccguggcuucccaaaaugcugggauuauaggcgugagccaccgcaccuagccuagauucaggcugcuucuuuuuuuuuuuuuuuuugagacagagucuugcucuuguugcccaggcuggagugccauggcaugaucucagugcaccacaaucucugcuucccagguuuaagcgauucuccugccucagccucccaaguagaugggaucacaggcaugagccaccaugccuggcuaauuuuguauuuuuuguacagacgggguuucuccauguuggucaggccagucucgaacucccuaccucaggugaucugccugccucggccucucaaagugcugggauuacaggugugagccacugcgcccagcagauucaagcuuuuuaaauggaauuuugagcugauuuaguugagacuuacgugcuuaguugauaaauuuuaauuuuauacuaaaauauuuuacauuaauucaaguuaauuuauuucagauugaauuuaguggaagcuuuuguagaagaugcagaauugaggcagacuuuacaagaagauuuacuucgucgauucccagaucuuaaccgacuugccaagaaguuucaaagacaagcagcaaacuuacaagauuguuaccgacucuaucaggguauaaaucaacuaccuaauguuauacaggcucuggaaaaacaugaagguaacaagugauuuuguuuuuuuguuuuccuucaacucauacaauauauacuuggcaaugugcuguccucauaaaguuggugguggugacucacucuuaggacacauucagauuucuuuuuuuuuuuuuuuugagaaggagucuugcuccguugccaaggcuagagugcaguggcacaaucucagcucacugcaaccucugccuccuggguucaagcgauucuccugccucagcuuccugaguggcugggauuacaggcaugugccaccaugcccggcuaauuuuuguacuuuuaguuuuaccauguuggccagguucgucuggaacucccaaucucaggugacccaccugccucggccucccaaagugcugggaguacaggcgugagccacagagccuggccauguucagacuucuaauaacagguuuguauugacucuuagccucauggcagaagccaagagacaugagacagcuuagaaauuuuugcuuuuuggaaaugaauguuagaguuacugguuugugauuaaggccuauugcacugacagaggcagugaaaaaggguuugauugccaaggaagauucacagggccuagaauggcagugguuaugcaucuacaguuuauuacaggagaaggauacaauccaguagcaggauuaugguaaggauaugcaucacagucaaaggcugucauagcaagucauccagagaguucgggugcaaguuccaguuuuccuuuguuguguaaagucugugguggggugcauuuucucucucagagcaggaugugugcacaggacaccuuggaaccuaggagcccaaaauagagucuucacuggacuuuuuaauauuuuucuugucaagcggacauguuccuguucucuaacuagccucuucaguggaggucagaggaagagccucauugagaccaagugcaacucaucaaucacaugaaacaaugcugauaaauaaaccaccuaaauauccccugacccacaaauacaaaacaacaccauucaaucaguauuuuucaugccuugaucaggggucauugccaugcaggaacuuuaacaaaacaguacaggcuaauaauagaauuguuggaauuaacucacacagcacaccuaugagagagaguuaagauagagggucuugguggucucuaacaguugaauucaaagugaaguuaccagaguaaagugagcaaagacacauauuaguacaauauugguagauaaaaucacguugcucuaauaagcauaguuuuaaacuuuaaccauguuucuccaguaauuuuaguaauuauauuguuguuaugucuaauacauaaagcauuuuuuacuuuuuuaaaaaauuuuuaggcaaugugggguccaaaguaauuaaaaaaaaauuuuuuuaacauaaagcaucuuaaaauuuuacuuaaucaugaucacuuagaaccauuaaaacauacguuuugauauuauggggaagcuucguuguuccuuuguagacagacuuaaagaaauacaacuuuaugaugacaagauauaagauaauuauagauuuaaauuuuauagaaaccuuuucccuuaucuagugcaagagguagcuaagugcuuauuuucucaaaguacuguguuauaaaaaguauuccuaguguagucaaagcuucucuuuagacugauaaaacuuagagcaccugcauuuacuuccaacaaagcagaauuaaagaaaaugagacuuggccggguacguuuguaaucccagcacuuugggaggccgaggcagguggaucaugagguuaggagaucaagaccauucuggcuaacauggugaaacccugucucuaccaaaaauacaaaaaauuagcugacaugguggugcgcaccuguagucccagcuucucagguggcugaggcaggagaaucgcuugaacccaggagguggagguugcagugagcugagaucacaccacugcgcuccagcuugggcaacaaaaaaaaaaaaaaaaaaaagaaaaagaaaaugagucuuuacuggcugggcacaguggcucacaccuguaaucccagcacuuugggagaccgagacgggcagaucaccugaggucgggcauucgagaccagccugaccaauauggagaaaccccauuuguacuaaaaauacaaaauuagcggggcgugguggcgcaugccuguaaucccagcuauucgggaggcugaggcaggagaauugccugaacccgggaggcggagguugcggugagcagagaucgugccguugcacuccauucugggcaacaagagcgaaacucuccaucucaaaaaaaagaaaaugagucuauacuuugcuguuuucauacucucuuagugugguguaggcagccauguaucccccuugugccucuauuucuccauucugugaaugagugucuuccacugcugugcuuuucugauuccguaaccuuuguuuguuuguuuguuuguuuguuuguuuguuuuuuauugaucauucuuggguguuucucgcagagggggauuuggcagggucacaggacaauaguggagggaaggucagcagauaaacaagugaacaaaggucucugguuuuccuaggcagaggacccugcggccuuccgcaguguuugugucccuggguacuugagauuagggaguggugaugacucuuaaugagcgugcugccuucaagcaucuguuuaacaaagcacaucuugcaccacccuuaauccguucaacccugaguggacacagcacauguuucagagagcacaggguuggggguaaggucacagaucaacaggaucccaaggcagaauaauuuuucguaguacagaacaaaaugaaaagucucccacgucuaccucuuucuacacagacacggcaaccauccgauuucucaaucuuuuccccaccuuuccccccuuucuauuccacaaaaccgccauugucaucauggcccguucucaaugagcuguugaguacaccucccagacggggugguggccgggcagaggggcuccucacuacccaguaggggcggccgggcagaggcgccccucaccucccggacggggcggcuggccgggcggggggcugaccccccccccccgccucccucccggacggggcggcuggccaggcggggggcugaccuccccgccucccucccggaugggguggcuggccggguugggggcugaccccccgcaccucccucccggauggggcggcuggcugggcagaggggcuccucucuucccaguaggggcagccgggcagaggcgccccucaccucccggauggggcggcuggccgggcggggggcugacccccccaccugccuccaggacggggcggcuggccgggcagagcggcuccucacuucccaguaggggcggccaggcagaggcgccccucaccucccggacggggcggcuggccgggcagaggggcuccucucuucccaguaggggcggccgggcagaggcgccccucaccucccggauggggcggcuggccgggcggggggcugacccccccacauccuucccggacggggcggcuggccgggcagagggucuccucacuucccaguaggggcggccgggcagaggcgccccucaccucccggacggggcagcuggccgggcggggugcugacccccccaccucucuccuggcugggcggcuggcugggcggggggaugacccccccaucucccuccuggauggggcggcuggccgggcggggggcuaacccccccaccucccuuccggacgggguggcugccgggcgcagacgcuccucacuucccagacggaguggcugccgggcggaggggcuccucacuucucagacgguguggcugccgggcggaggggcuccucacuucucagacggggcgguugccaggcagagggucuccucacuucucagacggggcggccgggcagagacgcuccucacaucccagacggggcggcagggcagaggcgcuccccacaucucagacgaugggcggccugguagagacgcuccucacuuccuagaugggauggcggccgggcagagacgcuccucacuuuccagacugggcagccaggcagagaggcuccucacaucccggacgaugggcggccaggcagagaugcuccucacuucccagacgggguggcggccgggcagaggcugcaaucucggcacuuugcggggccaaggcaggcagcugggagguggagguuguagcgaacugagaucacgccacugcaccccagccugggcaccauugagcacugagugaacgcgacuccgucugacaucccggcaccucgggaggccgaggcuggcggaucacucgcgguuaggagcuggagaccagcccggccaacacagcgaaaccccgucuccaccaaaaaaauaccaaaaccagucaggcguggcggcgcgcaccugcaaucgcaggcacucggcaggcugaggcaggagaaucaggcagggagguuguagugagccgagauggcagcaguacaguccagcuuuggcucggcaucagggggagaccauggaaagagagggagagggagaccguggggagagggagaggagggagagggagagggaaccuuuuguuuuauuccaguaggaccagcuagaaacagaaggugauugaccaguauuagggauggaaucaggguacaauuauggagacaggcuaucuaaacaauucacucucaccauuuaaaucagcuguuugaucauuuuuuuuccauauaucuuuaccaucgcauaguaaauaauauccuuuuuauuuucaagagggaguauuggccuuaaguuaggaacucucuuaauuuuuuucccccaucaucccacccgcacuucuuacuccuuacuuccuacuugcuuuuauucuuuacuggcucuuuaccacugcguauuuuuaggugcauacaucuauuuuuuaaaaaagcacccuuguuccuggguccucuuccaguaccaucuauuaauauaucucucucccucuuuccacucccagcuggguuucugaaagcgugcacuucccaucuuccauucauucaucugguuuccagcccugaccacaguacugaaauggcauuugcuaggugaccuuuauuuuuuuuuaaauccagugaaugcgguauaguccccccgcuuuuuucuuucuuuuuuuuuuuuuguuuuuuguuuuuuguuuuuuugagacagaguuuugcccuuguugcccaggcuggaguacaauggcgugauaucggcucacggcaaccuaugccuccccagguucaagcgauucuccugcuucagccucccaaguagcuggauuacaggcaccugccaccacagcuggcuaauuuuguauuuuuaguagagauggguuuucucgauguuggucaggcugguuucgaacucccgaccugaggugauccacacaccucugccucccaaagugcugggauuacaggugugagccacugcgcccagccuugguauagucuuuaacgaaaguucacugaucuugaaaauuuugaucuugaaacucuuuuuuuuuuuuuuuuuuuuuuuuuugagauggagucuugcucugucacccaggcuggagugcaguggcacaaucucagcucacugcaaccuccaccucccagguucaagcgauucuccugccucagucucccgaguagcuaggauuacaggugcccaccaccaugccuggcuaauuuuuuguauuuuuuuaguagagaugggguuucacuacauuggccaggauggucuugaacuccugaccucaugauccacccaccucggaccucccaaagugcuaggauuacaggcgugagccaccaugcccagccuugaaacucuccuaagguuauguuaaacauuuuuguauucuugguuuucuuuuuguuccauggguuauuucucuuuauccuucuuuuuagcuuucuuaaguguuccuuuaccuuaucaaauucuauuuuuggcucccauuucacuuaauaagaggaaaagcugggauuuuuuuuuuucuuuuguggagacagagucucacuuuguugcccaggcuggagugcaguggugcgaucucagcucacuccaaccuccgccuucuggguucaagcgauucuugugccucagccuccuguguagcugggauugcaggcaugugccaccacgccuggcuaauuuuuguauuuuuaguagagauggggguuucaccauguuggccaggcuggucucgaacucuugucuuccaagugaucugccugccugggccucccaaagugcugggauaaauuugagccauugugcucgucuaagcugggauucuuugaaugaguucuuagaggcuuccugaaacuuugugcaacauuuuguguauguguauauuuucuggggaaaggauuuguaacuuucuauuuuuugagagggagucucuguggcucaggguggagugcaguggugugaucucggcucacuguaacuucugccuccugguucaagugauucuccugccucaggcucccaaguaccuggaauuacaggcaugugcuaccacaccuggcuaauuuuguauuuuuaguagagacaggguuucauuauguuggccaggcugggaauuuguaacuuucaucagauaucccaagggauauaugucuuuccugguagagagggaagaaacaaaaaacguguguaaauacccuccucucccccagaagguaagaaguacugcucugcacauuccuugggugaucuuucucacucccugggauaauuaaggaaguuagggauugggguugaggguaacuuggcauccuuccccaaccucccuguauaggcacagucuaauauacuugaugacaguuugcaacaagucaacaauuuccuacuuuucugguguuagguuuaaguuauauagaccuauggugaucauaacauuaucuaaaucagaugcuucacauuauaggucuugcagcugauguccaguuuagguguuugaaguggcuuagccuggaaaauguuacaggggaaaaucugcuuuccauguguuaugcucagagcuguguucuuuucuuuuacacaauauguuugacauuuguugaauuuuagguguacccuggucauuaggaacucccuaaaggaucucugugagguuuuaaaaaaacaaaacaaaacaaaaaaacaguggcauuuugcagaacucaguauagcucuuuaccauacugacugcaaggagaaaguaaaaagugagacuaauuuugcaauuagucucccaaguuucuuuacaagaaaauagaccaaagguacuauguuuaaaagcaaaaucauggcuuaaaaguuuuucuuuuucuuaauauauuaauauauugcuauaaauugaguauugcucucuugcuaucuuguguuuuuuugguuuuugauuaacucuaagcuuaauguuauuccugacaaauaaauaaauaaauaaauaaauaaauaaauaaagugaauucagagagacaguagagggcagcagccguuuagaaaguagauucacauugagugauuacggcucuuuuaaaucuuucuccacuaagagauagcuaauuuccgaaaagguauacuuggccucccauauuccuuaugucucuuaaaacuaaaaaagcugggacaaaacuuaaaauaacaguauucuacgguuagggcaaauuucugauacugcuuaaaacaauuuaccgagguaucuuuauuuuuuuuugagacaggguuucacucugucacccaggcuggagugcuggagccuugaccuccugggcucagcucaaguguuccucucaccucagucugccaaguagcugggacuacaggcaugcaccaucauucccaacuaauuuuuuaaaauuuuuuguagagauggggguuucaucauguugccaggcuggucucgaacucuugggcucaagcaaucugcccaccucguccucccgaaguacaggguuauaggcaugagccaccacucccagccucagauuuuuuuauugaugaauuuuauuauaacagcuacaauacugagaugcauaacccuucccuuuccugauacccaguuaucaucuguuucuguuuaauacacuccuuaaguaccucacauuugcuauuccccugccccccauggucuaugcaucuucuucauugaagugguaguagucuuuguuagcucaucuggucaugucaucaauucagagcacauuaccucuuuaguucagaacacauuaauugcuucccauaaucuucaggacacggccccauuucuucacguggcuuggccauugcuucccuguucagcuucccccacacucccucaccuacaccuucugucucaguauaguacugcuagucuccagacaugccaugccuuuuuaugcuucuaugcguguuuuccugucuuuaauguccuuguccaugugaugaaccccuacucauuuuuccaagauugaacucaaaugucaccuuuucugugagcuucucugcucuucucaugcagaguagaaguguuuaucuccauugcccuugacccuaaauaacaguacauuaguauaauaaucacauuuuuuaccuguuugugugcuuuccuucuaaauggagaauaagaauauaaaagugauuuauuuggcauuucugcaaagggagaugauaaaaagaaucugcguuacuuagccuuuuuaaaaaacccuuagccuaugaaggcuacuauuuaagguuugguuggauuuuguauguuggaaauauguucuuuaaaucucaucuucaucaguuuauaaaagcaauauaaguucuuuguagaucauuaucaugccauccagauguagucauuauuguuuugauauagguuguuucagucuuuaaaccaaauuauacacuguuccgcuguaacucuuguuuugaaaacagauuuguuccaaugugggugguauauuagggaacaauuugagcauaauguaaauuuugaguuugcuuaugcacaaaucccuaggcaacacuaggugaaugcagaaaaaugcaugcagcugaacucagcaguguagauauauacaaaagauacacauacacacgcucuucaaauaccuaccuuauuuuccuguauguguuaugaaccauacccauucacaucugguauuacaacuuugccacccauuucagacaguauuccuuugaccauucugcaguaacucagaagcugcagcccuuuagaagucuacuccacuguggcucacgucuguaaucccagcacuuugggaggccgagguggguggaucaugaggucaggagaucaagaccauccuggcuaacacggugaaaccccgucucuacuaaaaaaaaauagaaaaaccuagccgggcgugguggugggcauuuguggucccagcuacucgggaggccgaggcaggagaauggcgugaaccggggaggcagagcuugcagugagccaagauugcgccacugcacuccagccugggcgacagagcgagaguccgucucaaaaaaaaaaaaaaagaaaaaaagaaggccacuccacaagcaaaccgcagauguuuugcaaggugacuuauuuauuguaauaguuguguauuucuuaaccauuucacauguauaaaacugugcuacuacuuuuaugagguuccugucuuuauuuuuuuuaacaugucgcuggugaagguucugagaguuguggcuugaacuccaguuuucucauaagcacgguuuuuuguuguuuuuuuuugaaauggucucgcuguguuccccaggcuggagugcagugguguggucucggcuuucugcagccuuggccucccagcuuaagcuauccucccaccucaagcuauccucccaccucagccucccaaauagcugggacugcaggcgugagccuuugcccaccuaauuuuuauacuuuuguagagacaguuuuuccauguugccaggcugcuuuggaacuccuuagcucaagcaaucagcccgccuucaccucccaaagugcugggauuacagguguguccuaccacacccagacggcucugguauuuacugcauaguguucugauuuuuaggaauacauacguugcauuauauagcagaacuggcuguauucaaaagucuaauagaaaauauugauagggugauaauguauauaguacuaauugucaguugccauaauuuaacuaauauuguuuuacuuuuuacuuuuuuuuuuuuugagauggggccuugcuauauuaccuaggcuggucuugaacuccugagcucaaggaauccucuugccucaaccuccugaggauguuugacauuuuuugacuuuuuuuuuuuuuuuuuugagacggagucuugcucugucucccaggcuggagugcaguggcaugaucucggcucacugcagccuccaccucccggguucaaggguucaagcacuucugccucagccuccugaguagcuaggauuacaggugugcaccaccaccacggcugauuuuuguauuuuuaauagagaugggguuucaccauguuggucaggcuggucuugaacuccugaccucgugauccuccugugucagccucccaaagugcuguggguacaggcgugagccuccaugccggccggcuuuuuggcaauuuaaauaguuacaguuaccuauuauaauugauauuuagcuaacaucuauuuuuauuuuaauauuccaggaaauuauuaugcagaaacuuuaaaggucuguguacuucucugguguuuugauuuuuuuuuuuucuuuuucugugaguaauuuucuaaaacugguuucuaggccaggcuauuuaugucuugcuuuuuauuuuuuuuggcgauggagucucgcuuuguugcccaggcuggagugcaguggcgcuaucucaucuugcugcaaccucugccuccuggguucaagcaguuauccugccucagccucccgaguagcugggacuacaggcacaugccaccacgccuggcuaguuuuuuguauuuuuaguagagguggaguuucaccguguugcccaggcuggucuggaacuucugagcucaggcagucugccugccuuggccucccaaagugcuaggauuacagguguaagccacugcucccagccuuauuauuuuauuuuuauggauucgggguauaugugcagguuugucccauggauauauuguguaauggugaguuuuggacuucuguugugcccaugaacauuguacccaauaggugguaauuuuucaauucucaucccucucucugccucugcccuuuuggaguucccaguaucuguuaauucucucuguauguccauguguacccauuguuuagcuccucuauuuuuuauuuuauuuuauuuuauuuuugagacaagagucuugcuguaucacccaggcuggagugcaguggugcaaucucaguucacugcaaccuuggucucuggguucagaugauucucgugccuuagccucccgaguagcuggaauuacagguccgugccacgaugcccggcuaauuuuuguauuuucaguagagguggaguuucgccauguuggccaggcuggccucaaacucuuggccugaagcaauccgccugccuuggccucccaaagugcugggauuacggugugagccacugcuccugaccccauauuuuuucuuuuaauuauaaagguaauaauguaaaaagaagucaacucccaguuuaacucuagcagaguaaccaguguuaauuuuuuuuuuuuuuuuuuugagacggagucuugcucuauuucccaggcuggagugcagugaugccaucuuggcucacugcaacuucugccuccuggguucaagccauucucgugccucagcuuccugaguagcugagauuauaggcgcccagugccacgccuggcuaauuuguguauuuuuaguagagaugggguuucaccauguuggcuaggcugguguugaacuccugaccucgugauccacccgccucgaugcugggauuacaggcgugagccacugagccuggccaauccauuccuuuuuauggcugaguaguauuccauuguguguguguguauauauacauauauauacacacauauacauauauauacacguauauauguauguaugcguauauauguauguguguguguauauauacacauauacauauauauacaccuauauaugugguauguguauauauaugugguauguauauauaugugguauauauaugugguauguguauauauauaugugguauguguauauauauauguauauauguguguauauaugugguauguauauauauauguauauaugugguauguauauauguauauaugugugucugcauauauguauauguguguauauauacacguauauguguauauauauacguauauauguguauauauacauauauacguauauauauacacacacacauauauauacacauaugcaggcacacauauauauacauauauauauauacauaccacaguuucuuuauccacuuguugauucaugggcauuuggguugguuccacguuuuugcaauugugaauugugcugcuauaaacauccgugugcaaguaucuuuuuuguauaaugauaucuuuuccccuggguagauacccaguagugggauugcuggaucaacugguaguucuacuuuuaaggaaucuccacacuguuuuccuuagugguuauacugguuuacauucccaccagaaguguagaaguguucccuguucacugcauccacaccaacaucuauuuuugauuuuuugauuauggccauucuugcaggaguaaggugguaucgcauugugguuuugauuuacauuucccugaucauuagugauguugagcauuuuuuuauguuuguuugccauuuguauaucuucuugagaauugucuauucauguccuuagcccauuuuuugauaggauuguuuguuuuuuuucuugcuaguuuguuugagcuuguuguagauucugguuauuaguccuuugucagauuuauagauugugaagauuuuuuucccacucuguggguugucuguuuuugucuguuuccuucugcugacuguuccuuuugccaugcaaaagcucuuuuuuuuugagacagaaucucgcucugucggccaggcugguaacaaagacacagguacugguaauaacugccauggcuuauugccuacauuaaugaugaaagcaaaugcuaaauuucagcuagaggcuagagaaaauaagccuggaauuuucuuuuauguuuauauacugcuaugaauaccaggaguccuuggguuaagacuguagggcuuucuaaagccugugaucacuaguggagaauguagcuuuacaaagucuaguuggaaauuggcaacuggggguuaguacaaguuacaaggaagggauggaauuuaagaugcuagugaaagcuuggaggauaagggagcaggugaacucauaaggaaguuuaugaacugagaagggcugcagcaaagugggcucaugugcuugaggagccagaggacauguugagggugacauagguucugaaguucguacagauacuuaugcaguauggauucuuggaaaaccuucuuuagucaugugauagaaaaauaacagcuuauggaaaaaacaggguugaggcagaccugaaaauacaugaaauuuuaaaaaccgcuucuaacagaagcauaacagacuguaauaaaaacuguggccuuccuggcauuugcacccaaacaacagcauuagccaacucuuugaagccuuagaucuguggcucuuguuuucuccuuugagguguagguccuugagggcauuugcuucuaauagaggcuaguuucaucagaauuaaaaaucugaaccaugguaugaaauucaauucuuuuuuuuuuuucuuuuuugaaaacacuggcaaauguuuuguauccuugagcuuucccacauaucuuaacauagugaguggaaaguacaguggcuguuaagccaacuacucugaggucuucacugcuaaggcuuacucuuaauugugugagagcuuaaccuugaucccuuuaaaacauuaaugggcuagaaaaaaaaccauucauaaaccagugccaccucugaauuuugcuaccacaauucccuuauuuaccaauagugcaugagcuaauuuggaauaaagaacuaggcauuguagcacaacagacauuaugugggcaaaguguuguuuauauucugucuaaauagugcuucacauguauguacuauuuucuaaauauguauagaugcuuuugugauuaauaauaaaacaugaauucuuaaaacaauuuugcugacuucauaguagcuuuucaccguuuuuucaguagcugcuaaaauuucuggagaaguuugggaacuauuguuuuggagugaaaugcaguguguuagauaucacuugcagaauucuucuaaggguauuuauuggcgauuagaaaaaaaauccuuguguuauaccaguaguaauacaaaguaauuguucagcuucuguuaaguguaaaggacuauacaaguauuguguauaguuaucucauuuauuauuuucuggguagcuauuguuauuauuacuucguacaaaaagggaaaaggaggcucaaaguaucaugcuccagauaacagagccaguagguagcagagcugggauugcuacccaggucucuaguccugcuuuuucacacuauauacucauugcuucacuuacuccuucauacaugauuccccagcauguacucuuuuuuuuuuuuuuuuuuuuuuguuugagauagaaucucgcucucuguugcccaggcuggcaggcaguagugugaucuugggcuaacugcaaccuccaucuccugcauucaagcaguucuccugcuucaaccuccugaguagcugagauuauaagccuaugcuaccacgccuggcuaauuuuuguauuuuuagcagagaugagguuucgccuuguuggccaggcuggucucaaacuccugaacucaagugaucugcccaccucagccuccgaaagugcugggauuauaggcaugagccaucauguccggccuccccaucauguacccuuaaauaccaucaagcacaguuccauuguguaaaaacuuggcuugauuuaaccuguuaauuggaacacugucauuaauggaaauuaggaauaugagguaagcuagagguuuuauuuuaaugacuuuggguuauuaaaucuauaagaaaugaaauucauuuagucauaauuaaugucauguuucugcaucuauauuacuuguuggguuuacagacgagguaguguauuauuagugggaagcuuugagugcuacaucaucucccuuucuauaaaauaaauugaguacgaaacaauuugaauuaaaacaccugaguaaauaguaacuuuggagaccugcuguacuauuuguaccuuuuggaucaaaugaugcuuguuuaucucagucaaaauuuuaugauuuguauucuguaaaaugagaucuuuuuauuuguuuguuuuacuacuuucuuuuaggaaaacaccagaaauuauuguuggcaguuuuugugacuccucuuacugaucuucguucugacuucuccaaguuucaggaaaugauagaaacaacuuuagauauggaucagguaugcaauauacuuuuuaauuuaagcaguaguuauuuuuaaaaagcaaaggccacuuuaagaaaguuuguagauuuuucuuuuuaguaucuaauuguagcaccuuuguggacaguggauguaauauuaagugacagaugggaaaaggauuuuuaaaaaaauagcaacuguuucaguggaugaaauaaagauuauuagcagagaaaaugaauauugggcauaacuguccuggugaaagacaaucucauaaaugaacaauuucauaauuucguaaaugcaacugcauuuuauuuucaaagagaaggaaaauuauagucacuggaaacggaaagagaaguuagagguaaacauaggacacacaagaaaacuuucauuuuguuuauuuucuuguuuuucuuuugagacaggguuucccucuguuacccaggcuuaagugcagugacacuaucauaguucacuaaccccucaaauuccuggguucaaguaauccuccugccuuagccuuaguagguguaaauacagguguguaccaccaugccuggcgaauuuuaaaaaaacuuuuuuauagagaugagcucucgccguguugcccaagcugguccuaaaacgcuggccucaagcuauccuccggccucagucuuagccucccaaaaugcugggguuucaguagaagccaccaugccgggccacuucuguuucuuuuccauguagaguucuuugcaggaggagguuagaauaggugugcaucuccuaaauaguugucgaauauaacuaaaaaguuaaccaggacucuaaauacuauuuacuucuaaaauuuguuaauugggaacauuuaggguuuaacugaucuauaucuuaugucuuuaacaauuuugaaugauaauuauauguaaaguaagaacaguuugugaaauaguugaaaauauccuuacaugaaagugaauuuuaaagcacaguuuauguaauguuaauguuuuguuuuguaucuguuaaaaauuuguuuauaugaacaaguuuacagguuuacuguggugagcccguugaauauaguggguuuuuuuuguuuguuuuguuuuuguuuuugagaugaagucucacucuugucccgaggcugaugugcaauggcgcgaucuuggcucacugcaaccucugccuccuggguucaagcgauucuccugccuuagccucccgaguagcugggauuauaggcaccugucaccaaacccggcuaaguuuuguauuuuugguagagaugggaucucagcauguuggccaggcuggacucaggugauccgucugccucggccucccaagugcugggauuacaggugugagccaccaugccgagccugaauauaguguuuuuaaguugcaggacuuuaaaaauaauauuuugaaauuuuucuaaguuaaauucccuguuaaaauggucaugcaggaauauacgcuugcauuauucauauuaggguaacuguuugguuugcuaguuguuagauucuuugcauuccuuuuuuuuuuuuuuuuuuuuuuuuuuuuugagacggaguuucacucuuuuugacaaggcuggagugcaauggcgcuaucucggcucaccucaaccuccgccuccuggguucaagcgauucuccugccucagccucccaaguagcuggaauuacaggaauacgccaccaagcccggcuaauuuuguauuuuuaguagagaugggguuucuccauguuggucaggcuggucucaaacucccagucucaggugaucagcccaccucggccucccaaagugcugggauuacaggaguaaucccccacccuuuuaaaaaaaugagacagaguuuuauucugucacccaggguggagugcaguggugcgaucaugguucaccgcagccuugaaucugggcucaagugauccucccacuucagccucccaaguaguuggaaccauagaugugcaucaccacaccuggcugauuuuuaaauuauuuguagagaugaggucuugcuuguugucuaggcuggucuuaaacuucugggcuucagcaguccuccugccucagccucccagagugcugagaugauagacaugggccacugccccuggccgcauuuuucuuuucuuuuccuuucuuuuuuuuuuuuuuuuuuugaaacggaguuuugccauugucgcccaggcuggagugcaguggcacgaucucugcucacugcaaccucugccucccgaguucaagccauucuucugccucagccuuccaguuaucugggauuacagucaugugccaccacgcccagcuaauuuuuguauuuuuaguagaaacaggguuucucuauguuggucaggcuugucccaaacuccugaccucagaugauccaccugcgucugccucccaaagugcugggauuauaggcgugagccaccaugcccggcccuaacugcauuuuucuuaguauuugugguuugaguuaauacuugcccuaugugauguugauuuauuauuacuggaucauuaagugagguuuaaagaagcuaaaugccauuugcucuaugcccucuggauuuuaaaagugcaugggugugcacguguguagguauaaauguuuccauauucuaguauauucugugucagugauagagcagucuuagagcugucuuuuccauuuacuuguagguuaagaagccaaaaaaaguugugucaucaucccguuuaggaaaacuuacauuuuggcuauuguuuccucuagugcugcuauuaguggaaugauuuuagguguucaacuuucagaucaaugggagacagaaauauuguucugagacaucuggaagccgaauguguuuuauuccugccugucugaggauguggucuugccuuugauagggcaaaguuauuuguaaacauugcuuuaaauaaaaacauguaaagguguuuuugaugguuaacaaaaacuaugaguauaauagagccuagucccuauuacggacugguauugaucuggugugggaagaguauugagcuuuucagugucaccuaccuguauucccuugaagggacccagagcccaggcaaagcucugcugaggucgggcguggugguucacgccuguaauccuagcauuuuaggagaccaaggcggguggaucaccugaggucaggaguucaagaccagccuagccaacauggugaaacccugucucuacuaaaaauacaaaaauuagcugggugugguggugcaugccuguaaucccagcuaucugggaggcugaggcaagagaauugcuugaacccaggagacggagguugcaaugagccgagaucaugccacugcacucuaggugggucccugagugagacuccaucucaaaaaaaaaaacaaacaaaaaaaaaaaaaaaaaaaaaccucugcugaaaugcuacaguuaauuuugccauuuguggucagcauucuucuucuaaauugcuauaaucuugccuucauauuaugugucucaaauuuaagcagguaucagaauguccacgggaacaaauugccauggcucuaagcccagaaucagauucuucagaucuggaguagggcuggggaauuugcauuucuaacacacaaguuuguugaugcuguuugucugggguccacgcuugccuaacuucugaugugauuuauuucugccaguuucuuuuuuuguuguuguuuuauuuuuuugagauggagucucgcucugucacucaggcuagggugcaguggcaugaucuuggcucacugcaaccccugccuccuggguucaagcgauucuccugccucagccuccugaguagcugggguuauaggcacacugcaccacacccagcuaauuuuuguauuuuucguagagacaggguuucaccauguuggccaggcuggucuugaacuccugaccucaggugauccauuggccucggccucccaaagugcucggauuacaggugugagccacccaccaugccuggcccuuccuaccaauuucuauccucccugaaaugcugcacacuuaggcagucacuggacaauaucugccccaaaauugguuuguauaauugagaauauuuaagagguuguuaaaauuugaaccacuuucuauucuucuauuaaguguacacaucuauuaaagauccccuuguagcucuuuuuaucugggccaucacauuucugcccagcagaugcagaggcccuguccucucuuccaccuccccacuaccucuccuucccuacuuuuggacuguaaaagcugucuuucugcaguuaauuguuuuauucuuuguagguucuacucguugauaauguuaucuacugcuauaauaauuacagacggcaacaggaugaucaaaucuuggauauuuuaaauuuacauuaugccuuuuuuauuuuauuuuuuuaaagucucugcuugacagcaaauaagccuaacguucccuaacaaaugaugaugucccauuaaugauuugaugacuuccuguuuguaguuuuuauuuagagugcuuguggguaguuuuucauaacgacauuuaaaaaucaggauauaaauaauuuuuuaaguuuuuuuuuuaggcggggcacaguggcucacaccuguaauuccagcauuuugggaggcugaggugggcagaucuugugaggucaggaguucaacaccagccuggccaacagggcgacaccccauuucuacuaaaaauacaaaaauuaggccgggugcgguggcucacaccuguaaucccagcacuuugggaggccgaggcaggcagaucacaaggucaggagaucgagaccauccuggcuaacacggugaaaccccaucucuacuaaaaaugcaaaaaauuagccgggcaugguggcaggcgccuauagucccagcuacucggaaggcugaggcaggagaauggcuugaacccaggagguggagcuugcagugagccgagauggcgcugcugcacuccaaccugggcgagagugcgagacucugucucaaaaaaauaaacaaauaaaaaauaaaaaaauuaaccaggcaugguggcgcauaccuguagucccagcuacuugggaggcugggacaguagaaucgcuugaacucgggagguggagguugcagugagcugagaucacccacugaacuccagccugggcaacagagcaagacucugucuccaaaaaaaaaaaauguauuuuucuuugaagcuuuucuacuuuuaaauguaauguauaguauuauaacaagugaacaaaaugauacaaagaaguauggcgggaaaggugugguagagaugggaaaacauauuuccuccagccucuuagguucauuggaggagcuugggaauucaacugacacacgacagauuuacaggagaaaaguuuuauuucaaguacacaugagagcuucauagaaaagaagugaagaccuaaagaaacagacuggagaguucauaugccauuuuaauaaaggauaauguauuagucuguucucaugcugcuaauaaauacauacccaagacuggguaauuuauaaagaaaaagagguuuaaucgacucacaauugcacauggcuggggaggccuuacaaucauggcagaagguaaaggaggagcaaaggcacauauuacauggugucaggcaagagagugugugcaggggaacugcccuuuauaaaaccaucagaucucgagagacuuauucaccaucacaagaacggcaugggaaaaaccugcccccgugauucaauuaccucccaccgggucccucccaugacacauggggauuaugggagcuacaacucaagaugagauuuggguggggacacagccaagacauaucagauaauaaauuguggagaggcaguaagauugaagaaaagagguuugagcuucgaggggugguaaauugugggaagguaauuauuuggggcaaacuaauggcacauaaggauuguuuuaguaaggcuuguuaugcauacccaaaacaagugccaucuccaguaauuuaagagucuauggugaucaagaguaguucucuuccugcuagaagaggggugggagagaacaccuucacaaagggaaauuuauauucugccuucaugcagaaagggggcgagcagagaguuccuacguauacuguuucuucauuaucuuccucucaaaagaauacuuaggcuaaaguggcaugauuuggggugacauucugauccucuucagugacaauccuugauauuuuuccuucuuucucuccagguaaacaguguuaacauccugguaugcuucccccaauuccauuauacuaacucuguauuguggguuaaagauuuuuuacuuugaucagcaguauuugaaacauaccuguuauacuagauguacucugacuguaaaauaguggucaguguuacuucuuuaaugaugcugugggauuaaaggauuuuauuauaaaugcugggaagagccuggauuugaggaagguaagcagugcaguuagguggauguagacuagaagaggucauuuguucucauuucauuguugccccuaugacaugcccguuucuuucuuuuuuuucuuuuuuuuuuugagacggcgucuugcucugucgcccaggcuggagugcaguggcgcaaucucaccucacugcaagcucugccccccggguucaugccauucuucugcgucagccucccgaguagcuggaacuacaggcgccugccaccaugcccagcuaauuuuuuguauuuucaguagacacgggguuucaccauguuggccaggguggucucaaucuccucaccucaugaucugcccgccucggccucccaaagugcugggauuacaggcguaagccacugcacccagccuacgugcccauuucuuaaaguagaaaauuuaguaguugaugaugucagggaagaaaagcuuuuucucugccuuacguuaaguaguugggggcaaauuaaauuaauaaaagacagauuagugagagaaaaggcuguaagaauuuggacuuuauauaccaucauaauagaggaaguaaagggagaugaagggcacuuaagggaaaacagaugacuuguaggaaagauaaaugaacccuuaagagaauagaugagaaauaugaagguuuugugacaaugucuguuuaggugguuacuucucuucuuguuaugagagucagucuucugguugcuggaaacugcuaggagauuuauaacaauugggcucuuucgagaggcucuucuuuuaagcagauaagggaguucacaaaaaagccuguucucaaaugauuucagcacacacacacacacacuuacgacacaguuaaguacugugccaguaagaugugaguugugcauuucuuuuuuuucucugaguagacuguuugagguuauuuauaucaggacuuguuaugcagguaacugaaaacucaacauaaucuagguuauguaguuaaaaguauggagagaagguaggcuuuauuuagaguugcuugauccuguagaucucuucuaccuuuuguaauuuuaauuucaaccaaggaugguucccuuuuuggcccuaggaccaguuagcaguuggggcaccauuccaagcaagaguccugcaguuuguagugaugggaccauuuaaacagugauugugaccagggacauagaaugggaugauuggcccgagguaaccaugguuggguauggagucagcuucccuguaggaagagauagacaaagucugagcacuccugggaagggggaggaagggaauaacuguuguguaaaucaucagcagugucuacuaagauaccaucuguaaccauaggcuucuauguuuuauaauauaaggcugucuuuuaaauaaaucagauucccuguuaaagaucuguucuagauucccuaggggguugaccucauauaguaucuucuuuuucuuugguuacaaacuuuuaaacuugucugagguuauaaggugaauucaacuguccacugucaauguagauauuuuuaauggauuuagggauuuaaauuacaugauucagaaccacuuugaggaagucuagggaauaucaguuguuucuguauaauuucugaaagcuucacuguuuucuaggugugcacuuaauucaugugaugaagggaacaguauuuacaugagugguuugguuaauuuuuccccuccuaagcuuagcuuuguguaucgugcgugcuuccaguguuuuuguggcugcuuuacauaagucuuuuagaaguauuuucuauuuuugaaguaaauguggaucaaaaccaccccaagacaggauugaaaaaaagacaguuuuucgcaagaaaguaaauaauuuuauuuagcuugggacuuuaaaugauaugucuuaaauguaaacauuucuauacugcauuuuggccaucuuuugauacuaguuuucagaugcauauuguuauuucauuuauuauuggaaaaguaguaacuuuaaacaaauuuuuauugaaaaugcugacagaggccgaguguaguagcucacaccuguaaugucagcacuuugggaggccgaggcgggcggaucacgagcucaggagaucaagaccauccuggcuaacacggugaaaccccgucuguacuaaaaauacaaaaaaauuagccgggcaugguggcaggucccuguagucccagcuacucaggaggcugaggcaggagcauggcaugaaucugggaggcggagcuugcagugagccaagaucgcgcuacugcacuccagccugggcaacagagcaagacuccaucucaaaaaaaaaaaaaaaaagaaagaaaaugcugaccaaaaaaaaugaaauaguuuuaaagaagccacaguugugugauccugauacaacuauaucauuauuguaugaguauauaugaguuauaaaaauaguauauguaaaugcuucauaauuuuuauuauuagaaaugaaaaaguauaacaagggggguauucauauucucuccacuuagaauuaacccucaacauguugacaucuuuguuuauaguaauccuuuuuuguuuuuuuuguuuuuuauuauacuuuaaguucuaggguacauguguacaaugugcagguuuguuacauauguauacaugugacauguugguguguugcacccauuaacucgucauuuacauuagguauaucuccugaugcuaucccuccccccucccuccaccccucaacaggugugugauguuccccuuccuguguccaaguguccucauuguucaauucccaccuaugacugagaacaugcgguguuugguuuuuuguccuugcgauaguuugcugagaaugauaguuuccagcuucauccauuucccuacaaaggacaugaacucaucauuuuuuauggcugcauaguauuccaugguguauaugugccacauuuucuuaaucuagucugucauuguuggacauuuggguugauuccaagucuuugauguugugaauagugccgcaauaaacacacgugugcgugagccuuuauagcagcaugauuuauaauccuuuggguauauacccaguaaugggauggcuggguccaaugguauuucuacuucuagaucccugaggaaucgccacagucuuccacaaugguugaacuaguuuacagucccaccaacaguguaaaaguguuccuauuucuccacaucgucuccagcaccugucguuuccugacuuuuuaaugaucgccauucuaacuggugugagaugguaucucauugugguuuugauuugcauuucucugauggccagugaugaugagcuauagaaauccuuuuuagaaacaacagagccuuguuguaaaacagguaaauguacgugaggacuucaaaaaguuuguggaaaaauggaauuaaaagauaaaauuuaaaaacacauuuuaaauuuauuucccaacauaagcuccucaaguucaagacacuuuuauaaaugaugaucucagcuguuuaguucauccguaaagaacugaggguacuagaaauuuuaccaugucaaugcagucucuuuacauuacuaacuaaagaaaaauaggugcucuuuaaagaucuuuuaagauuaggaacaaaaagaagucagaagaagccaaaucaagguggaugcuuaacgacuuuccauagaaacuuacaaaauuggccuuguuugaugagaagagcgugcaggaacguugucaugguggaaaaggacuuugaugaugcuuucccuggcauuuuucugcaaaaacuugggauaacuuucucaaaacacucuaauaauaagcagagcuuauguucuuuauccccccagaacaucagcaagcaaaaugccugaacaucccaaaaaacuguugccaugaccuuugcccuugacugguccacuuuugcuucgacuggaccacuuccauuuuugguagccauugcuuugauugugcuuugucuucaggauggcauugguaaagccauguuuuggcuccuguuacaguucuuugaagaaaugcuucaggaucuugaucccuuguuuaaauuucuauggaaagcucugcuccugucugcaguuaaucugggugcaacaguuuugucacccaucaagugaaaaguuuguucagcuuuaauuuuucagucagaauuguguaaacuggaccaauuguugagaugccuguaguguuggcuauuguuucugcuguuagucauuaguucucuucaauuagggaaugaacaaaauuaauuuuuccugaaaaauugauguggauggucugccgcugugggcuucaucuucgacauggucucaucccuuguuagaacaaguuauccguuuguaaacugcugauuuccuaggagcauugaccccauaaaauuuucauaaagcaucaguuauuucauuauucuucuaugcagacuucacuauaaauuugcuguuuggucuuacuucaauuuuagcagaacucauacugcucugacaucuaaacugaugucuuagccuucauagugucucugacuagauccuauucagacguguuauagcaaauuaguaaaguuuauuuuggugccaaaaacuuuugaauccacgcauaguuuuuucacaacacauuuuccaugaacuuuuugaagacccuucauauauuauaagaagaaaguuaaaaauauccccugcaucuacuacucagaaauaaccacuguuaacauuaagucuguucucaacucuaggcauuauugaggguuuugaggacaggucuugaaaauuucuauggcuaccuuuuacuggguggagacuagcauguauaguugaccgcauagguuaaucccuccacucaaaaagccacaauuuuaaaguguaguauucacuagcauuuaguauauucacaguguugugaaaugaccaccaccaucuaguuugaaaauauuucaucacaaccaaaagaaaaccucauaucuauuagcggucucuccuguuuccccagacaccggcaaccacuaauguacuuuuugucucuguggacuugucaguucuggacauuuuauauaaauggaaucaugugaccuuuuaugauugaccucuuucacuuaguauaauguuuuagaggcucauccacauuguagcaugugucaguacuucauuuccuuguguauugguccauucuuguacugcuauaaagaaauagcugagacugaguaauuuauaaagaaaagagguuuaauuggcucaugguucugcaggccguacaggaagcaugaugauggcaccugcucagcuucuggggaggccucaggaaauuuaaaaucauggcagaaggggaagugcggcgucuuacaugguggagcaggagcaagagagagaagggggaggugcuccacacuuuuaaacaacuagaucucaggacaagucagucacuauaaugagaacagcacccaggggaaaccgcccucacgauccagucaccucucaccaggcuccaccuccagcacuggggauuccaguuccaauucaacaugauacuugggugggggcacauauccagaccauaucuccucguauagcugaauaguauucccuuauauggacauaccacauuuauuauuaauuuauugauugauugacaggauccugcucuguuguccaggcuggagugcagugguuugagcauagcucacugcaggccuugaauuccugggcuccagugauccucccaccucagccuccugcguaccugagauuauaggugugugccaccacaccuggcuaauuuuuuuuauuuuuuagcagagacaggguuuuugcuauguuucccaggcuggcuuugaacuccugggcucaagcaauccuccugccuuggcuucccaaaguuguaggauuacaagugugaguuuagagagguauaauuucuuacucaacuucaaguauuuuauuucucuuaucauuuguuguuugguuuguuaauuauuuggaaguauauuuuuaaauuuccaagcuuagugugugucaguuucauaaaaguuccccauguauuuaaaaauuggauguguacucuaauuuugggauugcuuuuucauugucuauauaugcuugcuaauuuuugaucugcuggguuacugagaaggauguggguuucuccaucuaguucuauuuuugguuaauauguuaggcacagagcuguuguuuuuuuguggugaauugaaucuucaucauucuuuagggacucuguccuuaauaaugcuuuuuuugccuuacauuuuguuucauuguaagagagcuaugucagaguacuuuuuaaaacacuuuuuaauaugguauauauuuuuuucuuuuuuaaugagguuuuuuaaccguaaguuuaagcaaaauaaagcuuaauaacuggauuuuauuuaguuuuaaauuuaauuugauuuuuuuuuuuuugagacuaagucucacucugucgcccaggcuggggugcaguggugcgaucucagcucacugcagccuccgccucccggguuuaagugauucuccugccuuagccucccuaggagcugggauuacaggcgugcgccaccacgccuggcuaauuuuuguauuuuuaguagaggcgggcuuucaccauguuggccagucuggucucgaacuccugaccucaggugauccaccugccucagccucccaaagugcugggauuacaggcaugagccaacacuccuggcuaauuuaauucgauuuuuuuaguagcaguuuuagucuauuauguuuguuguaguuacuaguaucuuuggauuuauuucuaccuaauuauuuggugauuccucuucuuccugguuccacuuacacauuaaaaaaaaaaacaaaaaaaacuuagaauagagauggugucucacuauguuguucaggcugcucucaaacuccagggcucaaguuauccuccugccuuggccucccaaagugcugggauuacagguaugagccaccauaccuggucccccuugcccauucuguuuuacuuuuguauugcuuggguuucuaaaauuccauuuuguccucucccuuugcucuuccccaauccuaucucaucacacacacugguuuggaagauagccacuuuuuuuuuuccaauguguuuacuuaucuuaucagagucaaaagccuaucaguaucuucucagauaucccaaaaaauacuaggaccuuaagacaccuaaaaucagguuacauuucuucauaauugucuaguauucuaguucuaucaguuuuaccucucagaucuccauucuguaagucaauguuaaguuuagauuuguccauaugcauacgaguuucuuugguauucaauacuuccuguauauuuuuaagaaguuccuuuguuggaggucuguuagguuuuauuuguuugaaaaugucuguauuucacccuuguucuugaaggaugguuuuucuagguauacaguucuuuuuuuuuuuucuuugauacaguuuugcucuuguugcccaggcuggagugcaauggugcgaucuugacucacugcagccuccaccucccagguucaagugauucuccugcuucagccucucgaguagcugggauuacaggugcccaccaucacaccuggcuaauuuuugguauuuuuaguagacgggguuucaccaugcuggccaggcuggucuugaacuccugaccucaggugaucuaccuaccuuggccucccaaagugcuaggguuacaggcgugagccaccgugccugacaaaggccuaacuuuccuuccucauucuuuucaucuuguuucuugguuucaucaucccauuuuuuaguuucuuuucagucuccuuuuguguagccugaagcaauaacuguguuucugaugccuagguaaguauacuguagguaggcugauacuguucagcuaguacauaguagaagucagaugucacauuuuuagaauacuccaguucuagauaagaauaccuuguugggugauauauuuuauuauccuggauuguuuggcggauguaauggauugcugaagacgcccaguuuccuguguggcccuugaguauuuauuuuaguaaguuagaggcuaguuguucacuuuucccuuguuuaacuggggacuccucagcagcccuuucaaaacaguauaaccucaucugagaaaggaaaauguaaggauauucauuaaguuuucuucucuccagauuugggauuauuuuuaggaauucucaagaguuuuguugacuuaccaacuagguuucuugaagauggugagugaggauaggaacuuggccugguuuggcucaccucucagauucauuggaagaggcaaguucauuagcacaguuucaguccaccauuacagcauuuuuuuccugaauuauuauaagucuuagucaauauuuccagauaaucaucauuaucuguuuaaauuacugcacaguauucuauuuuacugauguaccauugugcaaauacuaugauguuuuauuauuuuuaaguuuugcuauaacagauaagucugcagagauuuuauucagcucuguauuguuuugcuucuguugcauuguuuccucagauugaauuucuaggaguagaauugcuaugucaaagagaauaacaaguaucucugagccuugccgcauacugcuuuuuucauuuuuaaagguuauaccaaguuagagucucacuagaacugaaugaguguacuaauuuuacuguagcuaguuucuuuuuuuuuaaaaaaaaaaaaagcuguagaauaaucucaagguugcuuaaauauuucugucuuuuauucuuacagcauuuccuguggauuaguucacuacuuauuuucuuaucugugaguuguaagugcuuacacaugcccacuugaugaccuugauguuuucuuacacauggaagcaagugcuuuuuguaaaagaauauauuaaccuuuaucuuuuuacauuuugugaagcuuuuuuuuuaauguuucaucuuuuaaaaauuagguuuauucagaauuuuaaauuuuaauauuauauugaauuucuuuugguugguuuaaauugagaaaguuauuuuauguauauucucuuuuuuugcuagcuuucuguaauuugauuuuaauuccuuauuccuugcauaguuugcuucugguauguuaaagugugcucucucuaaguggguaguaauuaggaacaauuuaucucaaccucauuuauugaauguuuuaaaucaagagaacggacucuguuauauuaagcuucuauauauaauugucuguuucacuguaaugccuaguaaggauacacuucauucuuuuuuuagauguucuuucacaauuucauguaaauuuuaguuguuuuguuucaaaaaacaauuccuauugaacaaucucuaggaauagauagcuuaauaauaauauuagaucuaguuuucucuuuucauaguuuaccucuucuuucuuuucuuucuuuuuuuuuuuuuuuugagacggagucucgcugugucgcccaggcuggagugcaguggugcgaucucugcucacagcaagcuccgccucccagguucgcgccauucuccugccucagccucccaacuagcugggacuacaggugccccccaccacuccuggcuaauuuuuuuuuuuuuuuuuuuuuuuuuuuuuuuguauuuuuaguagagacaggguuucauuguguuagccaggauggucucaaucuccugaccucgugauccgcccaccucggccucccaaaguggauuacaggcgugagccaccgcgcccagccucugucucucuuuucuuuuucuuuuucuuuucuuuucuuuucuuuucuuuucuuuucuuuucuuuucuuuucuuuucuuuccuuuccuuuccuuuccuuuccuuuccuuuccuuuccuuuucuuuucuuucuuuucuuuucuucucucuucucuucucuucucuucucuucucugucuuuuuuugacgagucucaguaugucaccuaggcuggaguacaguugcacaauguuggcucauugcaaccucugccucccuuguucaagugauuguccugccucagccugccaaauagcugggacuacaggugcgcacugcuacgcccggcuaauuuuguauuuuuaguagagaugggguuucaccauguuggccaagccggucucaaacuccugaccucaagagauccaccugccucggccucccaaagugcugggauuacaaguaugagccacgaugccaguccaauucuuguguaguuuuuuaaucagcugaauuuaacauucaaauucuucuuuuaaaucuuccaauaggcaguuaucuuuauaaagauccuauauaaucaagacuuuguuucugaauauuuuauguauguuuuugcuacuguaaaugagaucuauuucucauugugguuucuugcuguuauuacugguaagaauuuagugaaacaaaguacuuaagaguaugucuuuaaauugugagauuuugaugaacuuuuaagaaauaaaauucuuuaguuucuuagagcuuuuugagauuucuaagguagauccuugguuugggcaacauauaacuauuacaaguuuugcacauugaacguuauuugguaauuuuuagagaggacauuuuaaauguuuaggaaaaauauaaauaaaauguagaauacuauugggggcauauacaucaucagcacuguaacuguuucauaugaaucauuuuuguacauauagaacucuaaaguccuaaugaacagaauuuuacauuucuauaaauagaaaguccuuaauaguugugacugaauaacuuauggauagcaaauuauuuaacugaaaacaguaaaauuuaagugggaggaaauauuugcuuuauaauuucugucuuuacccauuauuuauaggauuuugucacuuuguucuguuugcagguggaaaaccaugaauuccuuguaaaaccuucauuugauccuaaucucagugaauuaagagaaauaaugaaugacuuggaaaagaagaugcagucaacauuaauaagugcagccagagaucuugguaagaaugggucauuggagguuggaauaauucuuuugucuauacacuguauagacaaaauauugaugccagaauuauuuuauaaguucccuguccccaagaugaugacuucacaucucugucaaacagaaaucgcccaacaggcccuuguaugaugucauuuaaacaagcccuauuuuaaaugucaccuccacugguaacaggauacuccuaggaggaucaccaagcccaauucuucuaggaguagugcauugauuaggcuuugggguuuccaagcaguucauuaaugucacuuuuggaaaaagucugucuuucauaccagcuuauuaauucccuauggguucacacgguuuuuuuuccuggauuuucaucaaacauguguaagguacucaguacaaagaaguuuagaaauccagaacaaagcaguguauuuaaguaguaguaaacuuccagauaaucugaugcccauaucuacauauauaaaaaauuugcaaauaguucuguagagaguccaaacauggaguagaucccuaauuaagagccuuugcauuaaaguccaccuuccucauuucauagcuaaggauauugaggcucagagaguuuaugugucuggaguuaaaguuauuuuguguuuccuuaauuuuugacuuacuagaaaguuaaaguaccuacagauuucuguguuucacuauauguuaacuugcuuggcuggaaguuuuucugcugauaauugguuuuaugaaggaagaauccuguuaagaaugcaucauuggacugggugugguggcucacgccuguagugauccuagcaguuugagagaccgaggugggcagauugcuugaguccaggaguuugacacuaaccugggcaacaugaugaaacccugucucuacaacaaauacaaaaauuggccauacaugguggcacgcaccuguggucccagcuacucaggaggcugaggugagaggaucacuugagccagggagguugaggcuauaaugagccauaauugcacuacugcacuccagccugggugacagggugagauccugucucaaaauaagaaaagagaaugcaucauuggccaggcacagugacucaugccuauaaucccaauacuuuaggaggaucacuucagcccaggaguucaagacuagccugugccacauagaccacauuucuaccaaaaaucaaaaggaaaaaacuugcuggguguggugaugcacaccuguggucccagcuacucgggaggcugaggugagaggauugcuuuagcuuaggugguugaggcugcagugagccaugauagcaccacugcauuccauccagccugagggacggagugagagcgacaccuugucuuuaaaaaaaaaaacagaggaaugcaucauaguauauauuaaauuauugccuauuuuuuuaucuauuuuauugagugcuaauaagaaaauuaauggcaaaaacuuguuuuuuacaguauaaauuaaguuuaauuucauuuuaaaauuaaguaaauuuguuuuauuaaaaaguauguugaaagcaacauaaauagcacucaaauugagacagaaacuguaacuguaguauaagaagcauuaggcugggaauugggaaacacgaguucuaguugcagcuuggaaacuuuuucugaagcucuuuacaaauuacuuaauuucucugguuuucaccacauuguucuauagcauuaacauguuggauucauugcuuuaauucuuagaccuacgugucaucagaaaugccauuacacuuugaggauuugagccuuauuuuaaauaaaguugugauccucauggcagccuagguuuacauguguuaaauaaacaguauucuguaaauaccauugucuuucauguuuagugauguugcuguuguuaacacugcagugaaaugcauauauaagcaaacuacauuacauacucaugaacaugguccuuuguuuugaaacuuugaucacugauuguucgcagucuuucauuguggaacuacucuuucacuuugaauguuuugagagguuccuuuguucagaucaguccgauuucguuucugggugggucucuacuuucccuuuucucacuggucaagcgaggucugucuaauuguuugcuacuacuaacauuugauggccacgcuucagcaaguacauuuguagauucucucucucugucucucuuaauuuguggucuagagaucauauugguuaaugaaauuaugaagagggaauguauuuauaaaaacucaaauucuugaugcagaaggucuagcugauugugaacccaaaauauccgagacaggucacaaccaauuuagaaacuuuauuuugccaagguuaaggaugcauccaugacauagucucacaagguucuaaugacacaugcgcaaggugguuaggguacagcuugguuuuauacauuuuagggagacaugagacaucagucaacauguguaagauguacauugauucuauccagaaaggcaggacaacuugaagcaaggggcuuucagguaauaaguagauaagagacaaaagguugcauacuuuugaguccuugaucagccuuucacugaauaaacaagcuuagucuuguuagugaaucugcguuuuuacauaaacaguaggucagaggaagcaaucagaaaugcauuugugucaggugagccgagggaugacuuucugucccucaccugugaagauaagcuaucaguuuccauugcuagggugaaauucaacagaauuguuugagagugaacaucuggaggcccacaaggacuuuccuuguggaggggaaguauguagugagggaaguauguaguuuuuaaaucuuugucgcuaucuuauuuagaaauaagauggaaggcagguuugucugacauaguucccagcuugacuuuucccucggcuuagugauuuugcgguuccgagauuuauuuuccuuucacauaucagucagaucauuugguuugugaaguuuccuaugcuuaacagaaaauaugugcacuaguuuuccuagaguuucauugucagagucucaaguuuuuguuuggaaauuguauuuggucacauuaauuauacucuauguuaguuccaaagaaauaccuuugguuaagaaaagaauucucaugcauaacuccucgagggugggguuacaccuuaauccauccucaggugcucaugguaauuggggcaaauauguugcccagugcuggugcucugcagccuuggauggguuuacccagaaagcagcuuucaagucagaaacuaacauucauaagggaguuaaggauuuuauaaauagauauccauaauucauguaguuuucaaguaaguaguauuugaaucuuuucugguuagauaauaauugugaguauguugucauauaauaacaguauguuuuucacuauuuaaauaauuuuagaauuacauugaaaaaugguaguagguauuuauggaauacuuuuucuuuucuucuugauuaucaaggcuuggacccuggcaaacagauuaaacuggauuccagugcacaguuuggauauuacuuucguguaaccuguaaggaagaaaaaguccuucguaacaauaaaaacuuuaguacuguagauauccagaagaaugguguuaaauuuaccaacagguuugcaagucguuauuauauuuuuaacccuuuauuaauucccuaaaugcucuaacaugaugugaauguucuaugauaaguuuuacuaauguagucaucagguaagagucaagcuuucuuccauagagcagucagcugucgcaacaccauuuguuaaauaguccgucuguucuccauugacugaagugguacuuugggucuauuuuaaagacucuacuuuuaccucgucucaccauucuuuugucuacacaaaauauauuuuaucgcuuauucuguguuaccauaucuauuagagcuaguucccccucauaucucugcuuuaguuauuuucacauguuucuuuuaucuuuuuuuuuuuuggagauggagucucgcucuguugcccaggcuggagugcaguggcaugaucucggcucacugcaagcuccgccuuccggguucacgccauucuccugccucagccucccgaguagcugggacuacaggcgcccgccacugcgcccagcuaauuuuuuguauuuuuaguagagacgggguuucaccguggucucgaucuccugaccucgugauccgccugccucugccucccaaaguacugggauuacaggugugagccaccgcgcccagccuuaucuuuuuuuuuuuucccccugagacagagucuugcugugucgcccaggcuggagugcagugacgcgcagucuugacucacugcagccuccaccucccggauucaagcgauucucaugcuucagcuuccugaguagcuaggauuauaggcaugcaccaccacgccuaguucauuuuuguauuuuuaguagagauggguuuucaccauguuggacaggcuggucucggacuccuggccucaagugauccaccugccucagcuucccaaagugcugagauuacaggugugagccaccgugccugacccacauguuuauuuuuucuaagaaaacuuuacuaucauuuaucaaguuaagaaaauuauucugauauuucaauuggguguuuaaauuaguugagggaaauaugaggccauucacuagaugauagguuuuuuuuguuuuaaucauguuucauguugaaacaaaaaaguuuuuuccugccaguuuucuggcuaaucucaggaagucccugaaacaaauuauugauaaguaaaaaaaauuauuuaaaaaauuuuaaauuauauuuaaaaucuucugugacuuaugguggggggaggcuaaagccuuucuccuucuguacuguucuggaaacuauggccuguucuacucccuccccuccugaauuuucccagaacuuuacagguagcuuuuauauauaugauccccugucgucuguuuaacaaguacuuugagugucuauuauaugcagacauucuagguguucagacacccuaguaauuaguuuguuccucauaauucucaguaaagaagacauguauauuucucauuuuauaggugaagaagcuaagacuuuacuuuuccucaguuagacagcuagugcuggugggugccuaaacuuagaucuuccauugccaaaucuagguguguuguuuuuccagcacacuagaauccuccugguucaagaaauguauauauuuuagcuuggauaagauacaacuuuuggaguguucuaaucaucuucaaguuuuucguggauuaguuauaacauaugaaaaaagauagggcugaaugggccacaugaugccaaaagugaaaaagucacucacuagauuaugaccugcagaaucugguccuugccugccucugcuuuuauauuuugcagcuugucccuucacacaguggucucacuuuuauaaugucuuucccucaugcauuucuuuaauucuuuuuauuugccuguuccauaguagucuguuugugcugcuacuugccccuguacuguucuugagcuauacauauacaugucugcugugccauugagugauuccaucaaggccacaauuaucaucuugaugaacugauuuucucccacugcugauaauuacuucucucuccuuucuuucuccuuuacaucaccucuuuuuguucuuaauuucauucccuccuugaugccagugaguauuuuuuucuuauuuuauucucaucuuccuugaguauuguuuauuucaaccucuuuuuuuuuuuuuuuuuuuggagaaggguuuggcuuugucgcucaggcuggagugcaguggcacaauuuuggcccacugcaaccuccaccuccugggcucaagccaucccaccucagccacccaaguagcugggacuacagguguugcccacugcuuuguauuuuuaauagacacaggauuuccccauguugcucaggcuggucucgaacuccugggcucaagcaguccaccugccuugcccucccaaaguucugggauuacaggauuacagaugcugugcccggcccaaccucuaauuuuaauuuucucuucaaauuguucaauaagauuuaguuucaagacauuuuccuggccgggcaugguggcuuacgccuauaauuucaacacuuugggaggccgaggcagguggaucacuugaggucaagaguucaagaccagccuggccagcguggugaaaccccaucucuacuaaaaaauacaaaaauuagccggguguggugguacaugccuguaaucguagcuauuguggaggccgaggcaugagaaucgcuugagcccgggaagcagagguugcagugaguugagaugacaccacugaaauccagcccgggcaacagagucagacuacgucucaaaaaaaacaaaacaagcugggcgccguggcucacgccuguaaucccagcacuuugggaggccgaggccgguggaucacgaggucaggagaucgagaccauccuggcuaacacgguggugaaacccuaccucuaguaaaaauauaaaacauuagccgggcguagugguuggugccuguagucccagcuacucaggaggcugaggcaggagaauggugugaagccgggaggcagagguugcagugagccuagaucgcgccacugcacuuuagccugggugacagaacaagacuccgucucaaaaaaaaaaccauuuuucuuauuuugaaaacuuuugguauugaaagauauuuauacuacaguaaugagaaauacuguguguguguauauauguuuguguuuuuuuuuuuguuuuuuucuuucucucucucucuuuuuuuuuuuuuugacagaguuuugcuccuguuguccaggcuggagugcaguggugcuaucucgacucaccacaaccucugccucccggguucaagugauucuccucccucagccucccgaauagcugggauuacaggaaugugccaccacaccuaacuuuguauuuuuaguagagacggguuuuccccauguuggucaggcuggucuugaacuccugaccucaggugauccaccugccucggccucccaaagugcugggauuacaggcacccugccuguguuuguguuuuaaaagggguaauagcuucagucuuuuuuuucuuucucugagacggaguuuuaguuuuguugcccaggcuggaaugcaaugguguguucuuggcucaccacaaccuccauuuccuggguucaagcgauucuccugccucagccuccugagaagcugggauuacaagcacgcgccaccaugcugggcuaauuuuuguauuuuuaguagagacgggguuucuccauguuggucaggcuggucucgaacuccugaccucaggcaauccaccgaccucaggugauccacccgccucagccucccaaaguucugggguuacaggcgugagccaccacgcccggcugucuucaaucuuaaauaaggauuccauuuaaauauuuuguaaaaggacacagaucacaguuuuacucaggggaauauaauuguuauagcaggaauugugccauugcgcuauuccaaacaguguaaaagaacauuaauaaauugaauucuaacuacauuugucccuaaggaguuguucguuuuccacuuguauuuccauuuuaauuaucauuauuuggauguuucauaggauacuuuggauauguuucacguaguacacauugcuucuaguacacauuuuaauauuuuuaauaaaacuguuauuucgauuugcagcaaauugacuucuuuaaaugaagaguauaccaaaaauaaaacagaauaugaagaagcccaggaugccauuguuaaagaaauugucaauauuucuucagguaaacuuaauagaacuaauaauguucugaaugucaccuggcuuuugguaacagaagaaaaaucaugauauuugaaguguguuuuguuauuuucgcaagccauuacauucugacuauuuaauauguuagguuuccuauauaaaauaaggcaugguauguuacaguaggacacauaacuggaaguuacucuugcacauagaaacaaaaaauggcagaaaagcacaaaacuuacuauaguuguaacagggaaaggaaacacuagggccuacaacguacuaaugucuugggucaucuaugggcucaugaggcucuagguuauggaaguaaauaccacugaaaagcaaauauuaauuacacaugaggcaagccuuuuugaguucuguaugucauuuuguagauuuugaguucauucuaguggcaccauuugagaucauuuucauguaauuaaaggaacacagcaaccuggcacuguguuauugcccuuagaauggaaugaauauauguuuagcacaagguaggaagugaugcguuaaguuggaaggcuuugccgaucaugguguguauguugacuaaccuuuauugugccuuuaaaaaauauacucaagaacuaccuuaaccaaguaauuaaagucaagauuaccaguugugggacaaaugacauguacuuccuggugugauauagaaggaaggacacaguaucaccuauauaguauucuugaccagaauauuuaaccugauuuuaaacaagaaguaaaaauucaaauaaauuuagauuguggugcauucaaggccugaacuuuaauaaauguccaugucacggcagcaaaaaagaaaucaacaggucuuaaagagacagggcaaccaaacgcaguaggcaguaguugauuagaucccaauuuagagguuggaguuggggaauagcuauagaggacacuauuggggcgaauugagaaaguuuaauaugagacaauaugguguuagugucagauuucuugugugaaaugguaguguuaugauuaggagaauguccuuguucucaggauaugcaugcuaaauuauuuaaggacaaauauuuuuuuaaaagguuaugugcaugaguaauucuauaaauuguguugcuauuaugaauugucaugguaaaucaaaaggaaacauaaaacucaaaagguuuuauuuuaauacacuuuauguauugaaaugaauggaauugauuuguaaagauuacauuuuugcuuguuggugucagauaacugugacguaauaaucuuuugcugaauuauguuucuuaggcuagauuucauuuuaaagaacccuguaaauaccauuuauuugaacuguggaucuuccuuaaaaaauaauauuuauuaagcaccuagcaggguaaaguuuuuagauuuuaacauuuaaauugaagguuuuauauuagaagucaaccugaauuuaaaugaaacuucuucuuggucugauauuacauauuaugagcuauuuuuauuuaaaaauguaauggcggccagacauggugauucacaccuguaaucccagcacuuugggaggcugagcugggaggauugcuuaagcccagaaguuugagaccagccuagccaacauagggggaccccaacucuacaaaaaaauccaaaaaauauuagccggcuguggugguacaugccuguagucccagcuacucaggaggcugaggcaggagaaucacuugaacccaggaggucgaggguguggugagccauaauuaugcuacuguacuucagccugggcgacagagcaagacucccaucucaaaaaguguaauggaucacuuuaauaauuuucuaucauacaauuaagucauaaaaggucaugcuauuaagagccaguuaugugacaugccaaguauagacucuuaauuaagaugcuuugguuugcuuuuuauuuauuuauuuauuuuucagauggggucuuaccauguugcccaggcuuuagugcagugaugcgaucaugacucacugcagccucaaccuccuagguucaagggauucuccccacuuagccucccaaguagcuugggacuacuacauguaguagugccaccacaccugguuaauuuuuuuuuaauuaucuuuuguggagaugaagucucacucuguugcccaggccagacucaagcagucuuccugccuuggccuccgaaaguguugggauuacaggcgugagccacccugcccagccuaguuuucuuuuuuuuacuauaaacuuauucuugucaguaugcuagcaauuuuacaaguuuuaaaguaguuauagcaaguacuucacucauguuuaauucuuaaaggcuucuauugcuauauaauaggguagucugaauucuucaaaaguguacugaggccaggugcaguagcucacaccuauaaucccagcauuuugggaggccgaggcggguggaucaccugaggucaggaguucgaaacuggccuaaccaacauguugaaacccugucuuuacuaaaaguacaaaaauuagcuggguaugguggcaggugccuguaaucccagcuacucaggaggcugaggcaggagaaucgcuugaacccaggaggcggagguugcagugagccaagaucacaccauugcacuccagccugggcgacagagcaagacucugucuccaaaaaaaaaaaaaaaaaaaaaaaaaaaaaguauacugaaacagaggaagauaauuaggucugcuuggccauuguuaaguugauuuuuauuuucaaaacauuugaucacuguuguggggaacaagggaauaaaaaauaaguuaaauuuccagccccuagauuaaacuaauaauuuuugguuuuccuagaauuaaaugcuuuuaucuugaauguucugugaagcuuuugacaugauugauagcuguaugauagucugaaugacaugugggucaugcaccagccccuccaaccuguuaacauuuagaaucuauucagaaaaauuuaagcauuguuaauuuccuuuguuuuuugucuagcaugugucagauuuuuuuaaauguauuuauuaauagcuuuuaauguuaauacucuagaacaguagaaucuugaaaauguuuuaagugacaauuagagauuuaaauuuaugcugacauccucugcaugugauacugaugaggaaagaaagccaaacugucuuacggucaguucguacaauauaccaggccuugauggucacauuucaacuugcuaccuuuuugcuuacauuuuucuuauggugauuuugaggugucauucugguuucucagauacuuaaaauauaggaaaaggugugucuuaaaauugagagaaugucuuggauaagcagcuguguaguuuuauauuuugcugauaagggaagguacucuauuuuuguuuuuuguguguuuuuguuuguuuguuuuugagacagaauugcccaggcuggagugcuguggcgcaaucucagcuuacugcaacuuccaccuucuggguucaugcaauucuggugccucagccucccaaguaucuggguuuacagacaugcaccaccauaccuggcuaauuuuuguauuuuugguagagaugggguuucgccguguuaccaggcuggucuugaauuccuggccccaugugaucccccggccucaugcgaucugcccgccucagccucccuaagugcugggauuauaggcgugagccacccaacccagccaguacucuguuuuugauagcuauucacaaugggaaaggauguagcaacacauuuuaacccuauguugaguuuuagguggguuccuuugaaauuuuguuaaggcuaacuuuuguuaauuuuuuuaaaaaaguguaaauuaggaaauggguuuugaauucccaaauggggggauuaaauguauuuuuacggcuuauaucuguuuauuauucaguauuccuguguacauuuucuguuuuuauuuuuauacaggcuauguagaaccaaugcagacacucaaugauguguuagcucagcuagaugcuguugucagcuuugcucacgugucaaauggagcaccuguuccauauguacgaccagccauuuuggagaaaggacaaggaagaauuauauuaaaagcauccaggcaugcuuguguugaaguucaagaugaaauugcauuuauuccuaaugacguauacuuugaaaaagauaaacagauguuccacaucauuacugguaaaaaaccugguuuuugggcuuuguggggguaacguuuuguuuuuuuuuuuuuuuuuuuaaucuuggaguagaaauauauuuaaaauugauggagaaaauucccaguucuuaacauuagaaagggaauauauuauucuuaccaguuaguaaucuauucacauuugguuuagagggaagauuuagaaggugagauaaaagcuugugagagaauaguguauucaugugaaacuucuuccauggguucagagcauuuagaaacaaacaucccuucacacucaaagcuuaccuuugagccaguccuccaauagugaggucuuugaaggucaggccaaauuggcugugggaggaccucagguuaggauaggaauuauuuuaagacauggcacuauauucaugugaaacucgcaaaaacuagccuugcauauaggcucauguaucaugucucagcugagauguuugagagaucuuaacuagauucuagaaaacaaaaaaggaaguaguuuuggggcaaauauauuugggaaacaguuuauuguauuuccuuuccccaaauggauuuucaaguucuucauauaaucuaaccccaacaaauaaauugccuguuuuucaaaagaaagaucaugucuucagguuuuugugugggguuuaaaugauucgaaagauuugaccauacugauacauucacuaguaaccuuaguuacuaaugaguaaugguuuugaguuaaucaguuaggccugaacuacuuuucuggaaguuaguaaauuaucucacaggcagcccugugagccaugggaaaauguguauauggucuuucuaggccacagucaaauuacagguauauuugucauggcuucucuugaugaaaggcccaguaucgguuugucugaagauauauaauagcauugcuuuuggggguaauaugggcaguaacucuguccacaucuuugggcaggcugugguucugccuuuauaugcuaugucaguguaaaccuacgcgauuaaucaucaguguacaguuuaggacuaacaauccauuuauuaguagcagaaagaaguuuaaaaucuugcuuucugauauaauuuguuuuguaggccccaauaugggagguaaaucaacauauauucgacaaacuggggugauaguacucauggcccaaauuggguguuuugugccaugugagucagcagaaguguccauuguggacugcaucuuagcccgaguaggggcuggugacagucaauugaaaggagucuccacguucauggcugaaauguuggaaacugcuucuauccucagguaagugcaucuccuagucccuugaagauagaaauguaugucucuguccugugagaaggaaaaguauauuugcagauucucauguaaaaacaucugagaauguuugucuuaguuuaauaguuguuuuccuguggacuuuauauacuuuguauugucuuaaaagagugauugaugguagcuacggaaaacuuugauuuuuaaaauugucucuuuaaguagacaauuuauaagcuacugguacgaguucaccuuauaaaucuccacuaccauguuuuugcuuggacuguucacacuuccuggaaugguccuucuugccguuuauccaacuucuuucuaauuuuuaagucccuaaugaugggaauucuauuucuguagugauuuuucuggucauacgaccguaaggucauggguguuuuucucugaauuccucuugagaugccuguaacuugaaccacguuuuuauucuagacauuacugaaauguuuugucuuuauuucacuuuuuaggagcuuccuugaagguagggacuauaccuucuauuucuugguaucuuuuucuuucuuuuuuuaaaaguuuuuuagagagacagggucucacucuuuugcccagacuggucucgaacuccugggcucaggugaucuuccugccuuggcuucccagagugcugggauuacaggcaugaaccaccgugauccuccuuauuucuuaguaucuucuaaagaacauuaaauauaguaggugccuaguaaauuauguauugauuuaacuucuuugagguucuguuguuugugaagaauuauaaaagcaauacaaauguuuguauaguaauuaagcaacagguuaauauucaugacuuaaaagauuaaagaaauaagcaaaacauguuagcuggcaacucacagaaaaagaauuaaauugccaaugagcacacgagcacaugaaaaauuagcaaaaguuucaccccuuuacauauauuugguuaaaauugagaaaagaauaguaauagaugguauugguaggacuguggcaggcacacaauuuacaugaccaccaaaaguguaugcagguauccaugucaccacacccuggucucaucuucauucaguuuuauuuauuuuuuuuaaucucggccuauuugauuggcacgaaaugaaugauagcugccuuauuuggaauuccuuugauuacuacuagugugcuugauaauguaaaacaauauucaaaaucuguuuuuccuuucauccguuguuuguucauguucaugaccuuuuuuuuuuuuuccuauucuccucccucccucccucccucccucccuuccuuccuucccuccuucccuccuucccucccucccucccacacaaaggugugugcuaccauaccuggcuaguuuuuaauuuuuuuuuuuuuuuuuuuuuuuagaggcaaggucucacuauguugcucaggcuggucugggcucaagugauccucccaccuccgccuuccaaagugcugggauuacagacgugagccaucaugccuggcccuugcccauuuuucuauugaaguuuuagugcuuuuuauugacuuuguuuauauauuaagauaauccauuauguuuguggcauauccuucccaauguauugucuuaauuuuguuuuuguauguguauguuaccacauuuuaugugaugggaaauuucauguaauuaugugcuucaggucugcaaccaaagauucauuaauaaucauagaugaauugggaagaggaacuucuaccuacgauggauuuggguuagcaugggcuauaucagaauacauugcaacaaagauuggugcuuuuugcauguuugcaacccauuuucaugaacuuacugccuuggccaaucagauaccaacuguuaauaaucuacaugucacagcacucaccacugaagagaccuuaacuaugcuuuaucaggugaagaaagguauguacuauuggaguacucuaaauucagaacuugguaaugggaaacuuacuacccuugaaaucaucaguaauugccuuauucuaaguuaguauaaauuauugauguuguuauagaacccauuuaccccuuaauucacagucuggggguaggaacauguacaucauauuucuguaucucauaguaggaccacucauucuaaagcauucacagaaagaauuaucuguacucuuuuugggacagaaucucguucuguugcccaggcuggagugcgaucucggcucacugcaaccuccgccucccggguucaagcgauucuccugccucagcuucccgaguagcugggauuacaggcgccugccaccacaccuggcuaauuuuuauauuuuuaguagagacgggguuucaccaugcuggccaggcuggucucgaauuccugaccucaggcaauccacccgucucggccucccaaagugcugggauuacaggugugagccaccacgcccggccagaauuaucuguacucuugaacaucaccauggaggcauuuucugcuaccucccauggcaguauguuuucuuguugaauuaggauaacaaacaauaugcuuucaaguuccaaaguucuagcuguuauuguuuaacaaaaucuucauuauaauuagcuuauuuuguguuuaagaguguguuauagaaacagguucauuuaaagcuggggguuccagaaaucuugaaauaguaguuaucacaugcagagugacuuaucuguuguuguuucauccuuucaggaaaguuugucauucgugggcuugggaucuagucagaucccuguauugaugagauucacauguuauaaggcuuucaaagguuuuaaaaaucauacuauaaggauugauuucacuagucaccagaauaacuuuuucagauagcgcucugauuuuccacgaacacguuuuucugcaucaguugguugcacaugagugagauaaucuugguucuuuauccuuuguuauuuguacuucauugggaauccuuuugaguuaguauauuugagucauuauuauuauugcuguagaauucaggaacuuuuaguagaucuggcagcauaaaauuuugcuuuuaaaucauuguuuguguuuuguaugcuauagaaauggguucagaauauuuuuuaaaaggccagaugaagugugaagauagaaaaacuucauccuucacugugaauguuuaacaaacauuugcuucuacuuuauuuuuguuugcuuccuuuaguugugcaaaguauucaguucuagaaugcaugagauauaugacaaagccaaaaaauucuuuauaguugauaaauaauuguggcaaaaacagcuguauaguaacuuugcaagcaucauuugauuaaaugcuuaaaaagucuugacucaguuuuaacuauuuccugcaaauaaucaauauuuaauuaaagcuacuccaaauuagugacacuuuacgugucugucuuucucccuccccuucucccuucucccuucccccuucucccauucucccauucucccuucucucuucuuccuuuccucuucccuucccuuccccuuucccuucccccuucccucuucucuuccccucccccuucccaucccccaucccuucccuucccccaucccuuuccuuuccccuucccuucccuccucuuccuccuucccuucccccuuccuccuucccuucccccuuccuccuucccuuuccucuucccuuuccccuucccuucccccuucccuucccucuucccuuccccuuccccuuuccccucccccucuccuccccucccuuaccuucccaugaaaugagaaagccucagagauaguggcuugauuaauuuuucuuuagauuaagauauuugucuaagccuuuaagguuuaucuauugagcuuuuuugucuccuauuuuuauuuuuccuacuauguuugucgaggauaaaauacagcacugugugccaagucauaaucacuuuucauuugagacuuaauuaaaaugccuuuauuuuaaugauauauuuggcuaauguauuugaaguaauccgaaauuaaguuuucuaaugacaaggugagaaggauaaauuccauuuacauaaauugcugucucuucucaugcuguccccucacgcuuccccaaauuucuuauaggugucugugaucaaaguuuugggauucauguugcagagcuugcuaauuucccuaagcauguaauagagugugcuaaacagaaagcccuggaacuugaggaguuucaguauauuggagaaucgcaaggauaugauaucauggaaccagcagcaaagaagugcuaucuggaaagagagguuugucaguuuguuuucauaguuuaacuuagcuucucuauuauuacauaaacaggacacuaagaugaagguuuuuuguuguuguuuguuuuccucuguguuucuagugcuuauuuuuuaaucaguuuuuuugauggcaaagaaucuaucucuguguuauuuugauuucugcaguauauacaucugcaugaucaauauucgauuucaaguaccaaaguaggaguaaaggaauauuaaccuagguuuaaaauuagucauuucacuaaaauuaguuauuauggacgauagaugucuagguauaucuuuguucauaaacgaauauaucaaguucaguuauuaaauuacacauuagguaagaaaaggacaaagaaauaaaaaagcaugauucauaauuccugcccucuauuugucuagaauuuaguugggaagauaagaauaacgaacgugacacagagaauaaaguggcauaugacaaauauuuauucaagaaagcuauauguggacgggauguuucaguucucaugggagaaguggauuuuauggugccuuugaguaaugggucauauuugggcguucacacagaaagacccaagcauaugccuaauuuuuuauuauuauuauuuuuuauuuauuuauuuauuuuuuagacggagucucgcucugucgcccaggcuggagagcaggggcgcgcgaucucggcucacugcaaacucugccuccuggguucacaccauucuccugccucaggcucccgagcagcugggacuacaggcgccugccaccacgcccggcuaaauuuuuuguauuuuuuaguagagaugggguuucaccguguuagccaggauggucucgaucuccugaccucaugaucugccugccuuggccucccaaagugccgggauuacaggagugggccacugugcccggcccuuuuuuuuuuuuuuuuuuuuaaauuagaggauuacuaguucucuucaauuauaaaaauaaaagaaucuuauuucacugccugguccuggaaacauguacugcaauauacauugugacaacuuuuuaccugucauguuuuuagcuuuuaccugugaaugucuuaucauuguucuuaucugaaggauagauaguugcuacaauaauaauagaugguguguaugguuuuugagccuaaaaaguguaguuuuaucuguuguaccuauacaagcaggagaaauauaacuuguuaauaauuuuagguauggcaggcugccauccuaaauaugaaguggucuuuguauuugcacuuuaauguguugaaaucauagcuuucagugauccaggauuaggcagacucuuuuaugcaaucucuuguuuccaguuagaauagaagucguguacuuuugauaacauuaauuauaauauauuuugagcccugugagguugguaacauuauucccauuuuaugaaugaggaauguguguuaaggaguuugcccaagagucacauagcaagucauagucaugcucucugaagcagcaauaacuuggcaauaaaauaaaaaugaagcaucuucuguauguguuaacuuuucagugacuguuuaugccuuccaguauucuuuguaaaccuugaauucuuuuuuucacagaugauuaaaguuuaucaauuguaaagguggaggaauuugggaacuagacagugcacacauaaauaauaaauauguucuucaaauauugggugggcuaaugugggaggaguuugagaccagccugggcaacauagugagacccucgucucuaaaaauaugaaaaauaaaaaaaaaauuuuuuaaaugugugauauguuuagauggaaaugaaacaauuugucacugucuaacaugacuuuuagaaaagauauuuuaauuacuaaugggacauucacauguguuucagcaaggugaaaaaauuauucaggaguuccuguccaaggugaaacaaaugcccuuuacugaaaugucagaagaaaacaucacaauaaaguuaaaacagcuaaaagcugaaguaauagcaaagaauaauagcuuuguaaaugaaaucauuucacgaauaaaaguuacuacgugaaaaaucccaguaauggaaugaagguaauauugauaagcuauugucuguaauaguuuuauauuguuuuauauuaacccuuuuuccauaguguuaacugucagugcccaugggcuaucaacuuaauaagauauuuaguaauauuuuacuuugaggacauuuucaaagauuuuuauuuugaaaaaugagagcuguaacugaggacuguuugcaauugacauaggcaauaauaagugaugugcugaauuuuauaaauaaaaucauguaguuugugg

SEQ ID NO: 192729 - RNA, 64640 nt, Homo sapiens
ggggauguggugcugccggggccgccacugcagcugcugcugccugcugguugccgcgucuucccggaggcgacugcuggaagcugcagggaacagcugcggugcucugccauauugugucuuccccggccggucccucgccucccggccgagcugacggugagucccgggcggagcgguccccuccagggucggcgcuccccgccccagcccgcggcgcagcucccgggcgcggaggcagcgcgagcgacccgcgccaggcguggggcgcggaggcggcugucccgugacgcgcccggacauuuuuguccagugaggaauuugcgccggcgcggggguguccccggcgcgcguaucggguggugugugggcuccgggggaugucgaacugaggggaguguggcuugugaggaguuaggaguuuuuccugagagguaaugaccgcccgggaggggcugucgcgcggcggaaaccgcggcgaggggugucgucucuccgggaaggcguggagggggccccaaggacccucagggcucggcucggggcuggaaucugcuguuagggaaguaccccaagcaccucggagccuuugcaacgcccccuccucuggcuugaaguggagcgagacaugucgggcucggaguccucguccggccccaguugggacuggcugggccccgccaaguagugcacggggaggugccgggggcggccgggcguuguggugggcagaggcgggucccgggugugugugggagcgaccccggcacccucucgccccuccaccgccucgagggggccucagaggguggcugucuugggagcuacuguuucagcgcugcaauauggacacuuccuguucgccgccuccuuuggggccgugguuaccuuugccuuuuaguccucuuuccuggcaaggugagaggucugcgguggaagaggccuucagccuuucaaguuugccccacugcagcagcagccuguguggaacccggcaggacggugguaguuagcggaaagcagcccaugugcuccgugcuccauccuccacuacuuaacuccacccccuuuugcaccuuugcaaaaugccucuuuuuccacugcaucucucgggaguuggggugucugcuucgcugacgacccacacucucgcaguguucuugcacuggauuucugcuuuaaagucuuuuuacagcagucucugaacuucauuuucucccuacugggaaaaaagaguuuuagcgugcaaagaaaugaccacagacuuucuuucuccuaccccaacuccgaggugaggggaggagggcaguuaaguauuuacagguuaguugaaguuguuucuccuaucuuuuuucugauugugacagccacguggccggcugaguguaauagagugcgcuagcggcacuaggggcugagguuucucugguagccaggggcuuuguaacugugcugucgccucgcauguacauuuaucuuggugggagaagcugaaccauucaugccuguaccuguuccauccgaaucuuaagacuuaccucuguuaccuugcaguucuccuaagguguauaccgacguuuuuugccguucucugcuguuuuguugauccaucuuuaaaaccucagcauuauuagguaccaucauagagugauggggaauaauagaguagugcauuauggaguuugccaacuuugggaaaaaauauuacuugaauuucaaaaccauuaaugagagauucuaaugcaaucagaaguaauugcauuaucuggauuucuuuuugauaguuuuagaaaaaucuauuuuuuucuuuuuacauaaaaauugugaucuaaacauacguaaauaaaauuaccagugaaaauacuuuuuuagggaugaaguagugauuugauuuguguauaugugugcuuuguaaagcuuuuuuugaaaaaugugaaguuaauaugaacguuaacaugaacagauuuuaagagaaugaaauauaauuuuuagaauauauaaaaguagaaggucaaagaguugaagauaaaaaaugaacuuuuggagaguuuggaaaauuuuugaauuuaaggacaauccuuguuuacuaaugcaucguuucauuuugugaaugcuuugguagguuugaauuauuucuguauuguauguuuuuauuugaaucaauuuuacuggaagaauguuaaaccacaggaaccauuuaaaaucugcacaagaacuguauagagaaguuacagcaacaccauuuuauuggaauuuuaauuaccccauaacaauggugcucaaucagaaaaguuaaauaaagauauugaagugguaucuaggccuuagggcagaaaagacaauacaauugagaaaugaguauauaugcuaaccacugagagcaauuuuuaguugagaaagaaaaguaaaugaggucauaaaauacuuauauaaggcuaaggcaggaggcucuccugagaucaggaguucaaguccagccugggcaguguagccagacucccaucccuugaaaaaaggauugcucaacucgugccuguaaucccagcacuuugggaggcugaggugggaggaucaccugagguuaggaguuugagaccagccuggccaacguggcaaaaccccaucucuaccaaaaauacaaaaauuagcugggccucguggggcaugccuguagucccagcuacucgugaggcugaggcaggagaaucgcuugaaccuaggaggugaagguuguagugaguugagaucaugccacugcacuccagccugggcaacggggcaaaacucugucucaaaaaaaaaaaauuuuuuuuuugaaggguugagaacaaagauuugaugcuuugggaaacuaacauuuaaggagcauuugguuuggucacaugugacuucaaaauuaauacuacagauguguacaaugccuauagccuauaguauugcuuuuuuuuuuuuuuuuuuuuuuuuuuuuuugguggagucuggcagccuuucucccaggcuggagugcaguggcgcuaucuuggcucacugcaaccuccaccucccggguucaagugauucuccugucucagccucuggaguagcugggguuacaggccccugccaccaagccuggcuuauuuuuguauuuuuaguagagacggaguuuuaccauguuggccaggcugcucuagaacuccugaccucagguauccgccugccucagccucccaaagugcugggauuacaggcgggaaccaccacgcccggcuuauaguauuguuuuauuaauaauuuuauauccucuaaaugagaaggcuaucccuguccugccacuaauauaaagggaucaaaagaauguuuauuauuauuugcuucuaagggauuuugauccauauauacuuuauuucccuuacccuaacuuuucuauuuaaauaaacuuuuuauuuuagaauaguuuuauaguuacagaaaaguugcaagcuaguauacagaguauaccucacccaguuucuccuguucaauuuccuacauuacaaugguacauuugucacaauuaaggaaacaaaauuguuacaguacuauuaacuacauacuuuauuccuauuucgcuaauuuuucccuaaugucuuuuuuuuguuccagaauuucacuuucuaugacuucucuuuguuuugaugacuaugacaauuuuaagaagugcuugucagacauuuuauagaauaucccucaauugagauuuaucugguauuuuucugaugauuagacugggauuaugaguuuuagggaggaagauaacagagaugaauugccagucucaucacaucauaucaaggauacaaacuaacgacaugauaaaacugaugacgcuuaccuugaucaggugguugaggucuuuguggaguuucgcccacuuuccugccuccuuccgaucucuacucuuuuggaagcaagucacuaaguacaugccauacucaaaaaccuuaaccuaauuuugauucauguauuuguaauuucccucgaccuaauuuuccuuucuauaaacgaauacuuaaacuuggacagauauuuauuuaguaucuauuguauuuaggugcuaagaauacaguggugagccagagagacauuuguucuggagucugccugauuuaaguaucacauaggauguaucuccucaccuuaggucuugauuucguuaacaguuuauaaacauaaaauuacugaagcccugaaaggcuaaauaauaaauaaaagcuugaguaaacauuuagaauauauguuauuagcauaaaguuuaaauauauguaccauaaaaauagccaucucuuugcucccaacacagauaauggaaaauuacuuugauucuucccgaguagauacauuacuguuaaaucccugggauaguuuaauuacuguuaacuaucuuccuaucuuaaaaauguuuacagguguuagaagaaaauucuugccuucuugcuaguguuuuuacagguauuggugcuucugccacucaaaagccuuuuuuuuuuuucugagaagugcuuugaaagguguguuggagaaaauacauggggaaaauaacagggacccuggucucugugagaagccaugcuuacauauuuauggaaaaaaaaaugagacugaggagauaaaaaacauuaaucaaaguuuucaaagugauaauaaacguuuuuggagggaauuuacuguauauuuaauagaagaguagaagagugcugccauccuaacauugggaauguuacugggaauguuuuuaaccaaauaauaccaauuuuauuggagaauaaaauuuuauuaaagacuuauugaguaaagauuucaguuaauauuuuucugguaaacuggguuaacuacaaaacacucuuaauuugaacuuuuaauugaaauucuuucuaaaauaugucauuaauacacuuuaaauuguauagcccacugaacagaauuuucauauauuuaaauucuuuuuuuuuuuuuuugagacagggucacacucaacccugcuggagugcagugguaacaaucacagugcacugcaagcuccaccucuuaggcucaagugauccuccugccucaaccuaccaaguagcugggaccacaggggcgcuccaccaccccuggcuaauuuuuuaauuuuuuuuuuuuuuuuuuuuuuuuuugguagaggggagaucugacuauguugcccaggcucgucucaaacuccugggcucaagggauccuccuaccucagccucccaaagcgcugggauuuuaggcaugagccaccucaccuggccaaucuuuaaauuaaauuuugcauuauacaggguuagugugguuauucuggguuuuauauguaaccuuggagauagagaauugaggaaauugacacauuuauaucuuuguaguuuguuucuuuuucuuaaaagaggaaauacagaaaaaaaggggaagagguuucuuauaauuaagauuuuacugguccuuuugacugcaccaugccuuuguccaacccuuccaaccuuaaaaauucaguuuauauacuaccucuuucuaugcugauugaagaauuauuaauaaucauagcaacaacugcagucuuuauuguguuuacuauguauuggcauaguuauacuagacauaugaguguauaauuuaauuuuuuuuuuauuuugagauggaguugugcucugucgcccauguuggagugcaguggcuccaucucagcuuacugcaaccucugucucccggguucaagcaguucuccagccucagccucccgaauagcuaggacuacaggcacacaccaccgcgccuggcuaauuuuuguauuuuuaguagagacaagguuucaccauguuggccaggcuggucuugaacccugaccucaagugaucugcccaccucggccucccaaagugcuggaauuacaggugugagccacugcaccuggccauaauuuaauuuucaauaaugccguaaggagugucauagucucauaaacagauaaugagaaauuguguaaauguaauacuggguauuuacccaaaucucucagacuugaaaaaaaucauuaaucuuuguacuacaaucugaagucuuuaaaaaaugaauauuuguuaggaugagaugcuuacaucuugaucuguuccuaaggaguagggaagaauacaagguagggagagaaacuaauauuuauagaaugcuuacucuguggcaggaauguugcuacuuuauuguuauagcaaguuaaguaagugguauuauuuccugggacucaaggagguucagucauuugucagagauugccuaaguauguugguggcuggugggucaguuugacuugagagacuuacucuuucacuuuucucuccuuuuuuuuuuaacuugccccaaagcaaugaagauacuguuucaguuuucuaguacagcaucuacuauauuuauucauucauuuaaacauuuaaauguucacuacauguuauggucuguaguagagcauaaaaaugaauguauugaguucugccaacaaggauuuauauucuaguguaguauuucuuaaaugggugacugaauuggggugggaaauuuugaccagcuuuuauuaaaaaacaaucuaggcugggcacaguggcucaugccuguaaucccagcacuuugggaggccagggugggcggaucacgaggucaggagaucgagaccgucuggcuaacacggugaaaccccgucucuacuaaaaauacaaaaaaaauuaggcgggcgugguggcgagugccuguagucccagcuacucgggaggcugaggcaggagaauggccugaacccgggaggcagagcuugcagugagccgagauugccccacugcacuccagccugggcgacagagcaacacuccaucucaaaaaaaaaauuuuaguacauuuuaugugguaaggguaaaaguauuauuucaugaaaauuuuaguacauuuuaugugguaaggguaaaaguauuauuuaguacauuuuaugugguaaggguaaaaguauuauuuaguacauuuuaugugguaaggguaaaaguauuauuucaugaaauugugaccagcuuuuauuaaaaaaaaaucuaaaaaaauuuuaguacauuauacaugguaaggguaaaaguauuauuucaugaaauguuuguuuuaguuaaauauguauguauauugugggucucuaugaaaaaaauacauuucuuauugugggauaacauugaaagugagaacuacaggucuaguggcugagauagaacuguaagcaaauaauuauacauaauuagaauagcaaguaaguuccuuuuuuauuuugagauggagucuugcuuuguugcccagccuggagcacaguggcgugaucucggcuuauugcaaucuccgccuucgagguucaagcaauucuuucucagccccuggaguagcugggacuacaggaaugugccaccacgccuagcuaauuuuuuuguauuuuuaguagagaugggguuucaccguguuggccaggcuggucucgaacuccugaccucaggugaucugccugccccggucucccaaagugcugguauuacaggugugagccacugugccugggcuagagguagauuuaaauuaauagcagcaguuuauuuuccuaaauucuuuuuuuuuuaauuguaaagugaaacaaaugcagaaaaccacacaaaacaaauguguaacuuagugaauuauaaggcuagcaccuguguaacccuguccuuuaaaaaguaaccacuguccuggguuuucugaaaaugaauuaaguuuuugguuuuauuacucaaguaugugucccuagaugcuauaguuaagccuguuuucuugcucaugcucacgcucacgcggauucuugcacuccccccuccuuuuuuucuuuuucauuaagcuugcuuucuuuacaccuucuguuucucuaagauuuuauccaauacauuuuuuucguaauccuuuaagucuucauuucugaaaugauuuuuucccuuuuauuuuaaauucuuucuugagcucuaucaccucaugucugagcuuuucuaauucugauauauuugauauauauauaauacaauauauauuucugauauauuugauauauauaauacaauauauauaucugauauagguauuucucauaauuuuuuuaaguuuacuuugaaauaggaguucauuuuuaucucuuugagcaucucuuucagacuugcuuuuauuguuuauagggauguuauuuuauuguuucuuuuuuuuuuuaguuguaacuuugugugggauucaaucucuuaaaaguaugaaugcuuucauuuauacugugcuaggaauaagaugcauguaaguaaauaauugcauuaugagacauauucuucuaaacauacauucaaggguauuaugagaacacagaguaggagcuuacuuuccccaaaguguagggauuggaugagguggacuuuagucaugauggagguuuuuuauugguguaucaauauuuuuaaauauucuguuuuuuuuuuauaacugauauauuuuugaggguacaugugauauuuugguacauguuuacaacguguaaugaucaaauuaagauaauuagaauaucugucaccugaaacgucaugguaguucugauuuuaguuuuugaggaaacucgauaccguuuuucauaauggcuguuacuuuacauucccaccaacaguguaugcgcauucccccuuucuccacauccuugccagcauuguuaauuuuugucuuuuuguuaaauagcucuucugacugguguaagaugguaucucauuguaguuuuaauuugcauuuaucugaugauuagugauguugagcauuuuuuucauguugguuggcugccuuuaugucuugaaaaguuacugaucaugcucuuugcccgcuuuuugauagaguuguguuuuucuuguugaguuguuugagugccuuguagguucuggauauuagucguuugucacauguauaguuugcaaauauuuucucccauuccacauguggguucucuuuauugauuauuucuuuuacugugcagaagcuuuuuagcugauuaaggucucauuugucuguuuuugguuuuguugcaguugcuuuugaguucuuagucauaaauucuuguucaggccaauguucagaagaguuuuuucucgguuuucuucuagaauuuuuauaguauaguuucaggucuuacauuuaagucuuuucuguagcuaauuuuuguauauggugagagauggguccaguuucauucuucugcauauggcuauccaauuuaguagugcuuuuuauacaaaugaauuuacuguugacuuccuucaauuacuacuuugaaauacuguucagauggaauuaaaauaauauuuuaaaaauuuucuuuugcuauacuauugucauaugucaucaacuaucucuuaaguagagaccugaaauuuagaaagugaaaaggucacaaaguagaauggaaaacauaguauaacgcauaguauucuguacgugaaugacaaauugcucaguaauuuuuuuuuuuuuuuuuugugacagaguuucgcucugucucccaggccuggaguacaguggcacaaucuugcucacugcaaccuccuccuccuggguucaagugagucuccugccccagccucccaaguagcugggauuacaggcaccuaccacuuugccuggcuaauuuuuguauuuuuaguagagacggguuuugccauuuuggccaggcaggucucgaacuccugaccucaagugauuugccugccuuggccucccaaagugcuuggaccaguaaauauuuuaaugaauaucauauuucauccuucaaauuuuuuuuuguuucauguaguuugauuaaaaugacuucuuuguuuaguuaaaacaaaacuugaugugguaugauuuggguauaauuuucccuuuguacuucuauucaaauuggcagcaaguuagagccagguugugcuugcuuuugaaguacucugcuuagggauauugaguccauuguuuucuauuuucuuucuuugguuaacgauacuuuugacuugguguguauuaaguaucuuauaaaauaacuuuaguguuuaugaagugaucucaugucuauuguuuauuuuggucucuuaacauaaauaacuacaguaaaaaagaggaaauguaaaugcaguuggaacacggagagauugaaagacucuaacagaaaaaaguuggggugggaauuauguggaggaguugucguuaaauuaggucuuaaauauuaggguuugacugaaugaugagagggaagguagacaauccaguuguuagaauaucaaaagcaagcauauagagaaauguauuugaacaggauuaguauaguuuggacugacuucuaauacagaagcauuagcuugaggauguagauacugaaucaguuauugauuuuuguuuguuuguuuguuuuuggucuuuuguacuuaaaaagcaaucuaggcaggaugucaggcuaguguagcagugaauagugugaauucuggagccaguacuuccaguuuggagcacaccguuuaauccuucucuauguguguuucugcauauaaaauagacacuaauaauggcaacuacuugauaggguuguuaugaauaagauuaaaagaguuaauacuaguaaaguauuuacaacaauaccuguuaccaauaagcauucaaugaguuuuuuaaauuuaugaaaguacuagcucuuucauuuuauguguguguguguauuuguaauguauacauacaugugugaguauauauggaauauaaugugaguguauguggaauaaauaccgaaaggaaauguagaucucacauguauguaucuauaggaaagguaguaauauuugaauuucaguuuugauuagaauuuagauuauuauaauaaagucuaacaucucauuuuacagauggaaaaauuauguacuagcagaacuagaaccaagauuugccagacaacaaauauuugagcaguaaacaaaacagacaacuagcucugcccuuaugaagcuuucaguuagucaggaaagauauguauuaaaccaucucaggugugacaaauguuaucaaaagguucgaguacuaugggagaguagaacuggggccccuccauagucugggauuuuagagaauucuucccucaagauuucuuuuuuuuuuuuuuuuuuuuuugagacgaaguuuuccucagucgcccaggcuggagugcaguggugcgauuuuggcucacugcaaacugugucucccagguucagaugauucuugugccucagccucccaacuagcugggguuaaaggcacaugccaccacgcccagcuaauauuuguauuuuuaguauagaugggguuuuugccauauuggccaggccagucucaaacuucuggccucaaaugaucugccugccuuggccuaccagauugcugggauuacagacaugagccaccgugcccggccuucuucucccaagaucuccaagcuguggugugaauaauaaauagcaguuagccaggguuagguggaaugaagaguguuccaggcagagggacuaggauuuguauaggcuuugagagaggagaaagcauggucuauucagauauccgaaauggagagaacaagggaaagaguggcaaaaaaugugaccugaaagguuagagcauggcuaaaauacgcagggucuuguauacaagguuaaggauuuugaccuaaggguccccuugauggauuaagcagguaagggacauugcuagauuuacauucugcaguauuacauuaguguauuacagagaacaaauuaagagagagucuggcauaaguuuagggagauuaauuuaggaagauacuguaggagcuacugugugugguugugcagaacacaccauagggguuuccauucauguauacugguugagcaucacuaaugcaaaaauccaaaaucugaaaugcuucaaaaucugaaguuuucugagugccaacaugccacaaguggaagauuccacaccugaccuaaugugaugguuuguagucaaaaugcaggugcacaacacauaguuuauucagcaucuccaagggaaaaauaaaauuaccuucaggcuauuuguauaagauauauaugaaacauaaaugaauauuauguuuagacuugggucccaucccuaaaguaucucaucauguauauacaaguaaauauuccaaagucccaaaaaauccccaauccaaagcauucuggucucaagaauuuuggauaaggagugaguauucaaccuauacuaccuuuggaguggucuggaugaaagauaauguugaccuaggcuauaguugugacagugaaaauggagaaauguggacagauuucagagguauuucagauuuaaugacuccaaaauuuaucuccagaccagaccucuuuccugaacuuuacgucacguauaucccaaaugccuguccuacuuggauaucucacaaaugucucaaauucaacagguuuuuaaaacaaaacaaaacaaaacacugcaaacauuaaucugucuccaaaaagaaaaaaaacagucauuuucucuuccaguauuuauaguagcaaauagaacuaacauccacucacuugcuaaccaugucuacuaguagugaccacuagacuacuuagcuauauguagcugcaguugauauggcuuauuagaauuuagguuguauuccauauaaguuuauuuagaaacauuuauuuuagaaaguauuacuuucuaaaaugaucuggagauagucuuuuuuuuuuugagauggaauuucacucuuauugcccaggcugcagugcaauggcacgaucuuggcucacugcaaacucucccuccuggguucaagggauucuccugccucagccucccaaguagcugggauuacaggcaugugccaccacgcccagcuaauuuuguauuuuuaguagagacgguguuucuccguguuggucaggcuggucuugaacucccuaccucaggugauccaccugccuuggccucccaaagugcugggauuacaggugugagccaacguguccagcuggagauagucuuuaauaacauuaauaucuuuaauaauuuuuuagcauaaauauauuuuuaagucagaguacguaugagguuaauguagcccuauuuaaaaucaacuuaauucuguuaauuguauuuuuguuuuguuuuuagaauuacauauaaaaucaauauauuaaaccaaucaguagagaguccuaaguuuuacucuugcuuuccaaauuugacauuggggcuauuaguaagguaucauugucugcauuuauuagauuuauuucugaucaugaauauacuuuuaaaagaugcuucuuuucaguggagcaauuuauuuggcuauaggugauauacugcaugacuaugacuuauauucaaggcauugaaauauuauuauacauaaacaaauuuugaugacaagaccacguguuuauauucaaaugccaaccagauuuguccuuuaggacuuucgcucuguugacuuuuuaaguuucuauaacuuuguuccuuucaguguuguuuuucaagugcaauguagucaucccuugauaucaugggggauugauucugggaccuccugaagauaccaaaauccacagaugcucaaguuucuuguauuacaugguguaguauuugcauauaaccuacccacuuccuuccauauacuguacuuuaagucucuagauuacuuauaauaccuaauacaauguaaaugcuauauaaauaguuguuaaacuguauuguuuagggaauaacgacaagaaaaaaagucuauaucuguucguuacagacacaaccaaccuuuuuuuccccccaaauauuucugaugugcaguugguugaagccauggauaacagaacccacagaugcagagggcugacuguacaagucugucaaaaaaccaaacugcugguuggcuaauaauuggucacuguaugacuuauaguacaggugauauuacuucugauucuagaugguaaguauauuuuucuccuuuaauuauuauuuuugcucuuugauuucugugcugucaguuuuuuuuucugcuuuuaacaguuuuguuuagauguggcauugauagcaauccuuaaguuuaaguagauggguuuucuaagucagauuuacucuaagagcuguagugguucuuuucuauuguauuuaguaacauguaggguauguaaguguuauguuugagauaauagaacuuuauaaauuauuuagucaccaguuuuuuuuuaaccuuuguucaaaauagccauuuuucuuaaaacaguuuuuacucaauuuagaucuuuugugguacugcuuuuugaaauccguguuucugugaaacggaggaggauuguguacuagagacucaucuugauguauuuggucuuuaugcagaaaauaucagguuuguaaguuauugcuucauuuuaacuuccccaagaaagagacgaaugacuacacuuuuauuuuugagacaaaugcugcaacauuguguagaggaagucuauacacuguguacaauugacagaaaauuauuaauauuuaaauagaaguagcaucuaaacacaugguuuacaaauugaaucugugcaaguuaguauaggagaaaaguaaauucaguggaaaguugccacacauauuuuuuuucuuuuuuucaguuuuaaugguaucugcuuuuaguaugaguuggagaagguuuuccccccacucacuuuuauuucauuuuuuacucucauuugagaagcaauuucuccaugagacagaucuuugacccuuuuguauucugcacucccaucccccuugacuagaaaaugcagcugcacacauuuuuuguuuagagacaauggaucacaugcugugucaccuaaaucugugaccaagaggcaguuuuaucccuaagagaccauaaugcuucaguucuccuggauacaugacaucauguagcauuauaaucaaauauacaucuuuuugcaguacauuugggauuugauuuuacccucuaaucucaguauuggauuuuauggggauagacauuauuuauaauggagaaucuuaaucaaaacaaaaaauguauuguuaaaucaauaggaaagguugugaguuccuuccuuuuauaugccuuuuuuuuccuuacaugagguuuaccaguguuuuuagauauucugagauuauagaauaucuuuaaagcuguaguggcuguuagguuuauuacacagugcauugcaaauaauguguguucaguaaaugcuagacuuuauuuuugcuacugacuagacaaauuaacaggaagaaaaugguuuuccuuuuuugagugagaaccaaccuuaauuaccaagaaaaaaaaauaaauaaauaaaaaauuguuuuccuuuuuaaaaaugagguagucuucagauuuagaaaauauuaguaucuauaaacugcuaaaauauauuaugucauuuauuauaauaagcugauaauacuuuugaauaaaucuggaaaauacaaugcuguggcuuccagucuugagaaaugguaccuuauuauaauuaauaaauaugauucauuccuaagaauauuggaggugaggaaaggagaggaaaauugaauggaaauuucuuuuauuauguauuaaaucuuaguggcaaagcuuauaaaauugcagugaauaauugaacuaauugcuaugcagcuuccauaaaauucacaaacauuuggauuucugggcuuugccauagcucuguagcagacauuucuuuuucuaugaaaaacauuguuuagugaucugaauucagugaaugacuaccucuuucucuuuacuaggguuaucuuagccucagucaauuuguuuuuuuaauauugguuacuugagagugauuggauaagaaagccacaaaucugagaugaugccuacuuucugguugcucuuuugacauuugugaaauugcuugauuugcugaugacaugcaguucuuggugggugguaaaauagcaagucaauaacauaaaguuuccaaauaucuuaagaccaccuaaaaagaauuagagauaguaaacuuaaauuaaguguaacccaaaaauccuauucuuacaugcuucaggauucacauguuuaaguauuuaaugagacugauuuuaaguaggaagcuggaguaguagggucaaaauggugagaaacaauuuuaucuguaggcuagaugcugccauauaguuugagguuaauuauuccuugcuuaaagcauggaaccggcuacagucuuccucaggccccuugguacaguuauucaaguguugguuucaacuucuuuccaguucuaguagaaauaacagauggcaugguucuuuuucacuccauguaguaaagcuuauuagaaacagcacaauugauguucuucauuacccaaagagguaauaaggaaagauauucagugacuggcucaaggguacaaggaaaaaauuaauuugccuaaguuugcuuugggcuaucaagaauugacuauuguauuuuguuuugaucugagucuuuucucagugcuauauuuuauuucccaguaagaauucuuagacaauauaauggaugaaauauaaauuuuaaaaaaguaaacaauuauuuagaaacaacauagauuuaggacucuaagaacuauaguauagguaagauagaaacaauuaaaauugaaaauguagcaugaagagauucaauaauaaaacuuuaaaagcacuuuuuaaagguauugaacucauaauuaaucgaaccaaguuaauugcagcuauuccuuauuugcuguggaccuauguaaguuauuaaagaauacacuaaaaaucauuuauguuggccaggcacacuguuucacaccuguaauccuuacaauuagggaggggccaaggcaagaggaucacuugagcccaggaguuugagaccaaccugagcaacauaaggagacgcugccucuacagaaauaagaaaauuagcugaguguggugacacacaccuguugucccagcuacucagggagcugagguaggaggaucgcuugagcccaagagcuugagguugcagugagcuaugaucaugccacugcacuccggccucggugacagaaccagaaaaaaaaaaaaaaagaaagaaaaaucccagaaccuuuauguucaugagaauuucugaacuuagcuggauuuuuuuuggucauuaaauauauauucauauacccauauuuuuaauguacuguagcugcuaggcugaaauuaaccguguuauuuauauauuuuucucagaucuaccgcauuuguuaaaaguauuaucucaaaaauggauggaaaaauuauuauuuugaguauuuuaacuuaagaauucugaaacagaauaguacauucuaaauuaguuggacacaaugaauguaacuaggagauauuuauauuccuguccuguuuucaugaugccauuacauuuguugcugugucuuuucuuuuuguuuuugagaauggcauuaauagugaaaacucaugauuauuucagagguaguauaguuauuuuuauuguuuauaaauucuuuuuuugugugugagaauguuggcaucagacaaagcuguuaauaauuuagaccuuucuuggccauuaauaacaaaauauuaaaaguuuauaauaaaguacuuuuggauuaaacuacaaggauuagaagaaggguucuaucauguugcaugauuggcaaaauaucugcagagugcauggggacaaauauaauaaggaagugaaagucgaaucguaaagaaaaugaugaaagacguauuguggcacucuuccaagaaguccugaucucauuuggccaccucgucaguggaugucauuggucgugagggagaucuauccuuaacacuagacaaauauguuuuuaauuucaaaacuucaaaauauaaagcauuguuacugauuuuguacccugauuuuuauauuuggagguuauaauauuuauacaucuacuuuaggaagaaagcuaauaauuuuaaaauuuauaguaguaauaaucaucauuaccaucucugcagcgaguauucauuguauacuuacucuguaccucuguucuaagugcuuuauuuuuguuguuuaauuuguacuaagaauccuaugaaaguagguaguauuauaauucuaaguugauaggucucauagcuuagugaaaagcagggcugggauuugaagccaagcaauauuucuucacagcucaugcugguaauccuuugguucacugucuccagaugugauuaauaucaagguaaaugauuuagauuuuccuuuuucaauuuuuaaauuaaugaaguuccuuauccuucauaauuucaacuucaaauauauugccuccucaaguuucugcccaauaucuccuaguguuauguauguuaauccuuucuaaaggaagaaggcuuucauuuuauaauuauauaauauuuacgauagacucuaagcaugacaacagagccaugcauguaguagaagcaagaaguuucugauuugaagccucuuagaaaagaaccagcagagguucuucugaauaguauaucucuuauacaucucuuucucuaccuuuuaucuacauuacuagaugcagagauacuauaaucauaguccaauauagcuaauacuuuagcuuuagcauuuaaaauuccuauauacauuuuauauagauuuaaauuucuauauuuaaaauuccuauauacauuuagguacuucugacauuauaguaauucauaauacauuuccuuaucaggagguuacucacucuguauccucaccuguuaaaccacagauagacaaaaaagagacuuacaaguauuuguuggggggaaucacgaaguuuaugcauuaaauucaugucccuuaagguaagcucuuuacccuuauuaagauuuuauucagaucugugauauuauaugaaauucuaaugaaauuuaccuggcuuuccauucuguaacagauaauaaaucuaaaaguccauuuccaugauuuagaaauccaaaaugcuccagaagccaaaaguuuucuuaacccuauaguggcaaaacaugaucugaguggauguaaggguauugguggucuuuauuuacagccccucuuuacuguaaauauacauuuugccacagaaauauuaacauaguuauuuugggguguugccucagacuucacuaggaugugagguguguguguguguguguaugucaccuuucugaaauccaaaauauucugaauuuugaaauauauuuggcccuaagguuuuuagauaagggauugcagaccugaauaaucagguacauugacuacauacaguaccauugaggacuaagauauggaaguaagguuuuuuugguaacuuaaauauagcaauuugagaccuuucaguauggagcagugccccucucaaauaauauggaucucuuuuaaagaaaaaaaaaucucguuuugagaaucuccaacuauaguucuuaaggcaguuuucuuuaaaaauaucucucacuuuucucuuugaaaaugguaaaauacauuuuuuauuauugaaaugaaagcacaaaaugaaaauuugcaacacuuguguggccuguagaauguauccauuaaucuuuuaccuccagggauacuuccaauugagauucauugucauaaugacaacucuuguuagaaguaugucagacuucucaagugugcugagggagaaaggaaaacauaagaaauuaugugcuaaaauaaaggauaauguacuuuagugacguugucaucagaaacuaauguaaacaucuguuuccagcagcauggugaaccacguaccuggaucaagguaccaaguaccuucagcuuucugcugaaaacaaccuaaaaugcuggauaaaauaaaaucuuaaaugcaucagugcucuggcgcaaaggggagaguacuuaggccaggcugaauucugaaucuggcuauugcuuugaggauauuugccaaaucaggugagcuucucuguucauggcuuuguggggcucagggaucaggaagcaaagccuagacccagucaagauggagcauuuagcaggaaauagucuuccucauuaauuuggagccccauuguacuguaccuuuauaagagugauauagaaauuauuucccuuuaugcccccaggguuucuacagagaaauuuucuucuagaauauuacugcaaaucgaaaaaaugucacugaaaaugugcuaccacaaaccagcucucacacuaguuugcagcauaaauucacacuaaaccuuaagaauuuaaaaugauccugggcuguuacuacucccaagggccugauaaaaccuaacauauaaucaucauuaucaaagaauucccauugguaaaguucuaaugaaaauaaguggcuuauaauaaaaauuacaggccauccaaggaaaaaggcacaauauaagagaaucauuugagucagaugugcaaauaguucacguuuuggaauuaucagauguaaaauagaaaacaaauacguuuaauauguucaguaacaggcuuaaaaaugaagaaaagagcaaacauguugaaaaggaaccagaaguuuuagaaaugaaaauaguaauugaaauuaaaauucaguggauagguauaaaagcaaauaugcuguugaaaaguuagcauaaugaaagguaaaucuuaagaaauuuagaccacaagauagacaagaaauuggaaaauauaaaagagguuaauaaagggaacauuuuuaagagaaaagacagauuaccuccaaaggaauauucagguuucgauaacaguaauggaaauaguaguggacuaugaaaugauaugcaagacaaaauaacagcguagaauucuauagcaaaaacauguucauacaaauaaaaugugaaaguucagugacagacuauuuuuuaagcagaaguaaaugaucagaaguagaaaaucugagauuuaagaagaaaugaucaaagacggugacaauuauauaggugaauaaaaguggacuccauaaauaauaauagcaucuuaugaaguuaagaaaaagcuauauuggcugggcacgguggcucacgccuguaaucccagcacuuugggaggcugaggcaggcggaucaugaggucaggaaauagagaccauccuggugaacacggcgaaaccccaucucuacuaagaauagaaaaaaguuagccaggcgugguggcaggcgccuauagucccagcuccucgggaggcugaggcaggagaauggcaugaacccagggggcagagcuugcagugagugaacaucgcaccaccgcacuccagccugggcgacagagcaagacucugucucaaaaaaaaaaaaaauaauaaaauaaaaaauaaaaagcuguauuauaaaccaggagaaggugauuggagcuagcauuuaaaggacuuuuuauuguugcuuggcacgguggcucacgccugugauaccagcacuuugggaggccgaggugggcagaucacuugaggucaggaguucaagaccagccuggccaacauggugaaacccagugucuaccaaaaauauuuuuuuaaaaaagccgggugugguggugcacgccuguagucucagcuacucaggaggccgaggcaggagaaucgcuugaaccugggagggggagguugcuuugagcugagauugugccacugcacuccagccugggugacagagcaagccucaguuuccaaaaaaaaaaauauauauauauguauauguguguguguguguguguguguauauauauuuauuuauuuacgagcagacuaaagauaacuggauuuuuagaaguauauaucaaaauuuauaaggugacauuucagugauagaaauauguauauaauuuccacacuaguagaggauuaaaaaaaauggaaugagaaaaaagaaucauuccaaagaaggcaaaaaaagaaagagaaaaauuaacauggaaagagcaggauaccaaaaaggaugguagaaguaaauccaaauacauguaugccuuuaaaaacaauauucauguauaugggguuuaggauagagacuacaaggaaacaaaggaaaauguugaaaguaaaaugauggaaaaacauacaccuggcaauuuuuuuuuuaauuuuaguguguacauaguagguguauauauuuaugggguacgugagauguuuugauacagguaugcaaugugaaauaagcacauccuggaaaaugggguauccaucauuucaagcauuuauccuuugaguuacagauaaucuaauuacauucuuuaaguuauuuaaaaauauacaaauaaguuauuauugacuauagucacccuauugugcuaucaaauaguaggucuuauucacuuuuuuuuuuuuuuguacucauuaaccacccccaccucccucccacuaauccuccacuaccuuucccagccucuaguaacuauccuucuacucuuagacguucaugauuucaauucauuugauuuuuagauucuaugaauaagugagaacaugcgacguuugucuuucugugucuggcuuauuucacuuaacaugaucuccaguuccauccauguuguugcauaugauuggaucucuuuuuuuuuuuuuuuuaaagugagacggaguugucucccuuuguugcuuaggcugguguguaguggugugaucucagcucgcuguaaccuccacuucccggguucaagcaauucucuugccucauccucccaaaguagcugggaccacaggugcacaccaccaugccccacuaauuuuugugggguuuuuuuuugguacagaugggguuucaccauguuggccaggcugguuuugaacuccugaucucaaaugacccgcccaccucugccucccaaagugcugggauuacaggugugagccaccacgccuggccugaucucauucuuuuucguguguauaugcaccacauccauuucuuucguugauggacacuuaggcugcugccugacuaauauuaauggaaagaaagcuaguauauaauuucaaauagacuuaaagacaaaaagaauugauacauaaugggaaauggcuaauuuggcaggaauauauauguuuuaaaguuacaugcaauuaauaaccauagccacaaaauaaagcaaaaaauuaacagauguacaaggaaaaaauugaaaaguuuuuccaguauagcaggagauuguaauauaucugccuuaguauuugauauagaaagcagaccccaaaaaaagauuaguaggaauacagaaaauuuaaacagugcgauuaacaagcuucauccaauggacauauauuucauccaugcaccauagaaacaucaaaugaaucauuaugaaaauuaaucauguacugggccaugaaacaaguuucaacaaauuucagagaauugauacccuauacacuguuauaauaccaacucaguuaaguuagaaauagguaacacaaaaaaacuuccuuuaucacauggaaacuaaaaaaaguuuucucgauaucucaucgaucagagaagaaaugcuggaaguuggccuguucuuuaguaggagauguuaaaucauaccucagguuugcuugcagcaaacaaaaaacugagaaauggcccagauaaaaggccuugcauucuuaacaggugagagugugcagggaugcuaaggacugaugguggauagguucuccuaacaggaaggaugccauuuuuuuuuuuuugagacggaaucucggaaucuugcucugucgcccaggcuggagugcaguggcgcgaucucagcucacuacaagcuccgccuccuggguucacgccauucuccugccucagccuccccagcagccgggaccacagccgcucgccaccaggcccagcuaauuuucuguauuuuuaguagaggggguuucaccgugcuagucaggauggucucaaucuccugaccucaugauccgcccgccucugccucccaaagugcugagauuacaggcaugagccaccgcgccuggccugaaauuuuuaauaaauggugcuggaacaauuuuauguuuauaugugaaagaugaaauuggauaaaaaauacauguauacauuuuuggugaguugaagauuuaaauguaaaaggcaaaaauuauaaaacaaacuguagaccauaaagaaaaggguuaauaaauucuaccauaugaaaguaaagaaauuucuuacuaaaagcaaccaauaaagagauugaaaagacaagucaucuacuggggaaagauauuugcaucacauauaaguuauuaguauccaaacauuacaaaucauuaagaaaacccauaaaaaaaugggcacaaggcuucaauagauacuuuauggaagaauaaauccaaauggcauauguauagauauauauucauagcuauauguucauauauaucuauacauucauauucuauauauccauauacagauauauaugaaugaauaaaaaggucuucugcccuguuacuagccugggaaaugcaaauuaaaacugcaaggagaugcaguuucagaguugauauggucuggcucugaguccccacccagaucucaucuuuaauuguaauccgaauuguaauccccaaguguugagaaggggccuugugggaggugauuagaucauggggguggucccuucaagcuguucuugugauagugaguucucacaagaucuggugguuuuauaaggggcuuuuccccaguuugcucagcacuucucucuccugccaccaugugaagaaggacauuuuugcuuccccuucugccaugauuguaaguuuccugaggccuccccagccaugcaaaacuaugagccaauuaaaccucuuuccauuauaaguuacccagucucggauaugucccucuagcaguguagaaacggacuaauacaguagucaucagauuggcaaaaacaauuuuggcaaguacaugaagcauuugguauauacacuccugguuagugguaacugauucagcauuuuuugguaagcaguuugucaucaauuaaaguugaaggcuauucugugaccaaauaauucuacuucuugacauauguucaacuuuuagauguauacucaagagaaauuucugacacuuguauaccaggugauaugaacaaagacuucuauaacaguaguacuuguaauagccccaaacauaaacaauuaaauguuccuuaaaaguauaagaaauuauugaauauucauaaaauggaauacuagucucuguaaaaaugaauuacugcuacaauaauguuaaugaauucgaugggggaaaaaacaagucucagaaugucuuccauauaauuuaauuuuaugugauguuuaaauguggaaggcuaaguaauguuuaaggauucuaacaucugggaaaaguauaaagaaaaaaccuuuuguuaacucggucuuuaaucaguuaaaaguguggaaaaguaagucaaaauucugauugguuaaaucaacauuuuguguuuaguagguuucuuaguuauuuugggcaaaaauggcuaucacugugacacaucuaauucucuguaaugcagcauauuauguuuuagguaaugcugaaaauucuguggcuuuguuucccuuuucuuauguagucucugaagcauuucucucuuaccaauguuaauaccaaccuaagcaaaaaugcucuccuaugaccuuuugggaaaugaucagagaauuccaauacauaauuuuauauuucuuauccuagaguaggauaucacuauaacauugaacguaauaugcagaugugcaaaucucuguuagacaccuuaggagaugcaugagcugcacaacugugaaaaaaaaaauaguacauuuaaauccgaagccuucuucucaagauaccgccauggcaggcacacagucaagcucuagauggguuccagagugauuguacuggguugguuugaacucuccacuuuuauuuuuauucauuuuucuuauuuuauuuauuuauuuauugaugucuccauagagacugucaaaaauugccagugcugacuauaucgcaaguaauugcagugggguauugggaaaaguuuccaauuagcaauaauugcacucagauaaaccucauuggcuacgauacugcuacugcacaaagcuugaacucuccacuuuuaaaauucuccucgugaauaauuuuuuuucuuuuuuagaauguagaagaugggagccuuaacacaaauguguacuuugcuaaaguguauaguacauuuaucuacuuuuuuggauagcagugucuuggcuuagaaauucguuuauuagugguuguauuaauuacuuggauuaagcuaguuauacuccuaaaaauuagaauacauuuuuuaaaucccacaucauacuauuuuggccuuuuuuuugaguaauauuuguuauguaucacaauuuuaugugguucauugaaauacuguucuuaaaggaguaauaaaaagaaauguuacaucauaggcccagguuuccuuuuauuuaugcauuuggcuuuaugaagcaaacugaccaugcauauuauuaaugcugugcuagugaauguuuucauuucauuuuaagauguaguuucucauaagacuauaauuuuuaaaauaaauaaaauagaaaguuuucuugauuuuauugugaaauauacagaucuuuuuguaguaauauugcauauuuauauauuccugaacacacuaaaauugugcacagcugaugggccaacucacucaaaagugaaaaauaugcagcuuuguaaccagaaugcuaacaaaaauaaaucuuaaugagaauacuagaauauauuaaaacauauaugaaauuugucacaaacaaguaauauggucaguuuaggauuuuaaaaagaacaugaacacugugcaaggaaggguugaagcuacaggaugauggaugccaggguaaaaugcauaaagauuuggaaagaagagcucauuaaacacuuccaagaaagagcauguggccaagcugugccaagaggaagaacauggguugaaugagaauuguguaccguacugucuuuucagcagcuugcugcuuuccacuguguuagccuauuucggguucagcuguuguuguuugguaguacaaaaacauaggcugagaagaaucauguacaaaccaauaugacuuacauuauacuaaaaucauucccuuauuuaccaaugggcuaauucguguuauggaaaagguuuguaacagaacaagcuguacuaagaauauaagagguggcuucuguuuuugacuugagcucucugauaaguccaugaccuuuuuaagauuugauuuuugugugugaaauggaaauacuacaucuaaaaauaauguaguacagccuuuucucccuugagcuuauuguuuuaauuuuaaacuauaaaaauaauaagcacauuaaagaaaaauugggaaauagaacaacaaagacaaaaauuaguaauauaaaucaccguuuucuuuuuuguauguauuuuuuacuuuuucacugguuuuuauaagcuuuuuaauuuauucacauucuucaagucaguaauuuuuaauggcuacuaaauauuagauugaauaguugggcuuuaguuuaccauuucucuguuauagaaaauguaaguuguuuauaguuuuccauuaucuuuaauaauucuuggaugaauaucugugugucccuccacacaucguggguugggaagggaauaucuuuuucccuacauaagauuauuucacaaaagugacacauuuggaauuguugggucaaagaaugaaauuuuuaauaauucgugauacacauuuccauuuagcuuuccgaaauggcccuagguccuugcccaaaauuguuuauuuuauauuuuuuaaaauaaguuuuuuauauaauuuuuuaauuuauguauuuguuugcuauuuguauuuaauaugugagaaaagaucauuugccuguuuauccauugugguggacuugguguuccaaauggauagugcucugucuacggucauagcacccugaacaugccugaucucaucuaaguggauagugcucuaaaguguucuauaaggauaguuuauaaacggcuuuuuuuccuucuugaaaacacaaugacaguucaaaccuuacuaagauaaugucagcacuugguuuuuaauaaugucaauacuugguuuuuaaacuuugcuuggauuaacacucuguaacucuuuggcauauuuugcugccauacuauuucuuuacaucuuaaugaaauuuuuuuguaaacuuguaauucagaggaauaacauacuugcaaccauuuaaauuacuuaugagaaaauuuagucaauaguuaucaggagacugauuuuugaguauguuacguuaauaaaacucacuauuucuguuuuaaguaguauugauaaaaauucaaguuucuugagcgauugagagugacucuaauggccagaaauuugaauauugaacuuagccucguuuauaauuuuggcuccacuuuuuauuagcuuuagaaccuuagggaaauggcuuacuucauuuccauuuccuuauuaacaaugaauuucaguuuuuuuuauuguuaccauuuaggauguuuccuaccauuaaggauucauuuccaaaauaaauuaacucuucaaggcaguuagugcaccuuuuugcagaauagacaaauaauuuguauuaugaguucauuuccaucugaaauaauuaugauuugagugucuacucauacucaacauuuugaaaagauucauuaggaaugcaaaaguaaaaaacucuuaucccagcuaggcaugguggcucaugccuguaaucccaacacuuugggaagcugaggcaggaggauugcuugaggccaauuguuugagaccagccugggcaaccauagcaagacucuguuucuauaaaaaaaauuuaaaaauuagcugggcauggugugugccuguagucccagcuacuugggaggcuggggcaggaggaucgcuugaacccaggagguggagguuacagugaaccaugauaucgccacuguacuacagccugggugacggagugagacccugucucuuuaaaaaaaaaaaaagacucuugccuccucauggaauucacaguuggaaaggaagggcauuuauugaacuaaggaguaguucagaguaaguagagaugaugcauuuuaaagccuaugacauagaaucuguaauguaguaaaaucucagcaaauguuagccacugcuguuugguacuuucuaauuucuagauguaauggaagauagauggagauuuaagugacaaggcaaaagugagacauuagaaauuaaucacucccuucuuuaacugaacacuggguacacuaaagagugguuuuuuguuuguuuuuuaaggaagcaagacauuauucaauucucauucgucauguuuuuaagucucuaugaauagagagacuuugauaaaaugaauaauuuggucacuuacauaguacaggauaucaguucugaaauacauugugugcucauauaugugaauguuuauuuaugugugguuuucauaagagauugaaacagaaaccaaauccguuaucguuugaucuuuuccuuuuuacaguguugugauguuucaaguuaugggugcacaggagagagauaagaacuggauauggaaagaaugcuguuaagauuuaaaaugaauaggauuugagucauuggugcucauggguguuguguacauacuguugccagcacauauugugguuagaguuuuguuucuggagucagucugccuggauuuaaauucugacaguuccacuuacgcuuaaccucucugauuaauuuuccucaucaauaaaguugaauuaauaauagugccuaccuuauaggguuuaauugacaguuaauugagauaucauauguaaauuguuuagcacaaugccugggcacuaaaguauuaucuaaggcuguugcuaauggagugcucugaggcuaacuacuucuggugguagcucccagaauccagauaaacuguucuacaucuaaaauuaacuaguuuucucuuuuacauaacugacauaaaaaguagaaauaaaauuagccgguuuucagaauucuugaaguaaccugccaucuaugucuuaagcaaaacaaacucuggagguaccccccccccccaauuauuucaguuacacaagcauaaguggguugaauaggauaauagucgguuuuucacugaauuuagaaaugaguuaucuuuaugagccauugaaaauuaauuaaauagcacauuagccuguugcuuucuucucuggucuguuauugucucaugauaaaguuuuugaauagaaggguguuuaaagugcaaaacaaaaauaauuugagaaaauagaaaugaaaaaagaauaguaacagcuauuuuucgcucuccuugaaaguacagggacaguucauaccuuacuaagagaaugccagccuugaaaugucaguacuugagaugauauagaaugcagaguuuaaaaguacugggauuuuaaaaagaaaugauaacuuauagugaauuuaauuuagcuaaugauaaauuuagugaauaagaaguguuaucuuguuagacuuacggaaguauagaguagaaugguugguaaccagauaugggugguggggguaggaggaggguguagggaagggggagauguuagucaaagaguacaaaguucugguuacacaagaggaguaaguucuagugaccuauugcauagcaugaugacuguaguuaauaauaauguauauuucaaaauuccuaaaagaccauuuaaaauguucucaccacaaagagagauagguauaugaggugauggauauauuaauuagccugaucuaaucauuucacaauauauacauguaucauaauaucacauuguaccccauaaauauauauaaucauuauuugucgauucaaaauaaauaaugaaauaaaaauguuaucucuuuuuaguaugacgugcuguaaaaauaguauacauaguuucuuuuuauaguaaauauuugagauuugaggaaaggguuuauuuuaaaauauugcuuaaauauuucaaauuuauuauuuucaagauucaacuauuuguauauaguaaaaucauagauucuuaagauacguauaaagucuuauaguucaaagaaauagccuguccacuuuaaguaauaauagccacuuccuauuaggugauuagugugggcuagguacuuuacuaaguauuuaaaauacacuauuuaauuguguuaauaucacccauacaccugguccuauaaagcugcacuuuauuuacagccauuucaacuaauauaaguuauuuuccuuguauuauaaccauuaguaucuucauuauacaaauguugugcuuaaauauuaugugggacaauugauugcaaaauuucucugauuuggggauauuuacauauguauuuucuuuuucccagaguuuaagaaucuaaaguauuacauugauaauuguuuccuuuguugcagaacuguaagaguaaauggguccaguaauuggaaugacuccagauaagagagcugaaaccccaggagcugaaaagauugcaggauuaagccagauuuacaaaaugggaagcuugccugaagcuguugaugcugccaggccgaaggccacucuaguggacagugagucagcagaugaugaacucacaaacuugaacuggcuucaugaaagcacuaaucuucuaacaaacuucagccucggaagugagggucuuccaauuguuaguccauuguaugacauagagggagaugaugugccauccuuuggaccagcuugcuaccagaacccagaaaaaaaaucagcgacuucaaagcccccauacuccuuuagucuucucauuuauauggccauugagcacucuccaaauaaauguuugccugucaaagaaauuuauagcuggauucuggaccauuuuccauauuuugcuacugcaccaacaggcuggaagaauucuguucgacauaaucugucccugaauaaauguuuucagaaaguggaaagaagccauggcaaggucaguguuuaugaacauugcuauauuuggugagguggggggacuaauuaacauggagcccuuaaaauaucuggaaaucggggagacaauaaguagucaagucaaauuacuucagcugaacugaauuauauucauuuguuuucacuugagauguuuuaaaauuucuuaaauauugauauaaauuuagcagaauuauguuuuguccacuauagguaccuagauuagucuuuuuauuauuuuaguucuuuguuucuaguuucuguaguguuccuauaacuaucagcauuugauucuuuauucaauaugauaaucucugccuuauaaucaaaguauagaccauuuaaauuaaugaaauugauaugguuggguuuaaaucuaucaccuugcuauuuauuugauuuucuuuuccacuuuuccugccuuuugugggaugagguguucuucacuuuugguuuugguguuuuggugcuuuuuuuuuuuuuuuuuuuuuuuugugagacagucucgaucugucacccagccuggaguacaguggcgcgaucucugcucacugcaaccuccgucuccuggguuccagcgauucuuaaugccucagcauccagaauagcugggacuacaggugugugccaccacgcccugcuaauuuucguauuuuuaauagagaugggguuuugccauguuguccagacuggucuuggaacuccugaccucaaguaccacccaccuugaccucccaaaguguugggauuacaagugugagccacugugcccagccgagguguuguguguguguguguguguguguguguuuuaugcuucaauuuuaucucuacuauugccugauuauuuauguauuuuagugguugcuauaugguuuucaguauacaucuuuaauuuaucauugguccaccuucaaauaauauuauaccauuucacguaacuggcucuuuacagaaaaaguugcuuggcaccugaugcccuauuggauuaauuccuuuugccuggagaaguuuauuuaaaauuucucauuauucaguuuugcuggcaaugguuauuuuaaacuuuuuuguggggugcagguuuagaauucuagguugacauuuuuuucuucuauguauuuuaaagaugauuuauugucuucuggcucccauaguuucuggugagaagucugcugucauuauuccucuuuauguaaugucucuuuuuuuaauugcugucuucaguauuuuuucuuucucucuuuaucacuguuuuucagcaguuugacuauagagggccuagauguguuauucuuuauuuuuaucuugcuuuggguucucagugguucuuaaauauaugguuuauugccuuucauuaaauuuaggaaauuuuugcucauuaucucuucaaauauuucuucugccucacuccuacuuuuaggacuccaaguaaaaauauauuagaccauuugcuauuugucuuaccucuugauugcuuugccuuuccuccacucuuucucucuuaguuuggauaauuuuuauugauuuuucuauagguucaccguuuuucuuuguuguguucauucugcugauaagccccaaugaaggacuucuucauguuuuuaauuucuaauguuuucauuuuccuuuuaaaaaaguuucugucucugcuaaaauuccccacuagauccauaaacauauuaauuauaguuauuauauaaugucugucaguuucaauaucugguccaucucuggaucugguuuugcugacuguuuuaaucucuuguuuuuguauguauuuuauaauuuuggauugaauaucagacauugcaaaagaauggcagggacggaaguauguaauauuucuacccagaaauaggcaugccucuacucuguuaggcuguuagugugaacagguauuggucagucuaguuaguaauugagaagaguuuugaguguuugugguugcaguaauuaccaucaguacaccacacucuucagacuccuacagagauggacugccaauacuuuguguuuaaagugaggccuggagcaauagaugacuuuuuugucucagcauuacugcuacaacuucaucuucuagcuugugccacauuugagguugggagagagguaagauagcucucucuguugcccuuccuacagcacuagauugcuauugcuuguuacuuggagcaaggcuuuuggauggggcagaguaggauccuugauucuucuccagcauuagucuuaaacagguucugcaugccugugcuucaggugugagucuuucugugccucccccaggagcagacagucucuccaucuacucaauauagagucuagagcugcauuuuucaguagcaaaauguacucuuuaaugccaggaaccaucucaccacugcauuccagccugggagauagagggagacucugucucacaaaacaaaacgaaaaacauuggauucaacuuuggcugagugcaguggcucacaccuguaaucccagcacuuugggaggcugagacagguggaucgcuugagcccaggaguuagagaccagccugggcaacauggcaaaacccugucucuacuaaaauuagaaaaaauuagcugggcguggugguacauguagucccagcuacucaggaaauggagguaggaggauuguuugaacccucggagguugcagugggccgagauugugccagugcacuccagucuggaugacaaagugagacccugucucaaaauaaaaaaauaagcuggacgugguggcucauaccuguaaucccagcccuuugggaagcucagguuggcgguucaccugagguugggaguucaagaccagccugaccaacauggagaagcccugucucuacgaaaaauacaacaaauuagccagacaugguggcauaugccuguaaucccagcuacucgggaggcugaagcaggagaauugcuugaaccuguggugagccuagaucgugccauugcacuccaaccugggcaacaagagugaaacuccgucucaaaaaauaaauaaauaaaaugugacaggguccauccugugacgugagauguaacauaugaacucuuaccuuugacagagcacagaaauggcagucguaaaagaauguaagaaaaagaagccacccaaauuuuaaaucaaauuauuaaagaccaaaugugagcuagcaugacagcuuagaaucccugacauucccagaagaagaagagucugcauccacuagcuaggucuuuuuccacuggccuccaucuggugcuccagaggaagacugcaggcaggccaggaagccuaagagaaacccuuaugaaugaagacagauguacagaaucugccaagauuuaggcaaagauagaccuagagcugcauucuucaguugccauuuauccacauguggcuagugguuggcauauugaacagcuauaggauauuucugucaucauaaacaguccuuuuagacagugcuguuuuagaguucaagccaguuuucugcucauucccauuaugguggagaaacucagccuagucuuagugggaggucuuggacaaaagugagugaccacucccuuucccaguggcagcaguucucuguaucaucagcagauuugagcaugagcagauuuucugccuuucuucuaguggcacauggcacauugccuuguuaaauauggggauagcuagguuuuauacuucucuuuuagcaacagccauccuuugccugggacuagagugggcaaaguauuuugccucuuccucaguggcagacagcuuuugcuuuguuuuagagaagaguccaggauauaggcagguuugugucuguccuacaccacuaucugaucuucaccuuuugcuuguucagggucuagaacauggaugaucuuugccuaaaccuuggcagauucuguacaucugucuucauucauaaggguuucucucucaggcuuccuggccugccugcagucuuccucuggagcaccagauggaggccaguggaaaaagaccuagccuaguggaggcagacucuucuucugggaaugucagggauucuaagcugucaugcuagcuaacauuuggucuuuaauaaauguuuuaaaauuuggguguuguuuuuuucuuacauucuuuuacgacugccaucucugugcucugccaaaaguaagaguucauauguuacaucucaccucacaggauggacucuguuacaauuuauuuuauuuuuuuuauuuugagauagggucucacuuugucauccaggcuggagugcaguggcucaaucucggcccacugcaaccuccgaggguucaagcaauccuguuaccuccguuuccugaguagcugggacuguaggcauguaccaccacacccagcuaauuuuuucuaauuuuaguagagacaggguuuugccaugcugcccaggcuggucucuaacuccugggcucaagcgauccaccugucucagccucccaaagugcugggauuacaggugugagccacugcacucggccaaaguugaauccaauguuuuucguuuuguuuugugagacagagucucccucuaucgcccaggcuggagugcaguggugagaugguuccuggcgugaaggaguuuaaguuuuaaaaaguaagaaggcaaacaguuaaucauaauacgauauagaaagaaauaucauaauagcaacaugaacagagucagagagaaguugauuaauuauuaccuagcacagugguccccaaacuuuugacgcuagggacugguuuuguggaagacaguuuuucugcuaccugagguggggacaugggauaugguuuugggaugaaacuguuccaccucagaucaucaggcauuagauucucauaaggagcgcacagccuagauccccucacaugcacaguucacaauaggguuugagcuccugugagaaucuaaugcaugggcugaucggacaggaggcagagcucaggugguaaugcuucucaacuuccacucuccuccugcucugugaccuguuuccuaagaggccauggaccuguaccggucuccagcuuggggguuggggaccccuaaacuaaaagauuugggaaauuuuuauggaaaaguuugccauugaagugugcuuugaaaaaagagaacagguuuuagaaggguaacauaugccaaagggcaauaguauauucugcugggaguuuggggcaguaggcauauucucuguuggugaggaauguacgagagcaggguggaaaagcagagugauccagaauagaagugugaugaauaucaugcuuggacuucaguuuugggcuucaguuguuuggacuucaguuuugagagcaaaccagugagaguuuuuaagccaggagcaugauggaguuucucuguauuugacuugugacagugugaaugauagggcaauauauuaccuuaaacaauaucugaauucauuugccaaaggaauguuacaguuaguaguaccaugcaaacagagauaguuucagugaagaugugggauuugaacacuuuguaaucauugcccuccuuaugucuaaauccacugacuucuuuucugucuuacucaaccuaaaacugcauuauaugacaugauuagcucugggaauucaucuuuucuuugauuuguauaacacugugcuuaauucuuuguuuaccuguguggacucuccaucuuuuucuuuugccacuugccauuuaaacuuuaguguucacuauuuugucuuuuuuguugauuuaguauuuucuuaaucucauuaauucccauggcuuaauaugucgucugugaucuuaugacuucuagaucuuucuccuaaagcccagacguaaauuugcaacuaauuauuagaucuggagguaucucaaauucaguguguccgaaauuggacuuuauuccucucucuucuccaaggaucuauuugggucucagcuagaaaucugagucaucuuggguaccugcucuuugcaaugccuaaguuauuugaaugucaaauuugaaaggaauauagacauuauccugaugaacuuccuuauuuuauaaccaaaaaagugagauacgugguauuaauugauccuggucuagaaagccugucaaagccagggguuagauucaagaaaaagcaguaucuaguagcaccuauaaauaccuacaaguugcuuuuugauucuggccauuucuuuuaguuucuaccauaacauuggccuuaguucaggucuuccccucauuucucaucaaauugaacuauuauauaaguugaggagucagcaugaaggauuggauucagguauguuccuagauccagauagaugugugacuugguaaaguuagacucucugagccucauuuuuacuucaguuuuuguaacuaguaaccuuuaguaaauaugacuuacuaaauaaaagccaaacuuguuaacaugguuuucaagacccuccccaguuuggcuucugccugucuuugcaguuuuuuuucuucacuacuccaugaucuacccccacaagacuacuugcuauuccaguauacuauaaauaguccuuguuuauuuuguuccucuaucuacacugcauuuucguaauucacuuucaguggagagaacauuuccucaaagcccagcucagaagucaccucucaagcauuuccugcuuuuuuguacucauuuuguguuuuuauagcauucuguuuguuaccuuuauaacauacauaucccaguuauguauagauuugcuucucccacuagggaagauaugagagcucucugaggucaaggccuuaguagaauagucacuuaagacugugugugugugugugugugugugugugugugugugugugugugugugugugugaaagagaaaggggggagugauauuauucaauaaccuuuuaaaagcucagcaucuuuuuucaucuuaaugcauaauucucuuuaauugugauguggaugaacauuuggguuucuaauuuuuuguuauaaacacugcuacagugaaaaucaucucccuauccuuccuucucuuugccuucuuugaaauugaucucccuuuauucuuuuuccucuguuguguugguauuguuauccucugucuuuuuuuuuuaaacacuguacauauuucauaauuauuuuauguagucuccguuuaaauuuacccuuauaguuaacagugucauuguuugcuauuguuuaugcauuuagaauuuccuuagugauuuuauucuugaauugugucacuuaauucuuuuauacuuuuagaacuauuguguuuauacuuaugaugguacauaaaagguaaccaucuacuagguacuuagaaauauaggcaggaauagaggugauguggugagauuacagcucuuaaguuuggaauuuaucagcauugcuucugaguggaauaaucuaggaaaaguaugguguaaugaagccaaggaagcuaagcugaagugugaauggccaacagugucaaauguugcagaacacuugaaaaugauuggcuaagaagaaguuguugagaaaguagcagccaaaagauuaggauucaaaauauauaauaagugcugugcuggcugggcgcgguggcucacaccuguaaucccagcacuuuuggaggcugaggugggcggaucacgaggucaagaggucaaguccagccuggccaacagagugaaaccccaucucuacuaaaaauacaaaaauuagcugggugugguggcgugugccuguaaucccagcuacuugggaggcugaggcaggagaaucacuugaacccaggaggcagagguugcagugagccgagacugugccacugcacuccagccuggcaacagagcgagacuucgucucaaaaacaaaaaaaagugcugugcugauaaauguuuaacaacuggcuagggacaggcuguuuagcuuuugcuaaauguggaguugagaagcaauguuuacuaucaacaguauaccauuauagaagaaacucauauaauuuaauaagaaaaugaaaaucuaauagaaaaaugggcaaguauaugaauaggcaguucacagaggaggaaacacaaauaggcaauaaacauaaacaaagauguuuaucuuacuaguaaugugugugagggacauucaaauuaaaagaacaaaaaaugcuuuuuuaucuauuagaauucaaaaauuuuaaauauuugaggacaugaguaaauauugauacuuucacaucauugauaggaguacauuaauaugaccauucuugagggcaguaguuacuagaauuagaaaugggcucuucuuugaucuagcagaucauauucugauuucuccccuagaguaacauucauaguugcauacaagaagauguaugugaaaauauucacagugguauuauuuuuaguaaaaguuacaaaaccauauguccaauaguaugauuugugauaauacucaaaagggaguuggucacaucuauaauuuuuaaauguauacauuuuuaauguaauuaaucugaguguuuugaauguucagagaaaggaagaaauuaaggaagugagagcuagagaaugggaaaggaugcaguccagaguauagguagaauuugauaacgaaaaggagagaaaucaucuuacaauuuuaaaaaagggauaaauauagaaaugguaauauauuggcauaaaaauuagcaagcuaucaccacgagucagggugggagggaaggaacuuguaaaucgucucauaaaaaucaguuaacuauuuugccuaaaugucugagauuuagacagaaagagauacauucaaguagauuugggaaugcauguggauuuuuuuuuuuuaauuuaugaaauguuucuugggucagugacagaaugacaguauuuuucuuccaaucuguggaagccaaauauacuuaguugcacuaaauguuagcauugcauuuggcaaccuugacagcacuuuucugaugaauggcgguuaucuagagaugauaaucccaauaggaggcagaauggcaaggucuagaucaaacuaugaagggauaaugauagccagcugauacagcugcugauuaagauguuuuucucccuaucaucauaccauuuuuacuacucugaaaagacaggucuaacaauccugguuugguauuuauuugucucuggauuuuaaauuuguuaaaauuauauaugguugucuuuugguucagcuugcuuugguuugggcuuuauguuuuaaauguuaacaucuggcugggcacaguggcacuuacaccuguaauuccagcacucugguagguugagacacgacaaucacuugaacccggaggcagagguugcagugagccaagaucgugccacugcauuccauccuggaugacagagcaagacucugucuccaauuuaaaaaauaaauaaaaauaaaaauaaaaauuggccaggcgugguggcucacgccuguaaucccaacacuuugggagccgaggcagguggaucacuugaggucaggaguucgagaucaggcuggccaacaugguggaacccugucucuacuaaaaauacaaaaauuagccgggcaugguggugcacaccuguaaucccagcuacuugggaggcugaggcaagggaaucguccgaaccugggaggcggagguugcagugagccgagaucgcgccacugcacuccagccugauugacacagcgagacugucucaaaaaaaaaaaaguuaauauccaagucuuguauguacuuuucuaaauuuuuauaaagcccaucuuaaacauuauuacuaugagacuuuagcugggaaacauggaauuaaauuuuuuccuagugugguaaaauuuuaaucaguuaauuauuuuuaauucagagguucuaaaagccacugaaaaucauuaccacuuuauaguuuuaucuaggccuugccauuuugccuucuuuuugguaguagacaaggugagcaacucuauuaaaauauacaggacaaguucauaaaaacauuuuaggaauaaugaacguugccuuuucucccaaucuagucuuuaccacuucuguuaagacaauucuuuuuaaaguucaccuuuuaguauauucaaaauuucuucaaaaccuuuagcaguucucuaccaaguaaguucagaagccuuagaguucuaaaacgcaaaauaauaaaaugagagaaugcucauuuccuguuuccguagcacagaaggcuauuuuguuauaggcaaauuuaguuuuaaacaguuauuauuuguauucucucaucuaagcccaauaauauaggaccaaagcuuuuaaguggaaaauuaguuacaaauaaguuucuuuuugcuguagacuuuaaaauguagauuagcaaauacagaguuuuaucucuuguucaugauaguucaugaacagacccagugaaaggaagugcugccaugguaacguaaaccagacuguuacuugagaccauacucaagauacuuaacugcccugaaacugcacguuuucaauaccaguuuuuccaauuugcuauuucaaggaaauagcaacucuacugugaucaaaacaauuugcaguccccucacaauagaauuugaaaaguagacuugaacuaaacaauuucuaggagcguaaucucaggaauuccaagguagagcauggcuagcauuauuaaaauaauugucuuggucuguguaugaaaaguaaugcugcguaucuuuucuauaugaaacugaauuggcuuuggggcaaaagauguuguaggugcuaacauuuuaauucuuccuuuuuuuuuuuuugagacagcguuucacucugucacccaggcuggccucagccuccugaauagcugagacuauaggcgcgcaccaccacaccaggcuaauuuuuucuauuuuuguagagacagaguuuugcuauguugcuuaagcugcucuugaacuccugagcacaagcaaucaccuucgccggcuucccaaagugcuaggauuacagacgugagccaccgcaccuggccuggugcuaacauuuuuuuccuugucaucaaaacacauuuaucauuugguccaggugacugaacauauagcuaaguuaagaaguuucauuuaauccaaaaauacauuuguaaaacuugucuuuuauugaaaaaaaaaaaaaaaaaaagaaaaugucaaauacuuuuuuaguauaguuaaugugauaucuugcugcuaaacaccaggaaaauguuucuccugauaauccagugcauuucuuucuuuaugauagugugauaugacaaccaugguuuuucuauuuauauaaauugccagcauaguaaaaaacugccuuacacucaauugcuacaccuuuucacaggcaaaagguuuuauucucuccuaaauuaauuuuaucccguuuuuuuuuaccaccuaacuuuugccuuuuauucagaacuaauguauuuuuuucuuauugucguuuuuuuuucaaaauucccuccucgguggaaaguaaaggaguaggaacauacuauuauucaaccaacaugcagcaacccuuacguacgucaguuucagaauggccccuuaauauucaccuauuuugcagcuaugucucuugcauauaaauccucuuauuugaaucucauuacaauucagugaaguggccugcauuguuguuuuacuuuacggguaaaauguaaaugagaagucugacucucaaaaauuaaaugauuugcccaauaucacauagccagucaauaaguagugaucgggaccuugguuuuugaaccuauagaacgguguucuuucauuuugccauucugcuauaaaaauuaugaaaugauauucagagauaaaagagcgucaauaauagacuaguaguaccuugaaaaagagugugggaaauggaaggacucuggagaucaucacauuaaaucuuaauagcaaucauaauagcuuauaucauagaagauuugauacacgcaaaaaggaguaugagaaugggaaacaaguaaauuuuguuguuaucuaaauaauuguuaauguagucguaaagguaauucaaauuuuaagaaagaguuuuugaaguagaaaaggcauaauauaaaaccagaagcuaauaacauuugaaccucacuaaucuugugaauuagaggaaguuuuguacaucauaggaugaaucccuuuuagucacuacagugcacacauagcaagcucacuucaaccuuaguuucauacucaaaaggugcuagagauuauuuaccccugcacauuuauuuaaaacauuuagacgcugacuguuuauguauaaaaguuccuaguuauucuugugcauuuuauucuagguuaauggaaaagguuccuuaugguguguugauccggaauauaaacccaaucuuauccaggcacugaagaagcaaccuuuuucuucagcaucuucacaaaaguaaggaucuuccauauaacugucaguggugauuuauaggauuucacugugugagauggagaaacuuaaagguccaggguauuauguuucuguuuuauuguauaaagaaguauuuauguuuuauuuaguuuuuaguuuuuaguuuuuguuuuuguuuuguuuuguggacacagucuuacucugucaccuaggcuggagugcaguagcgagaucucggcucacugcaaccucccucuccuggguucaggugauccucccaccucggccucccuaguagcuaggacuacaggcaagcaccaccacucccagcuaaucuuugucuuuuuaguagagacacgguuucaccauguuggccuggguggucucuaacuccugacuucaagugauccucccaccucugccucccaaagugcugggauuacaggcgugagccaccauccucggccuguuuuuucuuuucuuuucuuuucuuuucuuuuuuuaagaaguauuuauggauaagacauuagccuaaguuaguuuuccuuauggucuaauuuguguuucuagaauacaggaaauuggugacuugagaacauacacucugggaaauauagucaauacugaguauaaguaaacccuaaagaaaguuguaauauaauuucaguuacaaacaggucagaucauuuuaauugucugcaauacuaaugcuaaccuaaaaaugaaggaaauuaaaaauacauuuaaaauuuuuuaacaagauuauuaaguuugucauuauaacauuuuauauacauauguagguuucuuuuucuguuuuagguuuuuuucguaguacuuaauauuugaaaaguauguucaagucuaaaauuuuuaaauguuuggcaaauaaaauaaugcuuugaacuuuguuuuuauuuuuucugguaaauauaguuguacuguauuugcuuauaauuuuccuugucuuuguuuucaaucccaguaaccccuguugaucuucuagcuuccucauuuuaaguuaaaucggaaaauaauaugaccuucuuaaaucugauuuuuguuuccuuuuucuaaagaagacuuuagagucuucuccaauuuauuauauaccuucauuugaauugaaaaucccagauuugguuaaaauacuuuaaggguaguuuauaauggcuaacuuguuuuuugaaaaauuuaaaaagauuuuuaauaaaguaauaaauggaaauuuuuaaacauggaaaaaaguagagagaaaguuauaaugaacucccagcugcagcaaucaucaacguuucauauagugguuaauuugaauucuuaaaguauuguuagauaacuuguagaggagugguuguagcuggaauacaguaaauagcugggaaggcuaaaguugaaauaucaguaauauauucacucacugagauuuuaagcuucuuuaccauauuauagauuagauggaucauuauaaaaagaauaacugagugguuuaucuuuaugaaaugaaaccuagaaaagaaguuaccagauuuuauauucuuacuuggaaauugauaucuuuauuaauuaauuuugguuauuaugaggcauuuuaaauaauaauuuagaaacuaauggugaguucuacugauguucaccuauguguuuuacuuagcuguguuggguuuuuuuuuuuuuuugcugaagauuaagccuggacaacauggagaaacccugucucuaccaaaaauacaaaaauuagcugggcauggguagugcacgccuguggucccagcuacucaggagggugaggugggaggaucguuugagccugggaggcagauguugcaaugagccaagauggugcuacugcacuccagccugggugacagacugagaccccaucucaaaaaaaaaaaaaagauuauaugaaagaauuggcaccauuuuuuguaaaccaucacaaauauauuuugcugucuuugauauauuguauuuucauguuucuaucuuuuagccuuaaucauaaguuuaaauguuaaaagugaucuuguggcuuuaaaagaagauaaaaacuauggucaggugagguggcucaagcuuguaaucccagcacuuugguaggccgaggccaguggaucaccugaggucgggaguuugagacuagccuggccaacauguugaaacccgucucuaccaaaaauacaaaagucagcugggugugguggcacgcgccuguaaccccagcuacucgggaggcugaggcaagagaaucaucuugaacccaggaggcagagguugcagugagccgagauugcgccacugcucuccagccugggcgacagagcgagacugugucucaaaaaaaaaaaaaaaagauuaaacuacaacauaaggguuauauauaaccuuuugacuuuaaacccuuaauauaaaaugaaacauuuugcccuuuauguuguuuggcaaaauaacaguuccaucugacaugcuuuuguguagcccuugcauauaagaauuuguaagucugaggaaaagagugagauacaguauauguaaaacuaugaauaggaaauaaacuuuuaaguucguuaacaaauagauuuuuuuuucaugcuaucauaaauuccaaagaagagaaguaguuuuucccaaaaauauuuuaauuccuggauuaaaaaaagaacuguuggugucuuuccaugaauauagaaaguuuaauuuuauguuuauuaauaaaaucaggaacauaccuguuugcuaucacuaccaaguguuccuuaaccaugaauuuugguaaaugcuuuuauuuuugugguaauaccuauauuaguauuauaucaaacuuaagaauccaaugcaaaaccaaacaguaacuaucauguauuaucuauaguuccaggcauuuuaaaugcauuauuauuauuuaauuaucacaacagccuaugugggagauuuaauuauuccuauuuuacagaugaagaagcuaagagauuaauuauuuugccuaagaacauccaaauaguugugauuuaccucuuuuggcuccuaugcucuuucugcuuuggcagacuuucuaaauugaguaguauuagcaaagaaaacaagguaaaaauaguuuguuuuuggugguacaaauuagcuguauuugugacuaaguucuauaaaaagugaaauaguugggugcaaguggcucacgccuguaauuccagcacuguaggaggccaaggcagguagacugcuugagcccaggaguuugagacuagcuuguacaacaugguaaaacccuuucucuaccaaaaaaaauuaaaaaauuagccacacaugguagugcaugcuuguggucccagccacucaggcagcuaaggugggaggaucaccugagcucagaaagucaaggcugcaguaggcugaaaucaugccacugcacuccagccugggcggccagcagagugagagagaaccugucaaaaauuagggggaaaaagugaaguaaacauuuuuauaagcauauuugcuuuucuguuuguuuuucagugguucuuuaucaccucacuauuuaagcucuguaaucaagcagaaccaggugcgaaaccucaaagguaugugugaauaucaguacagucaugcaccacacaacaaucuuuuggucaacaacaggcagugcauaacaauggugguccccuaagauuauaauggagcugaaaaauuucuauugccuggugcccugguagcuuguuguaacauuguggcacaacgcauuuacugaaguuuguggugaugcuggugcaagcggacucacugcacugcuaguccuguaaaaguauagcacguaguuauguacauauguuaauacuugauaaugguaauaaacuaugucacuaguuuauguauuuacuauacuuuuuacuguuauuuuugaguauacuccuuccaccaauuaaaaaaaguuaacuguaaaagagccucacacagguccuuuaggagguauucuagaaggcauuguuacaguaagaugacagcucucuguguuuauugucccuaaagaccuuccagugggacaaaaauguagaggcagaagacagugauauugaucuugacccuguguaugcucagguuaauguguguauuuguaucuuuguuuuuaacuaaaaaguuuaaaaaaaguuaauuuaaaaauagaaaaaagcuuauagguuauaaauaaaauauuuuuauacagcuguauuauguauuuuaugcuguuauuacaaaagaguaaaaauuuaaaaaauuaaaaaguuuauaaaguaaaaguuuacaguaaacuaagguuaauguauuauugaagaaagaaaaaauuaaaaaaucaauuuagugcagccuaaguguacacuguuuauaaagucuacaguaguguacaguaauauccuaggccucuacauucacucaccacuaacacucucuggcucacccagagcaauuccgguccuucaagcuucauucaugguaaguacccuauacagguguaccauuuuaaauauuuguauaguguuuuuauuguacccccuuuuuuguucccuggcagaaacuaauagaucauuuacuguaccuuuucuguguuuagauacacaaauaccauuugugauacaauuaccuauaguauucaguacaguaacaugguguacagauuuguagcucaggagcaauccuagguguguaguaggcuauaccauuuagguuuaagcacacucuaugauguucacacagugacaaaaucaccuaacaguacauuucucagaacauauucccgucauuaaacaaaguaugacugcauuuuuauuuauuuguuuuauuuuuaagagauggcgucuugccauguugcccacacugaucuucugaaugccugggcucaagugaucuccuaccucagcuucccaaauaggugggacuacaggugcacaugacuguauuuuaauucauaaaaaauucagauaaaaauuugggauauuuuguuguugcuguuuaacauuuuucuauuuuaacaaguauuauguauuuauuauaggaaauuugggcaauaaaaacauuuauuaaagagaaaguaaagucauuuaucccauuguuaauauuuuauuuuuauuuauuuauuuauuuauuugagacagguucucacucugucacccaggccagagggcaauggcacagucaugacucaccauagccucacaauccugggcuuaagccaucuucccaccuuagccucccaaguagcuaggacuacaggugccauuacaccuggcuaauuuuguuguuaacauuuugauauaauuccuuugggguuuuuuuaaugccacauaugugaauagauacacuugcaugcguguauguacagggacacauacauaaacacacacauacuuuuucuccagauacuagauucacacuguguauacaguuuuauaucccuuuuccauuuauuuuuauggguauuuuucauugaaaauaggauugaauuuuuuaguaauaucaguagaguuauuaccuuuucaggucuaucuuagacuagaaaagggguuggcaaacuauggcccauggccauuucuggccugacaucuguuuuugggugucccaugagcuaaggaugguuuuacauuuguaaaaugguuggagaaaacaaaaucaaauaacaauaaaauuucaagacugugaaaauucauugcaacagagaccuacauauuauauccuggguuuugccucuuagcaugcaaagccuaaaauauuuaccuucugacccuuuacugaagaaguuugucaucccucaaauuagaauaugcuugaagauauuucuccuguagguuauuuaaucugaagaacuuuaauuuuaaaagauaauaaguugacuuuuuaaaaguauaucaaaauucugaauuaguggguuuuuuucuuguagauuaguaguauauuaaaaucaguuuuccuagcguugcuuuggagccuggagacauuuucauaaccuuuaaaaauagaaaauuucagaugaaaaccuuucuguguaucagaaauauuuuggcucuuuggaacuauacuaaacugagccucagaagcagugugcugauaucuuuaaaaauaaaggaggaaaagaauaugaaaaaguucuagagaacccugcaaagaaguuaaauggauaggggaucuguuucaaauaauguucugccuuaacauaagacaaauauccguguuccuguuaccuacaucagucaaaugugguuucucuuuacauuuagguauugccaaaaugccuuuaucuuuguauugccucaauaaagucugacacuuauucucuaaagcucaguucguauacauaucuugagaacauuuucuuugugaauucuggaguuuacuuaaaucuuuucuugcucuuguucuguucuauccaaauucuuucuuucuuuggggaacagacauuuccacaaguuuuugcugcuaguuucaccugcauguuuuucauuuacuagggcacagguacuucuucuucaucuaaugacuuguacguauuaugcaucaucugucuagugcuaccagcaccuuaccuccauuccuauaugcaugagucuuaggccuguuccucuaguaauaauuaacuuaguggggaggucguuggcauucuagguuaaaacaaaugcacaucuguccuggaauauaauacaaaauucuccaugaauuuuaagggaagaaaacauaaaaccucacaaaaauuuagggaauuuuauuuuugaacuugguuguuuugggguauauuucugaggaaauuuucucuugccucuuuauauuauuucuagagagaaguuuaaaaaacaccaaguggauuagacauucauuacaacuaauacuguugagccagacuccuugugccagacacuguuggagguuccuugggauaugcauagaugagagacccaggcccugcucuuagaaaauauauacuuuggcugggcacaguggcucacgccuauaaucccagcacuuugggaggccgagguagguggaucacaugagaucaagaguucaagaccagccuggccaacauggugaaaccccaucucuacuaaaaauacaaaaauuagcuggguguguguuggcacacgccuguaauuccagcuacucaggaggcugaggcaggagaaucacuugaacuugggagguggagauugcagugagccgagaucgcgccacugcacuccagccuaggugacagagugagacuccaaaaaaaaaaaaaaaaaaugauggagaacaccugauuaucaacgauuuguccaagguacaaccucaaacuuuguggaacaaaaguucucccuggcagagagaaucauaacaauagagagaguugucuggcaguugcuaggaaucugucuggcauguugauauagaccagguagauguggucauuugcgugggcaaggcaaauguagcagaaguuuaagagcuuauuuagcauaauaaggacuuugaacauccuccucugccuagaacaauuaauaagccuuaaguugcuuacuugaugcuuugcaugcauuaucuaauuuaauccuuaaaacaacccucugagguauugcugccccucuuuuacagauaagcaaacugaaguuuggggagauuaaguaacuucucaaggucacacaacuaguaaguggcaaagaaggauucagauugaauaauucuaauuucaaagccugacuccuacuagauaaguggcacugggagaccugcugaagaacuuuaaauagugaagugacaucgucaguuuuauguuuuauaaagaucacuuagguauuaucauuggccuccaauauuaaaacuuacauauucaucuaacacuucauagaaucaucuuuacugaucauuauauuagagcuaccuuuagacacggaaaacuaaagggagagauuaggcuuagaacuccagaaacuguuaucagccuaaacaggugcagcaguguguuuguugucucuugaucaacuuacaaugacuuuuaugugacaguaucaauguuauggcauuguauaauagauagcaggagacacaggauucuuacacugagauagcagaacgaaauuuuuuuuggucaauaguuugguuugguguguauuuagaguaaauucaccuguuuaaaaauauuacugagcuguucuagacaccaagguacaucagugaaaaaagcagacaaaaauggaacucacauuccaguuaguaaauuuuaguaguuauacuaacugcuaaaagcaccugguauacuacaaacagauauaaaauuaagguaguugauggugauguuagggcuacauguaaagcuaagauuugugucuuacugaaaugaaacuaaaccagugguccagacagcuuaaaguguugguaauuuauugaaacuauucuucuacuucagagaauuacaagagacagcuucuccaucuggaugcucugcaaauguauauauuaguuuugauagagacaauaaauccuuuuguaauuacuacaaagcuuauaccauuugaauuauuucuauaguucucauaucauuccuuacacaaauggacugagagucaaacaacagaaauaugcucgacuuauaaccuuacucucauauggcuaaaacuagugucugaauuguuuuuaauuauuuuuaaucauuucccaacaucaagguuaaggaaauaaaaaccaacaggcacaaauuaacaaguuuuuuaaauuguuguuuauuuuuuguuuuuugaaauggugucucgcucugucaaccaggcuggaagugcaguggcacgaucuucgcucacuguaaccuccaccuccuggguucaagugauucuccugccucagccucccaaguagcugggauugcagacgcguaugaccucacccggcuaauuuuuguauuuuuaguagagacggguuucaccauauuggccaggcuggucucgagcuccugaccucaagugauccacccaccucggccucccaaagugcugggauuacaggugugagccaccacgcuuagccaaauucaugguguugacacgguuuuguuugaaccaguuaugaaaucaguagcauguuugaaacuaucaaauuuugguuccuuuugaacuggauauguuagauaauacagcuaauaguguuauuguuuuuaaaaacagagccaccuuuaaaauagaauaaaguacuuuaucaaugaaaaaauaccauuaugaaguauuuucaaaugugacaauaaacaaaugagucuucaguuuaaauuucauagcaaaauuggcugaacgcggugguucaugcucguaaucccagcacuuugggaggccgagauggaucccucaggaguucaagaccagccugggcaacauggugaaaccccaucucuagggcaacauggugaaaccccaucucuaccaaaaauaugaaaauuagccgggcguggugguacacaccugugguuccagcuacacgagaggcugaggugggcagaucacuugaaccugggaggugaagguugcagugagccaugauugcaccauugcacuccagcuuggacaacggagugagacccuguugauaaauaacgaacgaaucaacgaaaauagauuggguacuauaauuaaaaauuguaauuucuacccagagaauuuuuauugcuuuuguuccacaaaguucaagacuguaccuuggacaaaucauugauaaucagguguucucuauuaugauggugauuuggaucauucauugcuuauuuuuaauguugaaguuaaacuuuuuuucacaguuaauuggcaaggcauugcaggaagcacacuuauaaauguuuuaaacaaauaagauacaggcaaaauccuuuugcaaagaaguguuugguuucacaaaguuaauuucauguuggagauuucaaauuaauuuggcuauaaguuaucuaccauaaauaaaucuauuuaagguguauuuuuccuaccauucuacuguuauagaaacaguacuuaauuuguuaacacuuuacaauauucagaaaugguauucauguagcuuucuuauguuaucaggauaagccucuuaccaguuuuagguguuguguuucaaaauaauguuccuugaaucauaauggauguuuguuaaaagaagugaaguuaggccaggcgggggucucacgccuguaaucccagcacuuugggaggccaaggcggguggaucaucugaggucaggaguucaagaccagccugaccaacaugaugaaaccccaucucuacuaaaaauacaaaaauuagcugacugugguugcgagugccuguaaucccagcuacucaggaggcugaggcaguagaaucacuugaacccaggaggcagagguggcaguaagcugagauggugccauugcacuccagccuggacgacaagagugaaacuccaucucaaaaaaaagaagucaaguuagagauauacuaauuuuuuaguaaguauauuuuauaggugcuucauuuauaagauaaaguuucuguaauugguuucucauuauaaugcauuuucuuguuagauuauuuuaccgucaccuuccucuuuuauaaaauuagaaacaagguagauccuuuuuauuaaaaagaaaauuuaggcugggcacgguggcucacaccuguaaucccagcacuuugggagccugaggcgggaggaucacuugagcucaggcaacacgguaaaaccauaucucuacaaaaaauaaaaauaaaaaugagccaggugcggugguacaugccuguggucccagcuacuugggaagcuaagguugaaggaucguuugagccugggagguugaggcuacagugagccauaauugugucacuacacuccagccugagugacagagggagaccuuguaucucaaaaaaagaaaagaaaaaaaaaaagaaaaauuaguuuauggagaaguaaucucucuguuggggcuuuugcauaaugccaugcaaguugugcccucugcaaguccaccuggcuuaaggcagugaguggggccugaaauucagcccacauuccauucgucuagcugugugccuugaauagggaaccauucaccuggaggaagauuugccuuuuuuccaacucacacagagacacaauaugggcuagcggcugcaacuuuucuucuucagacguguuagaauacugaacucaaaaagaauugccucaggcuucauccuaaaagacaggaauuggagaggucauuguuuuugcuagccucuuggauguggcaugugggcaucauugauucaaauccuuuguacuugcucuucuuucugcccaguacucuuuucccucagauaucauucuuucucucccugaggucuuugcccaacuguagccuaccuucuccuucaggauuucucugaccucuauauuuaaaauuguaaccacuuuccccaacacucuauuucccuuuccucuuaauuuuuuuaaauuucuugaccauuuguaugucuucuuuugagcaaugucuguucugaucauuugcccauuuuuaaauuagaggauuuugguuuguuuguuuuccuguugagaugcuugaguuccuuuuauauuguagauguuaauccccugucagaugaguaguuugcauauauuuuauucauucuguagguugucauuucacuguuguuucuuuccugugcagaagcuuuuuaguuugauauaauuacguuuauuuuugcuuuuguuaccuauguuuuugaggucucauucauaaaaucuuuucccagaccaauguccugaaguguuucaucuuuguuuucuccugguaguuuuaucguuucaguucuuacauuuaggucuuugauccauuuugagcugauuuuuguauagggugacaagugggagucucguuucauucuucugccuguagauauauauccaauuucuuuuguaucauuuauugaagaaacugucuuucccccaguuaguauucuuggcaccuuugucaaaaaucaguccacuggcggaggggguggggcgcgguggcucaugccuauaaucccaggacuuugggaggccgaggcaggcagaucacuugaggccaggaguuugagaccagccuggccaacauggugaaauuccaucucuacuaaaaacacaaaaauuagcugagugugguggcacgccucuguaauccuagcuguucaggagacugagcacaagaaucgcuugaaccugggagauggagguugcagugacccgagaacacuccucugccuuccagccuggguggcagggcaagacugucuccaaaaaaaaaaauaguuggcuguaaauaugucaauuaauguccagguucucuauucuguuccauuggucuaugugucuuauuuuuaugccaguaccuugcuuuuuugguuacuacagcuuuguaguauauuuugaggucuguuuguauuuugccuccaguuuuguucuuuuugcucaagauucuuuugccuauuuggggucuuuuguaguuccauacaacuuucaggauuauuuuauauuuccgugaaggauaucauugguauuuugauagaauuuauagauugcuuuggagguaguauugucauuuuaacaauacuaauuuuuccuauccaugaguaugggaugucuguuuguauugucuucaauuuuuuuguagguauuuuaauuuuauuuuuuguagcuauugugaaugagauugccaucuugauuucuuuuucagcuaguuuguuguuuuguguguagagauauuacugacuuuuguguauuaauuuuguaucuugcaacuuuacugacuaucaguucuaagaguuuuuugguagaaucuuuaguuuuuucuauauauaagaucauguugucugcaaacagggacguuugacuuccucucuuccaacauagaugccuuuuauuucuuucucuuaccuaauugcucuggcuagggcuuccaguacuauguugacuaagaguggugcaagugagcauccuuuucuuguuucaguucuuaggggaaacgcuuucagcuuuuccccauucaguaagauauuagcuguggaucaugaggucacauuuuacuuggggaaaaagagguaaaguauuaugugcuguuucauaguggccagcaucugauuuacuuaagccuguuaguguuaucaauaacaacagcauuuccuaccuuaagagaguuuauggucuaguuggagagaaaacaagucauuaucuucauggcuuuauuaucuacaauaacuuuuaaauuagacauugaaaguaaauaggaaaucuuuaugguaauaaaaauuuccaccuuugagauauagauuagaaauuucauaucugagucuuauuuuaaaugucuuuuuguaagcuaaaauuuauaaacauuuucuaacuuuucuaauuauuaaugguguaauuuagauuauaccauuuuacuuuucuuuaguuauucagacuaguauaucaccaagaugaagaacuuacagcaguaaauauaaguagguaugagagcauaacuuuaucuguuguagaaccugcugauuuugccagucuuuuaaagcccauuuuuaauggaguauccauuugacuucaugaauauuauauaaauuugucguacauguaggcuuguguauaaucaugacuaaaaacaauaauaauuauuuuuguuucugcauaauuauucacuuagcauuuauagguuuacaugaccuagacugacgaauuacauauuuuuaucuccuguaacuggcauguaauuaacauaguacuucauaacugcagauaugcauagguaaugauaguauucaaguaaaaaugcaaaaaaaaaaaaaaggaguaacgauguacauucuuagcuaauuuaaucuguuuaaggggaaaccuuacugaaauacaguuuaaguuuucguuuucauugugaauaauuaaagaagagaacuugcauuauuucugguaucucuccaucucuuuuacacuguauuguucacaaaacuguuucgugauuuuaagugaacaaaaucagacuucagaauaauauauaauaucucauuuuuguuugaugugcguuuaugcuuucuuagaauauacaccaaaauuguaacgcugguuaucuucaggggcaugcaaauacuuagaauagccucuccuuuauaaagaacauuaauauuauuacuuuuucccuuuucagaaucugauauugaugcugcugcugcaaugaugcuuuuaaauacuucuauagaacaaggaauuuuagaauguaaguaaucaugccuuuuuuaaaaaaaaauuuuagugccuuuucaaauuuaaccuagacuauaaaauaacuauuacagacaaaaauuacuucuuuccaaccaaauuguauuuugaucugaguaacucaguuucuguuuuauuauacuuucauuaauuuaugugagcaauugagagauugaaguuaaugcuucgauuuuucuuacauugaccaagaaaugaagaaaaauauauuuagaaaaugaacucaaagagcuaaaaguaaaaaugaaaacuauaaacaagaaaauauaauaaguaaaguauauuuaugaacuuggacuaggaaaagcuuucuuuaagauacaaaaugcaaaauccaugaaggaaaaaaauggguaaauuuaauaaaacaucaaaauuuuagcauucuggucaggcaugguggcucacgucuguaauccuagcacuuuugggagaacaaggcagguggaucacuugagaccaggaguuccagaucagccugggcaacauggcaaaacuccaucucuacaagaaauacaaaaauuagccagaugugguggugcaugccuguagucccagcuacucaggaggcugaggugggagaauugcuugaaccugggagguggggguugcagugagccaugagcacugcagugagcuggagagcacugcacuccagucugagggacagagugagacucugucuccaaaaaaaaaaaagcauucugacaacaaaauauaucuaagaaaagugacauaaaaugcuggagacauguuuuuuccauauauaacaaaggauuaguaucaaguauauacauaaaaaggauucugcaaguaagaaauaagaaaacaguucaaccggaaagucagcaaaauauaugacuagguggaucuuagaagaggaaauauaugugggcaauacacaugugaaaagauguguaacuucgcuagaaauucgggaaacacaaaaugaaauaauauugagguaacuuuuuuguccauaaaauuauaaaaaauuuaaguaauugagaaugguguuaaguagggaguaaguuuugucauacacuguugggaguaaauugguacaaccacuuuggagggcaauuugagaauaccaauuauaauuuuaaauguauauaucccuuagcaauuuuuucauaucucuuuuuaaaaauuacuugcauauauucaagaaaaggcauccagaaggauuuguauugcagcaugauuuauacuaaugaaaaauuggaaacagccuaaauauuaacacggaagugauuagcuaaacagugguacauucauauugaggcauuccuuguaagcaauucaaaauaguuacauaugcuauagaaaagucaagacauuguuaaaugguuuuuaaauguuucaaauuaaugcuugcaaaaugaugugaucuggguaaaaaaaaauaaaaaaucuacaaagcaucaugaaucuaaaacauuuguugcucaagaguaauguaguaguuuaaaauuggucuguuuuugcaaccaaacacauuugaccuauugauggaacuuuuauuuuccacaggugagaagccucuuccucuuaaaacagcauugcaaaaaaagaggaguuacggcaaugcauuucaucaucccagugcuguacgauuacaagagagugauucuuuagccaccagcauugauccaaaagaagaucacaauuacagugcaaguagcauggcagcacagcguugugcauccaggucuagcgugucuucccugucuucuguggaugagguauaugaauuuaucccaaagaauagucacgugggaagugauggcagugaaggauuucacagugaagaagauacagacguugauuaugaagaugauccucuuggagacaguggcuaugcaucacagccuugugcaaaaaucucugaaaaagggcagucaggcaaaaagaugcgaaaacagacaugucaagaaauugaugaggagcucaaagaggcagcuggaucucugcuccaccuugcuggaauucguacauguuuagguucccuaauaaguacugcaaagacacaaaaucaaaagcaacggaaaaaauagaaauacuuaaaguguggcaauacucuuucacuuaauucuuuacaagggauaucaaagccauaauggacuucauuaguuuuaggguagggaagggauacuaauuacuuauuucuuucaaaacauuuuugguuuuugguuuuuaaaauuuuuauuaaacaauugcuguuaggaucaugccugaucagaaauacaugaugugaaguccuaaaagcauaauuuuugugauaaauguguccaagauuugaaaauuuuuauauaagaaaauccccagccucugucuuaaacuugugggacaaaaauccuuucuucuguuaauaugucagaauguaagauuuggcaacucgauaaauuuuuuucauuuucuuuuccaaucuguaacuauaguuacugaaccagcuaaaaauuuugcugauguauuuuucauauacuucucuccugacacgcaauccgguaacauaagauugaaauuuuuuuacuuugucuuaauuuguuucuaauuuuuuuuuuguugucgugugagcaaagacaaacauaaauugaaaaacauccugauguuuagaaaguuucuuuugguuacguagguagagaauacaacaaagaguucuaagacuuagaaaagacaauuuuguggugucauuucauccaagaacacucccaauuccuauuagaaugguagcuuugaaguguuuuuacuucagagauccugcauagcauuuauuggggccuuuuauucuuucccaaagugcuuugcaaacauuaaguuuuagccacuagcugccuuuguugaguauaaguuauccagugagaggauauagccaauuaaguguguuauggaguacacccauuuugacacacuuguaauaagagaaucuuucauuugccugccauguguacuguauuaugagaaucuuauaaucggaauggagugaaaugaaacauuuugaguacugauggcauguuaucauacauaaaguaggucauuuaggaaaaaacuucuguccaagcuuuguaugaauuaaauucauaaguauaccaaauuaaaucuuaauagauuuaaugcaauuuuacagacacaauaccuucaugaauuucaaaauucauauaaaauuugaucuuaugcaauacaccuuuuugaggaggcaguguaacaaccuauagugccauugauccaugagaaaaagauuuucugguacuacuccaaaagugcuuugacuaaguaucuuaacuauuugaacagucugcuuauaugagacaguuuuucauaguaucauuuguauaauuugauuagauuauucagaaacaauaggaugcuaaacuaauucauuguaucuuuuuuuuacaaugguggaagcaacuuucugaaaguucagucuuaugcuacauccuaagucauagacaaugaccuuguuuucauuauucugauagauuguauacauauguacacauacauauacacauaugcacagucaaggucaugauguugauuugcuuucagcuguuucugugauuauaaagcauuuuuuaagagacaaauuuuaacuuuuaauuuuuauuuuggcaaaacugucaaaugagaaaaaugauuuuaaaaacuuuuuuuucaauugacaagacuuuaagucagggauaacaguauuaauguucucuguucuguuuccauguuaaauuuaauuuaaccuggauagccacauuaaugaauuggugcugucaaaauauaguaauuuuuaaauuuguuaauaaugaaaacccuuaagcaugcaggaugagguauuuggguuuuuuuuuuagaucgaucacaucuacagaaaauggcuaaaccaaguuaacuuuuauuauagacagugaauaaaacaccaaaaacccaaaaaugcuuuaaccacaguauaaauaauagauuauacacaucaucuuaauaacuauuuuuaaguuauuuaccauagccucuguauagaccuuaggaacaguguuucagugaucuggcaccaguuuauuuuguucugcugaaauucuguaucacaaaugugcuaccugguuuuuguccauuagauaauuacucuuuauaaggaaaggaaagagaagcagaguuaguuccagcucuaauagggaucuucaaaguuauuuugucuugauguauguaacaguaauucuuuacaucuuuugauuuuucucuuccuuuuuauucacucuucccacgaauuuaaauguuuaaguuauauucaucacuagcaaggaugauaaacacuugugcacugaaagcuaacagggagagguuacacaauauuuuacaguuucuuaaacauaauuuaaugcaucaccuuccacuugcuaacauaccaagucaguuauuuucaagggaagaaccuuuuaaauuaugguccuccauuuacuacuuccacugagaguaugcucucauuccucagguguuuugagaaacaugacuaauaaccacacaauuaaguagagucauuccaaguccuauggccuggaaauuguauucccuauaauauacaaauuuuccuguaauaaagucaacuuagaaacuccaaggagguuacauguuuuccaacauauccuaaaaacugugauauaagcuaacauauaauuugccuuacgucaaaagaauauguuuuguugcagcugauuccaguuuauaauagaucccuaguaaaaagcuuugauucaacacaauuguucaucuucacaucccaaacagaaucacuguuucuugaauauauauuuuugaaguuuuuuugugcaauauauuacuaaaucaguuauuauuuuacuuuuccaaauucagagaaagaaaacagauuaccugaauucauggaaaagguggaucaccucccuuuuuccaccuucaagccuuuccuguccucauagccagcaugacuucuuuuaacuuggauuccuuuguauauaguaaaguuuaguauauauauauuuuuuucuuuuugcuacuuucugaggcauuauguaaagggcucauacuagauguucaguuaaauauacuuuagcacaaagucaaacuagagaauguguuaaggagggaauguauaugucuugguagaccaggaggccuuugccagcaauuuaagcaacagaugugaauacuucacaaagcuguaaagaccauugucuuaaauacuacaacaacuuaacacccuuuugugaagaucacagcauuuaucuaagaaacugugaggcuuucugguuuacauauaucuuacagguguuuuuuuguauuuuuuuuuuuuuuuaguuugaaauguguaagcuuugauuuaaaccaaguuuacuucaguauguuaaugauguaguaaaaauauuuauugaaaggugaauucgaguauuuuaauguuauaccugccauuuuuuuucuuaaagcauauucuuugcaucuaacugccagugccauugucaaaacuuauuuuuuaaaucguuguacauuucuuauuaaacuaagugcuuaauuuuaaaguauuauguugccaucauauaguguauaaaaauguauaauugccaauugauuguaacuauuauuuauuuuuaaaugaaaguguaagaaugcuuucugauucaacaaauuuguuaucaaacuguuuccuuauccucuuuucugauguagcauaaaaauugucccgguuugaguuauaacugccaguagaugaccagucacaagugaaccacuucucaguugccaaucuuugcucauauuaaaaacaacuuacaaauacuuaguuuuuguaucuaaucucugauuauuaaaauguuuauaaaguuuauuuuuaccaaagagaugcaauucauuaugagaaaguauugcauaauaaauuuuguuuuauaacuuuu

SEQ ID NO: 192730 - RNA, 39538 nt, Homo sapiens
gaaaacgcgcugaccuuucagcuucgcgcuagugcuguuuuuuuuuuuuuuuuuuuuuuagcaauggcgguucccggcguggggcucuugacccguuugaaccugugugcccggagaagaacucgaguccagcggccuaucgucaggcuuuugaguugcccaggaacuguggccaaagaccuuaggagagacgagcagccuucagggagcguggagacaggugauggcgccgguuugcccuguaguuccgucccacagcgggcgaggagucugggaucacggggaaacacguggccuguggaaacggcuguggacccuuuggcaagaggguggggcuguguccuguccucuccucuccucugaucucuguaggggaacccagggucgccgccguugcugaggcagaagugagaugugugauguuuguuuggggcgacuccuguguacaguaauggaguuguuuagacuuccaugaaauucaggucaggaacccaguuugcuugcacuuuacaguuugacgaaauaguguucccaaugauaguaaugcuacacaccugagccagucgcugcaucguguacguauauuucugauuuugauacauuaaguuguugcuggaggccgaguuauauuguagccugaugaaucaagaggauucuugguuccuagacauaggguucugucuaugaaauguacugccguuuacuuuauucuuuuuggccauuuugaaccaaaucagucugguaacagauuuggauucacugcaacaggcuguugucccgcguucguucuacauuuauaugcuucuuuguguauugagaagccaguguuauugaaccucucuugugacucaagagcuuguguauucuauuuacaguucuuaaaacgaucuugcaagaaauguaucacuguguccauuuuacagauguagaaaaugguucaaagagguaaauaacuuaggcaaggucacuagcucaguuaauuuagacuucuagucaaauuauuaaacaaaauguauugacuucuacgauuccuuggagcuauuuuuucccuaaaauaagcuggugucuuuaucagacuguauaaaagacuuacauuggcaggcagugagaaaucuuuauguauuucauucaaauauugauuggauuguauuuaguggaagcuacuucuguugaacauuucuaaguaacgcugaaaauuugaguaaggauucugccaaaaaagcuauuguaauuuaacauuuguauggguguuuaaauuugagaguauguucauaugcucuuugauauaugaaacaacccuguagcguagguguggaaggaaauaacuguuacuccauuuuauagaugagggaacaggguaguccaaggguagcuugaguaguucaagcuaaacucagcuauucgguggcaaaaauuaaaaaacccacuguuuuuuuuuuuucuuuuucgggacgaagucuugcucugucacccaggcuggagugcaauggcacgaucuuggcucacggcaaccuuggccucccggguuuaagugauucuccugccucagccucccgaguagcugggauuacaggcacguggcaccacgccuggcuaauuuuuguguuauuaguagagaugggguuucaccauguuggccaggcugaucuugaacuccagacucaggugaucugccugccuuggccucccaaagugcugggauuacaggcgugagccaccgcgcccagccaguaaaacucacuucuaauuccaagacuauacucuucauuuacuguagcuuugcuauuuuucuuuuuuaaggaaauguuucauuuugugucauuagaauaauacgacuaaauauucagggauucuugcaggaaauaacaaaauccucauuuggaugucuuuaccauuuuaaagaaggacaguuaaguacaccuuauacucaccuagaagcaugugauuuuauaauuggaaggaacuugagaaauauccaauucaguuuuucauucagugugaggauucauuaccaguuuauagcaauaaggaacauuguugcauaaaucagucaauuccauuuuuggucagccucuaaugguugaaaaauauuuauagugagcuaaaaucuguuaauuucccauuuccagguuggucuuaguuuugacauagguuucauguuaguaguggaaagagcuguaguagaaagacaauaagaguacaugguguauuauucgggauucuuucugauacagguaacagaaacuaacucaaaauagcuuaaguagaaaagggagacuauaccaaucuguguaaccaaacuccagaaagagacauauaucauacuuuaaggucaauugguuugacguggucagugugagauauuuucauuuuccuuagcuguuuuuugguggccuuauaaucuugggcucuucuacaugggauguugaugaugggggugauggucaccagcagcuccacguucacaugcuugcggcuuccgauugaucacaugcccacccuuuggaugaagaggagguguccaaaauagucugauaaucccuaucucauggggugggggauaagugugacaguuccaccacaaccacauagagugguuuuuuacuagcaggggugugcuguuaccagaacuguuaccugaacagguuuagcuguuguuuggaugccagcagccaaaccaacaacagcuaaacugcaggaggcuacccagcuuauuagguauuugacuuugggcaguuuuuuucaccugcagugauaccuacccugucuaucuuaaaagguuauugugaauuucagaagaguguguaugugacagugcuuggaaaacuauuaagagaaggugcuauauuauguuuaaagccagugcucagcucucagauucuuacaguuuuuuuuuuccaggcuguaaauccucucuuuaucuguaguaauuguauauuagaguuucuagacuuuuuguuauuccucucuggaugcucucuggcuuaucuauuauguccagaguagaacauguacuccauauguggccugauuaguaaguaccaaagaaguguuauuaccccuuaaauuuggauuuuuaaaaacguuugucucaauaaggccugaaguucuuuauaugaauucauucucuuccuauccucaauccagaaguuaagacauuccuaugaugcaucagacuuucaggccucuuuuauaaaacugcuagguuaauuuuucccccauuacgugcaugcaucuuuauuuuguuuuuaauucuaaauacaggauaguauucugucuuuuuuuuuuuuuuuuucuuuugagaaggagucucucagucacccaggcuggaguucaguggcgcuaucucggcucagugcaaccucugccuucuagcgauucuccugccucagccucuugaguaccugggauuacaggcacgcguuaccacacuugguuaauuuuuuguauuuuuaguagagaugggauuucacuauguuggccaggcugguuuggaacuucugaccucaagugauccacccucccugaccucccaaagugcugggauuacaggcaugagccacugcaccuggccuauucagucauuucuuaauguuaguuugugcuuaccauauuguauuaucaagaccauugcacauuucaaucugucauaaaauauuagcacuuauuaguucuuccuuuuaauuuguuauagauuugauaaaccuuuggugaggcaauaaauuaccucaacuuucuguucccgccuucacaacuuugucaucgugucuacaucauucuuaaccuacuguuguuuacggcuuuagauucuaccuuuuucaucuucucaagcacauugcuccauuuuuuuuaaucaaacuuuucuaucucauucucaaauguaaucccugcucuuugccagcaguccaccugcagggauauauuugcauaaaugugcaaagacauugcauacagaugacauugcagcauuguuuguaauagugaaaaaaugguaaaccaccuaaauauuuaucaauagagauuuggcuaaacuaugauaaauacauauuuaagaguauauacuuuuuaaaagaaauaaaguaaauguguaucuucugauacgggaaaauguccccaauauauuaaauaucuuacagcauguuacagaauauauaguaagauuucaguaaauuucaguuguguaaaagauguguaucuauggauacaaguguauauguuuacauauaccuugaaaaugucugaaaagguaaguaccacaacuuaaugguuggcuguuaggguaagaggacugggagaggacuuaugcuucuaccugagaaaauucuacacuguuugggccgggcgccauggcucacgcuuguaaucccggcacuuugggaggccgaggcaggaggaucaccugaggucaggaguucaagagcagccggaccaacauggugaaacuccuucucuacuaaaaauauaaaaauuagccuggcgcaguggcagguccuguaaucccagccacucgggaggcugaggcaggagaauugcuugaacccuggagguggagauugcggugagccgagaucacaccacugcacuccagccugggcaauagagugagacucugucuggaaaauaaaaaagaaaauucuaugcuguuugacuuuacuuuuacaauacgcaguuggacaucaguuuagacucaguaaaaaucagagacgaguguguagguggcauucacaacugaaaaggugguaagguggucuaggcagagccuguagcauaagagaaggaaauaaggaccacuuggaggaaggacaguugguagacugagaucuaauugaaaagaauagccucugcccucaauauggaagaaaguauucuuccauauuguuaaauaaauauaacacuaugaauuacauuccuucauaguuguuaaaguaagguaauacagagguggaagagauucugccauggagagucagaagucuucacagaccugagcaagauuuggagggugaaugggaguuugccagacagaaaaugagaagguagacauuccaaccagaaggaagaagacauagauaguucauagcaugugauaguauuguguguguagaguaccauaugugaaaaguacaacagaaagaaaugguauaagugacaugaaagaggggagaugggacauggugcaagcacuuuauacccaugcuauggaguugagaugugauccuaaaggcaguggggaaaccauuaaaggauuuaagcagguaagccaaagaauaagacuuaaaaaaaaaagaccauuuuauaaagaacacuuuggcaguuauguggaggauagcuugagaaaaacaaaacuagggugaaugagacuaguuuaggagucagauuauugugauacaggccugaaauaagagauugauguuaaagaauugucauugggaauggaggcgaaggcacauaguuaaaagcuguauuuucaggcuuggcgugguggcgucaugccuguaauuucagcacuuugggaguccaaggagggaggacugcuugaggucagcaguucaagaccagccugaccaacguagugaaaccccaucucuacuaaacauacaaaaauuagcugggcgugguggcgcacgccuguaauaccggcuacuggggagguugaggcaugagaaucgcuugaaccugggaggcggagauugcagugagcugggguugugccacugcacuccagccugggugacagagggagaccuugucucuuuaaaaaaaaaaagaaaaaagauaguaagauaguggguuuggaguauuuccuugauccaucaguuucauagccuuuuggaagaaaaugaggcuaaaagcuucugcugauuucuauacaucauuuacauuuucuguucuauuuaauuucuuuggaauuuuaagauuuuuuuuuuuuuuuugagacagucucccucugucacucaggcuggagugcaauggugcaaucucggaucacugcaaccuccuggguugaagugauucuccuaccucagccucccaaguaaccgggacugcagacacacgacaccacgccuggcuaauuugggcaggcuggucucaaacuccuggccucaggugauccgcccaccuccgucucccaaagugcugggauuacaggugugagccaccgcgucuggccuuguuaaggguauugauaucagacuuggugguuuaugaucucuagagucuaccauuccagacuuuuuaaagaaacaccuuaaacuacuuaacuggaaguuaaaaucuugggggaaaaaaauuaguuguuaacauucagguuugugcuuuaauacucucuuagaacuugaauaauuuuuuucucucuauacuuaguucauuuguugaccuucccauuguggcuaguggguuauuaauauuuaauucuucacugucacaauucuugucuugauucccugugauuguaaaacuccuagccucuuucuuuccuuaguaaaauuaucagggagcucuucaugggcaguaacgagguuuuaaauucuuugauuucccugauacagagcgcaugauaguugguaacucacuguuaauuguuugagccagaucaagacccuugagaaagaaaaaugccuuaauagcuuaugucaaaacaccgaauuuccaaacucauugucucauuacacucaggcuuguaauaauuucuuuuaggcuuuggaauguuacaauuugcacaauuuugugugugcauauuuguacaaguauuaaauaagugauuuuaguuuccugguuuuuuuuuuuuuuuuuguggaacuccguuuucagcacuuugcaucaagcauaguaaaucaaaacagagaaagugggcaguuuuaauaguagucaugggagaguagucaaacgaacacugaaagugcaguaauuccaccucauccauguuuucacuguccacaguuucgguuccucacagucaacugugguccacaaauaggugagcacaguacaauaugauauuuugagagagagagagaccacauucauauaacuuuuauuacaguauauuagaauuguucuauuucauuauuaguuguuguuaaucucugucucuuuuuuuugagacagagucucgcucuguugcccaggauggagugcaguggugcaaucucagcucacugcaacgucugccaccugguuucaagugauucuccuguuucagccucccaaguagcugggacuacaggcgcgcgccaccaugccuggcuaauuuuuguauuuuuaguacagaugagguuucaccauggucaggcugaucucgaacuccuggccucaggugauccacccaccucagccucccaaaguucugguauuacaggcaugagccaccaagcccggcccguuguuauuaaucucuuacugugccuaauuuauaaauuaagccuuaucauagcaauguauguguaggauaaaacauuguauauauagggcuugguaauaucugagguuuuaagcauuuacaggcaucuuggaucauaaccccuguggguaauggggagacuacuguaguauaguuuaacccuuauaaaggaagagaaaaaauagauuaggugaaguugguuuuagucauauaugaagucuuuaaacaccuuaucaaaauauuuuuaaaauuuugugugugugcgugugguggaaauguuuuugucucguucauaggcuuugaagacaagauucccaaaaggagauucucugagaugcaaaaugaaagacgagaacaggcacagcggacuguuuuaauacauugcccagagaaaaucagugaaaacaaguuucuuaaauauuuaucccaauuuggaccuauuaauaaucauuucuucuaugaaagcuuuguaaguauuugaaaaacaaucuaacuuaacguuuaugcuuuucaaggguggaggucuccauuaguuguuuuuugcuguugcuuuuugcaauaugguagguagguucucuuugauauacugcaucuucuuuaucuagauuucuuuaaugaguuuuguuuuugauaugggauucuuauagcgguauuuuaggauuauaagucauuuaugacugauuucauuauuugaaugcuuaauuuuauuuuuuaagagacgggguccaacuauguggccuaugcuggagugcaguggcuguuggcagguacgaucauauugcacuacagccucgacuccuaggcucgggugauccuucugccucuggaguagcugggacuacaguccugcaccaccacacccagcuugaauacuuuagauagucucuuuaacuugcggaugaaggccagugggaggggaucuuuguuuugccuuuggauuuuucugcuucaucauucuuuucagucuuuucagcuucucuuaacuaacauuguuuuaagguuccguuucuuuuuuuuugacauggagucucacucuguugcccaggcuggagugcaguggcaugaucuugggucauugcaaccuccgucucuuggguucaagcgauucuccugccucagccuuccaaguagcuggacuuacagacaccugccaccacgccuggcuaauuuuuguauuuuuaguagaggcgagguuucaccauguuggccaggcuggucuugaacucuugaccucaggugaucugcccaccuccaugucccaaagugcugggauuacaagcgugagccacugcgcccggcccaguguuccuuuucuucaucuacuuaaauugaauaaaauuaaugcuauguuagaaucauaucauuuguaaauuuuaaagacuugauauuuuguagcauuaugauaauuguuuuaauauaugagcuaaaauaguauguuagauauaucgugaaauguguucuguuuuuucuuauguuuuugguauagggucucuaugcugucguagaauuuugccaaaaggaaagcauagguucacugcagaaugggacucauacuccaagcacggccauggagacugcaauuccauucagaucacguuucuucaaucugaaguugaaaaaccagacuucugaacggucacgcguacggucaaguaaucaguugccacguucaaacaagcagcuuuuugaauuacuuuguuaugcagaaaguguaaguuuuuagguguaccucaacuuuuagaacuauguauuuuuuuaugaacaauaaagauuccuguaaaauguucaagcuacauuauuguuuaauggguauagaucuucaguuuuacaaggugaaaagaguuacggagaugaaucguggugguggaugcauaaugagaugaaggaaaguuuuuuucuauuucuagcuuucuaagaaugucgucaugcucaacacauugaguagauguugaguuuugacauuugagaugguauugaugacuggcauauggucuugagauuguauaugguuccuaaugucuuuuucuuuccccuccuaaugucuuaacguagugaauuguagauucacuguagauuuccucaugucaagucauucuugcauucacagaauaaacccuacuuagucaagguguauuuacaaaaaugcauuauuacauuugucgugcuaauauuuuuauuacaauuuuaauaucucuauaaauaaaugggauugcuuuuaaaaauucaaacuacaggauauguugaaugaaaagugauaguaauccuugucugcuccuuccccgccaugccccauuuguacuuacagguaaccacauucuucugaaguuuucggccuuuugaacaguuuagguuuucuuucucuuuccagcauaaugacauaaaauuguacaugguuuucugucaauuuuaaaaugucuucuuucugauucucucucucuuuuuuuuuuuuuuuuuuugagauggagucucgcucuugcccaggcuggagugcaguggcaugaucuuggcuuacugcaacugcuccccgauucaagcaauucucaugccucagcugcccaaguagcugggacuacaggugugcaccaccacacccagcuaacuuuuguauuuuuaguagugacggaguuucgccacuuuggccaggcuggucucgaacuccugaccucaggugaugugcccacuucggccucccaaacugcugggauuauaggugugagccacuacgcccggcccaagauucugucucuucuguguucaaauauuguuuguauuugucuugguguuuuuuuguuuguuuguuuuuguuuuuguuuugagacggacucuugcucugucgcccaggcuggagugcaguggcgugaucucagcucacuucaagcuccaccuccuggguucacgccauucucuugccucagccucucaaguagcugggacuacaggcgcccaccaccaugcccggcuaauuuuuuguauuuuuauuagagacgggguuucacugaguuagccaggauggucucgaucuccugaccuugugauccgcccgccuuggccucccaaagugcugggauuauaggcgugagccacugcaccuggccugucuugguguuucuuacucagacuugccagaccuugcuagucuuuccaaagaaucaacucauggcuuuauuuaucaaaauauuauuuucaagguuuaauuuucuaauaagaaaauuuuugcuucuaaucuauuuccuuuacuuuuauuguuauuauuauuauuuugagacagaguuuugcucuuguugcccaggcuggagugcaauggccugaucguggcucacugcaaccuccgccucccagguucaagcgauucuccugccucagccucccaaguagcagggauuacaggcacgcgccaucacaccuggcuaauuuuuuguauuuuuaguagauuugggguuucaccacguuggccaggcuggucucuaacuccugaucucaugugaucugccugccuuggccucccaaagugcugggauuacaggcaugagccaccgagcccggccucuuuuauuauuuuugaguugaaugcuuaguucaguucaguucaguuauguuacguuauguuauguuauguuaauguuauguuguuauguuaauguuauguuguuauguuauguuauguuacguuauuuuuugagguggagucuugcucuguugcccaggcuggagugcaguggugcaaucucagcucacuguagcugcauacuccuggacucaagugacccaccucagccuucugaguagcugagacuacagaugcauuccaccaugcccagcuaguuuuuguauuuuuuuuuuugguagagucaggguuucaucacguugcccaggcuggucucacuccugagcucaagcgauccucccgccuuggccucccaguaguucacaggugugagccacugugcccagccaguugauauuuucaauguugguuucaaauaagagcauuugaaguuacgauuuuuuuucacuucagauacuccaguacacaauuucaguaugugaucauuuuaaugccagucuucuaguggauagacaggauuguuauucugagaaacugagaggucuugggccuucauuacuugaguauuucuaguuuuucuugcccuuuaacauuggucuuucaucccuuugaguuuaaaaugucuaacgugguuguuuuaaccucuucuggaguacuuuacuacuuucauuuucuuaaaacaauacuuuauacucaucgcuuacaaaguuuuaauucuagccaacuuucauuuugcuaguggcauuccucagagcuuuuuaaaaauuuuaaaauauuauauaauuuauuucuuuagugaaauagagacgagguccugcuguguugcuuaggcugaucucaaacuccuugccucauaugauccgccuuggccuuccaaaguauugagauuacaggcaugagccaccgcgccuggccuucucagugguuuuuaaagaguauuuuuuuuugagacggagucuuguucuuguugcccaggcuggagugcaauggugcgaucuuggcucaccacaaccucugccuccuggguucaagcgauucuccugccucagccuccugaguagcugggauuacagguaugcgccaccacgcccggcuuauuuuguauuuuuaguagagauuggguuucuccauguuggucaggcuggucgcgaaauuccggccucaggugauccaccugccuuggccucccaaaauguugggauuacaggcgugagccacugcgccaggcuuugcauauuucuaagguaggucuucaacgccaccaaaucuuugaaaguaaaaugguaacuuuuuaugcgaccuguacuuuuucucuauuuuguugguuuuguuucggcuagcuagauagacgaucagcugaacacucucuugaaggaguuccagcuaacagaggagaacacuaagcuccgauaucucaccuguucucuuauugaagacauggccgccgcguauuuuccagacugcauagucagacccuuuggcuccucagucaacacuuuugggaaguuaggaugugauuuggacauguuuuuggaucuagaugaaaccagaaaccucagcgcucacaagguaagucuauuucuuuugaccacuauaaucauguaaaguuaagaaaguauaaaaagaaaaaucuuugaacuuaauaaaauagaacuguugauuucuaaacuuauuaaacauugugguuaaagaauaagguguauuuguuauugauucuuuggugaagucuuucuuuguauuguucuacuaugugaucauuuuugugaauauucuguagauaugcaaucaaauaguuaauuguuuucaaguguucagaaauuuuucaguuaagucaaaguuaccuauuguguuauucaaauuauguaucuuaacuaauuuuuucuuuuuaaucuugugaucuaguuacugagauguuuuuacaucucaugauucuugguuuuguuaauuucucuuuaaaauucuuuugauuuuuguuuuauccaaaggcuauauuagcuacauauagguauacgaucaucauauuuccuuauuagauuguuuuauuauuauaucccucauacaugcuuuauucaucucuauaaauacuuuuuucuuaaguucuauuuuauuuguuaauauggccgcuugguaguugucucacaugucuucuguuucuuuauuuucagccuuuauauauguuauuuuaguuuggguguaucucuuauaaauagcaguaugcuuuuacuccagucuaucagucuuugaguucaauauguuuauuguuacugcugauaauucuuggacuaauuucuccuguuuuauuuuuuauuuccuauuuucugugcuuuugcuuuucacuuucuuuuauuuauuuauuuuuuuugaggcugagucucacucugucgcccagccuggagugcaauggugcaaucucggcucacugcaaccuccaccucccggguucaagugauuucuccugccucagccuccugaguagcugggauuacaggcgccugcuaccaugcccagcugauuuuuguauuuuaguagagacgggguuuuaccuccuuggucaggcugguuuugaacuccugaccucaggugauccacaccccucggccuccuaaagugcugggauuacaggcaugggccacuucccagcagcuuuucacuuucuuucuuccuuuuauuggauuacuccugcuuuauuccugcacuuuccuccuuacccuuuuuuucucuuucaaguuuggauauuauuucuuccauuuauguucucuuuaacacgaugucuaaugguaaaauuaaccagugucucuuccauccucccaaacaauauaaaugaugucuuaauuuaauuacaguguugaaaaggcuauuuauuuuuauuuuuauuuuuuuguuggagauagagucucuugcucuguugccuaggcugaaguacggugacgugaucuaggcucacagcaacuuccgccuuccaaguucaaacaauucuccugucucagccucccaaguagcugggacugcaggcaggggccaccaugcccggcuaauuuuuuuguuuuaguagagacaggguuucacguauuggucaggcuggucuugaacuccugaccucaggugauccauccaccucagccucccaaaagugcugggauuacaggcgugagucaccacacgcggccaaggcuauguguuuuuauaaaauguuuaguuucuauggcuguaucuuuccuuacaucuuucaaacuaguagugaacaucagacuuuauguggauguccaguugauauuucaaacaauauuuugagacaacuuauauucaucuucccacaaauguucuuucuaaguucuuacaaaaguucuauauguuucacauguuaauuaguggcauuuuagcuuugcuaaccauucuuuuaauucugcuucuaaguuguuaucuuuuguauucauaguuucacagucccuuauaaacucucacuuagauuauuguaacuacauucuguuuccacuucuuauuccuugugucaugccuugauauuuuaaccuucagucuuuguuggaguuaccuucacucacaguuugaauuuucccacaaaguuagaaugcuucuuuucuuuagcauaguauugaaauccucugugucuuaauuaauuuuagucaucauuucccauuauauauuguuacauacccaauuuuccaacuacauuguuuuuauuuuucuuuuuuuaagacggagcuucacucggucacccaggcuggagugcaguggcaugaucuuggcccgcugcagccucugccuccuggguucaagugauucuccugccucagccuccuguguagcugggacuucaggcacgccccaccacgcccggcuaauuuuuguguuuuuaauagagaugggauuucgccauuuuggccaggcuggucuggaacuccugaccucaggugauccacacaccuuggccucccgaagugcugggauuacaggcuugagccaccaugcccggccccaaccacauuguuuaauuaccauuuccaguaauagaaggcacuuguaaauaucauaaugaucaaacaguuguucugugccuucacucaggagugcacuuucccuccauuccucgacucauuccuaaugcagcuuucaaggucuaguucuaauucuaccuucuugaaaccgcucuugauuuuuuucuccacuccagccaaaauuaaccacuccuuuuuuguaguaucuugcagguauuucuaucugucuccaaauuucuucugucauguuuagugaguagcugauguauguaucucccacuauauaauaaacuugggcagauaggaaucaugucuguucauauacuuauuccacaguacuguguacuuaauuugcucaccauaugcuuauugaauugaagcuagccaggcauaggaaacagauaaaaauuaaaugggucaguuuuauuauaauaauaauuauuauuauuacuauuuugagaugaggucucacucuuuugcccaggcuagagugcagugguaugaucucagcucacuguaaccucugccuccugggcucaagcaauucuccugccucacccgugugauugagacuucaggcuuacacugcugcuuccggcuaauuauuuuagagauaguguuucaucauguugcccaggguggucucgaacuccugaguucaggugauccacccaccucggccuccccaagugcuacgauuauagggauuacaagcguaagccaccgcauccggccuggaucaguuuuauuaagacuaacauguacuugaaaauauauuaaguuccuggcaguggcacuuaaauuacauuaggcugucuuaaauaaaggauuguaacugaauaaucaaggagcauaacaguguguuguaaugguuuaaaaagccugggcucuggcaucaagcugcagaauuuuaauucuacuuacuaguaaugugauccuagguaaguuauuuaccuucucucugccucaauuguccuaacuauaaaauuggaaugguguuauagcacauaucucauacaauguuugagaggauuuauugaguuaauaugugugaaacauuuagaacagugcuuauggcacagaguaaguguugaaauguugaccaccaucaacagcaauauaauuuuacucuuauguaagugggaggcaaaauuuuuucuuugguggaaacaggcaggaguuagaaacuuucuucuuuuuuuuaaauuuauuuuuaauuaauuaauuuauuuuuuuuugagacagagucuugcucugucucccaggcuggagugcagcggugccaucucggcucacugcaagcuccgccucccggguucacacuauucuccugccucagccucccgaguagcugggacuacaggcgcccgccaccacgcccagcuaauuuuuuguauuuuuaguagagauggaguuucaccguguuagccaggauggucucgaucuccugaccucgugaucugccugccucugccucccaaagugcugggauuacaggcaugagccacugcgcccggccauuuuaauuuuuguuuucuuauugacucguuguuucaccacgguacccaggauagucucgaacaccugggcuaacgauccuccugccucagccucccaaagugcugagauuauaggugugagccacugcaccuggccuagaaacuuuuaguugagucuuacucuuagauuucugagguauagagguauuuagaaaaagauguuuuaaagacagugcuccagucuuacuaaacaauuaggcauuuugggccgggcacaguggcucaagccuguaauccuaccacuuugggaggccaagucggguggaucacuugaggucaggaguucgagaccagccuggccaauguagugaaaccccgucucuacuaaaaauacaaaaauuagcugggcgugguggugggagccuauaaucccagcuacucagaaggcugaggcaggagaauugcuugaacccggugaggcagagguugcagugagccgagaucacgccaccucacuccagccugggcgaaauagcaagacucugucauacauacacagaaauaaccagaacuuggcauuuccugugucaguuuaaauuaggaaaguguuguuauaaacauacaugugcuuauuuaaggauuuuuuggaaauauguuuuuguucaagauuauaauagcuuugcuaguaaaaauauuaaaaauaaaauacaauaaaaaauacaaguacucuuacauucaucagauucauaaaaccuucuuugacuacuuucugcauucaugagcucuucucuuaccuuuuguuucuuugauaucuuuucacacuacaccuugcuuuauaauucuuuguguguguguuuuauuccucaacucaaucugagaggaguuaggaagaguguguuagacuuuuuugcaugucuuauggcacuauguaugauaucccaugcacgauagggacuaaaauuauuugcuaaugaaugaauaaaaguuacuuacagcuaggcgugguggcucacgccuguaaucccagcacuuugggaggccaaggugggcggaucaccugaggucaggaguucaaggccagccuggccaauguggugaaaccccgucucuacaaagauaacaaaaauuagccgggcaugauggcgggugccuguaaucccagcucuucaggaggcugaggcaggagaaucgcuugaacccaggaggcggagguuguagugagccgagauugcgccacuacacuccagccugggcgacagagcaagacuaaaaaagaaggaaaguuauuuacuaacugaaauguagauuuuaauguucauaaauuuuuuaguguguguaaaaguugguuacaugugaaauaugucaccugacuuaucacaaagaucauguuagcacaaaauccuaaacuaaaaucugccuuuggucuuuccuucaguuuugcuuuuucuuacaggguucuguaucuuagaggacuuagguaauaaaaguaagaauuagugccuaagucuugaguacugcuuucuguuaucugaaugauugcuguggacagugugcuuaacuucuguuuuuucuuuauuagaugauuugcuaauaaacagauagugcuauaggaauagcacacauuaauaggaaguauuuauggaucuaacugucugugaacaguuuuucuaguuuuuauuuauuuaauagaggacagucauuuuugagaauaucuuuccuuugcucauaauaaguauaauuuucaucuaaauuuucccuaaaggcaguguuuuauuucuguacugaguccauugugauucuucguggcuugcauuuuuggucagucagguuaggcuaguugaugcuuugguaacaaacaacucccauaucucaaagaucucaguggcuuaacacaucaccuauuuaucuguugcugagguuauaugucacagcaggucagcaugggcacucuagacauuguaguagcucaagcacccaggcugaccaguguuucaucuccaccugcgcuaccaucacugaauaguggaaaggcaaagugaagaauugagcaucggcucuugaaguuucugccuggaagugacacuuaaaaccucugcucacauuucacuggccaaagcaaaucacaugaguuugcuuaaccuuagaggggcaagaacaugagaucuuccaaaugccagaaaggugauacagaacauauggugagcagcuucaauaacuaccacacuccugcucaugguucacaguucaccacuuuccugcgcccaguuccauuaaucagagcuauuuuuucuugucauuuucacuucuguuaccucaaggauuuuauucucucauuuauaguacuuaauuuaaaaaaucucugucaccuuucuucugagugauucuaauccuucuguugcuucugagauugaguccaccaugacuccucccugauguacucuaguacugcuuucucacuugaccucuuuuugccauccugagauagacccccaaucugucuuugcuuuuguuuggauuccuauuccuaacauaaauuguguguguuuguauuuuaaaagagaauggacagggaacuagguuaugaagguaaauuauaacaaaauggcuaaggaagaaucuugaaauuuuaauuuuuuaaaggaaguuuauuuuuaguccuuuuaauauaaaaauaucuaaaugacagaucaguagagaaaaugccacauguuuauuuguagggauuguauacagugauuuauuuaaucuauuuuuuucugauuauaaaaugauagacauagaaauacauaaguaucucuguuggucacacugccuccagagauaacccggugaauaauuuaauauauucuggauuuuuuuuccugugcguauagaaaagcuuuuuuuuuuaaaagaaaaaacccagaacauaaucuuuaccgauaauaacuuuaacuucauuuuuuuucccccauuaguagugucuuggcaguucaaucuacuguaucgcccucaguggccgcaaaauacuccauugaauggauguaccauaauuuauuuaaccaguccucuuuuuguuggauaaugagggugguaucuuuuuuuuuucccucuuucagugaaagugccaaauccuaggcacuggaccacuagguaacuuuuccccucuuuauugccaacuauauauuaguuaauauucuuugauuauacauuagagaaauaacacgaguuagcuuaaacaauuaaagaaguagaggaggcaucauagaacccagggccaggaauauggaugagucuuaggaaaggacuagaaguaagaaguguaaaccaucaagaacccaggaaguggccgggcccagugcuucaugccuguaaugacagcacuuugggaggcugcagcgggaggaucacuugagcucaggaguucgagaccagccugggcaacauaggcugggggagaccgcaucucugcuaaaaauaaaaaaauuagcaagguguggugguguguaccuguaguuccagcuacccugaagguugaggcuggaggauugcuugagucuaggagguugaggcugcagugagcuugguugcaccacugcacuucagccuggguggcagagugauacccuuuuuuuuuuggauucucacucugucacccaggcuggagugcaggggcacaaucucggcucacugcaaccuuggccuccuggguucaagcuauucuccugcuucagccuccugaguagcugggauuacaggcuugcaccaccauaccuggcugauuuuuuuuuguauuuuuaguagagaugggguuucaccauguuggccaggcuggucucaaacuccugaccucaagugauccgccugccucagccucccaaaguguugggauuacagccaccacaggcagccuaugauacccuguuucaaaaacaacaacaaaacaaccuaggauguguucuguuucugucuacauguuuuuccuucauuuauugcucucucucucuguccuuaacuccuuccucccuacccgcacugauuuucuuuucuuuuucaugcuuguguaaauauggcugccccaaagcuucugaguuagauauuuuagccacaugguugccucugaaccuuacuuaguuccuguucccaguaaccaguucccaguagagaucuccaaaugaaugugggguacacuccuacagugcuuagaucagcugucuuugcccaguccauucagcugaaaggaaggggguagauguccaugauaaacauuguuggagccuucauccuuuuaggaggaaugaauucuagaagagggaauaguugauagggaaccuuauuaaacuagauacagcucccaaaagguguauaccacauggauaguacugcagugagugaacaucuuuauaaauuggcucauuuaugcaaauauuccuuugacguaauuucuaaccauuuuaauaguuagccaacguauacaaguuucaguagauacggacaaguucuacaagaaguaugucccuuguuuacacucccaucaacaguguauacauguuuucucauacgcguuaguucuggucacuaaccuguuugucuuuaccaggcugaaaaauaaaaaaucucauuucuguuuuaauuucuguuuaguuucuagaaaacaugcacaacuuuuaucaugguuuuuagccauuuuuauuuuuucugugaauuuuuuugucuuuuuugcccauuuuuagaauuugauggguuucucccuuucguuugccuaaaacugucguaaauuacccguuuguaugauguguguuauuugcuuuguucuuuaguagugaauggaugcuuugccuuaaggugguuuuaauuuuuuaugcaaucauauucuuuugugucuucucuaauuuuaugucaugguuacagaaucuuucgcuauucuaagaucguaaaagcauucacucauugucuucugguacuuuacugaugcaccuuuuacauuuuagucuuugauccauguugaauuuacuucaguuuuuuuuuuuuuuuugagauggagucuugcuuugucacccaggcuggagugcaguggugugaucucgacucacugcaaccuccaccuuccagguucaagugauucucuugccucagccucccaaguagcuugguuuacaggugcaugccaccaugccuggcuaauuuuuguauuuuuaguagagacgggguuucaccauguuggccaggcuggucuagaacuccugaccucaaguuaucugccuguuucugccucccaaagugcugagauugcaggcaugagccaccaugcucagggaauuuacuugaguuuuaguaauuuauuuauuuauuuauuuauuuauuuauuuauuuauuuauuuugaaauggagucucgcucaguugcccaggcuggaguacaguagugugaucuuggcucacugcaaccuccaucuccuggguucaaguaauucuccugccucagccucccggguagcugggauuauaggcauccgccaccacacuuggcuaauuuuuuuuuuuuuuuuguauuuuuaaaagagaugggguuucaccauguuggccaggcugguuuugaacuccugaccucaagugauccacccgccuuggccucccaaagugcuaggauuacagacgugagccacugcacccggcgaguuuuaguauuaaacaaaggaucugguuuauuuuuuuugauggccacuuaacucauuuguugaauaggaauuuuccccuaguaauuuguggccuuaaauauuaaauuccuauguacaagccuguuuacaccaucuagucuucuuucuucuacugaugagcucuugugccuguacuuccauacuacuguggguuuauagcauagauuaaaauauaauggucaacugggaaggggcaaguauauguucacugaauuuauaaggugaaugguucuaugcauaguauuuaugauucauuuuauacuguaguucauaaguuaauuacaaaaaccagugaucguucaaguuagugcuuuguauuucucuauauucuggagaaacagaaggcaacuggggaucuuuuaaguuugcuuuuggcugugauuucuugaagaguuuuuauuuuguggguuguuuuuuucuuauuuuguuuugcuuuccagcagugauuuagagcauucuuuuacaaaagcuuauuaaaaaauuguuuuuuuuaccaaaagcuccuauuuagaaauguguuuauuuuucagaucucaggaaauuuucugauggaauuucaagugaaaaauguuccuucagaaagaauugcaacucagaagauccugucuguguuaggagagugccuugaccacuuuggcccuggcugugugggugugcaaaaaauauuaaaugcccgguguccgcucgugagguucucacaccaggccuccggauuucagugugauuugacuacgaacaauagguaugaccgcuuacauuuauuauuuuaaauaugaauauucugauauauuagcuuaguguuucucacacagaaacaguggcuuuguaaucuuaaacaugcuugaauaauaauuuuuuaaaaauuuaucacuuggauugaaaaguaaguaaucuuuucucuuacguuauaccuguugauaauuugguguuccuaaacaguguuaggauauuguguuaaaauguucacauaucuaaccucugagaagaaauguauuucauuauucuuacuugugcagccugguaguguguagugugaaagaugccuauuuuuuaggagaaauuucugauggcaaaaaaagaaaaaaguaaaauaagaaagaaagaugccuauuuauaguacaagccuucuaagaauacuuagaaaauaaaauaccaacuugaaguugaccuuugaauugccuccagauauauagucaacuuuguguacuagacaaauguccccuuuacuuagguccaaaagugguuggaagagcuuaagaccggauggcuuuuguucagccuaugugcauuguauuauccuagugauuuguuugcuuaaaaaaguggggugggaaaaguucuuuuguacugaugacuuuuccugguuucacaacagggaaaauuucuuuauuucauuuuuuuaucauuauuacuuuugagacggagucuuacucuguugccuaggcuggagugcagcacacugcacgaucucggcucacugcaaccuccaccuccuggguucaagcgauucuugugccucagccucccaaguagcugggauuguagaugcaugccaucacgcuggcuaauuuuuguuuuuuuaguggagacgggguuucacccuguuggccaggcuggucucgaacuccugaccugaagugaucugccugcuuuggccuccuagagugcugggauuacaggcgugagccacugacccuggcccacaguagggaaaauuucuuaauugagaaguuuauuucuuaacuucucauugcaugaguucauuucacuauguuauuuguuagcuaaauaaucauuacugaaaauagauucagaaaaucaaggcuagagcaguuuugauuaaacucgaaucuucacccacaagccaaucauaaguacuugcgacuuucucucaaguaaaacucauggaguaaagucugugauuucuugacaaauuuuaguauaaaaauauaauacuguacuuucuaucauuauuauauuuucuuuguaguauguaaaauaggacaaaauuacauuuaucuuuguaauuauguuuuuuucuuuauaucaagauaccuuauacuuuuugauauuuauuuuuagcuuaauuuagcuucauuuucauacauaaaacacuuaaucacaaugaauuucuaaguugcuguuucuucuuuuucuuuuucuuuuuuuuuuuuugagacauagucuugcucugucgcguaggcuagagugcagugccgcaaucuuggcucacugcaaugcaaccuccgccuccuggcuucaaucaauucuccugccucagccuuccgagcugggacaggcacaugugaucaugcuggcuaauuuuuguagagacaggguuucaucauguuggccaggcuggucuugaacuccggaccucaggugaucugcccaccucggccucccaagugcuggauuacaggugugagccgccacgccuggccuuguuucuucuauucuuuuuaaagacaguuuuagagacaguuuuaacuugaugcuguuaaauuauuuuuuuaugccaucuguugguucuuggagaaauuacaagacacguuuugaucaguaggagcuuaauauuuuuaauuuaauuuaauucuauuuuuacuuuuuuagagacagugucucucucuguugcccaggcugaagugcaguagugugaucauagcucacuguagccucgaacucuugggcccaaacaauccuccuuucucaaccuccugaguagcuaggauuacaggugcaugccaccacgccugacuauuuuuuuaauuaaauuuuuaaaauuuuguuuuucuuuuauauauacauuuuuuauuuuuauaaagacagggucuuacuauguuaccuaggguggucucaaacuccugggcucaagucauccuccugcuuugaaaugcugggacuacaggcgugagccacagugcccagccaauaaaugccuuuuugucuuuaucgauuuuauauauauauauguguguguguuugagaugaugccuuacucugucgccaagacugaagcccaguggcuuaauuuuggcacacugcagccucuaccucccugggcucaggugauccucccacgucagccacccaaguagcugggccuacaggugugcgacaccacacccagcuaacuuuuguauuuuuuguagagacagugucuugucauguuucccaggcuggucuugaacuccucggcucaagcuaucugcccaccucagcuucccaaaguucugagaucacaggugugagcuacuguacccagccauuuauuaauaauuauaaagcgccuuuguguguuuuacauauuauuuaaaucauguuuagaaacuuugauuuaaaaauucuaaguucuaggcugggcacaguggcucacgccuguaaucccagcauuuugggaggccgaggcgaguggaucacgaggucaggagauugagaccauccuggcuaacacggugaaaccccauuucuacuaaaaauacaaaaaaauuagccgggcgugguggugggcgccuguagucccagcuacuugggaggcugaggcaggagaauggcgugaacccaggagucggagcuugcagugagccaagaucgcgccauugcgcucuagccugggcgacagagcgagacuccgucucaaauaaauaaauacauacauauucugaguucuagaucuacauuuucuuuauuucuuuuuuuuuuuuuuuuuuuuuugaggcagggucuugcucugacacccaggcuggagugcaauaacgcuuucucggcugacugcagccuccgccucccggguucaagugacucuccugccucagccccccaaguagcuagaauuacaggcaugcgccaccacgcccagcuaauuuuuguauuuuuguuuaagacaggguuucaccauguuggccaggcuggucucaaauccugaccucaggugauccgcccgccucagccuuccaaagggcugggauuacaggcaugagccacuacgccugguccuagaucuacauuuucuuucuuuuuuuuuuuuuuuuuuuuuugaaacggagucuugcucugucucccagacuggaguacacugguauggucucagcucacugcaaccucugccucccggguucaagcaauucucaugccucagccuccugaguagcugggauuacgggggcacgccaccacgcccagcugaauuauuguauuuuuaguagagaagggguuucaccucguuguccuugaacuccuggccucaagugauccgcccaccucggccucccagagugcuaggauuacaggcaugagccaccgagcccggcuuacauuuuaauuaucaauuuuaagaggauguuuuaaugggaaugaauguauuugauauucagccauucauauuaaauuuuauauugcaaauucauaaugcuuuugauuaccuaaugauguucugaauacauucagauauaguaggauauuuagauguguuucuugguuugaguuuaauuuuacccuugguuuauaauuuggggauuugaacauuuuucuuauuuuuauuuuuugaaggauugccuugacaaguuccgaacuccuuuauauauauggugcccuagacucaagagugagagccuugguguucaguguacggugcugggcucgagcacauucacuaacaaguaguauuccuggugcauggauuacaaauuucucccuuacaaugauggucaucuuuuuucuccagagaagaucacccccuauucuuccaacacuagauuccuuaaaaacccuagcagguaagacuagaaagaaacuucuccauuuucuuuuuccaauguuaugaguaaauauaauuaccauguguuaccaaagucccgucuauuuguuuauuagucauaaaauuugucuugacuuuuuuuuaaagucuaccggagucacgagagcagaugauuugggaagcuagggccuuuagcauuuuuugagaguucuguuuucuuuguaucaguuggcaagguuguuuacagcaguugugagauagcuggagcuucuccccuaguugaccaagucuagaaugaccuuuuucagauacaacuuguucagauacaacuuuugauuggaucacagucucagagaugacuuucaaaucugaacuuauguuuagacuuguauuagagauacuaaaacugcuucgugauguuucaaagauucuaaauguguuuuuaaugaaaagcauauaagcagucuuaggugcauuauuuuaaauuugacauacuauauuguuuguauuauaaaugauuuuauaaaugccucccagauucaagugauucuugugccucagccuugcugaggccugcuggagaaguuauguuauaaaaucuugaaacuguaaaugcuaaagggaagauaauuaagggguacauacacacaaaugcauacugucuucuacccgucuuacauaauugcugccugauaauucgauuaagugccuucuugaaucuuccuguuuaaaaugaccuuaagaggcaaacuauuuacauagcuugguguuuaaaaucuuuagcucucuagacacggcccaguuuuccaugcucuucccuacuccucuuuaugugucccacauuccagccagugcugugauuacccuuggaacauuucaucuuagcuuuuuguucacacuguuuuucugccuggaaucugcuuucucuucucccagucuaaauuauuucuuccaugcuaccuuccuuuauccauauuagaagugaucucuuccuguuaacacuguaaguguugauauuguuugaaauugaccuuaaaaaaagcuugauuuguguuuacaacuaauugaucacaaccaguuacaaauuucuguguuccuucuccacucucacugcuucacuugacuagccuaaagaaauaaaguaaaaugaaauaaaauaaaauaaaauaaagcuagauuugauagguuaagggaaaaugggaaguuuucagugggguagagugguggucacuuaucucacuuuugagauuaaaauaaagggcagcaucaauaucugugcucauuucaucccuuagugucauucauucaguauuuacugauuacuuccuaugcgucagguguuauuggaguaguggggguaugaacaguguucccagauaacucacaaucuaauggagagguaagccauacauaagauaugggcagaucuucaccacuaaacuaccuguaaguagcacuuccuuuuccacuccugcugugugcaguggugcuuaaugcuacucucauagaaaccaucguggggaaaaauaacggaacuuugggaguucagaaacuaagaaacaguagaagcuguaaaaggaggagcagaagaaaguugaacuugggguagacuacuccuaagcaucuugauugcucccuucagucuuacaaguacugguaccccugcccauguuaaggcccuguuguccucugccugggaaggcuuauguugucuuuccuccuuaucucaaguuugguucccaccaaucuauucuuaguuaagagagugauuuucacaaacacauaugauaguauuacccucuuuugcaguccuucaguaacuuucuauuaucuuuuuuaaaaauggucacuauuuuuuuaaaaauuuuauuuauuauuuauuuauuuuaagaaagggucuugcucuguugcccagucuggauuacaguggcacaaucucggcucacuauagccucgaccucccgggcucacguaaucucacuucagccuccugaauagcugggacuauaggcaugcaccaccauaccuggcuaauuuuuuaauuuuuuguugaaacggggucucgccauguuucccagacuggacuugaacugggcucaggggauccucccaucuuguucucccaaaguguugggauuacaggcgugagccacugugcucuaccuuguaggcaggcuggagugcaguggugcaaucuuggcucacugcaacucugccucccaggcuuaagugauccucccaccucagccuccucaauagcugggauauacaggcuugugccaccacucacucagcuaauuuuuuaaaaaacuuuuuguagacauggugucuuacuauauugcccaggcuggucucaaacuccuaggcucaagcgauccuucucagccuccccaagugcugggauuuuaaaugaccuguugaguuuuuaauuccaaaucuacauuaaaauacauuuaaauauguucacaucguauagcaucaaaacaggcaaaacuagcuuggaauucuuuaauauuucacuugaaacaucaaauuugauuguuuuuaaauuuuugcaguaguuuuuaaauacgguaagagaauuuuucaggcuaguuuuugcaauugcuucucggcauauagcacauuguaggugcgaauugccaauaaaugccaagcaaaauacacuuuuugccuuccaucaccuaugguuuuugaaguugcuguaaaagaacuugucuuagauuaauguauauuaagaauuuggugaagaucauuuugaggagaauuuaucaauauuuuccuuuuccuuuuuuuucccuccaaaauccaugguuuuuauacuuucuaauuuugaccaguaguucaacuuugguggacauuaaaccuaaggaagaaaacaauuuuaaacugugaaacaaucaaaaccauauugaguacuugguguuuaaucauguaagugaccugaaucuuguguacaaucauuucauuucuucuaagcuguaccucucauuugauauacaaauaaucaauuuguucuuuuuuaaaagaaaaaauauuuuauuugcuuccuugcuuguuuauuaauagaaggcaacaugaauuccuagaauaccuuccagaacuucuaggauuuuguaaacuacuauuuagaaccuaagcuaagcuaaagaccaaacuuuuucacauuguaugcagggcccuuuaucaccuuccuuuuuauccucuucuuuuacguugauuccuguauaccaguugggagcuuuagccacucuugaacuccuugaugaucccugauguuuugugcuuuuuuucauugcuccaugcuuuugccugaaauggccuucucccagccucccccucccagccaccccgcuuuuuuuuauggagaaucucaagauuaagccagagaagacagacaaaccuaguacaggaucucaucuguuaggucuuuucuugcuguccucucugcuucccaguggguagugcuuuguugguuuccaagcucuugguacacaccuguauuguaacaacuguuagauuguuguaguucuuuuaugugccugccucagcauugucaagcuuuucuagggcuagcugucugcuucaccucugcgucuucuguucucggaauaguauuggguucauaguaggaguucacuauguagauuucaaaaugauuggauaacauuuuaaaguugagggcuguuuguacugggcaagauggaccaugauauuaacuuucauauuugguuccucuugaauugcccuguuuauuuguguuuucuuauaaucuccacuguguucucucauaugucucauuuucuuguguuuuccaugcuuucuggcuuugcuacuuuuguuacauuuacuucugugcuuagugcuuuaauugaagauucauuccugaaaaaagacacagcagcuaaaagagcaucaauauaugugacugacacugcaucacaaaaaaacauacacuguuaauuacuugaaauaguaaaacaugugcucagguuccuuaaaaauagaucuaaguagaaauauauauacauacauacauuuuauauagcuccuucaacauauuauaaauuguauaguagagcacguaaaaugugcuauuaaaauguuaaaaccuagaauaauuuuugagaaauuaugcagguaaccaggucuugacaaaaaaaugacaaaaaacacaaaaaaugggagauaaauuuauaggaggcuuauuuaucucucuggugauuauaggcauuuaaagucaaauaucagggccgggcacgguggcucacgccuguaauccuagcauuuugggaggccgaggcgaguggaucacuuaaggucaggaguuugagaccagccuggccaauauagugaaacccugucucuaacuaaaaauauaaaaauuagccggguguggugguguucgccuguaguuccggcuacucaggaggcuggggcaggagaaucacuugaagccgggacgcggaaguugcagugagccaaggucacgccgccacugcacuucagccugggugacagagccagauuccaucucaaaaaaaaaauuaaaauaucagcagucauccagauuauugauuauauaccugcuauaugcuagaugcucauugggggcaggucggugguggggaguugggcaauaaugaauaggacaguggccuuuguaauuccugacuggggcagaggaguggacagcauacaaacagucacaaugcagucagauaagucaaauggugaauggaacaaaaaggauggaaaaccaguuuggaauuaugaaaugcuuucagauaggaaguagccauugaugagauuucugaagagugggaauuugcucuugaaaacagcauaguaucuguugcagauagugugggccagggauuucauggugguuguauauuuaugaaaaugauuaccucuuaagauauaaauacuaguaggaaaggugaauaucugagucuaacgugcuguuauugaguuuguuuugcugaauuacugaauuccaguuagucuagagugcuacauuuuagaaauuaccugaagcuuuuuuaguuagcauucaguuugugucguguaugaagaugauaagaauggaauuggagauguaaauuaaguauugacuagagguagugcugaaauuugguuuggugaaagaugggggaacucccuacauuuccaucuacuguuagaaaacugauuaccucaaaaauugauuaggaaucauuggguuguugaaagacaauaauucuaguaugcuaaauuaaauguaauguuaauuucacuguggcauaacuagucucaaaucuuuuuuuaaaauauaacuccauuaaaagaagauaaaaagauuugagauuaguuaugccauagugaaauuaacaucauuaaaucauagacaagaaauuauagauuaaaucguuauuuaaucauucagucauaauuauucaaucauuuauaaaaucugugauuuaaauaaagaauagaguagaaauuuacuuaaauuuguuuuguuuuguuuuguuuuguuuuuugagauggagucuugcucucuugcccaggcaacagugaugugaucucagcucauugcaaccuccgccuccuggguucaagcgauucucgugccucagccucuucaguagcuaggauuacaggagcaagccaccaugccuggcuaauuuuuguauuuuuaguagagaugggguuucaccauauuggccaggcuggucucgaacuccugaccucaggugaucuacccgccucagccuuccaaaguucugggauuacaggugugagccaccgcgccuggccuuaaauuuauuuaaaucauagauuuguauucugagguagggaauaucuuugaaauaugugaaauaggcugggugcgguggcucacgccuguaauccccucacuuugggaggaugagguggguggaucaccugaggucaggaguucgagaccagccuggccaacaugguaaaaccccaucccuauuaaaaauacaaaaaugagcugagcgugggggcaugugccuauaaucccagcuacccgggaggcugaggcaggagaauugcuggaaccugggagguggaggcugcauugagcugagaucaugccgcuacacuccagccuggaugacagagugagacuccaucucaggcaaagaaaaaaaaaaaacacgugaaauauuuuuuguuuguguuuaagaugcagaagauaaauguguaauagaaggcaacaacugcacauuuguucgugacuugaguagaauuaaaccuucacagaacacagaaacauuagguaagugucuuucuguuuacuugauccuuucuggauugaaacaggcuuuccucugauuguccuuguuuuauuuucuuacagaauuacuacugaaggaauuuuuugaguauuuuggcaauuuugcuuucgauaaaaauuccauaaauauucgacagguaaauaauguuuuacuauuuaguuauuaguaucuggucuuccacuguacuaauauuuaauuaacuguuuucaaaacacucuaauaaauguuauuuauuucuuuuguguaguaauuuguaguaacaaggagguugauguccagagaaguuacaugacuugacuaagaucagucaucccuuuaugccaaauaguaaaagccagcucuuuagcaucugccuuguuauuaugccaugggacuucuguccucacuuaguguaauacuguaucccucaugauguggaauacauuccagaaaguuuccugaaaacuauuauuuacauacagcuguuuuuaaacuggauuugugucuauggaauaaacuuaagucccaaagauagauuucagugauucccucaauuugagcccuuaggauuuagguguuuuuuuguuuuguuuuguuuuguuuuguuuuuuuuuuuugagcaaaugaacuuacgauuuggauuucugagcagcugggaugaaagacauuuuuucuuuucaaaaagaaacucaggcagaagucuagacaaaauuuguuugcaagugggagauaacuugggauagcccucuguuuggguuuauucuguuuagcauuuggcuacuugauuacaaaccuuacaagauuggcuucauaaaacacaaacccagauauacuuucuccuuauuucuucaccucuccguuuuucauccuucccucuuaccugcucauggacucuuuguuaaaauaaaagauuggggagaggagagagaaaggauucauucggaaagcuuugcaaaugcuaucuagaaggaaaaagucauaagcauacaaaguucgucaccuuuuuuguacuccaaagcucagagaugccaagcaugaaauaaguuagggaauauaacagcugcugcucacaucagggaauuuugaccauuggcuuuguaauaguuaauuaaguaaauuuaugguaucauuugaaagaggaaaagauauauagacuaauggcuuauguuagucauaugauucauagcuuuagcuuuucuuuuucuuuucucuucuuuuuuuuuuuuuuuuuuuuuguuuuuguuuuuugagacagagucucacuguauugcccaggcuggagugcaguggcaugaucuuggcucacugcagccuccgccuccuggguucaagugauucuccugccucagccuccuaaguagcugggauuacaggcaugcgccacaacaccuggcuaguuuuguauuuuuaguagagaugggauuucaccauguuggucaggccugucuugaacuccugaccucagguguuccaccugccucggccucccaaaaugcuuggauuacaguuaucuuuuuuauuucugugagauacuaucuuauguggcagagcccuuuuguuggaucuauaggaagauaauggaaacuuuuuaguguuuuaaauaaauaaugaauaauccuuuguuccuccucuuuuuccucaucucauacuugggaaacauuaauuaauauauuuaauuuaaggguucuaauuuuguguguuccuguuucuaccauaauagguaugcuuuuagcaagucucagaaauaaacguaucuucaucuuacuuucugauuuuuuaaucauuuuuuucccuuucaugcucuaccuuguuagguaaaaguuauauuauuuuaaaaauacuuuugucgguugaguuaguccagauaccucuucucugagcaaugacaucaucauccauagaugauaagcccuaaguuauuucuccaaagaacacucauaaaacuuacaacagggaaaaaaaaaacaaaaaaugagaaguacacacacccaccaugcauacauacucaauccccugagaaagaaauucuuugcuauguaaaguuaaugcugguguuuuauguguuuugacauuuuauugaguuaacuguuuuuauauuuaagcccuucauguacuuacucauuuuuucuucuguguaauaaucuauagggaagggagcaaaacaaaccugauucuucuccucuguacauucagaauccauuugaaacuucucucaacauaagcaaaaauguaagucaaagccagcugcaaaaauuuguagauuuggcccgagaaagugccuggauuuuacaacaggaagauacagaucgaccuuccauaucaaguaaucggcccugggggcugguaucccuauugcuaccaucugcuccaaacagaaaguccuuuaccaagaagaaaagcaauaaguuugcaauugaaacagucaaaaacuugcuagaaucuuuaaaagguaacagaacagaaaauuucacaaaaaccagugggaagagaacaauuaguacucagacaugauggcugcuacauuguguaaagaacugggcuuagccuaucaaauggucuguggacuuacuuggaaaaacugauuugaaacuuucacagaucucagcuuucaucugaugucacuuuucaugaucuucucauuggcccccuuaaccuggucugaaguucugggauguuuucaguuugaucagucugauacucaguggcacuuuauuaaaacaucagcuguggaguguggcggugcacaccuguagucccagcugcucaggaggcugaggcaggaggaucucuugagcccaggauuuugaauccaucguggacaacauagcaagauuccaucucuaaaaaaaaugaaaauaaacauaagccacaaggaaugggugaaagauuauuguaaugugcuuuaacuaaauagguaaauauacuaaacaaaugcuaaaacucaguuuuaggaugaaaccauuguugauauccacaucagucccuguuuagaaaacauuuaaaaugacuuuuaguuauguacaguacguuggcaaugaauacauuaagcuucaaaauuugguagugcucucgaauauguauauuuguauuuuucaagcgaaguucucuuauucacauauaaauuaaaguggguugguacugauaucaaaaaauguuuauguuuuuagaacagacauuucagucacugcauucuuagguauuccaaaccaaauaugaugacaucaauagauugcauuuuaaaaauauuguuugauuuuucuauuuucaaaaauaaaauucuguuucuaacuaaaaugugauauucccaguauuccuucacaucucuuuugagaacuccccucuuccugcaggaaagagacauauuugucucucaguauaugcagaaaauugguuccaggaccauccacguacacccagaucugcacacacugaacuccuucaguccuguggagcccgugcaugggagaauuccaccuugcacauaagcagauuuugcauccugugaaaguacuguauuuucuuucuuucuuuuuuuuuuuuuuuuuuuuuugagacagagucucgcucugucgcccaggcuagagugcaguggcgcaaucucggcucacugcaagcucugccucccagguucacgccauucuccugccucagccucucugaguagcugggacuauaggugcccgccaccacgcccggacaauuuuuuuguauuuuuaguagagacaggguuucaccauggucucgaucucccgaccucgugaucagcccaccucaaccucccaaagugcugggauuacaagcgugagccaccaugccuggccgagaauacuguauuuucaauccaaguuugguuggaaaaaaucuguguguaaauggacuucgcaguugaaacccauguuguucaaugggcaacuguauauugaaauuuaauuuccauuacauucucuguggagcaacuuuuuugcuuuguuucguuuuguuucugagacggaguuuugcucuuguugcccaggcuggggugcaauggcacaaucucagcucacugcaaccuccgccucccggauucaagugauucuccugccucagcugggauuacaggcgcccaccaccaagcccagcuaauuuuuguaguuuuaguagggacaggguuucaccauguuggccaggcugaucucgaacuccugaccucaggugaucgcccaccuuggccuuccaaaguguuggaauuacaggcgugagccacugcaccuggcuucuguggaguaacuuucuauuuaagaagcaaguaaggccugggcauagcggcacaugccuguagucccagguacuugggaggccgaggcacaaggacugcuugaaccugggaggcagaggcugcagugagcugagaucacagcacuguacuccauccugggcgacagugagacucucucaaaggaaaagaagcaaguaguauaguguuuaaaaacagacuugagcgagacuggcucaaugacaaguuacucagucucuuggggccccuguuugaucuguaaaauggggaucaugaucagaucaaugugaggauuaagcgagggauguaggaaaaugcuaggucagugcauuuuccuggcgcgaaguaaauguuacuucucuuuaacuguugccuuucgguguuugugguauguaauuaccuuuuuugcuacucaaaauucagauuuagaguuuguaguacuuuaaaaauuuuucccauuuaaauuuuaugucagaaauuauaauggguucugcaugggauauuuuaagaaacucagcauuguuaugaagcaaaugaauucuguguccuugugucugugcuauuggauugcacauuugacaccaacaaauaucaguguucuguacaggcgaugucuuuaaaagccauuuuucauuuguucuuuauuuuguugggcuagaaauccauauugauuuaaaaagcuuaaaaagcauaaaccacuuaaggguuucuaaaugaaauuuuuuuuucuguucacagauauuuagucagauauuuucuuuuuuagguuggugcuagguguaauaugguuauuuaagcacauaaaguauguguauggguuagcauuuucuuuucuuuuugguaauuuguaggacagccuugacacuaggcuguuuuacuuuucagaaucagauuuaauuaugugauuaauuuuaaaucuacaaagacuuguuuuuuguuuuuuuuuuugagagcaaaucuugcucugucacccaggcuagacugcaguggugcgaucucggcucacugcaaccucugccuccuggguucaagcgauacuccugccccagccucccaaguaacugggauuacaggcgccugccaccaugccuagcuaauuuuuguauguuaguagagacgggguuucaccauguuggccaggcuggucuugaauuccugaccucaagugaucuaccugucucagccucucaaagugcugggauuacagguuacaggugugagccaccgcaccuggccuacaaagacccuuuuuuuuuuuuuuuuuugagaugggucucccucugucacccaggcuggagagugcagugaucuuggcucacugaaaccuccacuucccggguucaggugauucuucugccucagccuccugaguagcugggauuacaggugcaugccaccacaccuggcuaaguuuucuauuuuuaguagagaugggguuuuacucuguuggccaggcuggucucgaacuccugaccucaggugaccugcccaccucgcccucccaaaaugcugggauuacaggcaugagccaccacgccuggcugcaaagaccuuuuaauacacaguuuuaaagucuguucaacugaauauagacuacagacaaauauauuuucucauaacuuuaguguaucacaacccagauuuuuaaaauauuuuuauuacgugauagugauaacuagcaauuauuugucauugcuguuucuuaauuaaaaauaauugcaauguuaaguaaaacuuuuuucaaguuuuuuucuucuauaacuauuacuaggcuuucauucaguagcuuucaccuguaaugaguuuuacuaaguaugugaaaguaauuuugauaggagacuacccagaucaaaacgauuucagcuauagcccacuaguauaauuccuggagcuauuauccaucuuuagaaaauuugagaauuagccagagacuuucuaggaaauaacgauuagccugaaacguuauaggaaaacuguguguaauuaucucauucaccuucaguuaccauaaaggagaagggaaaauaaaguugaguugaaauaaga

SEQ ID NO: 192731 - RNA, 186881 nt, Homo sapiens
uugggaaggccauauccuuuuuauuaaaaucgccacaaauacaaaagcaucacugaacuaaaaauacaucauauacguauauucucauauucuuagaaacuuaucacagguuuauuggcuuuccaucuuaucacaugucauaucucgaaaacauuaaauagaaacaaaagucuccaugcaauuuucagaugaaaaacauucugugcauuuucaauuuguguguuuucauuuagaugguugaaaggguuugcuaacaacuguuucccaauuuaggcuuucuggccaugggagugacauguccugugucauguagaauuugauagcuuguaauguccauuuaaauuucaaguguaucuugccuucucuguagcaagagccagccugcggauauuggauauacaaccagcugcagcuuccuggagauccuggucaggggacccaaccauauccaguagaagcugucacacauaaggaggagaagaagggacacaagaauaaaaacauuaaucuaaagacauaaaguuaggcuaggaaaauaauuuucaauaguaaauuuuuuuaaaaccaccaaaaaagcauaagaaauuccauuuaagcaaauacgaauauaaacaguguuuaaucugauacaggaauuccucaugcacuucuuaccuuucuggagcugaauuagacuccuuccuccccacuuucucuggguaucuaacugcuauuuuugggucugcuucugaaauuucucuugcaucuuuucugucuuuuccaccucucagaacaagccaacagcauaccaugcuuagacuaguagggcauccacuuagguuuaaucucucugaguuccaauccaccugaucaugucacaaccucauuauaucagucacuuaauagggacucucagugccaacuaacuagagcugaucuauuaacuaguccuugaaggguuugugcacucuggccucaaugcauuuccagcuauucaucuuucuccucuucuccaagaucauaacuuucccacuucucuuggcuuuacugaugcuauccccuaucuaaaaugccuucccauccccuucucuggcuuggucaauuuuauccaucuuucaaaacagaccuagccaacuuuuccacgaagccuccaagauuuccaucaaacuaaaggccauuuauuccucaucaggcugucaguagcaguuuacucaaaugucuguugcuacacguauuuuucccuuuucaacagauaauuggcuuaaugcuuucuguccuucuuuagauucuaaaugcuuaaagaaacguacaguaucuaaugcauagaagacaaacaaaugaauuagaacauuuaaaaucuagcaauuaugauucuaauuaauaauccugguaaaagauuuuuuaaaaguaaauuugaaucacauauuuuuuuacccaauagcauuugagugcaaauguggaugaugccaaaaaacgaggaugauuugauaagcaaagaaaucuuacuaagaaaaauaucgugagaugucuuacauaugccaggcuuaggguguggcuuuuacucuauagguaauaaaaagaaguuauuuaagcacuuuacucaggggaaugacaugaucauauuuguauuuuagaaagguagcucuuacagcaaauuauauagacuguagagaaaagaggaggaaggguacuguauuacuucauguagaggugacaggauggaauaaaagguaaggauagugaggaaggaacaaauucaagcgauauuugggaugaaauaacucuucaauaaauggccccagaacaacugcuuauccaaauagaagaaaauaaaaaugguaaucucacaucauacauaaauagcaauuccagauggauuaaugauguuguaggagucucuucuugguucgacuaaagacaggguccuugucacaaggccaugaaaaauuaggcucacagacaauuugaagggggagaaaaauggaauuuauugggcaaaaugggggaaaaaagggaaacagggacccuccgcaaagccagagucccugugggugcacuuccugacucgcagauugaaucccagcuaucacccaggaagaggaggggucaggcuccugccugcugcaaacagcaugaacuucuguggcuccaccccagugcacauuccucccagugcgcaggccauuugaagucucuggggaccccuucccacccggcugucucaaugagauuaaauaagaaaggaacaaugcaaaacauuuagaagguuguauaugagaauaucuuguucaaauugggucacugaaggaugucugcccucucaguuccuuggccugccauugucacugaucuucacacuucagccuuccaccuucagaguuacaucugggcccugauuuuucaucacuuucaacagucugaccuccaaacucucugaccacaaugucuccucccacgauuuggcuaugcaaccaucuuacuuguuuguucucaucaugaucucuuguccaugggcucacauacuuuuccuuuaaccaucuuccgucuuugcuuccuccauaaccagcuuagauugcauaguccgucuuuugaaucauucucuuaucaguuucuuaaaccuccuuacaacaucccuccaggaaaaccauaacuguccauaaauccaacucuguucuucccugugccuucaccaauaacugaguccugcgggaggcauaugucaacaacaaggcaaauccauccucuaucaguucaaccucaacuggauucucauucacugcccagcaaucaaaauuugugucccucucauuagguuacuuucccuuuccaaugccuauuuuaaaucuuccuucuucuucaaucuucaguucuucuuuuuagcccccauuuccagaagaugaccaauaaggucuccuucauaaacucgaucgaagccauuagacagcaacaacucuaccuaaaacggcaaccaugccagcgucuuagcagaucuuuuuauccuaccuuccaguuacaauggcucucuccuauccaaggcccaccauccacuuguauucuucauucauucuucuucuuaggacauuuuacuaccaaauacucccuguuucucuucuacuuuagcuuucaccucuuccuuucuaaugauuccauuaucauuuaaacacgucuuacacauuaaaaauaaaacaaaacaaaaagacaccacuuugaccccauuuucuucccuucauagccaaauuucuuuaaagaguugucuggaauuccuaucuccagucuuaaauuccaucccacugacuccaggcugcugucugccuucagcucuccucugaaauaacccucucagaggaugucaguaacuuccuuccauguggcuaagaguaguggacacuuaggaguuuucaucuuauuugaccccuuaacagcauuugauauaauuggccacuuccuccuucucugccacuggcuucuucuaccguacuccccugcuuuuccucguauccauucauucucaucuucucaaucuucauccauggcucugucugcuucccccaaacaaaaauuguuagaguucaucagaacaaauuccccuucuguuuucauucuguucccccucccuagaugacaucuuucacuaccugaauucaaauggcauucauauggaaccaucuucuaaauuucuaucuccaccccagaaaccucuuuggaauggaacacuucauauccaacacuucuuagccaucuccacuuggaagucucacagccaccucaagcuuaauagauuccaaaugaaauuuuuuauuuuuucuauauaaacaugaaucucuuuccaaguauuuuccuguauccauaauagauguuaucacuuaguuguucaagacggaaaucugcgugccucacacucacucccacccucaucuccccuaugcugcauccaacugauuaucauauucuugugauucagcugccuacacauauuucaaagucauucacuucucuuuauugcuauugucauucaccccaguaaagccuacuucccacugucccugcacccugucuugucccugucugaugaacuauucauacuguaucuagaguaauugccuaaauugugaaauucacuaauaagauacaauguuuuugagaaacaggaagaaauaagacaggaucaaucuucugagauucaagagaaaggaagauucuguucuguaugagggaaacagggaaguuuggaggggcucaugccuugggaguuuuguaucauuccuuuucuccagcaucguucaauauccuaggcauaacacagaggaaauagauuauaggacugugauucauuugaacagccauauggucugugcugggcuggaagggaagugaaaacaggaggcuacugaucacugggagaauuaggaagugaggccucaacaaugcaggaaaacaguuuaggugggaccaaagcauaggaaaagggugaaaauaagacauucucaucugagaaugagauauuuggaguuuaagauuuuacagaugaaguuccuuugaguauugacaagauccaugguaugaccaugggaauguaggucaguauaagauuguuaugcaguuuuuuguuuguuuguuuguuuagacaagucucgcucuuuugcccaggcuggagugaaguggugucaucuuggcucacugcaaccuccguccccugggguucaagugauucuccugccucagccuccugaguagcugggauuacaggcguguggcaccacacccagcuaauuuuuguauuuuuaguagagacgggguuuugccauguuggccaggcugaucucuaauuccugaccucaggugauccacccgucucggccuccaaaagugcuuggauuacaggcaugagccaccgugcccggccuguuaugcaguuuuauacauacacacagauguaugcaugcaugcauacacacuuuuauauucucauucucccucucucacuguaggaagaggaaauaauguaaaaaauaacgagcaggaagaacagaguagccacucucuuugguuauccuaacacauggcuuacaugucuuuguauagcuauucacacuuaaaucccuuuccuagcucacaacuuuuaacucaugaucuaugguucagaauuuuuauugaucucuuuguuuauaccucacuuuacuguauagacaguuaaaauucuuuucaaaaauuuuggauauauuucgaggguacaagugcaaauuucuuacaugcauauauugcacaguggugaagucugggcuuuuaaugcacccaccacccauauagugaacacugcacccaauagguaauuuuuuaacccucauucccccuccccauuucccaucuuuuggggucuccaaugucuauuauuccauguguaccccuuguuuagcucucacuaauaagugagaacaugcaguuuugacuuucuguuucugagugauuucacuuaggauaagggccuccaguuccauuuauguugcugcaaaagacaugauucauucuuuuuuaugacugaguaggcauucuauggcauauauguaccacauuuuaaaaauccaauacucuaugaaugggcacuuagguugauuccauaucuuugcuauugugaauagugccgcaauacacauacaagugcagguauguuuuugacaccgugauuucuuucccuuuagguauauauccaguagggggauugcuggaucaaauggcuguuuacagacagucuuuaaagcagauacaacuuuaugaaauuuagacgauuucuucuagauacauacuucgcaccauucaccauuuuucauacucacauggcuuuuacugaccuccucguagcccacauccaccaugguaaccuuuguuauccuggaguauggagugccaacuguaagccuggagauuucacucuuccacaucacuaccaaauaauugaaugugagcgcugccagccuggaugccaauggauccugauauucauaugucucuaugcccaaugggccuguuuuuuccucacuucugcuuucugaucuuuaaauuauuucuuauaucaaaacaaaacguuccaacuaauuucuugguaaauuauauaaucaagggauugacuugauccuuugauuacauaauuguauaaccccucgauuauaggauuuuaaaguuauuaauuucccuuuuaccugaguuauuuucucacuccuucucccaaguagaugauucauaaggguucaugagucccugucuugacuccauuguuauacaaaauauagcagaaaaacucucccaacagucaaucacuuuaauagacaauaauuauuacuuuaugaauuuuguuauuacagccaggucaucacaaugaauaaugccaguuaccuguagguguuucugggcccuggauuagaggaccuaauccuauacuaagagcuugauuuccauacgcaaaugagauuuagaaaaaaaucuagucuccaauugcccuauauuuguuguuuagguaauaggaggagaauagauugcuagcuacagcaacuccaccuaauaucuaccucucauggccacccgccucgcuucugcuccaguccuuggccuccccgcucauaguucuggucauuguugcuuuuuaaaucuggaaagaagugaaauaaaguccuaguccauagcucaacuaccugagaaggaaucuagaugccuuauacuguucacuccuuccuagaaaaaucacuaucaaaccauagucaaggguauggguuuugaggucacagcaucuuggaucuguacucugacucucccagucacugggcacaucacugaaccucuuaacccaaccuucucauauguguaaagggaucacauaccucugggggucacugcaaagaugaauuaaacauacaucuuuaauagauguuugaacaccuguauucacagucucuuccuuucuuuacguccuuugaucuuuccccuuccuauuuugucugaugauucccccagccuucugcaaacccaagucugcagugugugggagggaagaguggaggagcacaggucgggggaauuuacacuggcaagggcagaggacuccuuaugggacagaaaagagcaacagaaauagaaggaaugaaaaagggggaaagagaacuucacccuguuuugaagaguuugagggguuuggaguagaaagauuauuuuaaaggcaacucuggggugagagagauauacuaugaaagauuaaggacuuaaagcuuaauagugcaugauuguacucucuaucuucgagagaguaaaacuaggauucaaauuacuuucaggccggguggaugccuguaaucccagugcauugggaggccaaggcaggaggauggcuugaagccagaaguucaagaccaucuugggcaacauagugagacccugucucuuaaaaaaaaaaaaaaaaaaaaaaaaaaaguuaaccagacauagguguggucacgugcgccuguagucuagguagcugggugggucugagaggcugagacgggaggauggcuugagcccagcucuucaaggcugcagugagcuaugauugcgccauugcugugaccucaaaacccauacccuugacuaugguuugauagugauuuuucuaggaaggagugaucagcacaaugcaucuagauuuaagagaccuuaucucuuuaaaaaaaaaaaaaaggaaagaaaaaaauacuuucaagugcuauuggguugcuaggcuuuuguuucucugacugcauuuuuagaucaggacuggaccaagaggcagccuggcuucauauggguuaugcauuugaaucgcauaguccagugcccaauacaaagcaagcguuccaugaaugcuacucacgcucauggugauucuuuugccaguucagaagucugguucugguguuauuuccuggaggccuggccugguuaguuuggaaggaagagggaauuuuggcccagaggucagucuagcuucugucagcaccugcuccaggcccugccuugucgcuggcugaccuccauggacaccaauggcccaggcuccacaugccacuggcugcugccacccuguacggcucucuuggaaaggaaacccuugaccugaugccugucaaaaucuagccugcguuucgcccauccucccucagaccuggucauuguucugcagucucugcuugggcuuucuaagagucgguuguauuuauucccaaacucuugauccaguuacauaauuucccacugcauaaaccaauggacugugagugucaagcauaugagucauaauguuuggcauacagaaagcugcuguguguuggcuauucccggagucaaccagauaaggguugcuggaaacagcaucuccuguguguucacaagacuuacguuagaagaaaacuuuuaaucuaagcagguacccuuuuuaugacucuauucuauaaauuaaauuuuucuuuaccugaguaacuucuaguccugaguguaccaagaggauuacucuuuguuggggaauuuauuuugccuuaaguuucucacauuaaccacaaggcuucauucuauaucccauaugcugguugguuaaauuuuagcuuaacaauuaaaccaaugaagcccagcaacuuuuuuuuuuuuuuuuuuuuuuuugauggaguuuuccuccuguugcccaggcuagaguguaauggugugaucucagcucacugcaaccucugacucccggauucaagccauucuccugccucagccucugaguagcuaagauuacaggcaugcgccaccacaccggcuaauuuugcauuuuuaguagagacaggguuuuaccauguuggucaggcugguuucaaauuccugaucuuaagugaucugcccaccucagccucccaaauugcugggauuauaggcgugagccaccgugcccagccagcauuccacuauuuugaagaacuaugauuuauucuuuacugcugaauuuagccugcucuguccauuuuacuuagcuaaguacagucucaaucaaggguguagaauuggaagucuagaauuuucugugugcuccggguaugaauauuugagaaguacccccaagacccucuuugaguuuugccgcuaacuaacuguauuguuuuucccgaguuuuacuuuauuuucaauaacuguuacucauugcuuuguuauacacccagaggggcuaggcaucuaaagguguuuuacaaauugaauaagguuauguuacugucccaaaccaccaucugaaaaauauguagcauauaugugucuugguuuugaauugggcucaggaauauguuuucauuuuccuacgagccucacaagcaaacuaaggcacuaauuucuuuaaacuaaggcacuaguuucuuuaaaacuagcaaauacucgcacaacagaaaguugguacaaaauccugaauuugauguggagcuaauauaaaugaaagugcaguucguguuuucaaaucacuaacacacggagcaaggugagggcaguuucuaaucucuuugucauaauuacauaaaaggaauaguuuucucaggaaagugaacuacaaauuugguacaagugauuaugaaauugguauacacuuuuuugguaucuauuuuuuuaucuauagacuuucuuuccaacuauaaagacauguuuuaauauucuaaggggcuuaccuuuuugaaguccuuguuccuuucaaacuuuucucuuuuuaauccuccgccuccccuaaaacacaccuaaagacuuuaaauuuauugggaguuucauauauacacugaaggaaaacuagcccccacgcuuuugaaaacuuaacugcacagagcacuuuaaaacaucauucaaacaaauaacuuuuuacaacacuggagugaacaagaacguggggacaggcacaaggacugguuuguagauuggguuaacaccaaugcuuccucugguguaaaaggcuuugaucuuaagguucaugcccucggcaugcagcugugacccacaguucacaucuccuggaaggugugacaaagguagcaugggaauugggucugcauucaauuuuuacauuuccauuuaacaguuuaugauuuuauauaauauuucaguuguaugaaaaguauguaccaauuugagugauaacagauuuucuugugguuugacuugacauuguuugggugaacacagccuagaaucaggaguuuuaauuagagcuggaugagcucuggaaugccuaccaggcuuagggguuuucccaaaagaucuuaagugcccagagcugauuugaacugggaacccuucugacauucuccuguuuacaaggcauugcagugacguuguagcacucaugcacaacccaguaacaagaaaugccuuuggacuguguccgccuauggaauggcuucccaacuauuugaguuggcugggguucugcugcucuuccaacagaggcuccacugcaguuucuugcacauccagacucugagccucgguaauucauuucacaugacagcucaccaaagccgggggccucaaaacauauuuaacauuugcuggcuggagcaaaaccuuugguucuauuuggucagugaagggagucaaggggcuugccuuuauuggugucuguccuccucaaggugauaggugugugugugaucugagguccaugucugcaaaacuuggaucugcuuauuggauccagugcucuuucuguguggacauuccuaaguuuauccucuggguuuucuuccauguuucuucacgaacuuuccacuagagagcuuuaaugcccaaacagacagacaggagacucgcacauugggucuauaguauugggaguagaaaugggauauauaauagagagagcccuauugacuuucuucuaaaaaugcuagaaauggagaaugacuugaugacuggcugggucagggaauugugggacauugcucagcacccuauaucagaggaaaaggaagugauaaguuucugccugcccagggcagaagcucauggugucauuuggaauggccucaaguugcucuuggauuuuuauuccuauuaaauauaaagaauauuggcacacauaggggcuuccuacauaagaaugcuaaagaaauaauaggauaaggauggauuaaaaaaaucuauguggauaagauuguuuagaauugcauuuugcuauugguuagaucaaaguguagauggcaauucucuggaaaaaaauauucccauagauuaugcaguaaaguggcuaugaguuuaugcuuugaguucagacagucugaauuugaauccugacuucacaucuuccuaacuguaugugaccugagguaacucucucuaaaccuuaguuuucuuaucaguaaaauuaggauuuuuaauaguacuuuccuaauaagauagauaugggauuaaaugggaaacguaauguaaagugcucaugcuaugugccccuaaauuauaguuguuauuauuauuacucuuguuauauugacuuggagacuguuguugaccagaggcauuaauauuugcuguuagcucauuuucucugcuacaguuccuguuggacugauccaaauaagcaauuuuaaucuaguuacauugaaaauuaauacauuaacauaagguucauggugucccguuagauagucaaaaacaaaagucaaggcauuagaacuaacacaucucuauguucauaaaaauaguucaggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgagguggcgggcgccuguagucccagcuacucgggaggcugaggcaggagaauggcgugaaccccagggggcggagccugcagugagccgagauugcgccacugcacuccagccugggcgacagcgagacuccgucucaaaaaaaaaaaaaaaaaaaaaaaaaaaaauaguucaauaaguucuuauucaaauuacuguuuucucuuguaucagucucuagucuaggagaacaucaaauccugcuauggauugaauuuuguccccuucuaaacucaugcugaaacuuaauugacauuguaacaguauuaagaaguggggccuuuaagaagugaauaagaccugagggcucugcccuuaugaacggauuaaugcuguuacagggggguugggcuccuaauaaauggguaaguuuggcccccaucugcucucugucucauguacuugcuuccaccuacugcccuucugccauggaaugacccuugacagaugcuggugccaugcucuugaacuucccagccucuagaacugugagaaauaauuuuuuuuccucauaaauuacccagucuauauucuguuauagcagcagaaaauggacuaaaaccccacagguaagcaaagacaugaauuaaauuaucuagaacgauccauagaucucuuuauuugaaacaauccauagguuuccuccagacuguaagaaaauugcccucuugauauaaacucugaauauagugccugcauuuaacuuggguucucucccauuggcaugagauugaaaaucuguuggcugucuguauucuguuguuagauccauuuucugagagacuauuuggaaauagauuucuuggggaaagguuguauguauaaaauagucaaacaguggaacaagcuggauuuuacugagauuuccccagaauuuuaagucuccagcccugaccugaacucuagacuauucagcuuccuacuugacaucuccacuuggauauaaaaaugacaccucaaaagggacagagcugaacuccuaauccuccccuuucaaaccuuauuucccacagccuccccuacucagcugaugccaacucaucucucuaguugcuugggcugaaaaucuugguguauccuugacuccucucuuucucucauagcccuuauccaagccaugaacaaaauuuguuggcuuuaccuucaaaauaaacccagaaucuguccugacaucuucccauuaccaucacuggucugagccacuacuaucucuugaacugaauuuaaugauuaggccaaguucucaauacgcaaaaagaucuggagcugacuuuaaaggugcagccuagcgaaaacaaaaaugcucagauucagaauguaauaaaaccuuucuuucucuucaaggggagacagcagagaagagaaaagacaacuuagugaucugggaggaugguagccuccuuuagaaauggccaugagucuuuuuaagaacugacaugccuaauacugaacucagaaguugcuggaauugcugcaauguauauguccuuccaucacuucaaaacuuugacuacuucugcuuuguacacaaugaccuuaugaaaauguuuugguuugguuguugucuucaugacuaagcuauuaaugaggaggacagguaaaaaggguugaguuccaaaucuaggucagcuccacauaggauagggacaacagguacaggaacaagacaauccauagccuggauaagguuaucagaagcuggagaugucuguggcaauauuuggaauccuuuacaaauuagacuuugccuagggcauggaaagcagaaagagacuugagccaauguuuccuacacaauaaguggaacaguagcccuuguuaacaccugagcuacugaaucuguuuuucuaauauaugaauaaaaucauaacugaaaaugacaccucauccucauagaaaacaaacaagacaaaaauauuuuccuccaagcaccucgccucuaacuucagaccuugaccuccucaacuccauugaucuucacuucaauuccacauuaauuaaucaaccauuauuauggucauacccggaccuuaguaauaccagugacugcuucaucucugccucucguugcugucuaucagaaauuccagguucuggaggacgcagaaugggaucaagaacaucaagaggcacugaucuaccagugcagucucccugcucugguccaccaugacaccugcuuuucugucaccagguuugacucucuguucucuaucauucuucuccuauagugauauuacaaauugaaauccuggcucucaaccaggcuuccggaucauguacauccauugcagcaauggcacacacauuaugaucucuaauuuccaucggcucuccguguugcccggucauccacccaggugucucucucaucaacuuucuccacagcagcuauuuaaaaccggcuccacucuccucaaauuaccuaacccaccacuucaguucccucacucucaagcauaugucuuugccuccuacuugguggggaaaauagaaaucacgaaaagggaaguggcccaacucacugccaccacacgcacagauucccgcugcaagugcacccguccuuuccuccucccaucugucauguggaagaggugucuccuccugcccaggcucaucuccuugcccucaugcucugcauccuccugccucccucuccacauccucuggaagcugacugcgccauuaaccccccucuuuccgguauuuucacugccucuuucacccuccuuccugcucuugccaauuaacauuuaaacauaucugcuaucucagaacagaaacauaacaaacaauggaaaaccaccaagaccuccuuuaccuccccuuccagcuagcauccucacucuccagcuaccacuuuccagcuaacauccucacucuccuucucagccaaacuuuuccaagggugaccuccacuugcugccccuauuuccucacuucuuauucaaggccauucguaaucgcuuugcuaugcauccaggggacacuuuugguucuugucuuacauuacuuuucaauaacacuugucccauuggucaugcucuugugcuuaaaauauucucuucucuugacuuugugaaaauaacacuuuccugauuguuuguuaguauuuucaccucuuuaauauuuaauugcuucuuuccaggaaucccuuucuuaacccauuaugauaugacucaggacaucaugguauguccuucaaccucauuuuuuugucuauacacccuccaaaggaaaugucauucacucucauuauuucaugaacuacugcucucaaaucuguguuuuuaaggacauauauacauagcagacacacacauacacacacacacacuauauauauauauauauauauauauauauauauuccauguuucugcuuuaaguuuuccaagauguucaaagccauugugucccaaaugagcucucauuuccccccacaagcagauuucuucucuccuccuuaaauccugcuguccaagucagacauuuagacaucaucacucugcccucuuccccaggcaucacauccaaaaugucacaaacuccucuuguuuuuacuugucaauuaucucuugaauccacccauuucucuucaucuccagggauaucauuuuaguugcaaccaccauucucucucccuggacgacugccuaacucaucuuccagccccguucccauccauucucaaaccagaguaacuucuaaagggucaauaggacccacugauucuccagcucaaaauauuuuaauggcuccccaaugucaaauuuuaauuccccagaaagguucacagggucuucggcaggcuccagugauauuguccccuucuguucaucuuuagcuucucuucuuuuuucugugacuauauauuacuugugcuacuuuaaaaguucuagcaagcggauuggccagaaggagaugcagaggagauaaggagucaucagagaggaaggggagaaccaggaggccaugaaaucauagaaaccagugaaaggcaacacuuuaaggaaauggggaugucaauauuauaguaugccucggggagguuaaauuccaugaaagaugaaaacagucccuuggauucugacauuugaaaauccuagggaucauugauagggacaucucugaaguuucuaaggcaaaagucagaagacagugagcugaagagcuaggagcagcuggggcaaggaggcucuugagagaaugcuacuucccugauaugaugauuuccccagugggugugaucaacugauagggaguuaggagaugagcaaguagggaaaggaagauuaaggcuaaauaugcagaagugagagggaauagucagugucagaacuuccagcuucuggagaagucaaaaugagaucaccauuacggaggaugggaaaggccgggagaaggaauauucaaagaccagaaggaagaugauuagacugaagguaacuacagguaaguuuguaggugugggacaggaaguugagguauuuucuggcuuuuacuucauuuucuuaaauaucaaaggcaaauccaucugaguaauaucccuacuuaaugcagacauaugguuauguucauaauuuaacaaggaaauauuuuuaaagcaauaaaagauaugcaccauuuauuagaaaacaauuaccuugauuauauaaagaagcuuuccaugaaauaauuuuguuuugguuuauaacuuuacucuaggaaaugcuaagaauuuguguaaucugcugcaaaacugucaaaucuuaccaaguaagaaaaauucaaaauuguuuaauauaagaaaaaagccaaacugagaauucucuaaauuauacccauauuaaaaaugaauaauuaguuccacaguauuccuuaacauuagaaaaaguauaaguuccuaauguuauguuugccuuuauauguaucugucuuccaaaaugggcacauuauuagaagaaauucgaaaccaaagacaagccaauauuuaaaauacaugaugggauauagaauucaucccucauguggauaaaauuagaacagauauuauccagaagagaugaagccagagaauuaaaaaggaaaaaaaaagaaacaaaauccuuuuguuaagcuauuuuccuaauuuuauuuugauuuugguucagcguucaaaagcagauuaauauagaaaaaauaaaguacagggcuggaaagaagagcacaauuuuucuucuucgaugucaaauaaauagcuuucccugcuccuacuaaaucggaacuaaacucauaaagaugaaaauaaaugacuaauuucuugggaaauaaccuuaagugaaagauucuuuugguccaguaauugcuuuuuucaaacucccguugacuuaaccucauucucaaggccuccuuggccuuuccuuccauuuacccuguugauaucaaguguaucuucagagucugucuugucauuugcuaccaauuugaggaauguuuuccuugucucauauaauuuuuggaaggcauaugucaaaugugguuguuauuucuuuuuuauaacuuauuucuaacaggacuugucuaagaccuuuaaaaaugaaaccuaaaacauauuaucguaaaauuucacaaagcaauguuucuacccacucugaaaaagcccccuaauaauccccuaacauuuuaauaagcaacuagauauuaauuugucuuuuugcuaaaauguuauaaaaugaugcuuuucaauuucaucuauauaagaacuucacauuucagugaaagaaacugaaugaguuuuagaacagaauaauacuucuuccucucuggcaaagacuguguucauuucagagcccaucuuacaugauuuuugccaacuuagguuuucagagcuucaggacuggcccuaagcaagguauucaggcaguaauuaaaaaaaaaaaaauguaagcaguggaacccauuucuuuuuucccccagacaaaacuuaauucuucuaugaaauccacauauaugugaacauacauauguaggauaaaauggaacgucugaacagaaaguagggcacaggaugguggaacuuagcuguuccuucuugcuccccauagagauccuugaaguaccuucuccaacuccaugauacucuaaaaacuguucaucuucauaauaggaguggagccuaauccuuggucuccucaccuccugguuucccggaaugucuuucucaccacauaacaccuccccuugcugcucacuccuaccuggugacaguagccuccucauguuccauucauuccacacaaaucugcucaaucugcacuuacucuucuaacaauugccccaaaccacugcaccauagucccugaagcucucauucucucauucugagagucucaacucgauacuuggaagaacacaguuuaaacacaugccuaccgaguuuuauguggcugauagauagccuugcuuaaucuucccagauuuaaaauguguguuuacaaauuuuagagaagagaguuuuucagccaaaucuuuaacuuaugaaauuucaaauuauguggcaauaucauacgugcauuucaggcagccuagugaaacaguucuauuuaggaaggucuccauugggggcccccuaaaaugauacaugaagagcauaauuuuuauguuauacugacucgucugaauauucucccuggagcacuggaguggauuguaucucuaagccuuuuccaggaccaacccagaguuccugauggagauucaauaaagucauuccuucaauacugaucuuacuuuaauaucaguuuggaucuggggcacugaaauggcuuauucaugccaauacuuauuuuguguuaauauggcugucuucagugcacaucuuauacuucuggcaagauucuuuaaauaauuguuuuucucuaguacaucuuuuggauaaguuuggcagguggacagguccuuuuuccuuuguucuaucagguagagauacugcugaucagcugagaugugauguuaaaggcaccaugagaaaaacacaguccagcccuggaggaguggaugggggagggaagaggcaugaggagggaucuggaggccaacggcccaggagacagugcucccagaaguccaucugccuugugcuuggaugcauccuuaccucugcagauaaugcuaccucggccugcaacacugauggacucugaucuaucagaacaauuccuuguucuuuuuugauacuaauucaaaugcucuaugaauuggaggcaacauuuauaaaauauuaaaucuguacauuuuuucaucaucaccgaaaacgacauuccccugcccaaauccaccguuauagacccaggaaaggcagaggggcuagagaaccuucaagaaggaaaaggacaauaggaaccauagcuaacacuuccacagugagugcuuaccauguaucaggcacuacucaaagugccuuauaagauacugauucauuugaaguucucagcaaaccuagcuaaauuuuauuauuaacguuccaauguagagaugaggaaaccauggcauagaaagauuaagcaacuugcccaaaguugcagaucuuggcaaagucaggauuugaacccaagcccuagauuccaugcucuuaucugccauacagauggccucccuuggcguacgugcccacacagaggcagcuggccuggccucauucuuggaugccugggguuggcauuuucugaggcauagcugguccucucuggcccuuuggccaucaugcucauacucuguagucccagcugugugucuuuauguuugcaguuguucuacucaauggagccuguuuguuucugcaaacccucccuguggguccauggguauauguggcuccccucuccccugcaugccauaugcagucugugagggcaccaggaccuaccugagggucacccuucuaggugccugccuugacccacagugcaucauugcuccugcacaacauuggacucacagucaagcauauucggggcuuccccugaaggcuggaccacauacuuucaucuuuguaucuucaggggcuaacacagagguaacucaauaaacaguauuuugaaguucagaugcuuggcguauuucagcugcagcaacgaaugaggcugagaagauuuaaaaaccacuccucggaaccuuucacugauuucaacucagaauccuuaaaacauauccuugaauaauucucugguacacaaugaaacuuauuaaucacucuuuugccuggacacaaugucucugggucucucugguuugauguuucucacaccuuacuuguacacagacuugauuuuaucacgcaugcccucuuucaaauaccuuuagcuucuucaauaagauuauuccuagugccaacccuagaagcauacuguccaggaauaugucacaugcugcuagcugacuacuuucucucuugucccuuguaucgcagccagguucucuaauuauccacaagcucaacuuuccccccacccauguuguucacacacacacacagacacacacacacacacauuucuuuucaauuacuuugguauagaacuuugucaaaaacauccuggaaaucuacauaaugaucuggcgggcuccuuuugguguuacugguuagcacauuucaugaauuaccagagcacacgugaccaggaaugcuacuuuucuccuuaaacguuauugcucaacacauauggcaaaaggacuuaauguugcauuucagcaggauacacucacaauggguauccuauuuaucauggucccaugcuauacuaaagcucucguggguuagaacuaaacaucucuuuuucagcauaucauuuuacugugaccuaagcagcuacugagaaaauuauccgacuuaucaugaaaagaauaaguaauaggaauaauuuuuuucaaauuauuuuaguaaagucgaaggauauaugaggaaagcaucagugcaauauggcuuuuccaacuuggcaggggcagguggaaucugugaugaaauuguuaccuuaagagauuggcuuucccccuugccuggccgugcuuuuugaaguuuuucauauaccacaaaauacauaaugaaggguaguucaauuuacucugaaccccagcuauauggccaugacauauuuagaggugacucugggaugcauucucaaauacagugcaugcuuucuaaauuuacagucugauuuauugcugccaguuaugacugccaaaugcuucugacaguguggccaguuuguggugucccuaaaaaucaucagcaauuugaaaacauuagcacccggcaauagucguacuucgcaaugauugccuguauuuaucaccuuacuuuuccaggguacaaacugaaaaaaaaaaucaaggaggaaaauuaaacuucucuagcagcacggaaaauacagcauuggaaauaaaaugcaucguaggaacucagccccucccuguauucuuuaaaaauuaaaauaaacaauuuaaacucuguggcuuauguggcuacguagaagaaaaauauuguaaguauguaucucuccucaaauacuuuuuauuuugucuucacauuugaagaguauuuugauauuaggauauuaugguuaugugugggacaaaaaauuggggaaaauaguucauugcuucauucaacaaauaucugcuauguucugcucuguggcaggcacugaacuaguuccuggaaaugcaggaguagacaagaaaggcuugacuuccauaggggucuugcaguuuacugagaugcacaauuauguuguuacaauugggaagaagagacgugcaaguccugggcgacuacagacagcaagguaaagguacaccucccugaagaacaagagcaaaucugaaaccugaaagaugguuaugaacaaagcacuguguaacauggggauugggagaacauuccaagccgagaaaggacagcggugaagguuccacauggcgccaccuuacagggauuugcagugugugcagcaccaaggugcuggccagaaggugagugacauccaggcccugcucugcucuccagcuuggacaucccggugugucacugacaacccaccaaaggacacaaaaguagcagaugauugccaagacaaguccuaugaaugcauugauuugaguccaggauaaacuguuuuaaccuaaaaacucuaaaauguagugauugaaauaaucuaggagguuguuuucccuggcguaacauuauacgugcauguggucuagggcugguagcaucgcucugccacuuucauuguguuggccaaucucaaugaguccaaagcugcuccaaaggcgcuaucccuuggccuucuggaauagacauacaacccgugacaccacaggcaucccuuacauagggcaagaaacacaaacagcaugcaucauuucucacuucccauuggugauaaccuaaucaucacacggccacaccaagacucaagggaagcugagaagcaucuucucuggcuggcugccaugugcuaucaucaaagaggggaggaugaagguugguggacauccaggggacugugcuacgaggaaggauggugggggcaaggagugagauaacgauggagaggcaggcagggggcagaucgugaaagggcuuguuuaaagcaaagggaagccaugcuaguguuuucaaaagagcagugacagauuuauggguaucugcuugcagaaaaggcuauuacagagaaggcuugauuaggguaaauacaagcugagguuuccuagugauucucucuuuuaauucucagauguccuuguuuaccaacagcccaaauucugcaugcagaacacaccuaagucauagagucuccaaagaaauugccuggaagcuccgauuuuaauggaaaguuuuucuguaguuguggauggaaaccugagcuauccuauauuaugcagcucuacacugucagugaccuugugauguggcucugaguuuucacaaggucacccaggcccgacagaacacacaaccgaaggcgcagggguugcggcacagcacauccguacuuguagacaucgcguggcccugcguccuggcagggcagggcagagaacaaaaccacucucaaggccggcacagucccaccagcaggcccuuggaggagcgucaaauccugccacagacacaggacccaucuacauggcuucuuggcccugaggagaugggcugcugaagccagcaccuccaauucugucuauaguggaaaacagagaggcugaggacugaauaccugcugucugaguugguucaauguacaggaacgggacuuuaauucagggaggugagaugugagaaagagcaacuucgaaagucacccaucucacaccuguagccugaacuugacaauucuacuccuauaacaacaacaaccgcugcagcaacauucagauacacccacugugaggcagguguguucucucucucucuguacaguugaugucugaaaaaugugaguuagggcaccacgcccucauacagucaaaaacccacauauaacuuuugacugcccccaaucuuaaggacugauagccuacuguugcucagaagccuuaacaauaacauaaacagucgaucaacaccuaguuuguauaucauguauauuauauacuguauucuuaaaauaagagaaguuuaacagagaauaaaauguuaugcagaaagucauaaggaagaaacagccuguccaacauggcgaaacacugucuguacuaaaaauacaaaaauuagcugggcaugguggcaggcacugguaaccccagcuaccucgggaggcugaggcaggagaaucacuugaacccgggaggcagggguggcagugagccgagauugcaccacugcacuccagccugggugacaagagugaaaaucccaucaaaaaaaaaaaaaggaaaagaaaaucauaaggaagagaaaauacauuuacuauacauuaaguggaaguggaucaucauaaaggucuucauccucgucaucuucccguugaguagccugaagaggaggaagaggaagagggguuggucuugcugucucagggguggcagagucagaaggaaaucugcauaaaauuggauccaugcacuucaaacucaugcuguucaagggucaacuguauauauauucaguacauauacacaguugaauacauaugcauguauauguguguguauauagaaagguauuucaucuuuccuauaacucuuugaggaaaauauuaucauccucauagaacugauaaggacacagagaccaguggugcugggugacuuggcagcagaacucagggccagaauccaaacccagaucugcuaacaccaaacacacacucauuucccugcauccugucuuuuuuacgucauuaaauaaaaaagauuuaucaguuuucuaaacuugaucaaugagagaguuuggggacaucuuccuaaauuauacuaauauguaaacauaucuauaccaucuaaaaugauuuuuugcaaaacucaucuaaauuugcaaacaagucacugcuauauccuauaaaaaguacauuagaaaccucugauguuccaacucuugaaaaauggccuguggcagcuuuagggccuaugagcuugcaggguucuuaccuuuaugguugacucucaaaucauuaguuuuaugguaggacauaauuucuuuaggauuucaaggaauacgaaaaauacacuuaagccauauuagugguuuugacuuaauuaauuauaauaauuacuaucaauugauugauuaauaauguugguuaaucaauuguuaauuucauugaauaauuaucagagcaaaaacuugaaaugguguugaaacacagaggacuuauuucauaaacaucaaaccuaaagaguauagcucagcaguucacgacuaagccucaaagauauaaaucaggauuuucccuggcuuugcagggaaugucgcuuaagucaggcucuugaguugccuuuccagauccuaaacugcccaccgugaggauuucugggacucguaggaguguaacugaagacaaauucugaugcaagaaaggucauauucauccugagggaaaauuuguuguccacacaauuccaccguuaaaagacaccagcaucucggcugccucucugggucacagcaaggaugcucccaccccugucugugcugcccugugaccacauggucccguacuggucacucagagugagaccuaucgugggggccauccuggccacacaucuuagaugaguguuucuacacuucuuugauaaagacaguuaauucccaaggagguuuuuguuuuuacuucucuguaugcaaaauggaaugaaugaaaauaucagguugacguucuggcaagucauuuccuaggcaagugaucaucuaagaaaaaauaccuuagaaacuuauuuucacagaaauuugaucagguuuccacaaucagaaaaucaugggucuagagaaaauaucagcguuuucagucauuaguguguauauuuuauguucuuauaauaagcagagguauaaauacagacuaaggcaucaaacugaaugaugguuuucacugcuguaaauggaacauuagggugcuuuucuaauucccucucucugccaggauuaaaauuuaaacgugggucauaaagaacgacaaaauaaacuuuauaaauauuucucuuacuuuugcucauggguaaacaaagacguagagaaucaaguguuuauucccacaaguguauuguaaaugaacacagcauccgcaagcccugacuugucaaccauaaggauaagccauugugguccaucacuccuaaagacaauaguuguucugacugaaaucugcauaagguguaauaaauuugauuuuuaauguaacuuuuuuuuagcuccuguacuuuuauuuccgaagacauuucaguaagugacaucuuaccccacggcgauggauugggaaacacagagaacaaagauccuaagaaucuaagauuuuuguauuuuuuuaaauaacaaaaauggauuaauccugaagaaacugaaaaaaaaggagucuuaggagggaauauuaaugcgagcauauuuuuggcacauuaaaaacuccaacguacuaauucaagcacuguuuacuuuuuguauuuaacaggauugcuguuuucaagggaaaaaacaagauauuuucugagugccaaaaacuacuuacucaugaagucugaaauaccauuauuaguaguaguaauucuuacauuuagcaucugugaauaacuucuuauacgagaacacuauuuugggucagcugaaggcuaaaaauaaugaguuggcuuucugccuuuguguauugagucaaauagcugccaauuaauauaauggauuuuuuuccugugauaaauuucagaaagugagaacaaauaguuguugguguuucauaauuuccaauggaaagaauauauuucucacaaguuuaaagacugacugcacucuaaguaaccaaacaauuacaagaagcugccgguguauuucugugguuuagcaaaagggccaagucggaaggaaaagacauucccagcauuuucuaaagcuagauaaauacagaaacgaaauauagaugaaagauggaacugcucucuauagcaucugccagauuccucgacuuuuuggcacacugauugaauuuggcaaagguacccaguagcaaucuuuuccauuaaaaggagcagcauauacuuuauuuuaccauacuguuuguguauuuuugacccuccaaaacucucuuuuuuagaaggcaauuauuucuacagaguuggcugcaauuauuugaaacggaucuuuuaucaacaaaaaaagcugcgggacauagcuacuguugaacagauccaaggaccuacaggucgucaggaaagcgucuuucuuugaaaccaaaagaugcuucaacaugugccagcaucaucuuaugccaaucuaacgcuuuugauauccaaaccuauuuaaauuuggaggaauccuggacuguucaauuuaggcaagauaagcuacccagcucugucguuuucuucuauuugugaucagaaaaacuguaacguaguccaacauuccuaauuuugguaacaugaugauguuaagaaaaggaauaacucucccguccaaaaucaaauuuuuguggaauccaauacuucuuaacccugaauuuuuuucugagcuggcagugauucuauaguaaacuucugaagauauauaaguaacaaucucuaaaaauaugacacgcggcagcaaguaugaaggcaauggcuucuggcuucacucaacucaggaaagagaggcucacaccugauaagcuuuuuacguaacucagagggaaaugacuuuuuguuuucagauuuuauuaguuucuucuaaaccaaacaaaagcaaaagaugagggguguucaccuguugcuaugaaguuuuugagugcaacauuauggucagauauuugguuuuuaaacagccccaaauugaggccuaccguauagcugacagugacuuggaaauauuauuguuacuaauguuauuugccaucuagugcacuuucuuaaucauuaaguagcagcuaauuuaaagcaguggaagaguauuagcuucaugugagcgccagaaaaacgcugugguuuaaacauaaaguugggagccaacagcgacagauauaacauauaaagauguauaauuugccaaguuuaaaauccccaaaccaacaugggaaugcuucacagguuuauaugugcauaaagugaagacuguuuugcacagauuuaaaauggugaaggagcguaucuuuucuuaaacucagguugacaguauaauaguacaccuccuauaaucacaaaguauuugacaaaaaagagucaacuguuauucuguuuaaauuucaggaugcuaaauccauaccagcaguuggcaguagcugagucuggaauauuuucaaaaauauuauaaauaauuaccuuucacauuaauaauuuacaucgauuuaacucacaaagcuugccuuaugaaagaguucuuuaauaaaaauaaaacaauaauaauaaauaaaaccagccaaagcugucagcaagaauuugucauuuucacaacugagguaaaauauucuacaaguuaaauauuggguaaaaugcccucuguacauuuuuuucuauuuuuauugaucuauuuguacauauuuacguacaucuuuaaaacaacugcaauaacaaccucauaauaaaagcauauauuugacucuaaaacagccuaaauaacagugugacaaaagauagugaauaucaacugaccuaagaauuucucaugucaguugguucagaaauuuaaauucugaguugucacuuucgugcacaucuuuuggagugccuucccagcacaucaugaacgcccuugacugccuuuguguuccaccuccaauggcaagucuuggaagccaucuuguaaaguaucacaugcuucauuguccaccacugauuggacaaggggguggguacuuuucuuaaacugggccaaucagcuucccuugucugagauuuuugaacugaaaauggggguggagaaaauauguggccuccuuggguggcuggauaccuagauccaggagaagcaguaaagaaaacaguggcaaaagagaggaagccaacuggcauagaaagaauaaaaggaaacaaauaagaaaaguggagagauggcaguuggaaaaaagaugcuaaaggcuuuggagcucagcgccuucuuagggcucugcugcuuucuugcccaugggaauucucuuuggugcauaaguuugaguuaugaaguaauuuauugauuuauagcagauccugcauugcaucuguaggacuuuggaugcaucagacugucgagcuaaagcuucccagucuuuaaaaugggagaguaaugccugcaccacagggguacagugaagauuaaaugaaauaaggaauaaagcacauaggccacgggugaaugcucaguaauugauuguuauucuuuuuaaaauagaucaaccugaaauacacauuuuguaacauauauaugagcuauuuauauugacuauuugcuaguguaauuauuaagccuaauauucuaauauuggauaauuauucacuuaauggguacuccaaguuaucuaaugaaauuuaaaauaaaaaugggcuugcuagcaacuguuauuacuaugauuauuucccucuuugugguagaaaaaagguuugugaauggauucuuaauucuuccuguucccuuaaucucucauccaaucuguaacuaagccaccauuucucaugcgcuuacagcucaccagccucguagacagaucagcuuccaguuuuucuuuucuuucccuucuuuuuucuuauuuuuauuuuuuuuucggagucuugcucugucaccuaggcuggagugcaguggugcgaucucagcucacugcaaccuccaccucccagguucaagcaauucuccugcuucggccuccugaguagcugggauuacaggugcccgccaccaugcccggcuaauuuuuguauuuuuaguaaagacgggguuucaccauguuggccaggcuggucuugaaauccugaccucaggugaucugccugccucggccucccaaacugcugggauuacagguaugagccaccaccccggcagaucugcuuccagucuuucugauccugucccuauacaccuccaagagugaucaucuuuuuuuguuuguuuuuuguuuagagaaaggaucuugcucugucauucaggcuggaguaugguagugcauucacagcucacugcagccucgaccucccaggcuaaagugauccucccaccugagccuccugaguagcugggacuacagguaugcaccaccaugccuggcuuauuuauuuuuauuuuuuguggagauagggucucccuauguugcccaggcuaguccucagaaauuuuaggcacauuccuacccuauggccgcugaacaaacacuuucccucuggcugcaaauucuucuccucacuucauucuccuuaguuaagaugcaucucuucaaagaugccuucucugacuucccuguauaaaauggguugucccuucauuagucuucauuugacccccuuuguuuccuuuacagcauucagcacacuugguaauuauuuuguccauuuacauguuuuugacccgucucuucuuaaaugguugagaggguuaugcgagccuugggcuugcucucucuuccugaauucuggggauggugaauagaaggacagguccugcccauguggagaaucucuacacuguaucuuuauuucauuucuuugaaaaaagggugcccuugugaagaaugucauuuucuggauagacacuaagcauacaugaucauucuugaccaaacuuuucaagagauugugccuccaauuagcaauacauauuuuccucugauuacaauaaauuaacaagcaauauaugggaauggaguggauaacuauuuuucacaaauaguuaucaaucuucuaccauuugaaagauuaauuuauuaaacagaaaauucaaaaacauauaaaugucuuuaagaacauucuauaaagccaugggccauguccagaucaacuaaaaguagaagccaaaaauaauuccccacaguaaaaucuuuaaauuuaaauaugcugaaagaaaaagucaagucagaugauugauuaaaauucugaacaaacaaaauauuuauccagguuuuauaucugaacccucaucuggcaugaaaucaauggaguaaaaauaauaauuuaauaauaauuacuaaagcuaauuauacauauacccuuugauccagcaauucugcuccugggcauauacucaacaucaaucagugcuuauaugcaccaaaacacauguccagaaugcucauagcagcacuauuuuuaauagacucuuuuaauauauagaggauccuaaaacaaaagauucauguucaaauuauccuucauaaauuucucaagauguuggauaagugcuguaugauuuguaaagaaugucugugauuacauuuaaggccacauguuauauauucccuagaauaaacuggaaacuuuuaucuaaaauaaauuagaaaaccauaucuggaacaaauuagaaacuggugucauaguuuauuuuuuuaaaaaauaagcugaagcuguuuacuguggaguacaaagucuuaaaauaaaaacagccuaucugcaacaaaucugugcaugaaaaucuugaagguuuagaaaagaucgagcugaaucaauaguaauguacaaaccauuccagugaucuauaaaaauauacaaagcuugaaugcaauuguagcggaugguguaguguaccacccagcauaacuggguaaaaaagcaacuggcugaugcagaguggcucuacauauuccugauuaccugagagguaacuguaaaacuuagcacugagggccgggcaugguggcucacgccuguaauuccagcacuuugggaagccaaggcagguggaucauuuaaggucaggaguuugagaccaggcugaccaacaugaugaaacaccaccuauacuaaaaauagaaaaaaauuagcugggugugguggcaugugccuguaaucccagcuacuugggaggcugaggcagaagaauugcuugaaccugggaggcacagaugcaaugagccgagaucacaccauugcacuccugccugggugacagagcaauacucugucucaaaaaaaaacaaaacaaaaaacuuagcacugaaaauuaggaauauuaauagucugaagaugcaauauacauaaagauuuguuuuuucaaaaaaucacaaagaaucugguuuaaacuugauauacuauaaccacuacuagcaacaauguuuaauucugcccaacaugcucacaccuguaaucccagcacuuugggaagcugaggucggaggauugcuugaggcugaguucaagacugaccugggcaacacagcaaguucccaucucuacaaacaauaaaaaaauuagccagguaugcugacaugcaccugcagucccagcuacuggggaggccgaggcagacagaccacuugacaggaguuagaggcuucagugagcuaugaucgugccacuguacuccaacuuggacaacagagcaagacccugucucaaaccaaaaaaaagaauaauuggcauaaauuaagaauauauaccagcugcaagagcagcaaaggagguuggaaaauugcuaaaacugaaaagagaaauggagcccuugggauggauuuucaaaagaggaugugggaguucuaacaggaagggcagacaucauuccaccaugaagcaagcaaacucucugccaaguccccuuccuuuuugugcucuagccuauaaagcagaguuucucaaccaggcucaguccuucagaaaaaacugcaagcauaggaguccacacauauaugugcaucuggcacuugagcaauaccuuccaauggugguucagagaggagccucuaaacccacgcuccuugaguccuuuucuuaugaccugggugauuuggggcaaguuauuuaaucuuuaugaaacucaauuucuuuaucuguaaaacuaagauaauaaguuuccaacucaauagguuauggagaagauugaauaaaagacucuguguaaaugugcuuuuagaauaaaugucuggcacacaggaagcugaaaaaacaaaaacgauaugacuuccauuauuaucuagcucuuuuacuauacuuagcuuuucuuuuucauuucuucucacuuguagcucuaagaaggggaggaaaauuuauuuggcuagcgauggggugguggcgaaggaguuggauuugacuuagcagaagcaagguggauccauuauagugaagcagagcuuggaugaagaagacaagcagucuauuagcucagccccuucuaggcacauucaauuuuucccaagugcuccuggauauuuuagaagucagcugaaucagcaaggcaggccaacauucaaauucaggaaauacagagaacaccacaaagauacuccucgaaaagagcaacuccaagacacauaauugucagauucaccaaaguugaaaugaaggaaaaaggaaaaaauguuaagugcagccagagagaaacaguggguuacacacaaagggaagcccaucagacuaacagaggaucucuuggcagaaacuauacaagccagaagagagugggggcugauauucaacauucuuaaagaaaagaauuuucaacccagaauuucauagccagccaaacuaagcuucauaagugaaggagaaauaaaauccuuuacagauaagcaaaugcugagagauuuugucaccaccaggccugcccuaaaagagcuccugaaggaagcacuaaacauggaaaggaacagcugguaccagccacugcaaaaacaugccaaaauguaaagaccaucgaugcuaggaagaaacugcaucaacuaacaagcaaaagaaccagcuaacaucacaaugacaggaucaaauucacacauagcaauauuaacuuuaaauguaaaugggcuaaaugcuccaauuaaaagacacagacugacaaauuggaugaagagucaggacccauuagugugcuguauucgggagacccaucucaugugcagagacacacauaggaucaaaauaaagguauggaggaagaccuaccaagcaaauggaaaacaaaaaaaggcaggaguugcaauccuagucucugauaaaacagacuuuuaaaccaacaaauaucaaaagagacaaagaaggccauuacaugaugguaaagggaucaauucaacaagaagagcuaacuauccuaaauauauaugcacccaauacaggagcacccagauucauaaagcaaguccuuagagacuuacaaagagacuuaggcucccacacaauaauaaugggagacuuuaacaccccacugucaacauuagacagaccaaugagacagaaaguuaacaaagauauccaggaauugaacucagcucugcaccaaguggaccuaauagacauccacagaacucuccaccccaaaucaacagaauaugcauucuucucagcaccacaucguacuuauuccaaaauugaccacauaguuggaaguaaagcacuccucagcaaauguaaaagaacagaaauuauaacgaacugucucucagaccacagugcaaucaaacuagaacucaggauuaagaaacucacucaaaaccgcucaacuacauggaaacugaacaaccugcuccugaaugacuacuggguacauaaugaaaugaaggcagaaauaaagauguucuuugaaaacaaugagaacaaagacacaacauaccagaaucucugggacacauuuaaagcaguguguagagggaaauuuauagcacuaaaugcccacaagagaaagcaggaaagaucuaaaauugacacccuaacaucacaauugaaagaacuagagaagcaggagcaaacacauucaaaagcuagcagaaggcaagaaauaacuaagaucagagcagaacugaaggagauagagacacaaaaaacccuucaaaaaaucaaugaauccaggaguugguuuuuugaaaagaucaacaaaauugauagaccacuagcgagacuaauaaagaagaaaagagagaagaaucaaauagacgcaauaaaaaaugacaaaggggauaucaccaccgaucccacagaaauacaaacuaccaucagagaauacuauaaacaccuccacacaaauaaacuagaaaaucuagaagaaauggauaaauuccuggacacauacacccucccaagacuaaaccaggaagaaguugaaucccucaauagaucaauuguugcucugaaauugaggcaacaauuaauagccuaccaaccaaaaaaauuccaggaucagauggauucacagccaaauucuaccagaaguacaaggaggagcggggaccauuccuucugaaacuauuccaaucaauagaaaaagagggaauccucccuaacucauuuuaugaggccagcaucauccugauaccaaagccuggcagagacacagaaaaaaaagagaauuuuagaccaauaucccugaugaacauugaugcaaaaauccucaauaaaauacuggcaaacugaauccagcagcaacucaaaaagcuuauccacuaugaucaagugggcuucaucacugggaugcaaggcuuguucaacauacgcaaaucaauaaacguaauccagcauauaaacagaaccaaagacaaaaaccacaugauuaucucaauagaugcagaaaaggccuuugacaaaauucaacagcacuucaugcuaaaaacucucaauaaauuagguaucgaugggacguaucucaaaauaauaagagcuauuuaugacauacccacagccaauaucauccugaaugggcaaaaaugaagcauucccuuugaaaacuggcacaagacagggaugcccucucucaccccugcuauucaacauaguguuggaaguucuggccagggcaaucaggcaggagaaagaaauaaaggguauucaauuaggaaaagaggaagucaaauugucccuguuugcagaugacaugauuguguaucuagaaagccccaggucucagcccaaaaucuccuuaagcugagaagcaacuucagcaaagucucaggauacaaaaucaaugugcagaaaucacaagcauucuuauacaccaauaacagacaaacagagagccaaaucaugagugaacucccauucacaauugcuucaaagagaauaaaauaccuagggauccaacuuacaagggaugugaagguacucuucaaggagaacuacaaaccacugcucaacaaaauaaaagaggauacaaacaaauggaagaacaucccaugcucuuggauaggaagaaucaauaucgugaaaauggccauauugcccaagguaauuuauagauucaaugccauucccaucaagcuaccaaugucuuucuucacagaacuggaaaaaacuacuuuaaaguucauauggaaccaaaaaagagcccacauugccaugacaauccuaagccaaaagaacaaagccggaggcaucacacuaccugacuuuaaacuauacuacaaggcuacaguaaccaaaacugcaugguacugguaccaaaacagagauauagacaaaugaaagagaacagagcccucagaaauaauacuacacaucuacaaccaucugaucuuugacaaaccugacaaaaauaagcaaugggggaaggauucccuauuuaauaaauggugcugggaaaacuggcuagccauauguaggaagcugaaacuggaucccuuccuuacaccuuauacaaaaauugauucaagauggauuaaagaccuaaaaccauacaaacccuagaggaaaaccuaggcaauaccauucaggacauaggcaugggcaaggacuucaugucuaaaacaccaaaaacaaugguaacaaaagccaaaauugacaaaugggaucuaauuaaacuaaagagcuccugcacagcaaaagaaacuaccaucagagcaaacaggcaaccuacagaaugggagaaaauuuuugcaaucuacccaucugacgaagggcuaauauccagaaucuacaaaaaacucaaacauauuuacaagaaaaaacuccaucaaaaagugggcaaaggauaugaacagacacuucucaaaagaagacauuuaugaagccaauagacacacgagaaaaugcucaucaucacuggccaucagagaaaugcaaaucaaaaccacaaugagauaccaucucacaccaguuagaauggcgaucauuaaaaagucaggaaacaacacgugcuggagaggauguggagaaauaggaacacuuuuacacuguuagugggacuguaaacuaguucaaccauuguggaagacaguguggugauuccucaaggaucuagaacuagaaauaccauuugacccagccaucccauuacuggguauauacccaaaggauuauaaagcaugcugcuauaaagacacaugcacacguauguuuacugcgucacuguucacaauagcaaagacuuggaaccaaccuaaauauucaucaaugauagacuggauuaagaaaauguggcacauauacaccauggaguacuaugcagccacgaaaaaggaugaguucauguccuuuguagggacauggaugaagcuggaaaccaucauucucagcaaacuaacacaggaacagaaaaccaaagacugcauguucucacucauaggugggaauugaaaaaugagaacacuuggacacaggaaggggaacaucacauaccggggccugucguggggugggaggagggggagggauagcauuaggagauacaccuaauguaaaugacgaguuaaugggugcagcacaccagcauggcacauguacacauagguaaaaaaucugcacauugugcacauguacccuagaacuuaaaauauaauaauaauaauaauaaagaagucagcugaaucaccucagaggcaaaagcauugccuagagcuccccauggaaaacuuaaaaagagagggaaaaaaguggcuuuaaagagucauccucuaguauaaaauucaagaugagaauucuuaauuccuacugaagauaaucugauuuugcaaacuucucuaucauagagaagcaaagugcuaaauaaaugugaaaaaauaguuccuaauggguuucauaaacagaacuacuaaagggcagcauggccaagugcaguaauuuucaauucuuuuuaaagucgcaaaagcuacucuaaaauaggagcuugugcaugauucuaauuuguaaaacagaaaaaguagcugcucuaauugcaguaggugaaccacccagcaagagcucugaguaccagucccugaucucugucaggggaacccgaaguuccaugagucacgguuugaaaucuacuaaucaaauggacacagcacuaaagugaauauuacaauaauuuaugaugucacaucauauauugaugguguagguuuagauacuucacuaauuugggccuuaguuuccucgucugcgaacuguguguuuaaagugaaaacauuugcugggcguggcggcucacaccuguaaucucaacacuuugggaggccaagacgggugaaucacuugaggucaggaguuugagaccagccuggccaacauggugaaacccccucucuaucaaaaacaaaaaaauuagacggccgugguggcaggcgccuguagucgcagcuacucuggaggcugaggcaggagaauggcgugaaccugggaggcagagcuugcagugagcugagaucacaccacugcacuccagccugggcgacagagcgagacuccgucucaaaaaaaaaaaaaaaaaaaaaagaaucacuugaacgugggaggcggagguuguagugagcugauaucguacuacuacacucuagacugggugacagagcgagacucugucccaauaaauaaauaaacaucuacauaaauaaauaaauaaaaugaaaaccuuggcuuuaccagcccuaacuuucuauaaauuuauucucuaagagaaaauaucaaaagaaaagacugccucauguuaagauggaguaacggggacuggauuuaccuuccugucuaaaauaauuuaaaaauggaaaaaaacugugaaacaacaacuuucaaaauauuggaaaucagacaacaaaagacagugauucuugagagaaggaaaacaaaaaagguaagcccuaagauugacccagacuaacuccagggagaauguuuauaggcuacagcacagggagggagagcccagacaaagccugacagucuguccgaguugaggagacagagcuggaagucugggagaaccacagccacuagagucuucagggcagauaauggagauuggggaguggaacagagaaaccuggggucugcggaaggugccucuugaauauucggcucaguacugcuuagcaccuguaugagaagaaacuguuugagggcaggaaaagaaccaccugaaaagauuagaaggaauaaucuucuaaacuccugcaaggggaggaacaguguccguccaccacucagaguggaagacuucauaaugcacaggguaucagguagaguagccagaggucuugccucaguagugggaaaaaauuaucccuacucuagucuugcuaacaaagcauaaaaguaagaacugaaaggaucaaauuguuucaaaauagcaaucugauucuuagaacaaagcucgggaauauuuauagauauccuguucccccaaaaaauaaaaacccaucacucaacauguuaacauucaaggaauugaaagcaacccagaaauaauauuagaauuggauuacauaugagauuagaaaaagacucaacaugucaaguagagacacgaaagaugugaaaggagauccaaaugaaacgucgauaguauugcagauguaaaacacacuagauggcaauaaaggcaaauuaaacauugcagaaaaaaaagugagcuugaagacaaagaaaaaaauccuaauuuaaaacacagaaagaacaaaguaaacaaagucucagggagcugugggaaaacguuuaccuauauuuucaccaaauacaggugaaaguggcguuuacaaggacaguaaaaagagaacaggauguaaacauauuugaagaaauaauggcugaaaaauuucuaaauaugaugaaaaccacaagcccacagaucucagaagcuuagcaaaguccaagcacaagaaacaugaaggaaacuacacaaggcccaucauaaucaaauuucuccaaaccagugaaaaugaugaaaucuuaaaaacagccaacgcaaaaagauacaugacauacagaggaacaaacauaagcaugauaacagauuuccucucuaaaacaaugcaggugauaauaaaauggagcaccauguuuaaaguugggaaagaaaagaagucaacauaaaauucuauacccagcaaaaauauuuuucaaaaacaaagacaaaauaaaaagucuuuuuuagauauauaagaccugaacgaauuuaucauaaacagaacuguacuaccaggaaaguuaaaagucuucuaggcagaaggaaaaugauaucaggagaaaaucugcauuuacagaaaggaauaaauagcacuggaaacaguaacuaugaagguaaauagaaaaggcauuuuccuguguauuuaaaucucugggaaagacaauuguuuacagucaaaaacaagaacaauacaguugagcuuauaacacuuguaugauaaaaauagcauaaaaguggggagggcaaaaauggaagcauaugguuguacaauucuuaaauuauauguuuauauguauaacauuacuagaacuuacauuauacugaauuaaauacauaugcuaugaacucuaaagcaaucacuaaaugacaacacggaauaauaacuaauaagccaaaaaugagauaaaaugaaaugauaaaauauucaaauaauccaagaggagauagaaaaagaugaguaaagagaaaaagcagaugggaaaaauagaaaacaaauaacaagaugguacauuuaaagcuaaccguggccgggcacaguggcucacgcccauaaucccagcacuuugggaggcggaggcggguggaucaccugaggucaggaguucgagaccagccugaccaacauggcaaaaccccgucucugcuaaaaauacaaaaaguagucaggcaugguggcaugagccuguaaucucagcuacucaggaggcugaggcaggagaaucgcuugaaccugggagguggaaguugcagugagcugagaucgcgccguugcacuccagccugggugacagaacgagacacagucucaaaaaaaaaaaaaaaaaaaagaaaagcuaaccgugucaauaucacauuaaauguaaauaguguaaccacuuccccucccaauaaaggcagagguuguauaaaagacugaauaaaaaaguaagcccuggccgggcgcaguggcucacaccuguaaucccagcacuuugggaggccgaggccggcagaucacgaggucaggagauugagaccauccugaccaacauggugaaacccugucucuacuaaaaauacaaaaauuagcugggcaugcuggcacaugccuguaaucccagcuacucaggaggcugaggcaggagaaucgcuugaauccgggagguggagguugcagugagccaagaucguugucacugcacucuagccuggcgacauggcgagacucugucuauaaauaaauaaauaaauaaauaaauaaaaguaagcccuaacuauaugcugccuacuauuauccacuuuaagugaaaagacacaaauaugauuaaaggauauuaaaagcuauaaaacuuuaguaugcuaauauuaguacccucucaaaaaaaccaagggugucuauauuaguaucagaaaaugauuucaaaacaaagaauaugaccaagaauaaagaugaccauuuuauaauaauacagauuacaggcaugagccacucugccugguccaguuguuuuuuaauugcaaaagaaauucagugagaaaagagcaaacaguuuuuucaauaaauaaugcuaauaugcccuccaaaugaacuuugauucauaauuaguaucauaaaaaaguuuacucgaaugggucauagacuaaaagugaaaaaccaaaaauuauaaaacuucagaagaaagcaugaaauccuugagaccauguguuaggcaaauauuucucagauaugcaaccaaaaacacaauucauuaaaaaaauaaauuggacuucaccagcguuaaaaacuucugcucuucaaaagauacaguuaagagaaugaaagacuagcuacagacggggagaaaauauuugcaaauuacacauaugguaagcaaccagaauguauacagaacucucaaaacccaaugauaagaaaacaaccuaauuaaaaaguggucaaaaaugugaacacuuugcccgaggaguuauacagcugauauacaagcacauaggauguccacaucauuaaucauuagaaaaauugaaauugaaaucauaagauaccaugacauaccuguuagaaugucuaaaaucaaaaagacuggccauaccaaguguuggcaaggaugcuuuccuauacagcuggugggaaugcaaaaauggcacacuuuggaaaacgaucuggcaauuuuuuaaaaaguuaaagguacacauaccguaugauccagccauucacuccuagguauuuaccuaagagaagaggaagcaaauguccacccaaugacuuguacaugaauguucguagcagcuuuauuuguaacaacccaaaccggaaauaaauauucauuaacaaaugaaaggagguugggcacaguggcuuacgcuuguaaucccaacacuuugggaggaugaggugggcagaucauuugaggucaagaguuugagaccacucuggccaacauggcaaaacccagucucuaccaaaaauacaaaaauuagcccggugugguggugcaugccuguaaccccagcuacucgggaggcugaggcaugagaauugcuugagccaaggagguagagguugcagugagcccagaucgcgccacugaacuccacccugggccacagagacagauucugucacaaaacaaaacuaaacaaaacaaaaaaagaaaggauaaccaaauuaugauaauuucauacaacggacuaccacucagagauaaaagaguugauugagccacauaagaaugugaauuaauacgaaaauaaguaagcugagugaaggaagccaaacaaaaaaaccaaguacuuacuguaggaacccauuuuucuuaaguucuagaaaaugaaaacuuaucuauauugacagaaagcagaccagugauuggcccaggcagaguggggcaggagacagggauuauguaaggguaccaggaaacugugggugaucaacauuuugguuugguaauaguuucauguguauguguggguguaggcauauauaugucaaaaucuaucaaaguguacaccuuaaaaugugcauguguaugucaauuauuccuuaaagcugucaagaucucuuaaaauuaaaaaaaaauugaaauaagaaaagcauuugauguacauaugauauuaaaguuaaacaugaugaacuaaacucugacuuacuggaccccuucaguaaucaugaacuucuuucucacuuuacaggagaaauacaaauaaaaauuaaaaagccaaucagaaacaagucuguuuauuacucuauauguaguauauauucaucgauaccaauugguucuauuaaauuauuuaauagcauaucaccuaguaaacucuucucggcacuccaaggaaugucuggaaugggagaaaaacacucaaaacuacagcgacauuaagaguuuuaauuaacaggaaauauauuuagauaaaacauuaaguauaugggcacuuaaugaguguuucuaggugaccuuaguaucuaaaauccguuuacuugacucacaaacauuaacaguauuuuuuugucccugugcuaggcuucaaaaacgauggguguguuugcgucugggaucaucuuucuggcucucuggaacgccaguacauguacugagccuaggaggcagcuagccuguuggcuguaccaauucagcaguuccaauugaacugcucuccacucacucugccaaugcuggacauacuucugauuguauuugucugcaaucucuucaauuuccugccuuucagaaaguuauaagccaugauguagcuuucacuugccugguauagacauuugcaaaaacaaauccaaugacaccauggggaaagaagcuugaugccuuuaauaggugcucaucagucuucuaguugaucacuuuuucuguccuaggaaagggcuugccuugaugaauuuuuuuccugcaauuuauucuuccccauuacucuccuuugcuacaguuuuguuauaauuagcaaauaacuuggauaucucuuagacuucucauauuuuccacauaguuuccaacaaaucugcauccauauucacaaauuuguaaugauacaaaucccugggcugauacauuugaaaaggaagucugugcaaaaucauaaagagaauaggauugaauauuccuaucacacuguauuggaggggauugauuaacacauuuagaagagauucuuaccucuucuaaaacacaagcugauuuuucaacauaaguggaucaggaaauccuuguugaccucuuaccaguauuuaaacacaaacccuuuugaaacuugcucuuccuuuggcuucuagaacuccugguuaaccucuuaacuucuccagucuagucugacagcucuuccuaguuuacaugccccaaaagugaaaauguagauauuucccagggcucucuaaacucucugccaaaaacaucucauccacccucauuaauggcuuaauacccccugcugaauuucugaaucucuccacucuccacucuccacucuggaauugcacagucuggcaaggaaaccgcuagccacuagugagcacuuaaaauguggcuggugcaaaccgagacauacuagaaaacacacaagagauuuugaagacuuggguacaaaggccgagguggguggaucaccugaggucaggaguucgagacuagccuggccaacauggugaaacccugucucuacuaagaagacaaaaauuagucgggcaucauggcgggugccuguaaucccagcuacucaggaggcugaggcaggagaaucgcucgaacccaggaggcggggguugcagugagccgagauugagcuauugcacuccagccuggacgacaagaccgaaacuccgucccaaaaauaaauaaauaauaauaauauaaaguaucuuaaguaauuuuuauauugauuauauguugaaauaacaauauuuuggauauacaccauguacccuugaacaacaaaaguuuaaacugcacgaguccacuuauauguggauuuucuucagccucugccacuccugagacagcgagaccaacucaacuucuuccuccuccucuucagccuacucuacgugaagaugacaaggaugaagaccuuuaugaugauccacuuccauuuaauaaacaguaaauauauuuucucuuccuuaugauucucauaacacuuuucuuccucuagcuaauuuuauuguacuaauacauaauacauauaacauacgaaauauguauuaaucaacuguugauguuuuuggucaacaguaggcuauuaguaguuaaguucuggggcagucaaaaguuauauguggauuuugacaguguagugggucaugaccccuaacuccugcauuguucaaaggucaaguguauuggguuaaauauauuacuaaaauuaauuucacuguuuccuuuuaucuuuucuuaaagugugacugcuagaaaauuuaauauuacauacauggcuuaugugacauuucugcugggcagcgcugcuuuacaccuaaaauucaaacugacuauucaaacugaacacauuagaaacugaacucauuauauuucagacccugcuccgucacugucaggauagaauaaaccuuagccuucaggagacagauacaccgcauuacaucggccacugcuguugaggaaauugucuaacaaagcagcuaauccuaggaucaauuacuuaugaauaggcgacacggugacucuggucauuguuaaagagccugucaacauucacucauuggcagcugcagcaggaauguuuguacaacuggaaaauaacaagcauuugacgagaagucggcagcaggaauuaggaacaaagacagccaggguuuugccaaaauacuggauaaaauuuacaugcauucgaagucagaaauguuagcagucacacauguaguugugacacauucucugcagguaauugaaccacccugaugugccaaaauuuuuugcauuaccuggcucgugaaaucuuccucuucaucuaggcugaaaucuggaaucauuuuuuuuacuaugcuuuccuuuauucccauauccaagcaaauaucaaauuaugauucuaccaacacccaguaugccacacccacauuuuuuuccuccuuaaagaaaaccagagaaaggaaacacagguuguuaugcuucccccaugaccccacaaguucuggggcucagaacagaguaggaagaagaggucgagagagacaaucuccagguugcauauuucugcugguaacacagcaugguaaggucugccucuauguuauugcagaguaauuuacaaaaaaguacccuguucuuuacaguuuuccuccaguaggaguaacagguuguuggaaaugcaaacagacuaaagagaaaggcccccaagaaacccaaggauaaucugggaaaggcucuagaacacaacagacacaauuuuccuucuuugcuuuuuucuuuucuguccuucacucuaaucuuucuuauugccuuucuuuuucuaauucuaaaguuucucuuuacagaaacuuuccuaacugugugggugggccaaacacaguuuggucacuuuacacgguaggauaauauucauaaaugauuuuggauuaucuauuggcuugcaucagaagaaauaauugcgaguugcauauacaccaggcauuuaugucaacugaaccauuacauguacaccuuaguacauuuuuuuuuuuuuuuuuugagacagagucucgcucuaucacccaggcuggagugcaguggugugauaucagcucacugcaaccuccaccucccagguucaagcgauucuccugccucagccucccgaguagcugggacuacaggugcaugccuauacauuuuuaaacuuuuugagcuuaaacuaacugacaauugucuaagcauaugcuauaugucagacauuuuuaccuggcuacuuaaauuuuauaguuucuuuuuuuuuuaagacugcauacuuagguugugcaagucccuguucaauaaaaguaugcauaauuuuaaauuagaaauaucuuccuuuuugaaaugggaacgcagucauauugagacaauggccuuuuuagcauuccugaacaacuugaaguuaaugguccaauauguuuuuuauaguuuacuuuuaaacauuguuacuuaguuuaaaagaugcuuuggccagauuuuugcuugaagaaacuaaucuggccuaauuuacaugccauaaaaacagauuuauaauggaaagguugacacauucaaacauauauugaguuuaauuucagaaaaauuaacaucauauucuucuacuggaauagauuucaagaauuaauuaaaauaauugccucaaaaauugccaauugguauuuuaagaguacuauuccuccuaagauguuucauaucuagcauaucuagauuugacuagauaugacuaacugggguuuuuaacucuuugcuaaaccaacaaguccacuuugggcaucuguuuuaagauguaaaugcaucugguugucauaggcuccaaaugaagguaauaagcaguaaaauuauauuguacaaggaaacaggcuauagaaaagaacuaauauuuuaaaucaauuuuuccuaauacaugugagcuguucauguacucuaaguauuuuuauacuuauugccagcaaaauauucuaguugguuugcaauguguagguaaguuagagucucuuuacagaaacuuuccugucuacugaugcacagauuuaaacaaacaaacaaacaaacaaacaugucuuugaaucuaucuauuguuguuaugguuuagacuaacaagcuccaucuaguuauuguuucagccaguuccuuugguguuuaguuggugccuaugguugccucuauccuuuauuauuuauguguuaaguaaacacuauagccaauagaauugugaguacuacugcuuguccauaugcuguacauuuucuuucaucaaaaaucaaauuauggaaugauuauuuuacuaaguacauuucuaugcuuuaauuuagaaaaauucuaucuccauacaacuuuucugcagcauaaaucaucauaacacacuggcugggcauugugacucacuccuguaaucccaacacuuugggaggccgaagcaggaggaucacuugaggccagcaguucaagaccagccagggcagcauggcaagacccugucuguauacaaaauuaaaagaauuagccagguaugguggcaugcaccuguaguccuggcuacuugggagggugaggcaggaggaucacuugagcccaggaguucaaggcugcagugaacuaugauugcaccacuauacuccagccugggcaacacagcgagaccuuguuuaaaaagaaaaaaaaagucaugauaacacauggcuugaaugcagccaugaugcagcaggcaggcacuuuugugucucugaauaccuccuuuagagaaaucuuagugaugccuaaguuucuuuccaggcuacauuuaccaaacuuggacuaaaccacaaagucauucaacuguaccuuuacugcaccauucucaugcauggugaugcaguuaucggcgucuucugagaguugguacaaggccugagcugucgcccgaugcacguuggugucauuugauuucagauaacgcacuaguggagccacugcuuugugcucaccgaaggccacucuauuccugccccacauacagcaacgugaaauagcuucugcuagaugaugucucaauuuauuguuauucugugcaagggaaaaugaaaugggaucugugcauuguaaugacccugcaagaucaugucuauaagcacuuuauguuuauuaaccauuaagacaccaaugagucuagagaaaagggcuagcuggcugacuaccuaggugauguuuugaaggaacuagucuuuuuuagauggagucucacucuguugcccaggcugaagugcaguggugccaucucagcucacugcaagcucggccuccuggauucaagugauucucaugccucagccucccaaguagcugagauuacaggugcccgccaccacaccuggcuaauuuuuguauuuuuaguagagaagggguuucaccauguuggccaggcuggucuugaacuccuggccucaagugauccacucacuuuggccuccaaaagugcugagauuacaggcgugagccacugcacccagcugaaggaacuagacuuuuggugggucaccaacagaccaacguucaaucuugaguuuucuucuuaugaacugaauguagucagugcacucaaaggugaccaagcaucugacaucagucauuagcucaaggcuagauuuucuuuagagugagucuacuacacaacgcaaaauuacagaucagcaaguuauuuuguaauccaaauauuuauagaauauuagauauccuuaaagggauacugcacuuaacugggauaaguggauugacuggauuucuccacccuaggaauacauugauaucaguaauacaccuugguugccuuggcuccugagagggagaagagagugcagcaaauccgaagacacauuuugggucuuccauuuuccuuucuguauuuuuugaugcagacgauauccuucuuuguauacguaauugcccuguaaugggcauacuauuacugaaucggaugguuuuguguuuauuaagaguacugcucucuugauucaggcaacaacuugguguccuuaacugaaucugacagauauucuuaggaacucaaagucuucuagaccaagcauccuuccaggguuugaauuucugcucuaugacuuuucugccaagugguaguccaagcuaugcucaaauaccucuggucauggugaagucauugucucucaaggcugcuuauucugucuggcacagcucuggauaaacaaugaaaugauugccaaagucuucuagcucaagaaugccaucgacugaagcuugcuaaacuggggaggcacauuugauuucuaacguuggcaugaagaaccaucgagaaucauaaccaugaugguggcggugaagaugauaguuaacacuuacauaauagcacuuguauuugccaguuuacuugccaguggcaaauaaaaaacagcuucuauuuuacaaggaucuuguaauacuaacauuuuauaguuuaaaauacgcuuucacauauauuagucucagagaaacuaaaugaguugaccaaaucucauaccucauaagcaauggguauuaaacuugaauccagguuucuggacugcaaaugcauuguuuucaucacuacaccaugauaucucaggacaauaugcauguaaaacaaaaagauguguuacuuacuguauuugccaguuuggacaauaaaggaacaacuccaugaucugugauaacagcuaaauuuucuugaucuuuugcuauguugguaauggcagcacauacacuugccagaacuucuuuguuaucugauuucaguaaauugacaauaaguuccaaaccaccaacaaaggaacgaaccauuuccccagcauccuagacaaaaauaaaaguaaagaugguaucaaaacuaaaccuacauuuaggcauuuuuuaagaggcagaaaguaacaauacagcugugagguacaucuuuggcaugaaagacuacuucaacuuaauuuauuucuauauuauauauuauuucuacauguauauguauaaaguguguguguguacauauguauaagucuauauacauauguagcacauauaaaaauucaguuucaaaaaauauuuauugaauauuacaggagagucacuguguuagcuacugaggauaucaaaguuauuaaaguacaguugauucuuacuauuugugguagcuuuguucuauaaaguaauugcaaacacugaaucagccaauacuaaacuuuuucucuuaggagaaacauaggacuagguuccugcaagccucuggcuacaacauuuucaucaguugauggauacauaaccuuguuuuauguguauuucuguuugaagacaccugauuucauauauauuguucauucauucauauugaacucauggccaacagcauuauagcucaugcaauggagcuuauuuaacacagauauuuucucuuucaggcacaccacagccuucuugcccuuacaaaccauaggcagcaccucagcaccacaucugggggccacugugaacagugaaauaaccaacaaaaagcacaaaaauccaaaaauuauggcacuaaauggacugcaaaauggacacuugcuuacaguaugagaaaugaaacaagaaggcagagaaucgccuucuucagccucagcugagaacgugugcauuggacgacucaaauuuuucacuucucugugcauguccaagaaugaccauauugaguaggggguuacaaguaaauuugagcaaguaggcaaauucccaaggagaauuugugaauaauguggaucgacuuuauauauucuuuugccaugauguugccuacaacugguggggaagaugggcauuaagaaauuacaaguauaacaaauagcacuggagggaggaggagaugaagagacuacaaauccauacaaugaggaaaccucaacuaauauaaagguucaagggcugacuccccaaggccuaagggacaaaaaguuauccagcgugaaagggauucugguuggacaaaucaucauguugcacagaucugacagcgagagagaaggugauuuuuuuuuuuucuaguucagaaugacuggagcacaaaauaagaaaggcagcaugggagaaagugagacuuaagaggugagaucuugaagggucucaccuuuaagauccuucagggagcaucuugguaaaggguuuggaguucauuuuuaagggcauuggaaagccccugaagaggcugaagugugggggaaggauuuuuaucaauuuuuuaucuuagaagauuucucagaauuacagggugcaggguuggagugggugcaaagaaugguauagggaacacaggggcuauuucgcuagaccacaugggaaguggugaugguuugggggagggugguggucuaugccuggagagaagauuguggauuugggaagcuugcuuggagaagauagagaugagugauuugagaugauucccacgucucuggcucaacuuaguagggcuaauguuggaagagcuggguuugguuugacuugguuugguuuucuugggguggcauaugauauuagaagaccuaauuugaaugaaguacccacagacauuuaaguggaacuaucuaggaugcagaugaauguaugggcuuggagcuuagaaaaaaaaaacaggcuggaaguggagauuuggaauucaucagaauaaagacuguaacuaaagccaugcaaauuagagagugaggagugaagugagaguggagagugaggugagagcggggagugaggugagagcggggagugaggugagagcggggagugaggugagaauggggagugaggugagaguggggagugaggugagaguggggagugaggggagagugaggaguggggugauagugggcucuuucuggugucccaggugugggccaaggaaaagaauuugucagaagaucuuggagucagaucuccaccuucucuaagguuguaugggggugaguguaauguccaccaauuacuuggcucuaucacuuucucaaauaauaauaauucacaucuuuugcaucccaacggcguaucaggcaugguacuacgcacuucacauaaguuauuucaguuaaaccucacaggaaucaugcaaaauggguauuauuuccauuuuagguuuuuaaaagugaggcucaaagagguugaaccuuauaaaauagauuguaucccucaugaagguaggcaccauguguuacucaacugagugaucauuagaaaccguaaaucugaugaucccaucuccauacccaccaaauucuuccacagcaaccccugcccuuaggauaaaauucaaacuccacaacguuguuugcaaaccuuucaaggugcaccccugguuuaucucuccagccucaacuucccugccuugacaccucuucuccaaccucccccacauauacccugagccaguggcucucuaugugagcuaauaauaagaacccuggcacucauucccugagaaugugauucauuaagucugggugagguccacuaaaauauuuguauuuuuaaaaacucuccagccaguagagggaacacuacuuuaugaauuaguccuucaguuuucauguccucaaaugugcaugucuccacaagucugcacaaaccuuuucugucugucuuccuguuagcuugggaauuccuacacaucuucagcugccaacuaagguaugcucuucuucaggaaaccuuuccugaaccucaagucuggguuaaguggcaucuuccauaauaccugguucuccuguaugacagcaccuaucacugcacauaguugugguuucuuuguuugucuuugacccugaacuguaagucccaggagggugaggacucuugcugucucauucauuguugaaugccugguaccuaugccaguuucuagcaguuaguagauacucaacuaacauucauugaauuugauuguuugcaaacucauagccuuaaaagaaagcuuucacugugguuacaacaaaccaaacuaaacuccuacuaaauggugaaggcaggacacgagucagguucuaugcaagugugagggcgaagccacuuucucucuguaacacguugccuuaccugauugcugagagaagugacagcagcaauauuggugggcugguucucaauaguaaaucuaaauacaauuucugauaguuaggacauacuucuaaauucugauguauucauaagcuuauuuggaaaaauaguuaauugccauucuuuguaaaauucuacaauaaagauuucuguguaauacaaaagaaaugauuauauuuucaauugucuucuauacugucacuuuauuacacuucuaugcauuaggaugcucucaaaucaaaauacuauaaacaugaauguauuaaccuugaaauauccaacacuguuuaauccuaauuacccuuugaggcaguuaguggugguagauggagcuuuaguauuugcaugucauagaugaagaaaacccagaggaauaaauuaacauguaaaagguaaaaugacagaguggcagaagcaggauuugauuccagaucugucugaccccagagcccccucacaauauugugauuuguaaauccuaaccauauacuuggcucaaaugaggccaugcacauguaaauucaaaagcaaaaacaggggcucuuagaauuucaggggacuucaaaagcauagccccaaagcucaacuuuuccaaggaucaucuugguccaauuguguuacuaugaagggauacuuuauaaauuacuggguaauuuauaaagaagauaaguuuauuuggcuuaugguucugcaggcuuuacaagaaacauggugccagcaucugcuucuggugagggccucaggaagcuuccacucaugguagaaggugaaaggaaguaggcaucacaugguaaaagaaaggaagcaagagaggggagggaggugccagacuuuuuaaaagacuuuuaacaaucaguucuggugggaacuaauagaccaagaagaacucacucauuacaaagcuggcaccaaggcauucauaagggaucagcccccaugacccaaacuccucccauuagaccccacuccaacacuggggaucaaauuucaacaugagauuuggaggggaaaauauccgaacuaucucaaugauguuauagaugucaauagucucauacauuugucaaugacaaaaucacagaacuucuuuuuuuuuucucaagaaaaccgggaggaauucuggacagaugauaguggcaaaguguuugaaucucauucucccuaugaaaacagugcagauaguagagcaaaacaaaaaacacaauggacaauauacaccauaguaggugaacaagauacccacaacugaccccaaagcacaagcagacuuggagggacaaacuagcaaccacagugggaaggcagaggcauuugugaaggucuugagagccaagaaaccccaaagggccaugaaguucucacuggaaaguuccagaacagcagcagaagcagcugcgaauggacuuuucaggcugugaugaacggauaagacuacaaugccacaaagucugauggugcugggguguucuguuaggccugaguuccaugaauugguaaaacuacaaacugaagccuuuucugggacaaagccaugcacagaagagaaacuacacggaauagcaucauccaaauugagcaacgcagagacacugggaugaaggacuaagaaaguucagauaaaaagggaggguggaagcagaggggccagaaugcacccugcaucacugugaagaugacaauggaauccugggaaucaagaaaguagcagugccauccuaguccacaucucccuucuaaaagaccaggaaaacucauuucacuuacaaauaagcaagggcugggugcaguggcucacgccuguaaucucagcacuuuggaaggcugaggcaggcggaucacuugaggucaggagguugagaccagccuggccaacaaagugaaaucccaucucuacuauaauacaaaaauuagcugggcaugguggcgugaaccuguaaucccagcuauuugggaggcugaggcaugagaaucgcuugaaccugggaggcagagauuacagugagcugagaucacuccacugcacuccagccugggugacagagcaaaacucugucucaaaaagaaaaaaaaaaagcaguauaaaaaagacuccagucaauuuccauauacaguuauuauaagaaauaaaaaacaugaacaaacacuucucaaaagaagacauuuaugcggccaacaaacaugaaaaaaagcuaaauaucacugacuguuagagaaaugcuaaucaaaaucacaaugagguaucaucucaugccagugagaaugacgaucauuaaaaagucaagaaacaacaugcuugugagucuguggagaaauaggaauacuuguacacuguuggugggaguguaaauuaguuuaaccauuguggaagacaguguggugauuccucaaggaucuagaaccagaaauaaaauuugaccuagaaaucccauuacuuggguauauacccaaaggaauauaaaucguucuauuauaaagacacaugcacacauauguuuaucgcagcacuauucacaauagcaaagccauggaaucaacccaaaugcccaucaaugauacacuggauaaagaaaauaugguagauauauacaccauggaguauuaugcagccauaaaaaggaaugagaucauguucuuugcagggacauggaugaagcuguaagccaucauccucagcgaacuaacacacgaacagaaaaccaaacaacacguguucucacucauaagugggagcugaacaaugagaacacauagauacagggaagggaauaacacacauuggggccugcuggggcacggagggagggagagcaucaggauaaauaacuaaggcaugcagggcuuaauaccuaggugauggguuaauaggugcagcaaaccaccauggcacacauuuaccuauguaacaaaccugcacauucugcacauguaucuuggaacuuagaauaaaauaaaauaaaauaaaaauaaauaauaaaauaaaauuuuccuguaaacauaaaaaaagagaauaaggagcaaaaucaugcucuuacgaugaaagcacauuagaaagacaugccuacaaaacagaugaaaacuguaagauaaaauuucaauaggagcuaaaggaaaauaauaaaagcaaugaaugaaaaaccuaaauuagaauugcugaaguuguaauuaggugauuaauuuaaaaaagcaacuuuuuaaaagacagaugaaagauaucuauaaagaauuagauauaaaauaaaaaugcauuuuugaaaugaagagugaacuagaaggagcacaagaacaaauaaagauaauggauaaucuuugucaauagaagaugugaaaacugaaggguaauguaaaaauaguuaacaaaaaauucaaggcaacaaauaggcagagaagaucuaacacauguauguaagaguccccaagaaagaaaacaaaucucuacaauagggcacauuuuaaaaucuagaauaaaaaaaucuuucuccugaaauaaauaaaaccugagaguauacugaaaaguuauauauuuggaaaaauugacccagaguggcguaauauaaagauauauucugguacaacuucuggacuuaaaaaaaaaaaucuauaaucagcaagcaaaaagacuaagucacuuuuuuuucuuuuuucuuuuucuuuuuuuuuuuugagauggaguuucacucuuuugcccaggcuggagugaauuggcacgaucuuggcucacugcaacuuccgcccccuagguucaaaugauucuccuggcuuagccucccagguagcugggauuacaggugcaugccaccauguccggcuaauuuuuguauuuuuaguagugacaggguuucaccauguuggccaggcuggucccgaacucuugaccuuaagugauccaccugccucggccucccaaagagcuaggauuacaggcaugagccaccaugccuggccgaccaagucacuucuaagggaaagaauaagacauuaucauuagacuuuccaacagugauguuugaugauguggggaagggagugacaccucuaagcuacucaaggagagcaaaugcaaaucaguguucuaauauugagucaaaaugaccuucaaaguaaaauauauauauauauaguuggaaguauaaaauuuuauaaacaugggagauuuccaggaaugauguuaacacaaguucuucacuugagaaugaaugucagaucuccaaaaagucuagaaggacauuaacaaaagggcugucaaugucuuaaaauccucuauuggcuucauuuuucuucagaauaaucauuagcaugacauucaggcauuucccgaucuggcccaaccucaaucuuuucucucccaaucucaaucuuuucucucccagucuucucuuuggcauagucuacacuccagccuccuggaaacuguuuccuaaagugccagauuccuguacaucuuugaaucuguuauuuucuuuuuuaauauuauuauuaucacacuuuaaguucuaggguacaugugcucaacaugcagguuuguuacauaugcauacaugugccauguuggugugcugcacccauuaacucgucauuuacauuagguauaucuccuaaugcuaucccucccccaucccccaaccccaugacaggccccagugugugaugguccccuuccuguguccaaguguucucauuguucacuucccaccuaugagugagaauaugcgguguuugguuuuuuguccuugcgauaguuugcugagaaugaugguuuccagcuuaauccaugucccuacaaaggacaugaacucauccuuuuuuauggcugcauaguauuacaugauguauaugugccacauuuucuuaauccacucuaucauugauggacauuuggguugguuccaaguauuugcuauugugaauagugccacaauaaacauacgugugcaugugucuuuauagcaacaugauucauaauccuuuggguauauacccaguaaugggauggcugggucaaaugguauuucuaguucuagauccuugaggaaucgccacacugucuuccacaauggucgaaccaguuuacaguccuaccaacagugugaaaguguuccuauuucucuacauccucuccagcaucuguuguuuccugacuuuuuaaugaucgacauucuaacuggugugagaugguaucucauugugguuuugauuuguacuucucugauggccacugaugaugagcauuuuuucgugugucuauuggcuacauaaaugucuuccuuugagaagugucuguucauauccuuuguucacuuuuugaugggguuguuuguuuuuuucuucuaaauuuguuugaguucuuuguagauucuggauauuaacccuuugucagaugaguagauugcaaaaauugucucccauucuguagguugccuguucacucugaugguaguuucuuuugccgugcagaagcucuuuaguuuaauuagaucccauuugucaauuuucgcuuuuguugccauugcuuuugguguuuuagacaugaaguccuugcccaugccuauguccugaaugguauugccuagguuuuccucuagggcuuguaugguuuuaggucuaacauuuaagucuuuaauccaucuugaauuaauuuuuguauaaggugcaaggaagggauccaguuucaccuuucuacauauggcuagccaguuuucccagcaccauuuauuaaauagggaauccuuuccccauuuccuauuuuugucagguuugucaaagaucagaugguuguagaugugugguauuauuucugagggcucuguucuguuccauuggucuauaucucuguuuugguaccaguaccaugcaguuuugguuacuguagccuuguaguauaguuugaagucagguagcgugaugccugcagcuguguucuuuggacuuaggauugucuuggcaaugcagggucuuuuuugguuccacaugaacuuuacaguaguuuuuuccaguucugugaagaaagucauugguaguuucauggagaugguauuaaaucuauaaauuaccuugggcaguauggccauuuucacgauauugauucuuccuauccaagagcauggaauguucuuccauuuguuuguguccucuuuuauuucgcugagcagugguuugcaguucuccuugaagaguaccuucacaucccuuguaaguuggaucccuagguauuuuauucucuuugaagcaauugugaaugggaguucacucaugauuuggcucucuguuugucuguuauugguguauaagaaugcuugugauuucugcacauugauuuuguauccugagacuuugcugaaguugcuucucagcuuaaggagauuuugggcugagaccuggggcuuucuagauacacaaucaugucaucugcaaacagggacaauuugacuuccucuuuuccuaauuaaauacccuuuauuucuuucuccugccugauugcccuggccagaacuuccaacacuauguugaauagcaggggugagagagggcaucccugucuugugccaguuuucaaagggaaugcuuccaguuuuugcccauucaggaugauauuggcuguggguuugucauaaauagcucuuauuauuuugagauacgucccaucaauaccuaauuuauugagaguuuuuagcaugaagugcuguugaauuuugucaaaggccuuuccugcauccauugagauaaucaugugguuuuugucuuugguucuguuuauaugcuggauuacguuuauugauuugcauauguugaaucagccuugcauuccagggaugaagcccacuugaucauaguggauaagcuuuuugaugugcugcuggauucaguuugccaguauuuuauugaagauuuuugcaacgauguucaucagggauauuggucuaaaauucucuuuuuuuucugugucucugccaggcuuugguaucaggaugaugcuggccucauaaaaugaguuagagaggauucccucuuuuucuauugauuggaauaguuucagaaggaaugguccccgcuccuccuuguacuucugguagcauucggcuaugaaucccucugauccuggacuuauuuugguugguaggcuauuaauuguugccucaauuucagagcaacaauuggucuauugagggauucaacuucuuccugguuuagucuugggaggguguauguguccaggaauuuauccauuucuucuagauuuucuaguuuauuuguguggagguguuuauaguauucucugaugguaguuuguauuucugugggaucgguggugauauccccuuugucauuuuuuauugcgucuauuugauucuucucucuuuucuucuuuauuagucucgcuaguggucuaucaauuuuguugaucuuuucaaaaaaccaacuccuggauucauugauuuuuugaaggguuuuuugugucucuaucuccuucaguucugcucugaucuuaguuauuucuugccuucugcuagcuuuugaauguguuugcuccugcuucucuaguucuuucaauugugauguuagggugucaauuuuagaucuuuccugcuuucucuugugggcauuuagugcuauaaauuucccucuacacacugcuuuaaaugugucccagagauucugguguguugugucuuuguucucauuguuuucaaagaacaucuuuauuucugccuucauuucauuauguacccaguagucauucaggagcagguuguucaguuuccauguaguugagugguuuugagugagcuucuuaauccugaguucuaguuugauugcacuguggucugagagacaguuuguuauaauuucuguucuuuuacauuugcugaggagugcuuuacuuccaacuauguggucaauuuuggaauaagugugauguggugcugagaagaaugcauauucuguugauuugggguggagaguucuguaggugucuauuagguccacuuggugcagagcugaguucaauuccuggauauccuuguuaacuuucugucucguugauccgucuaauguugacagugggguguuaaagucucccauuauuauugugugggagccuaagucucuuuguaggucucuaaggacuugcuuuaugaaucugggugcuucuguauugggugcauauauauuuaggauaguuaguucuccuuguugaauugauaccuuuaccauuauguaauggccuucuuugucucuuuugaucuuuguugguuuaaagucuguuuuaucagagacuaggauugcaaccccugccuuuuuuguuuuccauuugcuugguagaucuuccuccauaccuuuauuuugagccuaugugugucucugcacaugagaugggucuccugaauacagcacacugaugggucuugacucuuuacccacuuugccagucugugucuuuuaauuggagcauuuagucuauuuacauuuaagguuaauauuguuaugugugauuugauccugucauugugauguuagcugguucuuuugcuuguuaguugaugcaguuucuuccuagcaucgauggucuuuacauuuuggcauguuuuugcaguggcugguaccagcuguuccuuuccauguuuagugcuuccuucaggagcuuuuguagggcaggccugguggugacaaaaucucucagcauuugcuuaucuguaaaggauuuuauuucuccuucacuuaugaagcuuaguuuggcuggcuaugaaauucuggguugaaaauucuuuucuuuaagaauguugaauauuggccuccacucccuuuugucuuguaggguuucugccgagagauccacuguuagucugaugggcuucccuuuguguguaacccgaacuuucucucuggcugcccuuaacauuuuuuccuucauuucaacuuuggugaaucugacaauuaugugucuuggaguugcucuuuucgaggaguaucuuugugguguucucuguauuuccugaauuugaauguuggccugccuugcuagguuggggaaguucuccuggauaauauccugcagaguguuuuccaacuugguuccauucuccccaucacuuccagguacaccaaucagauguagauuuggucuuuucacauagucccauauuucuuggaggcuuuguuuguuucuuuuuauucuuuuuucucuaaacuucucuucucgcuucauuucauucauuugaucuucaaucacugauacccuuucuuccaguugauugaaucggcuacuaaagcuugugcauucgucacguaguucuugugccaugguuuucagcuccaucacaucauuuaaggacuucucuacacugguuauucuaguuagcccuucaucuaaucuuuuuuugaagguuuuuagcugcuuugugaugguuuaaacuuccuccuuuagcuuggagaaguuugaucuucugaagccuucuucucucaacucaucaaagucauucucuguccagcuuuguuccguugcuggagaggagcugcguuccuuuggagggggagaggcacucugauuuuuagaauuuucagcuuuucugcucuguuuuuccccaucuuugugguuuuaucuaccuuuggucuuucaugauggugauguacagaugggguuuugguguggauguccuuucuguuuguuaguuuuggugguuccaagauggccgaauaggaacagcuccagucuacagcucccagcaugagugaugcagaagacaggugauuucugcauuuccaacugagguaccagguucaucucacugagucuuguuggacaguggcugcaggacagugggugcagcccaccgagcaugagccaaagcagggcaaggcauugccucacccaggaagcacaaggggucagggaauucccuuuccuagccaagggaagcugugagagauggcaccuggaaaaucgggucacucccacccuaauacugcacuuuuccaacagucuuaguaaacagcacaccaggagauuauaucgcacgccuggcucggagggucccaugcccacagagccucgcucauugcuagcacagcaaucugagauugaauugcaacauggcagcgagccugggggaggggcacccgccauugcugaggcuugaguagguaaacaaagaggccaggaagcucgaacugcguggagcccacugcagcucaaggaugccugccugucacuguagacuccacaucugggggcagggcauagccaaacaaaaggcagcagaaaccucugcagacuuaaaugucccugucugacagcuuugaagagaguagugguucucccagcacagaguuugagaucugagaacggacagacugccuccucaagugggucccugacucccgaguagccuaacugggaggcaccccccaguaggggcagacugacaccccacacugccggguaccccucugagacaaagccuccagaugaacgaucaggcagcaacauuugcuguucagcaauauucacuguucugcagccuccacugcugauacccaggcaaacagcgucuggaguggaccuccagcaaacuccagcagaccugcagcugaggguccugacuguuagaaggaaaacuaaugaaucuguuauuuucuuuacugggauucccuuucaaacucccacaaacucccacuuagcccugcaaacucuaacucaacuuuuaauagcagccaauuauuugcuuagggcccaauuaugggcaaugaggucugagauaacgucucugaggaauccucugggaguccuccuacuuauaggcaggagucaucacaggucacaccaaggaauggcaaaauagaaaggaaaauauccggggucagcuacacuuugguuuguccaagcacacuuuccaguacacuuacuguguuacaacuuaucucuauaugcauguucccugaugaacuucuugagcugcagaauugacuaauccuaaaaucugauguggucauucacagcuaaaggcaucuguagccuuuuguucuucauauuguaauaauuuucuuacagauacuucccccauuaauucuugagcucuuccaggacaaagagacucagucuucuuguucuuugauucucccuugggauauaggcucaugucuaucacucagugaacauucaaaaauauuuguugaauugugaaaaaaaaaaggcaguuuuaacuuuaagauacuuagccauaguuacaaacacuuaaaaggaacagaguauuagcugugucugauggaauauaaauugaugagaucaguucaacaagccaaauuucaaaucaguuuugcuccucuggaguugaccucacagcgacuaaugacuucccaauucuccaguugcuucaucaguagagacaaucagccacagcacuggggccauacugggaaaaaugacaaaagugaucacaucugccucugauccaagaacuuccuaaggugcaugguaugagauaccaggagccaaaguccccgugagaucaugggcacaguucaacagggucccauaagcuuccuaaugacuccuaaucugugggacagggaaacauuaggcucaaaacccugcaggucccucugaaguuuauuuguuuugaaggugagauuucuuucuuuucuuuuuuccuuuuuagauuuaaagauuuuaaacauaugacgucuugccucgcauaguuucuauggaaagggaggcaguauaucugaggauggaaaaaguaauuauucugccaaaacugucuuucaccaaugcugaacgacugggcaaauucaccacauuuuccaccuucucacaugucuuaaaaaccuagucguugccaguuucaccacugguacaauauugguuaugcacaauucaaauguucaucuguaauggcaaaacccuuaauaauaacaaugauaguaaaaauaacaggcuaaauuuugcaauuuauaaaggacuuccacaugcauuaucucauaugaucuucacaacguugucuuaagggggcaugaaauuuuuguucuauagacacaaaggcuugagguucauguauaguuagugacaaaacaaaaaacuuagcuuuucugaaaucuuguuuaacauuuuuucacuauacacugugcacuuaagacuugaaagcaccaacaauuauuuauuaaauuaaaucuagcucauacagaaucaaaagaaccuucacuacuuaggagauuaguaauuuuaaaaaaagaugaaguuauuuuaccaagaucauucccuaagacaaacaaaaacagucauugagaaagagaauaugaaaugccuuuauaauggcacuaaaguaaagguuggaugcuuaaauaaguaggaaaagguaugaaguucaaaguaaacaaaaucaaacagauugcacaaauaagaugaaaaauauaaaacagcaaauacauuugguuaaaauucaacuaaugggaaaaauauugagacauuauuuacagauuaauguauaaaacagaaaacuggguguuuuggcguaaagcaauuaaauuaauggguaugaaauuccuucucuugccuccagcgaaaagcacuggcaguuuucugaugaggugagauauacauaaugcaacuuuaaagcacauacaaggcgagcguaacaugacucaagacaaaaauuuuuaaccagaagagcuauaaaaacaccacucugggccauauagagaccacaggaugcauaauauaguauuugaaaaagauuuuaaaauagcacaucacauacaaacuuuuuuuaauccuacacuaacauuagaauagcaugucagagaagugaaaacugaacgggcaaaucuugucgucaaaaguauacuuaaugaauuaaauccuuuaaaaauucucaauacagccuauauauccucaagcacagagaguuuguuuguguuccucuaucacaauaagauccuuguucuguucccaguuguuaacaaauccaacaacuuuaaaaaaaauuauugcuguuuuagacuuaccuuacccuaccaaauguaguacuucaaaaaucaaaauuagaauaucaauuauuacccuuguccuugugaaccaaaggaaaggaaaauuagcuuggguaaaagaaaugauacaaucguuauagucuagacuuacauaacaaaaaaaugcauuacguguugaggguagcuuuaacgaauugaaucacaagaaaagcaaaaaaauaaauggaaugguugauuuguuucugcuucucuagccugauuugacauaauuuucuuaaauaucacagauaagugugauuuuuccauuuuaccaugcccuggguugauucugcuuuagaugcaguauuccauuuaugaggaggucuaaauugugagguaccauuguguaaccagaggcuuacagaguuaauuacaugacauucuuaaccaaugauguauuuggaagaacuuuauaacaaguauaaggugcuauacaaauguaaguaauauauuaucauaaaauagcuauuauuuauaaagcuauguguguauaucuaugcauaugucuuuuauauaggaauauauguauauauuaaauaauuuaaaauguauauauauuuaaaugucuuuccugcuuauacucaguaacccacagauuaagaagagaaaaguaauucccuguucagguucagacagaugcuucuaaacagugaguuguacggauuaggcuaagaacaacacuugaaaccauaauuacaagaaaaaaaucuaacuauaugauguauuauacuccaaaaacagggagucuucaauuuaugaagagauuguuuuccaaaaguuuacuuguuggaucuguuacauacauuuuucugaagcuaugugguuaucuucccaacuugguagauaagagucuacuaacucauaaugaauguaaaauauaacauuauauuaacuguaacuaaucuuaaucuuuaugaaugcucuccuaauauuccaagccagcugucuggucucccucauccuuucugcuguguaccuuuagccaauuuucauauuaaauaguuugcagaggccuacucucucauuuaucgaaguuccucugaaaauaaacacagaguuuaaugcagaauuccagaugugguccgacaagagcagaguguagcggaauucuuaucuucuaugaucuagacaugguaguucugcugguguggcaaacuccaugagcuauuucagcuucauguuacucuauuuguucacauuaagcuuuaaaguuagcugaaaucccuguaucuuuaacaagugaauuauacaggccaggacuccccuguccugcccuuacaggauuucuagcuacccuuuauugcauuaaucaaguugaacaauuuuccuacaaaagagaaucuuuuagauauaaauuucaccuugugaaacuuuucuaaaucuauguaauacuuagagaaaccaguugagcuaucuggaugucuucuugaaguaaauaauuuaucugagcauucuuaugucuaaaaaaauuccuuugggaggcagaaaauguaguuuucaagacagugguucucaaauuuuacuuuauauuggaauuaccuggagaguuuuuaaaacuuccuaaguucaaaugcuaugguuugaauguuuauguccccucaaaauucauguguugaaacuuaauugccuauguaguaauauuaagaugugggaccuuuaggagcugauuaagucaugaggauggagcucuagugaguggaauuaaugccuuuauaaaagaggcuacacauagcaagaggcccuauugcccuuccccauucugccaugugaggacacagcaaccaagugccaucuuggaagcagagagcagcccucaccagacaccaaugccagugccuugaucuuggacuucccagccuccagaauuguaagacauaaauuucuguucuuuauaaauuauccagucuguaguauuuuguuauaggagcacaaauagaucaagucacccaaguugcaccaauaccaauugauucagaauguauucauuggugggugggaauggaaggcagcaucauaaagauuucuacgugaacccaauguuuggaaacuaccagcuuaagaguaagucccauagugaaaaaauuggggagcacauccuagcauccaucacuaucagcaauguggcuuucagcaaacuacuuaacuucucuaagcuucaauuuccucaucuguaaaauggagcuaauaagauuuuacucuucaggauuguuaaaaggauacauauuaagcauacagcaagaugucugguauaugauaauacuguuuuuuauuauuauuuuuagaaaguauguguuaccaauaguuuacauaacuaaaauaaucaaucuaaugaauaaccacuugaaauuuauuugauuccacaugucauuaacccuuaugaauguguucaaaauauauaacucagguaacaacaaacauuguacuguauauucaaugccacuuuaaaacccaaagaaggccaggagugguggcuuaugccuacaaucccagcacauugggaggccaaggugggagaauugagaccagccugggcaacauagcaagacuucugcuucuacaaaaaaaaaaaaauuaaaaauuaacugggcauaguggcacgcaccuguagucccacuuacuugggaggcugaggugagaggaucacuugagcccaggaguuugaggcugcagugagcuauaaucacaccauugcacuccaaccugggcaacagagcaaaaucccgucucaaaaaaacacugaaaagaaugagccggcaaaaauacauccuugacuauuauuagauaauaauucuauguuuauauaacuaaaaccacuuuuauucauuaauucauuugguaaauuaggagccucagaaauauaagguacuauguguuguacauugugagauucaaagauaaauaaaaccuugauuagugauucucagcccugguuucacauuauaauuacuuggggugauuucuuagaaauaugaaugcucaaacugggcaugguggcucacaccuguaauccuuucgggagguugaagugggcagauugcuugagcccagaaguucgagaccagacucgacaacauggugaaacccuuucucuccugaaaguacaaaaaacacuagcugggcaugguggcaugugccugcagucccagcuacucaggaggcugaggugggaggaucacuugagcccaggagacagagguugcauugagccacaauuccccauagcacuccagccugggugacagagugagaccuugucauaaaaaaaaagaaagaaagaaagaaagaaagaaagaaagaaagaaagaaagaaagaaagaaagaaagaaauaugaacucucugaucucauucucaauaagauuuacugaacagggauaggauucuggaauaaaauuuuuuuuuaagcucugaaguuuauuuuaauguguagccaggguagaggauuaccuaucuggauaauuucuaaaauguguugcuguuaccuccaaaauuauagcauagugucaacaagugcauauguuuaaguuuaagaauaaacagaggggaagcaugucugaaaugguggaauagugaccuccaaaaaucuuauccuccauaacaaaaagaacacaggcaaaaagugguaaaaucaacauuuucuagaacucucaaauuuaauaaaaggcuugcaacaaacagcaucuauucaagaaaaaugccugaaucucaguaagaaaagugagcuuugugguauuuuaacuuucucuauuccaaucucccucucuccagcuccacaguagccuugaagaucagcaaccuugcaaccgcggaaucuggggaaaucugcagccuacaaaccauaggagggacagaauagguuuggagccccacaaaagcuccauucuaaaaacugccuguauggcaauuccuaggaaaagcaccaaucacaagccuugucuuuacuugaccuaagacuucacacaguaaguaaagucuuaucccuagaguguuuguuauacaaaaucaguggcaauuauuuaacaaaaaaaaaagcugcuugagauaagcauaccaguugcaguaaauaagaggcuggucaaaaaaauuaaaagaaaaaucuuagaagugagaaguguguacagagauuugaaaaacaacacauuccugggaaucuaaaaggcuacauacaugugucagguucugugcaugcucagaaaagaucucagaaggccuuaguuucucaccgcuggcugaccuugagguucuauacaagcagaagugaagucugagaguuguaaacuguaguaauauuaaugcacacagaacccuuaucacaggguggcagacuuaagagugcaaggcauuuaaggaaauaucugucaacucauuuguugaccaauaagcugaguagaaaccucuggagucaugcaugacaaaaaaugcauauuuuacagaauuagcccaagauaguuaauaacaaaauaaacaauagcaaaagcaacaacaaacagcaacaaauacaggccacgggaaggggagagucugacuucuaggauuuucauauuuaauuauuuaaaauauugcuuuuaacaaaaaaugugauacauacaacaaaggagaaaaguaugccucaaaguaugcaccagaggaaaaagcauucaagagauucugacccucaagaagcuuguauaauguuggccuuauuagaaaaacuugaaaaucaguuauuauaaacauauuugcgaaacuaaaggaaacuaugccccaaaaaaguuugagaaaaacuuuucaggaaguagugugcaucaauaaagagaauuaaauuguguuaaaaauuaaauagaaauucuggaguugaauuucuucaguuuaguugaaaguacaauaacugaaaugaaaaauucauuagaugggcuuaacagcagauuugagcaggcagaagagacacucagugagcaugauagaugggucaauucagauuauccaaugugaacaggcagaagaaauaaaugaaguaacauaagcauagcuucagagaccugggggacaucaucaaguaugccaacauacacauaugagcauucuagaaaaaaggagaaagagaagagaaagaggcagaaaggauauuugaaaaaauaauggccaaaaguucuccaaauuugaugagaaacuuuacauaugcaaguaucuuaaugaauuuuauguagaauauacucaaagagauccccaguuaggcacaucacagugaaacuauugaaagacaaagaaucuugaaaguugcaagagaaaaugacucaaacaagggaaccucauuaagcucaacagcugacuuuucaucagaaaguguagagauguuaccaagauggugaacuuggaagcuccaaacccucauucuccuauggaaacauuaaauaaacaacuacagacugacucaauuuuauaaaagcuuugaaaaucagcucagauaucuaaagaaaaugccaaaccacaaaaaacccacacuugaaacauaaaauuuccuggcacuuuuauuugcacuuucuccaccccuucucuggcacagcauggggcagucaggaggcauuacuuuaagucuuauuuccuuccuucagccggaaggaccaaaguggaaguugcuugccauguuuuggccuaucugugggcuacuugagggacugguuucuguuuuaucugacucagagcucagacagaacaccauggcagagucuagauuucagcuagcagaagcuaugaaaagcaaggguagauacuguggccuaggaaaacuucagggagacugcagacucacagacaccugggggcaagagauuacaggcacagaaguacaacugaaugccuaagaucccaagaagaagcuggggugagccucuuuggaaaauuaaggcauuuaagaacagccauguauaugggggaaaaaaauuaaaagcauacauacaggcucagguaggaugaaugcucagaaaagacccaagaagaccuucugcuuuuacucugggaugaucccaggcucagaaacuuguuaauuagugaaggucuuccgagcuggucugcaaaaacugagagaaguggcuguuucuuuaaaugcccaguuuucaacagaagaucugaagacauacgaagaaacaggaaagcauggcuuauguaagggaacaaaucucccaaaacugaaaaaagaaaauacaucagacuuacuagacaaagauguuaaaacaacugucuuaaguauauugaaggaacuaaagaaaaacacaaauaauuaaaauaaauaaggaaaauuauauauaaacaaaaugagaauauaaacaaggagacagaaaaaauaggccuggcaugguggcucacaccuguaaucccagcacuuugggaggucgaggugggcagaucacgagaucaagagaucgaaaccauccuggccaacguggugaaacccugucucuacuaaaaauacaauaauuagccaggcaugguggcaugugccuguaaucccagcuacgugggaggcugaggcaggagaacggcuugaaccugggagguggagguugcagugagccaagaucucaccacugcacuucaggcugggugacagagugagacuccaucucaaaaaaaaaaaaaaaaaaaaaaaaauauauauauauauaaauauauaaauauaaauauauauauauauaaauauauaaauauaaauauauauauaaaauauauauaaauauaaauauauaaaauauauauuauauauauuauauauaauauauuauauauaaaauauauauaauauauaauauauaauauauauaaaauauauauuauauauuauauauaaaauauauuauguuauauauaauauauauuuuauauauauuauauaaaauauauauuauauauaauauauauaaaauauauauuauauauaauauauaaauauauauauuuguuuggauauauauauuuauauauaaaaauauauauuuguuuggauauauauauuuauauauaaaaauauauauauauuuuuauauauauccaaacaaauucuggaacugaaaaauacaauaacuaaauugaaaaauucacuauaggauauaacagcagaagaagaagucagugaacaugaacacaggucauuugaaauuaucaagucuggaaagcaaaaaccaaaacaacaaacaaaaagaaugugagaaaaggacaggaaaauuauuuaaaguaauaaugaccaaaaaugucccaaauuuaaggaaagagauagauauacaaauccaauaauucaaacaauucgaaguaggacaaacaaaaagauaaucacaccaagacaccacauccccuaguuguugaaagacaaagacagguucuugaaagugaaaaaaaaaagcaacaugucauguacaagggaucucaacaauauacauaucaguagauuucuccagagaagcuuugcaggccaaaagacagugagauuacauauuuaaaaugauaauaaaacuauaaacugaacauucgauauugaucaaaacugucuuucaagaaugaagaaaaaauuagacuaaccuagagaaacaaguugaaggauuuauuacuagacuugucacacaagagaugcaaaagagaguccuacaaguugaaauaaaaggauucuacacaguaacuugaagccauacaaaaauauaaaguucuuugguaaaaauaaauagaugaacaaauaaaaauaacaguauuacaguaauuuuguaacuccacuuuuuauuuucuacaggauuuaaaagacaaaugcauaaaaauuaugcaugucaaugaguaugcaauauauaaagauguuauuuguggcauucauaacguaguguguggguggagagaaaaguggaguuguauacaauugaaaugaaguuacuaucaauuuaagagagauuguuauaacuuuagaaugguagauguaagcuccauguuaguaaccacaaagaaaauaaccauaaaauauacacaaaaggauaucaaaaugugucacuauaaaaagaucaacuaagcacaaagaaaagcaguaaugaagaaaaugaggaauaaaaggcuauaaaacauacagaaaacaaagcacaaaacagcaaaaauaagugcuuuccuauacuuuaaauguaaauggaauaaagucccuaaucaaaauacauuggcaaaauggauuuuaaaaaaacaauucuacaauauauuauuuacaagagcaucauuuuagauuuaaggauacacauagguugaaagucaaacguugaaauaggacauuccaugcaaauaguaauuaaaagagagcaagauuguccauaccaauaacagacaaaauagccuuaaaucaaaaauuguugcaagacacaaggaaggauauauaaaggucaauucaagaggauguaauaauuacaaacauacaugcaccaaacaugaaaguucugaaauaaaugaagcaaacauugacagaguugaagggaaaaauaggcaacuucaauaucccauuucccaucaugcauugaacaacuagagagaacauaaauaaggaaauagaagacuucaaaacacuauagaccaacuguaccuaauggacacauacaaaacaccccaccuaacaacagcagaauacucauuuuucucaaguguacaauaaacguucuccaggauagaccauauaugaagccgcaaaacaagucuuuaaaaauaaaaaauauugaagucauauaaaguaucucuucugaacacaauggaauaaaaauagaaauuugcagcagaaggaaaaguggaaaauucacaaauauguggaaauuaaacaacacacuuguaagcaaccagugugucaaagaagaaaucacacaaaacuagaaaaacaacacauaaaaucaaugaaagcaagaguugguuacucaaaaagauaaaaaaauucagacuuuaaauuagauuuuaaaaaagugggaagacccaaauaacuaaaauuagaaauagaaaagauuguaagagaauaguaugaacaguuguacaccaacaaguuggauaaccuagaugaaauagacaaauuucuagaaacaaacaaccuaccaagacugaaucaugaagaaacagaaaaucugaacagaucaguaaugaguaaggagacuuaaacaauaauaaaaagccucccaacgaagaaaaggacacuuaaggugauucuguaucuuugcuauugugaaauagugcugugauaaacauacaaguacauguaucuuuuugauauggcaauuucuucccuuuggguagauacccaguagugguauugccagaucaaaugguaguucuauuuuuaguucuuugagaaaucuccauacaguuuucuauagaaguuacacuaauuuacauucccaccaacaguguauaaguguucccuuuucuccucacccuugccaacauacauuguuuuuguuuguuuuacuuuuuaauaauagccauccugaauggaguaagaugauaucucacugugguuuuuauuugcauuucucugaugauuggugauauugagcaguuuuucauauuccuguuggcuauuuguacgucuucuuuugaaaaaugucuauucauguucuuugcccucuuuuuaaugggauuauuuuguuguugaguuguuugaguuccuuguagaaucuagauauuagucccuugucggauauguacuuugcaaauauuuucucucauucuguagguuugucuauuuauuccguuaauuauuacuuuggcuguguaaaagcuuuuuaauuuaauuaauucucauuugucuauuuuugaguuugugcccacaauauauccacauaacaaaacuguacaguaccccuuaaauuuauacaaauaaaaaauuuuuaaaaagacuuucaacaagggugucaaaacuauucaauggggaaagucuuuucaaaaauguuguugggaaaacaaaugguguuggauguucacaugcaaaagauuacauuugaauuccuaccuuacaccauaugcaaaaauguaacucaaaauggauuaaagaccuaaccauaagaccugaaacuauaaaacuuuuagaagaaaacauccaaagcacaauguagcugaaguucuaagcauguugaguuuagguccagaaacagacaaagcagcauuuaguuuagauuuuacaggacaauaaaacaaaaguguuucaggcaagggugccaaaucuaguucacuucuugaaaacaguuauacaaaggggcuuccacaugaaaggagauagaaaaacauuacuacuaaagguugccuguggcugcuucuuauaugaagcugugugccuagagagaucaaguuggacccaaccuucugaccagaaacugagcaagggauaaggaagauuucacacucgggguaguugcuaaagcaggggcuuguuggguagaaaagcgggcaugcuggaaaaggacagucugccugaaagaagaugaaagaagagaaaacagccacacuuugauggacacagcauaucaaauuugacaucagaauaauuccuaagcacagauauaaucaucguaagugauucucucacacaggaauuuugcucaguaagaaagcuggguggccaggcuggaaaauggagagggauuucugaauuccacugucucuuagucuuaugaucucaugggucucuacuggugguguugaagcuccacaaccucaaagucucugcagucccacauuuuggugugcugucccucagucccacugucccacauucugaucucacaguuucacacauggacacucccauggacuucaagucucccagcccuguguacucaaugauguugcagcucugcaauuaugcauucucacaguagaacagucucacgguuaagcagccccgugaccucaguuuuguuggccaauuugagauuggugaucucauguugauaauaaugguaacuggcccaauuacaugaguuucuccugcaacauucaccagccagacuacagucauggacaagauggauaaaugcucuuuccaggguugggaguucauuaggcagguaccauggaaagaaagagaguauauggacuugaggguauuugaaaugcagugagugcuaugcaauauauccauggaacaaaacugcacuuguacccaauuuauacaaauaaaaaaugcauaaucaaaaaaauggagcaaguacaaugauagaucauggaacaaaugugugcaaugagggaaccgaagauagcaaaaggcugguggauggaaaaaacagugaggucaaugggcagggagccugauggggucacagugcaaugggagugcuuaagcaagugaacuggaagaagaggccaucuggggucccagucaggugucugagucaaugaauuuugacauggcacaguuucugaucugaucacgacagcaugcauuguuugaugcugggcacucuuggcugaggugaauauaaugacauaauuuaauagaugaaguuauuaauuuaauaaguaacugaaaacugauaaccaacugugcuuucaaaauuaagugguuaagugguuucaugaauagcuaguggcugguacacaauucuauauaucccuguuuagaauaggcaaugcuuuucguuguaaguuaccauuuuguacacuguguuacucuucugucaauuucaucccuuuguagacuagcagccucuauugcagcccucuguggaguagggaaugggagggcaguaguggagagauagggaggagaaaggaaagugauagauuugagcuauggccagugauucuuucggcugugcucugaagacaggcuuuuuaaggcccucacuuuuguuuggaccccuuauguccccacuugaaaaucugguauauauauauuuaaaaaaaaaaaaaacuuguauuaucauucguuacucuaaucuuuuaggauuuuaggaucugggggccagaugggugcauacuuagaacuauuuggugacugaaaaugacaacugaccccaaacagggaggcagaacccaaaugcagauuacauuuuaaagacguuuuggauuuagaaaaaaaaguugauuauuuggcaccaugucauacagcgauauauucgacagcccaaacauggcuaaaucagagcuuguguuuauagcaauauuccuagcaugaaacuaaaccccuccacaagccuucuucucaaaguucucauuggcucccugauugggcauggaccguugggcagcugaaguuaaacagagggugaugucaaauuccuguccuguuugaucagcuguguucugucacaccuguggucaggaaacuggccucauccauacucaguccucaacauuccuggcuaaauuacccaagcauguaucccaaccucacagaaauuaacuucucuucucuuuuggggaaucauucucaaauuccugacuggcuucucaguuuggagcagaacuuuaggucacugguuuucaaauuacuagaguuuuuuguuuuuuuuuuuuccuucaagaucaaaaccagacauugucuaaacaaguagcaaaauuaaguuuaggaagguuacaaggccaaaugaucucauggauauauauuacugauuuggaagacauauugaguuuucuuccuaacccaacaacugacuuauuauacauucagaguauuuauucuaagauaagaauaccuguuuucuaucuaauucauaaggaaauggugaugauacauuaauaugaauuauacuauuacuucuuaugaaaaugcaaauauaguugaacaucuuuuuuuucuuaauaaaaacuuuuaaaaacucauuaaugaaaggaagcagaauuaaggaaauuaagcacuaucuugcgauauucacaaaacaaauaauauuaaaaaugcacugauauuuaagaaaaaauguuucuuacaaauguuggcaaaaggcaugaaaauaaucgugugauacgacacaauuaaauuuuuauauaaauuuucauauuuucaguaucuuaauguucacggagcacaaauuugaguagacuuucugcagcagacaguuuugcuucuuaagaacaaagaauuuaauauauggacuuuuaccagauucaguugcauucuuuacaucacaacuucauaauacugaacaccuguucaacuacccuuuuucuccaaaaauguguuugaucguucagcuugaaagaaacaguuuuacacuucuauuuacaaaucucucacauuuuucacaaagcaguuauuaguugaaucagacuuacagcucuugaaauuuacacauaacaucacuacagaggucgaaucuuaggaucucuguccuuuuuagcaaucuuaauaggaaaaaagaacuuuucuuagacauaacacagaaaagaucuuaaaugguaaauguucaaauaaaacuucuuuaaaaauaugcagauuauuuuuuaugacuaguucacuuuaguuugaccuucuguucuuggguucuugauagacuaaaaaagaccgugcggcuuucuaagugaagaugcuuauuuccugucuuaaauuauuucgagguuuacaaagugaucuuuguaaaacagacucucauuucacacuccgauuuuccuaucagauaaugaauggaccgauaauuuuuaagcuggaaaaacauaucuguuucaccuaguacauuuuauuuaucaccaauaagcuaucaauaacuauuacauacuugcuuucuccaaaaugaaguuuuaaacuuaacugaaacacuagucuaccaacaaaaaggucaauacuucuuauuacaaaaaucccacauuccauuuguuuuaugcauuuaauaacaaaauaauuauaacacaaaagcaaugucaacuuacacugugaaucuuuauuucucucaauuauccuguaauucauuacugaagucuuugauucugcuacuucguugccuggcucaaucacugauagguagcuuuaaauguuuccaacaagaaaagauguacuacggccgggugugguaacucacgccuguaaucccagcacuuugggaggccgaggcgagcagaucacuuguggucaggaguuugagaccagccugaccaacauggcaaaacccugucucuacuaaaaguacaaaaauuagccaggcauggggcugcaugcuuguccauuccuguaaucccagcuacucgggaggcugaggcaggagaaucgcuugaacccaggaggcagagguugcagugagccaagaucacacuacugcccuccaaccugggcgacagagccagacuccuucucaaaaaaaaagaagaagaaaagaaagaaagaaaaguaaaagaaaagagaaaagaaauaaagaaaagauguucuacauucacuagaagcaauauucacaucuuauuuucuuaacacauacaucugaaaauguguucuaauguguauaacaauauaaaaaaacggauaacaucugguuugaacaguugacauuucaccauguccacaccacagggacacacauauacauggugaacuuagguuucaugacgccugacagacgugguaggggcccugaaguagcaacagcuugucuaaaggcguagcuggugcuuucuucccuuucauguggcucucagcuauaauuaacaauggcugguuuuugcagcauuacugucagugccauuaauccaaacaaagacguuauuucaaagugaugccaaauccuaugacucauaaguuaauaagucuaaaguuacuugcaaaagcauuguaguugaaaacaauguagaaaugcuuccguacaaaauaaaaggcaauucuuuccuagaaagcugagccauuaacuuaccuaaauaggacaggggcagugacggggagaaagaaagggcuauacuauuugguaugaucucuucuucuaguuccacuguuuuauugcaagcuggaugccccagcauauucaaaaaacauuucccaucccuacugucccucagaauuuauaaccuuauuagaaggccagguguggugacucaggccuguaaucccagugcuuugggaggccgagguggguggaucaccuggagccuggaguuugagaucauccugggcaacagagcaagacccuaucuugaucugaaaaaguuagccaggcaugguggcucaggccuggaguccuaacuacucuggaggcugaggcagcaggauugcuugagcccaggagauugacauugcagugugcaaaugugccacugugauccagccugggccaagagugagacaccaucucuaaaaaauaaauauuuaaauaaauaaguaaauaaauacauaaauaaucuuauuagaaaacaaguuuaauccaucuaaaaaucauagaacuuacaaaauauucauugaaaaugcuaaauucaauauaaccaaguggggaaaguuuuggauagugauauaaauacaacaugagaccucaaaaaaauuccaaguacacauaaccuccacggauauacauuuacauguaucuuuggucauauuauuucccacuaauccaaaaggcaguugaucguaaaauaaacuauuauuuuauguaccaccaagaaaaucaccacugauuaaccuaugauauaaaguuacugauaaaacaaauauauggggagcuaugcuaaaauuuuuaccaaagggucagcaguaacuauuuucucucccugugugaaagaacauucuagaaaggcuuaaaagaaauuuuuuuugagacagggucuugcuuuguugcccaggcuugagugcaguggcgcaaucacgccucacugaagccucaaccucccaggcucaagcaauccucccaccucagucuccagaguagcugggacuacaggcaugugcauuaaaaaaaaaaaaaauuguuguagaggagucucccuaugcucccccagcugaccucaaaauccugaguugaagcaauccuccccacuuggccucucaaguucuggggucacaggugugagccacuuugcccggcuucaaaugaaauuuuuguuucacucaaccucacuguuccuuaacacuggaaacuuaauuauguaaaugaauuaugauauauccauacaauauaauacuauauagccaaagaaaauuagacaggcauauggaaagacauacagagagaauuagagagagacucacuagucaucgguacgaaaaaaaaaaaaaacuguuagcucuuaauaucaguuauccccaagugcuaaaauuacaggugauuuuuuuaauuugcuuuucuuuaguuucuaaaacuuauauaaugaacauguaagcacacacaaacucauuuaauucuugagguuuacaacuuuucauagcagauggcuuacaaaaacaacucugucuuacuugcauaucucagaccugggcaccaaaacgauagccgcuaacuacauguaacuauuuauacuuuuauauuuuuauuuccuauuugagauggagucuagcucugucacccagugcacuggagcaaucuuugcucacuacaacugcagccuccuggguucaaaugauucuugugccucccaaguagcugggauuacaggcaugcgccaccaagccuagcuaauuuuuguauuuuuaguagagaugggguuuugccauguuggccaggcugggucuugaaccccuggcuuccagcuauucacccgccucggccucccaaagugcugggauuauagacaugagccaccacaccugaccuaaacuuuaauuaaaacugcauauaacucaaaauucaguuauuuggcccuacuagucacauuccaagcacugaauagccacauguggcuaguaguugccguaucugaacaauaccuuuucaucaucacgcaaagugcuauuaauagaguugcccuaaccaugguuugauucagaucuguguaaauaaugagaugcuauuauuaaacaguauaaaugugcuuucuuuccucuugccuuucugagcacaugaccucugucauauucuacuccugaaguacccuucugccuuggaagaaugugauuuguuguagaaggacgcaaggugggagacaaauauaauauucagcuucugacccugaaaaauaggaccuuuuaagaagaaacagccuugcaaaucaggccacuuucuuaaggaaagaugcuuuaaauuucccucucucucauuucaagcguucacuagacaagugucuucaacauuuugcucacauaucccaaugcacuuuugaaaagcuguguaucuucuucaucucuuuugaauugacaucuaaaaauguucaucaugaauuuagccacaaagauuuacuuucugauauuauacacgucaaugaaauuuugucccugcauauuuaguuaauucaauaaauggaaauaucuuccuuauuaccuaaucauaaaagccagugcucauuguugaaauaaucagccaaauuaguaaucugcuaggaaaagucugacuuugauuuuuuaaauucauaucaagguauuaauuaggaucccuuugauaacuuucucacuucuggauugaaauucaaagauaucaauggguaggcaauauucaaauucaaguacauagauugauagguaauagauggaugauugauugaaagauagagagauagauaagcaggccaugcguuuguugccuggauaaaauaaggaggugccucuuucaguauuccuuucuauucuugcucuucugguuuuguucuuccuggacuugcccucaggaauuaggcauucuagaaccauccuuuugcuuggugcucuagaaaucuuuuacaguacucagagcaauguguuuauaggauuaaggaacagugagagccaggccugucuuuuuuucuccaucugugcuuguguauguguacucuuucuagauacguagauauauguauauagauauagauauauagauacaugcacaaaaucacacacacaugccucuuccauguuuaucacuucuuaaaccugagcuaucuucuggauuucauacuagccuccuucucuuaauagcugagcuucuagaaaaaacuaugaauccuuuuuuccucuauuuccuccccucaauucauuucucgcuccagugccauccaacuuaaacucucgccucucaguggaaauggcuacaaccacgaccgccuaauuccuguacuuaauguacucuuuucacuuuucaagggaaauugucuucuuagggguaaauaauacuguugaacauucucccucccucuugauuucucuccuuucuuggcuuuuuuguaaucaaguucuccugguuuucccauccccuucccacccgccugccuucuuucuuuacuucacucugucauugguggucuccucucacuccaguccuucucccuuccaccuacacucagaccuccacuaccuccuaaaggcuaaugagcccuacucauauaucuccauccagaauucucuccugacauccagauucguguauucaaaugacuggacaucucuaccuggaggaaggcaacuccaucaucuuuuccucagacgauguuauucccauguuugguaaaaauucuaucauguuccuagcugucaacauuaaagaaaaaaaauccaaaauucaaacauccaaucacucaccaauuccugauucuacuuuucaauucuuucuuauauugucucuucucuccauccacacugccaugguguuaggucaaauuuuaaucauuuucaucugaacuacuguaauagcccaauuugucacccauucuuacaugguuuauuuucuaauuagccauguggcucaugucacuuucuuguugacgauucuucaaauguucguguugccgcaaugauaaaugcauacaagagagggcaguuccuggugagagaugugaucaagcagagaucuuuuucaggaggcugucuuuccuuuaagacaagaagagggcuggaggcagggaguauucagaggguaggugaaguucaagagaaauggaacaggaagaagcucuuucaguagccuaggaucuaguuuagaccuuggggccaagagcaaagagagaggugggcugggucauguuuuaggcugcuugcauacgagaccagccagauauucaggaaagaaagcccaugugagaauaaugaauaugaaaauacugaaaaaucuuuuaagcccaauaauagauaauuagauuuggaguugaaauucauaagaagacagaacacacuuuacauauaauaauagcacuaagcagaaauaauaucuaucaaaauggcaacucaccaaugauaauauuaaauuugacauuuaaauauagauuuucaaugaccauugacaguuaaucaguaucuauaacauccuuuuuuaggaaagggaaaggacuuuaguuauuauuauauuaguuaugauuauuuagccauauucaucuuaguauucauccucucuacuaaauuugugguuuugccaaauauaucuucaauuuccaaaaaaaacaguuuuaagccuaugaauuuuuaauaacaguuuaugugaacccuuagguguuucugagaauauuaauuuuaaaauuauuucauuccuuacauuaucucuguuucuucugaagucaguucugcuaguucaugugggugugugucuuuaacaugguuaguauuccuuaaauauauagugaucuuuguuuaaauuuaugaaugaaggacuggacugauuaguuaaagugacugauuaagauuauccuucaaggauuuguaucaaucuuuccccaguuggcuuauuucuuucccuguaaacaauauuauuuaaauuuggcacuuuaaaaaauauauuugaacuuuaauaggaauuauauuauauaucuauuucugcaaguuuuuauuuuguucaacauauuugugauauguauugauauugacgaauacauugccaaaauacauugauuuuucacugcugcaauguauaacauagugugauuccaguaaggauuugagaucuuuuuaauuuuuuggcugugauaacaaaugauuccauuaauggguuuauaauaggucuccucuauuccaaacacacauuacaauucgcuuuuuaaaaaauauuauauuuaggaugacauuuagagucaaguuaaauuuauuguagaacuauccuuuauauaaaaauauucaacaagaccuaggcaagauggccaaauaggaacagcucuggucugcagcucccagugagaucgacacagaaagugggugauuucugcauuuccaauugagguacccaucucaucucauugggacuuguuagacaguggguacagcccacggagggcaagcagaagcagacuggggcgucaccucacuugggaagcacaagggaucagugaaaucccuccccuagccaagggaagggggagugugggacugugccaugaggaacaguauacucuggcccagauacuacacuuuucccacggucuuugcaacccgcagaccaggagauucccucaggcgcccacaccaccaaagccauggguuucaagcacaaaacuggggggccauuucagcagacacccagcuagcugcaggaguguuuuuuucauaccccaguggugcccggaaugccagcgagacagaacuguucacacuccuggaaaggaggcugaagccagggagccaaguggucuagcucagcagaucccacucccacggagcccagcaagcuaagauccacuggcuugaaauucucgcugugagcauagcaguccaaagucgaccuggcaugcucaagcuuggugggggaggggagucugccauuacugaggcuugaguaggugguuuuccccucacaguguaaacaaagccuccaggaaguucgaacugggcggagcccaccacagcuccgcaaagccacuguagacagacugccucucuagauuccuccucucugggcagggcaucucugaaagaaaggaagcagcuccagucaggagcuuauacauaaaacucccaucucccugggacagaacaccugggggaagggguggcagugggcacagcuucaucuaacuuaaacauuccugucugcuggcucugaagagagcaguggaucucucagcacagcacucaagcucugcuaagggacagacugccuccucaagucggucucugaccccagugccuccugacugggagacaccucccagcagggguggacagacaccuuauauaggagagcucuggcuggcauuuggcaggugccccucuaggacaaagcuuccagaggaaggaacaggcagcaaucuuugcuguucugcagccuccgcucaugauacccaggcaaacaggaucuggagugggacuccagcaaacuccagcagaccugcagcagagaguccugacuguuagaaggaaaacuaacaaacagaaaggaauagcaucaacaucaacaaaaaggacguccacaaaaaauccccaucugaaggucaccaaccucaaagaccaaagguagauaaauccacaaagauggggaaaaaccagcacaaaaaggcugaaaauuccaaaaaccagaacaucucuucuccaaaggaucauaacuccucaccagcaaaggaacaaaacuggaagaaugaguuugacgaauugacagaaguaggcuucagaaggugaguaauaacaaacucgucugagcuaaaggagcauguucuaacccaaggcaaggaagcaaagaaccuugaaaaacagguuagagaaauugcuaacuagaauaaucacuuuagagaagaacagaaaugaccugauggagcugaaaaacacggcaaaagaacuucgugaagcauacacaaguaccaauagcugaaucgaucaggcggaagaaagguuaucagauauugaaggucaucuuagugaaauaaagcaugaagacaagauuagagaaaaaagaaugaaaaggaacgaaugaagccuccaagaaauaugggacuaugugaaaagaccaaaccuacuuuugauugguguaccugaaagugacagggagaauggaaccaacuuggaaaacacucugcaggauauuauccagcagaacuuccccaaccuagcaagacaggccaacauucaaauucaggaaauacagagaacaccacaaagauacuccucgagaagaacaaccccaagacacauaaucaucagauucagcaagauugaaauggaggaaaaaaucuuaaggcagccagagagaaauguuggguuacccacaaagggaagcccaucagacuaacaguggaucucucugcaaaaacucuacaagccaaaagagagugggggccaauauucaacauucuuaaagaaaagaauuuucaacccagaguuucauauccagccaaacuaagcuucauaagcgaaggagaaauaaaauccuuuacagacaaucaaaugcugugagauuuugucaccacuaggacugccuuaugagagcuccugaaggaagcacuaaauuuggaaaggaaaaaccgggaccagccacugcaaaaacauaccaaauuguaaagaccaucaacacuaugaagaaacuauaucaacuaaugggcaaaauaaccagcuagcaucaaaaucacaggaucaaauucacacauaauaauauuaaccuuaaauguaaaugggcuaaaugccccaauuaaaagacauagauuggcaaauuggauaaagaucaagacccaccggugugcuguauucaggagacccaucuuacgugcaaagacagacauaggcucaaaauaaaggaauagaggaaucuuuaccaagcaaauggaaagcaaaaaaagcagggguugcaauccuagucucugauaaaacagacuuuaaaccaacaaagaucaaaaaagacaaaaaagggcauugcauaaugguaaagggaucaaugcaacaagaagagcuaacugaccuaaauauauaugcacccaguacaggagcacccagauucauaaaacaauucuuggagaccuacaaagagacuuauacuccaacauaauaauacugggagacuuuaacacccacugucaguauuagaucaacgagacagaaaauuaacaaggauauucgggacuugaacucagcucuggaacaagcgaaccuaauagacaucuacauaacucuccaccccagaucaacagaauauacauucuucucagcaccacaucacacuuauucuaaaauugaccacagaauuggaaguaaaacacucccuagcaaaugcaaaagaacagaaaugauaacaaacagucucucggaccacagugcaaucaaauuggaacucaggauuaagaaacucucucaaaaccacacaacuaaauggaaacugaacaaccugcuccugaaugacuacuggguaaauaacgaaauuaaggcagaaauaaauaaguucuuugaaaucgaugagaacaaugacacagcguaccagaaucuaugggaaauagcuaaagcaguguuuagagggaaauuuauagcacuaaaugcccacaagaaaagaucuaaaaucgacacccuaacaucacaauuauaagaacuagauaagcaagagcaaauaaacucaaaagcuagcagaagacaagaaauaacuaagaucagagcagaacugaaggugauagagacaggaaaaacucuucaaaaaaucaaugaauccaggagcugguuuuuugaaaacauuaacaaaauaaauagacugcuagcaagacuaauaaaaaagaaaagagagaagaaucaaauagacacaauaaaaaaugauacaggggagaucaccacugaucccacagaaauacaaacuaccaucagagaaugcuauaaaaaccuuuacacaaauaaacuagaaaaucgagaagaaauggauaaauuccuggacacauacacccucccaagucuaaaccaggaagaaaucaaaucacugaauagaccaauaacaaguucugaaauugaggcaguaauuaauagcccaccaaccaaaaaaagcccaggaucagauggacucacagcagaauucuaccagagguacaaagaggagcugggaccauuccuucugaaaccauuccaagcaacagaaaaagagggacuccucccuuacucauuuuaugagaccagcaucauccccauaccaaaaccuggcagagacacaacaaaaaaaagaaaaugucaagccaaugucccugaugaacaucgaugcgaaaauccucaauaaaauacuggcaaaccgaauccagcagcacaucaaaaagcuuacccaacacgaucaagucagcuucaucccugggaugcaaggcugguucaacauaugcaaaucaauaaacguaauccaucacauaaacagaaccagugacaaaaaccacaugauuaucucaauagaugcagaaaaggccuuccauaaaauucaacacucauucaugcuaaaaacucucaauaaacuaauuauugauggaauguaucucaaaauaauaagaacuguuuaugacaaacccacagccaauaucauacugaaugggcaaaagcuguaagcauucccuuugaaaaccagcacaagacaaggaugcccucucucaccacugcuauucaauauaguauuggaaguucuggccggggcaaucaggcaagagaaagcaauaaagaguauucaaauaggaagagaggaagucaaauugucuuuguuugcagauggcaugauuguauauuuagaaaacccaucgucucagccgaaaaucuccuuaagcugauaaccaacuucagcaaagucucaggauacaaaaucaaugugcaaaagucauaagcauuccuauacaccaauaauagacaaagagagagccaaaucaugagugaacucucauucacaauugcuacaaagagaauaaaauaccuaggaauagggccaucugaggccuccagugcgguaccuccuauuagauacagcugaggccccaccaauacaugcaagaaacccuucuccucugaaaagcuggugucacaggcugccugucauuuccaugaguucuauggucacaccaagacaaggguguccaccaaccagggagaccacugucccaaccagaaagacuuccuguaucuccucuuccuccccucugggguucccuuuagaccuucucaagauaauacaaucuauguuuucuccaaauaaggacuaccuguugccaaaaaggguauaugcagacaacaaucugagguuuggaguuuuaaaaaacucuucugaccacuauguugacuacuccccaaacuguucccucauacagaaugacccacaccuuaguuuagcuccuaucagcucuguaagcauaaaugacuuagaaauuaacaauagcuuuccacgugauagggcuccugcaauguggugcacauuccuaaagccuuccagacuuucuguaagaaguguggcaagcaccaaccccacaaaguggcacaggacaagaaaggcaaggaugcuguguaugcgcggggaacauggcgucauggcaggaagcagagcgggaaucuugggcugaguacucaggaggcugaggcaugagaauugcuuaagcccagcagguggagguuacagugagcugagaucacgccacugcacuccaaccugggcgacagagcgagacuccaucucaauaaauaaaaaauauaaauaaauaaauauaaaaaguccaucacugccucugagauuugacuugccacuuuuaucauauacuaaauucccauuuguacuuaggucuauucuguacuuucuauccuauuccauuggucugucugccuguucacauggccaaugccacacuguucuaaauacagaggcuuuaugguuuguuuuaauagcccauagggcuagcccauuuugugccaguuuuucccuggcuauuccgacauguuuauuuuccauagaagcuuuaguaucaacuuaccaacuccaugaaacaaagcuuguuggcauuuuuaugggaauggcauucaauuuauaaaucaacuuggagggaaugggcaucuugaugaugagcugugauagccaaaaacaagggaugucuucccacucaaaacacaaaagggaugcuucuuuguugcuauuauacauggguuuuucuuaaguccuuuaacauaaauauuguuuguguuuaucaaggccauugauuucuguaaguaagccaauuuuccaauaaaaaggcuaaaacuacaaaggagauggugcugaggcuugagcgcugagcccagcugcagaucuaagacgaugcuggauaugaggacaugcaagcauuuugaacuaggaggagauaagaagagaaagggccaagugauucaguucuaaauuucaucuuuuguuuuauuaugaagacaauaaaaucucgagguuauuuucaguucaaaaaaaagaaauguaugauaaauuuuacacuguaaauaaauccuuuuuugugggugaaaaaaaauaccuaggaauacaacuuacaagggaugugaaggaccucuucaaggagaacuacaaaccacugcucaaggaaauaagagaggacacaaacaaauggaaaaauauuccaugcccauggauaggaagaaacaauaucaugaaaauggccauacugcccaaaguaauuuauagauuaaaugcuaucccuaucaagcuaccacuggcauucuucacagaauuacaaaaaacuacuuuaaauuucauauggaaccaaaaaagagccuguauagccaagacaaucuuaagcaaaaagaacaaggcuggaggcaucacacuaccugacuucaaacuauacuacaaggcuacaguaacuaaaacagcaugguacugguaccaaaacagauauauagaccaauggaacagaacagaggccucagaaauaaugccacacaucuacaaccaucugaucuuugacaaaccugacaaaaacaagcaauggggaaaggauucccuauuuaauaagugguguugggaaaacuggcuagcuauaugcagaaaacugaaacuggaccucuuccuuacaccuuauacaaaaauuaacucaagauggauuaaagacuuaaauguaagaccuaaaaccauaaaaacccuggaagaaaacguaggcaauaccauucaggacauaggaaugggcuaagauuucaugacuaaaacaccaaaagcaauggcaacaaaagccagaauugacaaaugggauugaauuaaacuaaaaagcucugcacagcaaaagaaacuaucaucagagugaacaggcaaccuacagaaugggaaaaauuuuugcaaucuaucaaucugacaaagggcugauauccagaaucuacaagggacuuaaacaaauuuauaagaaaaaacaacuccaucaaaaagugggcaaaagauaugaaaagacacuucucaaaagaagacauuuaugcgaccaacaaacguaugaaaaaaagcucaucaucacuggucauuagagacaugcaaaucaaaaccacaaugagacaccaucucacaccaguuagaauggcaaucacuaaaaagucaggaaacaacagaugcuggagaggauguggagaaauaggaaugcuuuuacacuguuggugggaguguaaauuaguucuaccauuguggaagacaguguggcgguuccucaaggaucuagaaccacgaauaccauuuuaccugccaaucccauuauuggguauauacccaaaggauuauaaaucauucuacuauaaagacacaugcacacguauauguuuauugcagcacuauucacaauagcaaagacuuggaaccaaccaaaacacccaucaaugauagacuggauaaagaaaagguggcauuuauacaccauggaauacuaugcagccauaaaaacgaaugaguucauguccuuugcagggacauggaugaagcuggaaaccaucauucucagcaaacuaauacaggaacaaaaaaccaaacaccgcauguucucauucauaagcgggaguugaacaaugagaacacauggacacagggaggggaacaucacacaucggggccugucagggggugcgggacuaggggaggaauagcauuaggagaaauaccuaauguagaugacggguugauggguggagcaagccaccauggcauguguauaccuauguaacaaaccugcacguucugcacauguaucccagaacuuagaguauaauuuaaaaaaaaauucaacaggcagaaauaacuucagcaacaaggaucuuaaagggcaaucucuaaaccuauagaaaaaauguuaagagaaauaggcucaaaagugaucuucaaagaaaauaacaaaauuuacaaaucaagggcuaaaaucgauuucagaaacuucuggucuccuguuuuuagugacagauaagaaaagugagagucauugaaaucaugugaccuuuucaaagcaacacagaacguagugcucucucacugcaggcuguaaggacaauagaagcagucaugucucccccauggcugcacucucucuggauagcagguaaaugcagacaaauuucuuaucccucaagagacaagaacagucaacuuguccucacucugauuuaccugggaugcuugcuuccauugcaccaaucagcuagaauuuggcaagcacugacaucuuuggcuaguuuugcuuugcauuuuaaaacugaccagaaaaaaagcaaugcuccgaaauuauuuuggcauaaacauugugcaacccucucccaccagauaaaucugacuuacaauaagucaaaagcaauuaguaaccugugguggcauuuuucaguauaguauuagagauucuagaagagacugacuugcaguccguucuuaccuuugcauuuuugaugcauggacagagugcccaugcugcgcuggccuucacgucugggugaggauuuuucagcagggaccacaacaaacgaacuccaucuaagcgaucaauuauccuaucguggaacccaaaaucaugauauaaacugucauuaguaugugaagacaaacauuuuaaugacccacuuauuuaauuauuuuuucuccuuuugauauuuugcuuagaauuuuuuuuuuuuuugcaaaacuucaucaacaguagggagauaacaugcuguugaauugucagcccucugauuucaguuuuaaauccaugacacagaaaacaagcugcuugaugauuacgauucacauaaacugaaaaucaagccauguaauuuuuuaauuagcuguacacagaccuguuaccuaaauguaaaaauacggguuucuuucauauaguaacauuuaaauacuuuccaaaacaaauauuuaugccucaaaacugugcaguuaccuuuuuuauuuggucuauguuuaauugacuuaccuuaccguaugacauauuuuaaaugcuuucaguccuaaucuagcauuaggaauuaaaaucauuacaccacagugcauccuuuguugggcaugaauaacagguaacuuguuuuccaugugcacccuucccagcaagacuaacauugcagacuguguuauaauuacuuaaagacacuguaaucaaaauagcuucaugacuagcugaaaaaugaauuaucaucagagccaucucuccaccaucugucuucuguuuauauaucaaucaguccaggagcauaaccucgcaguaagguccauuggguacucacagcggagaagaaggccaaacaaaacuuaauaaccuuuacaaacauggcuuuguuucggaaagguauauuaaacucaaagcagaugaaaaaagauaaagggcaucaaaauuccuuugauuuuuaaucucaaguugaauuaaacacauguaguauugagccacagauagaauaaauacuagcuuaaaaugccauucaaauucuuccuugaaaauugacguaaaaacaucuagaugucuugauuaucuuagaugaguuuaccaggggggaaaaauguauuauuccaaaguuuucaaguaggagaucaguuuugcauaacuuuauaaaauuggugacgcugaaaaagagcauugaaaaaaacuggugauguaaauagccgauaguaagauaaaaacugucuuaaaaaggacuucuaauaagaaaaaauacacguaaaaauuauuuuaaagcaaagcuuaaguaaguagguuuucaaaccuaaaacuuucauaccaugcugagagaaaacaguuuuauuucucaauuaauggaaacucuaaagaaacauacuagcacuucacaaugaaggauuugcuuuucaaauuuaaauugaaaagucauacugccuuccauaugcuacuuaaaauauaacuaacgccaaucucugagccucuauuuuuuucacauaaaauuucacaaugaacaacagugaauaauggccugcccuaucuucuugaaaauuucgcagcaaauuuggcauuagugauauuuaacuguauauugcuggacagaaauaacuugucauugcaguggaagucauuuggauggcacaaauuugcaauuuaaaaaaaggaacauucaauccuggacaaaauuucacaauuaacuuuaaaacaaguuauagacaaaauuucacaauuaacuauaaaaauucacuauaauuguaaaauuagaucuaucauuuaccauuuucaccccaaaccuuaggcaauucaucagcuacuuagcuauaaugagugaggauuuugaucucauuacuggugucuuaaaagaagacucaggggcggggcccagugacucacaccuguaaucccaacacuuugagaggcgaaggcaggcagaucacuugaggucaggaguucaagaccagccuggccaauguggcuaaauccugucucuacuaaauauacaaaaauuagucaggcuugguggcacgcgccuguagucccagcuacucaggaggcugaggcaggagagucgcuugaacccaggagguggagguugcagugagucgagauugcaccacugcacuccagcuugggcgacaaagugagucuucauuugaaaaaaaaaaaaaaaaaaaaaaaaagacucagaacacuacggaaugauaacuuccuaugacaagaacaugauugaaaaacauuugcaaccauaggaacuaacaaagucaggaguaguaaguuagaauuuaacuuuauccuuuccaucucccucauccucugcaugaagucauuuauugcuaaauuuuacuucacaaugacucaaguaucugcccauuucccuguuuucuauuuuagcacccaaaucccagucuuuaccauuucauaucaggaucguugugugagggaauaacuugguuuucuguccucaguuuuucucaauuucaauccaucuuauaaaucccagcaaaauuaauuuuccuaaagacacuuuuagaauuucugcaauagcuccuugagaucaggaugccagggauauucauucuguucaugacacuagcuagcacauuugaucagcgcuuguuaaacgauucucaacccaaagaucacuccuagggaaaaaagucuccaauggcuucccguugccuucaugguauuaaaccugcaauuccagagcucgguauuuaaauuuuuuagggggcuggaauuucucauaauacuccuuggcuaucuacuaaacacuaaguacuaggcauacagaaauaacagauacacuugggucaggcacgguggcucacgccuguaauccuaacacuuugggaggccaagguggguggaucgcaugagcucaagaguucaagacuagcccaggcaacaaaggauccugucucuacaaaaaauacaaaaaaaaauuagccaggcaugguggugcacgacucuaaucucagcuacuugggaggcugagguaggaggaugacuugagcccaggaaguggaaguugcagugagcccagauugcgccacugcacucuagccuggaugacagagccagacccugucucaaaaaaacaaaaaacaaacaaacaaacaaaaaaacagauacagucaauucucaucaggggaaguuauguucuaucaagucagugcaaaccuuugaugaacaaauagugaacuacccuuccuaggguauauauaaaguggguucccgugagccucuagucagaauguuuucaucaaccaaucaauauauaacguuguuucacguguauuucucuuuaaagacaccuuauuaaauauagauuguugaaucaugaauauuggacuuauggccaguagcucuguaacuugugccugaauggcguuuagggaauacacagauuuuuuuccaaaaggaacaucgccgccguccugcacuuaggaacacugggcggcacuucagcacuauguuuagggaccauauuaaaacagcaaaaucaccaucccagagcacagacugugaaaaacguggcacuaaacagauugccaaauggacaagcuguucacagugugagagcuggaacgaaaagucagaaugucaccuuuuuggaccucagcagaaaacauaugcaccaggugacucaaaaugugucccugcucugcacguguccaggaaugacagcgcaagugaugugacuacugauuuggggguuauaaauaaaguuuagagacuguaugaauucaucaauucagaauuugcaaauaaugaggacugacuguauuuuaauggaccauugggaaacuacagucuugugagggugauaaacagaccauuauaaucuguaauaaaugcugcaauagaugugagcguggaguuucacaugaacacagacagaagacaccaguuuacucacaggccacagagcuucuccccguuaugcacuuucaacuauugcuguuucccagccaucuccguauuuuacauaguaauccaucacuuaaggucuacaacaaaaccucuuucgcaaauucucuggcaucuuccuccuuuaagcuucuuuuuaauuuugcacucccuuuuccugccccucauaccacauuacuuugccuuguagucuuguguugugugcuucuuaucuccccaauuaccauguaaucuccaugacagcaggaauucuguauuucccaccacacucccagcaggcuaccacaccagugaauacugaugaaauggaucugaaacaagacagccuuugcuuacucuuuuucauugcaucaaaaaucucucccaacacaaguacacuccuccuuaaaccucauacuugcaaaauacacguucaaauucuaaaucggagcaguaaaguuuucauuugaaguugucucuaaguggaaaguguauuuucucagaauuucuugacaacuucauugcuuucugcauacacacugaugggcuuauaggugguguuaauuuauaccacucuccauuuucaacaggucuaccccuuauauaguucuuuaauuugauuagcaucuugcucugaauucauuuccagcaguaugguagcucuucucauuuugcauagcaauagaauccuaaauuaauuucuugacauuauaaaaacaaaacugaauuacaugcuuucaagaucuucaguuuuaucucagaaaucaaacugccuggcuggcaaaauaacagcucuagaaagaugaauacauguacgugcuuuugguuauuuaaaaaaaaauaaacaaaccaaaaagaugcagcuguuugcuacguuucucaggcucuuguuauguuaacauuuuccaggacugcuaugaaguuuugcuggcucgccugcccauugaggccauauauaugaacaaaugugaacaguuugugcccauacugugggcacaggcaagguuguaggguuucuuucuggcaauaucaacauaucuauuuugaaaucauaauuuugcauguuuucuaaaaacuucacaguauuuggugaaaauuacacugauaaauaccauuguaugacaguggcucaaacuaagugugguuugcuuaaaagaacaugacguucuuaaaccacaacauuaaaggaugcgacugucaucuacaaguuuugaaaccaaguuggcaauucaguaaaaugggaaacauaaauguaugucagaauuaaaaugaucaucccugggaaaaacagauuagaagagaauuuuaccuuuaaaaaaauccuuaagguuuuuacguuucuaccucuauguguuauuccaaagaggcuaugggacaacaaauuuggagaaaagaugugaauguggcagucuugggauaaguaugucagaaauucuuuagccuuuggaaagcaggaggauagccuaugcuuucauaguugguauaaacaauaugauuagaaagacucuagaaaucuuuuuugucagaaaaauuaucauauaguaaauauguuucuccuuuuuucaacuuuuuaguuuuggggguacaugugcagguuuguuaaauagguaaauuacgugucgcggggguuugguguacagauuauuuuguuacccagauaauaagcaugguaccugauagguaguuuuucgauccucacccuccucccacccuccaucuucaaguaggcccuggagucuauuguuucccucuuuguguccauguguacucaguguuugcuucccacugauaagugagaacaugcgguauuugguuuucuaucccugcauuaauuugcuuaggauaauguucuccagcucuaugcauguuguugcaaaaacaauuacaacagaauaaaaauggacaaauuagacuuaauugaacugaagagagcuucugcacagcaaaagaaacuauccacacaguaaacagauaaacccacagaaugggagaaaauauaugcaaacuaugcaucugacaaaagucuaauauccacaaucuauaagaaacuuaaauuaacaagcaaaagcugaauaaccccauugaaaaguggucaaagcacaugaacagauacuucucaaaagaagacauacacguggccagcaagcauauuaaaaaauguucaacaucacugaucauuagagaacugcaaaucaaaaccacaagaagauacuaucucacaugagucggaauggcuauuaugaaaaagucaaaaaauaacagaugcuggcaagguuguggagaaaagggaaagcuuguacacugcugguaggaaugcaaauuaguucagccacugugaaaagcaguucggagauuucucaaagaacuuaaaacaacuaacauuuaacccagcaaucccauuauuagguauaaacccaaaggaauauaaaucauucuaccauaaacauacaugcagguauauguuuacugcagcaaaauucacaguagcaaagacauaaaaucaaccuaaaugcccaucaaugguagacuggauaaagaaaauguacauacaaaccauggaguacuacacagccauaaaaaagaaugagaucaaacaauaaauauuaagugagagccaauuauaucccaugcauugaaacacaucgagaggcacaaaauaucuaguuguccaacuuucagcaaugcugaguuugguccuuuaauuacgcuggugaccaccagaccuuuccauuuuaaagaugccauuuuuucuuuucauuguauaacaaucuguggggucauauuaugucucccugagaaaguucuguuccaacaaucauucccuauuuuaaguuuuagcauucauuaauuauccuugccuaaaauaauuauuuuauugggaauuguaaaauagugauuuuucuaauucuguucauuuucucaauuuguuacuugacauuauucuaugaaaaagagcuuuucuuucauuaacuagagcucaauuacaguuucuccauaaaggcagaauauauguuuaaucuguucccuuuaaugaccaauuugugguuaucuccucuguaggcaaaggagaaauauagcauuuccauuauuuauaaauauguauguauguguguguauauauauauguguguguauauaaauaugcauguauacacauacuuuauauauguauauaaaauggaaaugcuauauuugaaaacuacaguauuagaaaugaagaauucauuagaugggcuuaacagcaaacuagacacagaagagaaagggaucuguaaauucaaggcaguaaaauauauccaaacagaaaaacaaagagaaaagccugaccuuuucucuuugaagaagaagugacagaguucaaugucugugaaauauuauuaaaugaaacaacauaugcaugauuggaauaccaagaagaagacagagagagaaugggaccaaagaauauuugugaaggcgauaaucacaaucuucccccaaauugauggcagacauuaauccauagguccaagaagcucagcgaacccuaaauaaaaguaaaagccacaauauaaaugaaaguaaaaaccacaccuacacacaucauaaucaaauggcugaaacccaaagguaaaaagccaaucuuaaaagcaaccaaagaaaaaaaaugcauacgucuuagucccuucaggcugcaauaacagaaugccauaugcuggguggcuuguaaacaacacacauuuauuucucacaguucuggaggcugggaagucaaagauaaaggcaggcagauucagugucuagugagagccuguuuacugguucucagacagccauauuuucaccuuaacuucacaugguagaaggggcaaaggagcucuccggggacucuuuuaaaagggcauuaauuucauuuaugaggccucuacccucacguccuaaucacuucccaaaagucucagcucuaaauuuucucacaauggggauuaaguuucaacaucuaaaugugagggaacaguauauauagcacaguagguauggggaauuaugauacgauuaaauucugacuucucauaagaaacagugagggcaagaagacaauagaauggcauuuauaaaaugcuagaaggaaaagaacugucaaccuagacuucuguauccagugaaaacauccuucaaaagggauaguaaauccucuuccccuugccuuagcccuaaagccaguaaguggagcacacaaaaccauuguguguggcagaacaaaguagucauccaugauauugccagaaagaaacucuaugaucuuaaccaugccuacaauauggacacaaacuguucacauuuguucauauauauggccucaauuagcaggugagccaacaagguuguuuuaaugguccaccauggaguguuagagcacaagaaggaugaagagagaaucucucuaaguguagggggaaacagucacaagauauuagaaccuaaauagagugauugaagcaaucuuuaguggugcaacccaacgcgggaagucagaacccuagcagaauaaggggaauauccccacugagaauuagccugguauguggggacagagacugaaaagugugaaagaaagugccaauauaguagagcagcaugacaggagaucaaaagcugagcagggugaggagggcagacauacuaggggaagguggccuaacauggggaacuagagccugaauggggugaagagaacauuuuggaggcuggguaauccagcaugguaaaucagaacaagcacagggugaagagagcaucugcaaaggggaggagauggggaugauuaugaaagcuugguuacauacagggaaauugaucaaauaaguaaggacggaggucaguuucucacugucaaugaagagaauuauaaauacaguugacccuugaauaacauggguuugagcugugugggaccacuuaacauguggguuuccuuccaucucugccaccccugagacagcaaggccaacgccucuucuuccuccuccuccucagccuguucaacgugaagaugaccaagaugaagaucuuuaugaagauucacuuccacuuaaugaauaguaauuauauuuucucuuccuuagaauuuucuuaauaacauuuucuuuucucuagcuuacauuauuguaagaaaucaguauauaacaacaaaauaugugcuaauuguuuaugcuauugguaaggcuucuggucaacaguaggcuauuaguagcuaaguuuuggggaagccaaaaguuauacacagauuuucgacugcauggaggguuagcgucucuaaccccuguguuguucaagggacagcucuaggaagaaaaaacuacaaauaaacaaaucuacaaucaugauugaaaauuuucacaccccuuucucaggaguugauaaaauaaaauuuaaaaaaugauaaagauagaaaagacugaaaaaacacacuuaaccaauuucacuuaaucaacauuuuaaaagcauugcauaaaacuacugcagaauacacaguuuucucucagugcaaauggaauauugacaaauacagaccagacagcugagucauaaagccuaauaugaaagaacugaaaucacauauaauaucaucccugaccuugugguuuuaaacuagaaaucaauaacaacaugggaucuggaaaauaaccaguuuuagaaauuaagcagcacuuguaaauaaucccuggguccaagguaaaucacacaaaaaauagaaacuauuuugaauuaaauaaaaaugaaaucacaacuuauguuugugggaugaggcuaaaacugugcuuaaagaaaaauguauaccuuuaaaaaauuauauaagacaagaauuggccuauaauaccaaugaacacagcuuuuaccuuaagaagcuagaaaaagaagcaaaaguuaaacacaaauaaguacaauaaauaaaguaauuaaaaauaaaggcagauauuaaugaaacagggaauagacaaaaauagagaaaauaaagucaaaaguagguucuuuuaaaaggugaauaaaaaugguaaaccacuaaagaaagguugacaaacuuuuucaguaaagguccagauaguaaauauuguaggcuuuguagguaacauauaagcucuauugaauagucuuugcuuuguuuuuguuuuuguuugaaaaaccaauugaaaauauaaagauaauuagcucacagauuauuuuuuuaauggaccaugguccucccaaaaaagagacugauggagagagagaaaaaugagaacuacuaucauuauagaaucuacaaagauuaaaagaauaauaaaaugaauaauacaaggauauugcaauaauuuuaggcuaagaaauaaaauaaaaugaacauauuuccaaauuaccaaaacugacccaagaaggaauugaaaaucuacauagugccauaucuuuaaauaaauugaauuuguaauuuuaaaaaccaauuaaaaaggaauccuuuucauaaaaaaaacuccaacuuagauaauucugcuaagugaauuauaucaauauuuaagaaaaaauaauccuacacgaaaucuaucagaaaacaaagagaaaaaauaauuucucaacuuguccuauagggccugcauaaaccugauacuaacacuugacaaagacauuacaaggaaagaaaacuacaaaucaacauaucucaugaacauaaacacaaaauauaaaauaucagcaacaugaacgcaagaaugcaugaaaaagguaaugcaauaugaucagagugauuuuauccaaggaauagaaguuuggcucauccuuccaaaacaaaucauggugagucacuuuauuaauagaacaaaagaaaaaucaccuuauuuauuuauagaacaaaagaaaaaucaucugaucaucucaauagauaaaaagcaucguauaaaauucaaaaaucuauuuuuauuaaaauauaacucucacagcaaacuaggaauagaaggaaacuuuuucaaucugauaaaacaucuacaaaaaccuaccacuaacaucacacuuaauggugaaaaauugaaugcuuucuccccaagauuagguacagaacauauauguuugcacucauuugauuguaacagaggucuuggccugccuaauaaagcacacacaaaaaagaaauaacagacauaaggauuguggggggaagugaacugucauuauuugcagauuauguauuucuacauguagaaaacccuaugguaucuacaaaaaaaauuggaaaaaauaaaguuagcaaguuugccagcauacauaaagguauauuugaauauacaaagguauauucaaaaauuaauuauguauccauuacuuguaaaaaaaaaaacuggaaaaaaauuaaaaauaauuaucaaucacaaaaccacaaauaaguagauaacuagaaaaaguauaauggaaaaugugcaaugcucuacauugcaacuacaagguauugcugagagaaaugaaagacccaaauaaauggcaauauauaccucauuaauggauuggcagucucaauaucauuaagauuuccauuuuccuuaaauuaguucagaaauagacccauucauuuacaaucaguugaauuucaacugagauaccaaguuaaucaaaugaaaaauaguguuuucaauaaaugguacugggacaaauggauacuguaugaaacaauuaauuuugacccccuuucaugccauacuuaaaaacuaguuugaucacagacaguacagaaucccaugaaccuuaaaggacaaccgaaaaauugaccuuccucauauuaaagguuucugcucaaaaggaagucuuaaugcuuacuggggaaaaauuacuccacaguacauauaucuaauaaugcauauguguucaaaauauguaauagacuucaacaaaagagaaacaauccaauuaaaaaugggcaaaagacuuuaacaggccacaaaacaauauauacaaauugguaauaaagauauggaaaguuacucaauaccauuaguuaucagaaaaaugaaaaugaaaucuacaaugacauaccauuucacccuauuagaaugacuaaauuuuuuaaagaagacugacaacacuaaguauuggcacugguaggaguguaaaaucguacaaucacuuuuguguacuauuuggaaguuucuaguaaaguuaaacacauacucugugaugacucagaaauuccaaugcaaggauaugcaauacuaaucuauaguaauggaaauaaaauugguugaaacauaacaugaguaaacuuuccuggaugaaggacauguuuuauaauuacuuuugccugcugguuauauggcuguauacaauuaugaaaacucacuaaacuaaacaauuaaguguaaaaauaacccguaauuuagaacaaaaugucagauaaaacacucuaugcuuucauucagauacacuccaaacagaaacaaaacuaagcuauaguuuauagggaugaauucucaaguauaaaauuaugaaaaagaagcaagguccuaauuaccauaaaaggcaaaaaaaaaagagauauccccagaguagagagagguggcacugagugggcugugaggacgggcagccgggagguuuauaauaaugaccauauucuauuucuugacuuggauggcaguuacauaaguguuucccuuccaauaauuuacuaauguguuaauuuucauuauucacuuucccuuauguauaguuuacaaauuaaaaaaauuuuaaaggcuuuuuauuuuauugugaacacacauauacacguaugcgcucucacaguaaauaguacugagaagcccacucacaguaaauaguacugagaagcccauucuuucaucuauuaauaugcgugcauaucacaacuggcuggaugagauacagaauguggaaaaauaaaacccacauaaucuucaaauuuaaaaaucccuagagccuguuuuaaaaugagaaaaccaagauucggaagauuaaaugauucacauaauuacucuccauuugacacuuuugcaucucaguuaaaucuacgugcuuuaaaaguaugcagaugaaaaacaaaaaugaaaaugugagaggaaagaaaaauguucuuguugauacaaacauguaaaacacauauucuauuuuauguuuugcauaaacccugaaaggucacgaagacuuguucuguggcaaaagacauaucugggcagccacagagagauuaaaucucuucuguauacaaacaagcauagcuuuacuuuuuuucuccuuuuuacaaagaacaaauaaacccaauguaaaaacugaaaaaaaaaaacuauguaaaugcaacauaauuauguuuaaaccacagaagagaggaaauuuagaguuacagauuccaugguaaguuuuaauucuauccuuguguaugugaaagagucuuucauuacacgaucacauaacacugggccauguaacaaucaguccaacaaauguuuacuuuacaacguguggaaggaaaauauuuuguaagagaaauuguaggaaauuaguauauuauuuauguaaauuguuagguaacauuucuuagaauccugggcacuuacaaaauauuaauagaaauaccuguuccuuaauuuccuugaucuaaagaacacgaaauuuggaggaucgcuugagcccaggaguuuaaggcugcagugaccccucaucaugccacuguacuuuagccuggaugacagagugagaccccaccuccaacgaaaaaaaaaaagaaaaaaaaaagaacaugaaauuuaacucuuuuauaggcaggcacuuacucauguugaaagcuaaccuuuaaauuuuaaggauauuuugaaguaauggaaaauuuagagcauuagacuuuuaguauguuuugaaucauguaugccagguaguuuguauaaaagaacaguagagacuaaauaacucaugaagauccaugaauuccaguaauuaaaaaaaaaaauccuuaucagucuuggaguuugcugggauuccugacaacucauauaucuauaugcauauauaaauggauuuuuuuuuaaaaaaaggaggaauaaaucauuuauccuuauuuguauaaauuauauuucagguugacaaacagcaaucaauucugagacaaaccuagcaaaauuauuagauuacaaagauaaaaauccccaguccaaaaaaaaaaaaaucaaguaauuuacaaaggcaaaauaauuagacaagcaucagacuuuucaaaaaaauguuaugaagcaaggcaauagagcaguauuuuauuuuuuuuuuuguaauuuaaugaaagaacuugggaaucaagaacuuuaggccgggcgccuuggcucaugccuguaaucccaguacuuugggaggccaaggaggguggauagcuucagcucagggguucgagacccacgugggcaacauggugaaacccugucucuacaaaaacuacaaaaauuagccgggcauggugggaugugccuguagucccaggcacuugguaggcugagguggaaggauaucuugagcccagaaggucaaggcugcagugccacugcauuccaaccugggugacagagugaaacucugccucaaaaaaaaaaaaaaagaaagaaaacaaaagaaaaaagaaaaaaagaaaagaaaacaacaacaauaaaagaacuuuauaucuagcaaggcuguccacugaguauuuuuagcaaguuuuaacauauaagaauuuagggaauucugcaccccugagcccuuuuugaagauucuccuagagggaugagcuccaaacuaagacuauagaacuuaagcuaauugaaucacauaugcauagauuauauaaguaaauauauauguaacuguugaucuaaguuuaaaacaaaggcagggucaaugguggaauaauaauguuugaauguuauauauaacaaaacagaaauaaugcacuuuaaaaaugggaggaaaaggaagggagaaaaagaaaaauagaaugauccuauugauuaccauacaggcaauagaugagaauuaaaagaaaccaauaaaaacugagaaacuaaauacugaaugggcugggcacaguggcucacaccuguaaucccagcacuuuggaaggccgagguggguggaucauuugaggucaggaguucaagaccagccuggucaaaauguugaaacccugucucuacuaaaaauacaaaaauuagcuaggcauaguggugcaugccuguaaucccagcuacuaugguggcugaggcaggagaaucauuugaacccaggaagcagagguugcagugagccaacaucgcaccacugcacuccaaccugggcaacaaagugagacucugucucaaaaaacaaaaacaaaauaaaacaaaaacaaacaaacaaaaaacaaaaaaaacuaaauagugaaugauuaaauaagaaggaggaugaggacacuggaaaaauuuauagguacaaagauaaccacuagaacaaaaaugcaaaccuuucuaaagaacaacaaauuaaagagcaagcaauaacaaagaacaaagacugcaaaucuuauagcaaaauauaauuauaaaaaauuacgacauuguugaaacuaaacauuauucauauccaugaaugugaaugcguuuaacucauuaaaacaaaaacuauguuuaauugacucacaaaacaagaccccauuuauauacugcaugcaagggcacaucuaaaacaaugugauucagaaagacuaaaaaaguguagaucaagauauaucaagcaaauggaaacaguaagaaagcagggauaaauauucuguuaccaaacaaaguagaaaucaagccaaaacacauuaaaccugacaaagaacagcacuugaaauaucaaaagucauaauucauaaccauuagaaacauuuaugcaccaaauaauacagcaccuacuauagaagauguaagaagauuuagauaaaaguacauuaauaauaagagaauuucauacagcaguuacagcauaagacagaucaaguucacacaaaauaauaagauagaagacauaaguaauauaaaguagaucuagagaauacacaucaaacucuacacucuguugauaaagaaucccaagcacugacaggguacaguggcucacaccuguaaucucagugcuuugagaagccaaugggggauaaucacuugaggacaggaguucaagaccagccuggacaacagagcaagaccacaucucuacaaaaaauuuuugaaauuagcuggauguggaggcacauaccuguaguccuagcuacuugggaggcugaggugguaggauugcuugaguccaggaguccaaggcugcaguaagcuaugauuacaccacugcauuccaggugauagagagagacccugucuaaugaaagaaagaaagaaagaaagaaagaaagaaagaaagaaagaaagaaagaaagaaagaaagaaagaaagaaagaaagaaggaaagagaaagaaagaaggaaagagaaagaaagaaagaaagaaagaaagagaaucccaguacccauaaaacacucauaauaauucaucuucuauugucauuaaaaaagcauccauaagcuucauuaacaguugaaauaaaaaagucaacacacucugaucaaaauguaguaugagaaauaucuaacaaaucaaaaaguaaaauucucuguguaguuaaaaaaaauuuuaaagaaaaauuucucauuaauucuauuaagcaacugggcuaacaggggaauacaaagugaaauuaagacacuucuaaaaaugaugauaaugaaaguacuauacaucaaaauuacaggguacauuuaaagcaaugucaaaggaaaauucauaacauaagcaacuuuuauuauuuuuuaaaaaauuaaaauaauuagaaaaauagcuacaauauaaaccaaaagagaccaaaaugaauaaagauaaaaccagaaauuuaugugguagaaaauaaaagaacaguacauccaguuaauaaaauaaaaaauuuucagaaaaaaaauucaaaauagagaaaccauacuagcuaaauugauuaggaggaaaaaaaaaaaaaaaaaaaaaaaaaacagaagaaagcccacauuauacaaaaauuuaaaaugacaaggaaaaaauaaccauugaaccaggaaaauuuaaacaccauuaagagauuaguuugcaggccacuauucaaauaaauuugaaaguugaaaggaaauugaacauuuccuaauaaaaugcagauuuccaaaauugagcucaguagaauaaaaaacauaaauagaccacuuuacauagaagaacuagagaaagcuauuaaauaauuuuuuaaaaaacuguagguccauauaauugcauaggagacuucuaccaaaccuucaaagcccagguagucccauugcucaauaaacuguuccagaguauuuaaaaugaaaaaaaaaaaaaaaucccgauuccuuuugugaagcaaguauaacauugauaacuagauuuuauaaaaagccagaaaaagaaaacagaaaaaagaaaaacuacagaccaauaucacucaugaauauuauuacaaaaaugcuaaauauuagcuaacagaguccuaccucacauuaagaaaaacaguacacuaugacuaagugagacuuauuccaggaaugcaagguuaguucaauguuugaaaaugcauuaauaauucccuauauuaauaggaauaagaaaaaaaucaugaugaaacauauagagcacaguccccacaaaugcucagaaagccuuugacaaaauucaauuaccaauccuaauaaaaacacuuuuuaaaaaauguuuuugaggcaaggccucacucugucacccaggcuggaguacagugaugcaaucauggcuuacuacagccucaaauuccugaucucaaauaauccucccaccucaaccuccugaaaggcuggaauuacaggugcacacuaccaugcucaacuaauuuuuaaaguuuuuguagagacagggccucauuacguuuuccaggcuggucucaaacuccuggccucaagugauccuccugccuuggccuuccaaagugcugggauuacaggcaugagccaccacaauggcaaaaaacacuuuaaacauagaaauugagagauaauuuuaauaugauaaaauacauacacuuuaaaccuaagguuauucuuuuacuucauagagagacacuagaggcauccccacuaaaauuaugaacaagacaaagaggaucccuaucuccacuacuauucaagaagguacuagggaauuagcuaaugaaauuagaggagauaaaucaauuuaaagaauaagaauuuuaaaggaguaacauuugggaggcugagacaggagaauugcuugagcccgggaugcaaggguugcagugagccaagauggugccacugcacuccaaccugggugacagagugagacuccagcuaaaaaaaaaaaaaaaaaaaaguaacacuuucucuaauguuagagcagaggugagcaaauuuuucuguaaagagcuagauauuauuuuagucuuuagucuuugugggccauccauucucugccacagcugcucaacuuugcaguuguagcacaaaugcagccaaaggcaauauauaaauuaaugaugguaacuacauucuaauaaaacuuuauuuauaaaaguaagauuuggcccauaaaccauaguuuaucaaacauuguccuagagaauuaacaauaaaaggaacucaaccaauaagagaauucuguaaaguagcgggauauagaauuaucauacagaauucaacggagcucauuaaaaacagccaaucagucugaggacaugauggcagaggcggaaaaaaaaaaaacuuuuccacaauccacaaagaggacaaaauacuuacaaauuaaccggacaaaaauaaacaaaauucauaugaagaaaccuuuaaaacacucuucaaagucaaaaaucuggacuugaauaauggaagguuucugaaauguacuaugacuauguaagauguuaagguuaagggaagcugaguaaagggcaugggaauucuguguuuuguguugucucucugcuuuugcaacuuuuccauaaguccaaugcuauuucaaaguaaaauuuagcagaaaauuuuuuacaaagaaaguaaagauccugagguauggaaaaauaaaucauagauauuucugaaguuuuuaacuuaaauuuuuuuaguuguuugacauuuuauaauauuuuaucagaaaauuaugguccccaaaacauaaauguuaaugguuuuuugcaauguuggugugauuuuauauacuugaaggccagauuaccuccagauaaauuuuauaaguaucaaauagacauuacuugauacuuacaaaacaagaaacgaaaauucagcacacguaaaucuacuguuucauaaacuuaauguaucaggauaccuauugucccauuuuagaucuggugguggggcauaaggcauaauuaguaugaaauaauuuauauugaguuuuuaaaagaaguagucuggaguacugaaaaaagucaauagaguuuuacaaaaucauugguuucacaaaaaucacuuuuacuucaguagccaaacuauuaauauuaagaugacauuucuuauuccuacugagaaacauauaaaggaagagaggugcuaugaauucuacuccacaaaguuaauaaaacugugcuaaggguuuauauguuuauccugauaugugacccaaguuuuuaccauagccacagccaaaucacuaaaacauaaaacugcuagucauuaaaacaaguuccuaacccaugaauuauggaagauuuacauaggagagagggauuugucauuuccuuaccauguaagacuuaaagcucaaagaugcaguagguccuauaaaucuagcaauaauagccaugccugaaacauaaugcaaagaguaaugcugucuugauucuuaucaaaguuaaaauacuguuuucugaaacuuaguguauuuauaaaaacacacgugggacgccuauguucacagguacaaaaggauucacuaaccuccuuguugcacaaaaaagggaaguuuaguccuuaucuuaccaggccuugcuauagaauuuaacauguuugaccucuuugucuccuuuaaacacucuauugccuguuuuuucuauaacucacucuucuaguuccccgcucaacucucuggcugaugccuguuucuuuacagagacuuuuucuucauucuccuuaaugauugaguucauucuccuuaaaugauugaguucaauaagcuucuguuuuugucuuucuuucuucacucuguuucucuuccucacaaccucuuacauauauccaugacauaaguuaccaaauauucauaauauuauacacccaacccaucccucuaaucuaacuaagcuuuagacaugaauacccaauugacuaguugacaucaccacuugggugucccauaggaaccucaaugucucuacacaaccauaacugaacucaccauucauuuauuauacaauaagcauuugucaggugccuacccugaucaugguccuggguugggcauuggagguauaauaaugaacauauugacuuugucucuccucucaugaaguucacucuuucuucaaccaucuucuaccaguaagugguaccaauauccauauaguuacccaagccagcaaaccgaacaucaucuacgacuccucccuauucuuuguaacucauguucagucauucacuuggucccauccauucucuuccaucauaggucuuuauuuaaccuaucgauuucucuauuuuuauuacauuauauuuuauaggguuaguuuaagccaccuucaccucucaccuaugaugauccccuaacaagguuuccugucucuauuaaugcuaaaaaccuucaaugauccucgacugaccucaaaacaaaauccaaauuagcaugacacacaaagaccugaauuaucuauugccuguucacuuaucuaugacaugcccucaaaccuccuuuacugcaggugagaguuuaaugcgaauuauuugccauuuaaggccccuuguuucaauuuauggcaaauuaaauaacaugucuugauauaagagaaacacaaucaagaggcaaaaucaucuuauacagaugaauauacauacuaugcaaucugacuuucauuuucuaguuauguauuaucuuuuaaaauuucuauuaauugaaccuauuucuaccgcaacaauacuagccuacauuuacacacagcacuuauuauaugucagucacuuuacuuacauaaauucacuuaaucaucucaacaacccaaugacauagguaccauacuauccccauuuuauguauauggugaccaagacacugagucauuuacaauuugccaaaggaaaaauaguuggugaaugaugagacugguauugcaggcaaugguuccagaauccauauguuuagccauuauacacuauacguaugaacaaaaugggauuguacaagguguuaaacaagaaauucgauuguguaaaggugacauauauuaaucauguagacuguacagaaaaauacaaagcauuaacaaaugaccccaaaauccuaccauacugaaauaacaaucauuagcugcuuagguaaauuauucuggauaucucuguaugucuuuagguagauagaaggauugauggauagauaaggcagauagauaaaacagaugaauagaugagagacgauugauagauaaaauaauguuuuguaccaugucuauugacuuuuuaugugaaagaugauaaaauuugcauacuuacacaucugcccugagaugacuuuguuuugauuuuugucaguuguauuauuaaauuauaauuauccauuucuauaaaauauagaugacucucccuaaugaugauucuuucauuguuuugucuuagcuuaauauuuaaaugaauucaaagguuuccacugguaucuuuuagccauaguuuuacuauuuuaaaguacuuugaguaauuucuugguugacugggauuuugucaucaaguaguuuuuucagggagagcuagagaguacuacauucaccaauccuguaugcuuacgaauaugauauugccuucacauuugaaggauaacuuggcuaaugugaaauucucaggcaauauuuuuucucucucaggauguuuuaaucaauggcuugugucauuaaaagaagaugcagagaaguuuacagccaaugguuugcuucuuuugccuggauguacuuauuuuuucccuucugaaaugcaaguaauuuuaucaggauauguguugcuguuggucuuuuuuaugucaauauuacuaagaucuuuuggggucuuuuugagauaaagacucacagcaaaguuuucuucuguuauaucuuuacuuaagaucauauuccauugguuccaaccucuucuugaggaauaccaauuacguuuauguuggcucuccuuggguuccauauuuauacauuuuucuauuaacauuuuauauauuuuuauuuuuuauuuccuauacaucacauuccugacuguguuuuuaguuguguuuauuauauuucuuuuacuccuauccaggcuuuuuguucaaugauuuuccuauuucuuuucugagcucugacuacuugcuuuuaaaacuacuuagguugccuuauaaaaucuuuugcaaaacuuucuaugauuuugaccaggcaugguggcucacaccuauaauccuaagcacuuuggaaguuugaggcgggaggacugcuugagggcaggagcuuaagaaccugucuuuacaaaaaaauuuuuugaaaacaauuagcacaccuguaguccuagcuacuugggaggaugagggaggaggauugcuugagcccaagcauucaaggcugcagugaacaaugauggcaccacugcacuccagccugggugauagagugagaccuugucucugaaaaacaaaaacaggcugagagaauggcgugaacccgggaggcggaguuugcagugagccgagaucaugccacugcacuccagccuaggcgacagagccagacucugucucaaaaaaaaaaaaaagaaaaagaaaaaggcaaacaaaaacuuuauauaauuuuuugauucucuuauuaagaaacaauauacuguuuuaacagccuugugacuuuaaggaaguuacuugaauuuaucuguuugcuuuugugauggaaucaccucaaauacaaucacacaacaaccugcaaucccuuucacacugagaacacguugucauuuaguuuugagcauucaaacagucaaucugguuuacucuaaaucucuaaaaguuuauaguuucuuuuuguguuacaaucuggcaaucauugucucuaauacccuuuucacuccgaaaugucuacgaaauggcuggaaggccgcuauagacaaaacaaaaugacauguccguaugacuuuucccaaggcucuacuucugaugccucauaaugcaaaacugggucucugauggcaaagucuucacuucuuccaagacccauucaauuccccuaaucucugcucucuuaaaaaaaaagaaagaaagaaagaaagaaagguugacuaugcuucgaaugaccaugacacuuauuuggggggaaaucuugagaucugaagaggcauguguuaaaagucagcauauuacauaugggucaauaauucauagcauuuugcaggugcguuuuacauuuuaaaauuuggaguuguggccauuccccuguuugggugaauauaauuuuuucucuacuuuugcucucuuuuuguagguuucaugccauuaaccagaagucaagccacucauaaaacuccacaaacuaguuuugugcauuacuaauaaauguuuacugccuucucaucaucuacuuuacuauuuuaaaauuaucacuucacuugucugucuacccagcucaaucagguccuucaggcuuguuguuuaucagugauuuuuuuuucauuuccauuuuauuguuucaaaacuugauagguucuuuacaauucagaauaugaaaagaauauagcuguuuucucuggcuuuucuucaguggauacaacugaaaagucaauaaaucuaauacuugcuuaaaacaguuauauuaaugagaauuuaaagacucauuucaaaaaguaaugcaaugauaacauuuagaaggaauuucaagguggcaacuagauaaccuggcaaugacuuacauagaaaucauuaaagcugagauacagaauagaaguagaggcuucgcaagaguaaguucuaaucuauaauaaauacaauucagugcagacacucuucaacucacaaugggguuaugucccgauaaacccaucauaaguugaaaauauaaaucaaaagugcauuuaauauaccuaaccuacugaacaucauagcuuagacuagcccaccuuaaauacacucagaacauuacugcagccucaaacucaugggcucaagcaauucuccugacuuagcuuccugaguagcuaggacuacaggcgcacacccucacauccuuuaauucuuuacauuuuuuauagagacgggggucuugcuauguugcucaggcuaguuuugaacuccuggccuccagcaauccuucugccucugccucccaaaguacugggauuacagauguaagccaccacgucauuagccuauaguugggcaaaaucaucuaacacaaagccuaucuuauacuaaaguguugaaaucucaugaaaguuauugaauacuguacugaaauugaagaaaagaaugguuguagagguacuugaaguauaguuucuacugacugcguauuuuugcaccaucaaauauuaaaaauuucuaaguugaacgaucauaaguugggaccaucuguauauuuauuaagaaauuaauagucacagaaagauuaaaagaugauuugugauauagucuaucgagugauacaaaaauauuauuacuaacaagggagacaaugauaaauucuauauggaaaauauuugaaaauuuuaaggugguuucucaggcgaagcccaguuccaucucagguucuccauguuggcuacuccugucugauauguucaugcaagcugccuccuucucaguuuuuaggucuugcuuuaaauauuauccuccccgagucuacauuccugacugcuugagcuaaaguaaccaacucccacccagucacucuuucaaucacacuguuuucuugucuucauagcuuuuaacacaauggaaaucauuuuauuugcuaacugauugaauguauagucaauguuccacacauauaauagaauguaauccccacgacagcaggagcuuuguuugguuaccauuauaaauccaguggcuagcacaaaagaugcucaauaaauauguguuuaauguaaaggaauaaauaaggagcugggugugguggcucacaccuguaaucucaguacuuugggaggcugaggcagaagguuugcuugagacaaggaguucaagacuaacuugggcaacauggcaagacccccaacuccacaaaaaaauuuaaagaauuagagggcauggugauauagucccagcuacuaaggaagcuaagaugggaggauugcuugagcccaugaguuugaaguugcagcaagcuaugauugcaucacuguauuucagccugggugacagccugagucccugucucuaaaaaacaaacuaaacaaaacaaauaagaauguaacuccagacaauugauauuugcaaguaaaagaugaaagcaaagaaguuaaauggggccauaagacaaaaugcuuugaauagcaaguuaagcaccuuaguauuaaaauggauuuuagcauugagaagucacugaagguuuugugggccaagaaaacaacauuaucagauaugcaguuuaggaaaguaaauuucaauguuuucaggaacaaacugaaaagggaggcggagacuagaggugaugccaaauaggacccauuucaauaguccagguaaaagaugacagagcccaacugagagcagagaggaggaaaugcauucaaagaacaucagagguaguugguggccaaguagauuuggguagacaaaaaauaaagaggaaccaaagaucaaaagaaauacaugcagccauuucuggcaaguguuuauaagauucuaaugaauagcaaagugcguuucaaaaacauaaauacauuagaaaaugguuuuacaaguccagccaguaugcuucccuuaaaguaaucauguaugcaacuuguauuccuuagugucugaaacacuggagacuaagauuccaauaaccaaaugcaaaaggagguguuaguacuuguguauaagauacgugguuagacgaagcccccugauaggauuuugcuguguccccacccaaaucuuauccugaauucccacguguugugggagagacccggugggaguuaauugaaucaugggggcaggucuuucccaugcuguucucaugauagugaguaagucucaugagaucugauaguuuuaaaaagaaguuucccugcacaagcucucuucucuauucccugccaccauguaagaugugacuugcuccuccuugccuuccacuauaauuaugaggccucccagccauguggaacugugagugaauuaaaccucuuuccuuuauaauuacccaguuucggguaugucuuuaucagcagcaugaaaauggacuaauacgcuuaccuccccacacuuccuguugguucuguuucucuggaaagcccuaauacaacagcuuuaagucacccagguuccuccuuuguuggaguaaagauauauaucuuuauaaaauauaaagauauaugucuuuauacauauauguauauguaucuuuuaauauaugaauauauaucuuuauauagauauauuuauuuauauauggauauaucucucuauauguauauuguaucuuuuuguucuauuguucuuaaauugucuuuucuuccuaauuagacaauaaggagcaacaccauuacuuaaaauucuugucucuuccccucaucaguucacaguucuugccaggugcucaaaauacauuugcugaauaggugagaaacaagaaggcuacuaugagaauguaccugacacucucuaggagccuaguuagauagauguauaauacuucccuaggagacagagaaaaguuuuguugacugaauaaagguuuccacaugggaaauugauuaccguguauuguaaauccucccaauaugaccaacuuagcccuccaucucauaugagguaauguuuuggcucuguaacucaugauuugguaaacuugugauuauuuauaugacacacuguauuuuuucaucauucgugcacaucaauucuaagugaugacacuauucugugaccucccaaguguucucccuaacacuuauauaaaaucuuuccaucuccagggccacuuacaucauacuuucagguucuacugcacaagcaccaacugcuuuuguaacauucacaagaagagcuugguuuauuccaacaaggagguucacaagugguugaaugccaccacauuuccggacaaugacucgguuuucacguucuuggcagcauucucccaaggccccaaccacauucacaaguacuucuucaggcugaucuguuagaagucccaccaagguuucaauggcuuuguauucccgaaaccuaaguucaucauaagaaagaggagaauugguuuuuguauaagguuugcuaaaaauuacuaaauguucauucaauccuuacaacaacccaaugauacagauauuauuaaauccccauuacuggaugguuaaucugaagcuugguaaauaguagagcugacgucuaacccagccaucugcuccagaccugcacccuuaaucaccaugcaguacagccucuaagaaaaccacagcuuguucuaaaccugaggaucuaagauuccacucuacuaggguuuuuucccccuaucuuccagagacuacuuuaccugaaugaagucuucuaaauguuuaauaaaaauaaauuauauguuauauauuuuuguuuucaaaugcaucaaacauggcucuauuguaccuauuuggguuuaauaggucucuugaaaugaguaguagcuugugcuacuuggauaaaaaaaaaaaagucacucucagguaucuucuauauuaaccacuaauacauuuuaccaucucucuugucauaaaauugcacucugauauauauguauauauguaugugugcauacauauauacacacacauauguaugcauauauauauauacacacacaaauacacacacauacacacacacaccaaaaggaagcaugcuacauaaagguaaauauuugaaaauuccuaguuucuauacagaacauuuucccuuccuaauaaauuucagcuguauuuaaguaccaugaugcagcugaguuuuuaauuaagauaaaaguuccauuagccgagguuacuuuuaaucuagccaugacuucacuacgccuuauuaaguaaacuuauuuuguguuaaauggucgggacgugaaucucuuguuaaaggaaauaaucagauggagucaaggagaagcugccucagaauacccaucauugagauuguaaucucucaaaaauaggaagagauagauuugaaaauuaaaauaaaucaaauggucauaaagguuacaaauacuuuaaaaucgaaucugaugaaaucauguuugaaaaugaccacucuuuaaagaguaacugguuaguugacauuuaguugauucaucuuguuuaucuuuagaaaaggaaaaagaacaaaaucacuuccaucucuaaagauuccaugggaaauccgcccacucaccuugauagguccccacagaaaauaucaaagauauuucuaauucaaauggcugcccauaugcaaaauagagaaaucaugucagcaagccucuuagugccacugaggcacagaaaaagucauugccagguggugggcaauuucuauucuuuucuuuucuauucuaagaaucccuucauugggcuaacuucauccagaauguacaucuacaacuaacauuagaauugacuccuuacuagaauggcauuaaaugacaagaagguguuucagaagccguaucuucauuucagaauauugagagccuucucuuacuugguaacauucucuuugcugauggaacauuuccauauagccccugugacagcagcuaaccgcucuuuauugucaguguuauugaguagacuggccaagggcuuaaguccuccgugcagccuaacgaggucccggguuuccuuaucuucagcacacugcacgaaaagucagacagaggcugucagucaucaaggaauaucaagcuuucaaugaugcuaaaaaggcugccauucuaguagcuaggaaacuucuuucuagagagaucauuuucgaaagaugccuccaaguaaaauauaauucaucuuucuacuaguagcuuucugacagcaugucucucuccuuauguggcuuugggaauggauagcaguuucuaaguacucagcaauucucccaagccaguuuugagauagccuaggcaucuccugaggcgaaggucaguggaaaaccuacaacuccacuagcaaggaauggaggauuucugcagugaugcaacucagagucuugggaaaacauaguagagaagacagaugagugauagggauuuggucagcucuucaauggccccugaaaucuagagacaaauauauuuucuuuuuuucuuucuuucuuuuuucuuuuuuuuuuuuuuuugagagagacucuugcucugucgcccaagguggagugcaguggcaugaucucgacucacugcaaccuccaccuccuggguucaggugauuagagacaaacaauuucuccaaucaaguuucuaugcccagagcagugagugauaucaauaguaccugacauuuuauucaaauaugcuuauccauguuugugucauccuuugaaauaaauauuuacugcacagauggucucaacugaucauucuucccgggcucuagagccaacagaugauacaguuagcagagacuuggcaauuacuccaagcacacagauguuuucugaugccaugugauccagauaugugucaugugucacccauggaggccacuagaagaaauccucaucacagugcaccauacaggcaccugccauguuuaucuucugcacgugauuuucaauucuggauuacaggcaccuucuaaaaauuaaucccuauuucuaaucaacucagugguuacucugaugaggcauauauacaaauauauacaagucagggcuauauacgauuguuaugggccaaauuguguccccucaaaauucauauauagagguuuuuuguuuuuuguuuuuuagaucgaguugcucucuguugcccaggcuggaguacaguggcacaaucucagaucacugcaaccucuaccucguggguucaagcaauucucgugccuccaccuccagaguaacugggauuacaccaccacaccuggcuaauuguuuuuguauuuuuaguagagaugggguuucaccacguuggccaggcuggucucgaacuccugaccucagguuauccacacaccucggccucccaaaaugcugggauuauaggcuugagccacccaguaccucagaaugugacuguauuuggagacagaguuuuuaaagaggucauuaaggcuaaauggccucuucaaaauuacuugaguaggcccugcuccaauaggacugcuguccaaggggagaaaaugacacuggcauacacuaaggaaagacggugggaggacacagggaaaaggcagccgucuacaagcugaggagagaggccucagaagaaacuaacuuuggucugaaacgucuagccucuggggcugcaaggaaauaaauuucggcuguucaagccacccagucugugguauuuuguuauggcagcccucccucacaaccuaauacaauccucuacugaaaugacucccuuguaucugucucuucuuuuuucuuuuuuuuuucucuucugagacagagucucacugucucaggcugaaguccaguggcgcgaucuuggcucacugcaaccuccaccucccagguucaagugauucuccugccucagccuccugagcaacugggauuacaggcacaugcaaccacacccagcuauuuuuuguauuuuuaguagagacgggguugcaccauguuggccaggcuggucuugaaccccugaccugaagugauucgcccaucucagccucccaaagugcugggaauacggggacugcagggccggguacagccccuuguaucuuuuuggcauacucucuugaugcugcacaucuuaagugcauuccucuagcaaaccuacucugauuagguagaagcagacgugcacaguaaccagccauccacuacuuugucaaggccauuuuucucccuuuaccauucugaucuguuuucugguauacuaugaaauguaucauacacaaaaaguuaguguagauuacaauaaguaaaccaguaaaaagauaaaacaggaacacacacacacacacacgcauuccucuggcuagucuugguaggagauaaaugccccaagauuauuugaacaggacauauuaaaagcaauauagaagcaccauguacuuauuuaucuauuuuacgcuaaguacauuauuuuaggagacaaagaugcauaagugucuucuagaaacaaauagucccagaugucaaagcagguuucucugacuuauacaaguuaucugccauuaccacaggacaaugguucuuagaccugucuaugaaaauccaauggaguucuuguuaaaaaugcaggccgggcacgguggcuuaugccuguaaucccagcacuuugggaggcugaggagggagaaucacuugaagccagggguuugagaccagccugggcaacagaaaaaauaaaaauaacuccaucucuaccaaaaauacaaaaacaauuagcccuacauuagccaggcauggugguaaacaccugaagugccggcuacuugggaggcagagaugggaggaucacuucagcccaggagauugaagugacagugagcuaugauugugccauugcccuccagccugggcaacagagcaagacccuaucucuaaaaaaauaaaaauaaauuaaaacuuaaaaaaaucaaauaaauaaauaaaaugcagauuccugagucccauucucacagaaggaaaccacaugguuagaaaacuaccuuaaacuaugugagaaagaacgccaacaaccgcugggagaguucacugcaccugguaaauggccauggcgcagugcuccugcagcugcucauucucacuauuuagguucuugacaagguuuucaaugauccuuucugcuuugauugcagcccgguaguuuuccuaggaauaaaaaccuacauauuuauguguucaagacgugaauauaaguaacuguuuacauuuauuaauaaacaugcugaacaaacuuucuuaggaaauaaucaccauaguccaagcuuaacauaucccuacaucaauaagagaaucaacugaauuaauauacacauauguguguuuguguguguguauauauauauaguguauagauauauaugucagcauauaugugugauauauauauaaaugucaguauaugugauauauauauaaaugccaguauauaugugugauauauauauaaaugucagcauauacgugugagauuuauauaaaugucaguauauaugugugagauauauauauauacauauauguguauauauaucacagguacugauuuaauuaacguccuaucaguuggaucuucucuuucucauagaaugcugacuucuagaaaaagaauguccuugagccaucaugauaaccuuagaaacaacuuuuggacuaaagaaagucaaguugagaaggcaagggaagcagaacuggcaugaguaccucugaugcacacucuugcaauguccccaccacuggaauuagcauguuuucaugagaagucuucagcagccgagccaacagaggaaugcccccagcuuugcggauggcuucuuuauucguaugacucuuacugcagcuccacagggccagugccccacagcgagccacuuccacgucucuggccucauacagacucgauugggcagguuuuguggaaucaugugcacagucuaguagagcaaccuauaauaauagauaaauccaauguucauggaaaucuuaaaaagaacauuuaaggcauucuucaauagcuacaguguuccuuaccaagcucaccuccgucaaaaacaagaaugcuuuaaaaaaucacuuuucguacuccauagcagccacggaaagcaaagaaacaaaacccuacaaaaaaccuuccuccagauuugggagcuuauacauuuccuucccacaagaaauguaagcccaccaagauaguauuuucuuaacauggcucuaauauuuacaucaaucauauuuguaaaccacauccucagcccaaacaucucagaaaacuagcuucccuaaaaccauuagcacuuucuaaggagaacugaauggacuauacaccuuaaagccacaagaccuguccaggaacacuggcucacgccuguaaucacaacacuuuaggagcucgaggugggaggaucacuugaggccaggaauuagagaccagccugaacaacauagcaagauccuguuuccacuggaaaaaaaaaaaaaaagcuggaugugguggugcauguguguagucccagcuacucaggaggcugaggugggaggauuguuugggcccaggaguucaagucugcagugaguuaugaucacaccacugcacuccagccugggcaacaaagcaagauccugccccccgaaccaaaaaaaagaaaaaaaaaaaaccaugagaucucuuuggaggacauagccugccucaugugcuacugaaaccaaccaaaccaaacagcacaacugccagcauccaguuuuuuuuuuuuuuuuuuuugcaauaacuaaagucacugaagaucuuaagggaaaggcaauuuacuauaaggauuaagcaguaugucagguugccccauggaggaagggaagucagaccucccuagagcugcaauuggcugucagccuuccuugcaggcucacugucucuaucuggggcuugggagccaucaucuaugcacgucuacuccauucuucugucccugaaggucaacuuccacagauacugcccguaaccaccaaucucaaauuuauaagggaauaauagccuaggcuagguagagucuuucaaucccaauuccaaguuccugggagagagauccagugggacuggcuugagacagguggacacuccuggucuaauuaguuauggccccaggaaagacggggaugggguauggaggcuuccagguacugacugcaggugggauaggaacgugggaaaaauucuaagaccgugggauugaacacagaugcacaacaauaaaugaugcaguauggaagugcucagaaagcccguagcauuugugacuguuuuggaauugcauggugguuagcaggugcuccucacaaucuuugccuugcaaaaauuuauuccuugauuuaacccacugccacuaugaccagcacuacugguugauucaccaaaaauugguuaaauaauugucuuaguuguuuugaugaaucuuucuuaaauguacguauaggucacagucauuucaauuuuuaauguuggaaguguuggggucuucauuuagaagucuggugauauuuuugugaccagaaaaaugccauaggaacuuaauucuuguuuauaucaguuagucuauaggaaaacugguuuuguuacauguuguuuugcuuaaagucacaauuuuugagaaucuguugaugauauugaaugaagacuuacuguacuagguuccugaaugugaugcauaaaacauauuuuauguuacauuauccauucuuauaauuuaaugggaguagugucaguagacagucacaucaaccuaccaaauuguuucauuauuuaagcagaauaaugauaaucauaguaauaauuaaauuuucuguaacauuuuaaugaaaauuuucgaacagaaaagcuuuaagaauuguacaaugauugcacacaaaccucccuacauccaccaccuggagucucuaauuaacauucugccacauucguuuuauuacauauuucaccaucuauucauccaucuauccagccauaagucuaucucauuuuugaaacaaauacauuuauagugcuuuacagaugacaagugaaaacacagaaugucuuuuggaaaauuucugaacacauuuuucaguguaccuauuuacauuaaaauccauauuuauccaacagguauuuauuaaccguucauacggguaagguacugggcuaagugcugugaaagacacuaggaugaauaaggccugucacuuaaagugcagaaguggaaacaauacaguaagauaacagcucugggugagacacaagaucuauugauccuuacuaagaaagugaaaacauguugacuuuuuaaagaucuuuccuaaugauggcaaaggugguaagcaggauucugguauuuuucuuuugaugccagcuauugagaaaauuauuuuuucugauuacaaaagcaagacuuagacaaagaagacaaauuggcaaauguagaaaugcaggcagaaaaaucagucaauucagagaaaacuccugagagcaauuuguguguuuauuucuagugguuuuuuuuaaagaugguagguacaucuuuaaaaacugggaucauagauaacaguuuuuaauccugucaugauuuuauacaauauuaaauauuauacauuuuauuccuugcuauuaaauauacuuuucaggcugggugcguuggcucacaccuguaaucccagcacuuucggaggccaaggugggcggauuaccugagcucaggaguucaagaccagccugaccaauauagugaaacucugucucuacuaaaaauauaaaaauuggccgggcuugauggcgggcaccuguagucucagcuacuugggaggcugagacaggaaaauugcuugaacgcuugaaccccguaggcggagguugcagugagccaagaucgcgccacugcacuccagccugagccacagaagugaggcucugucucaaaaaaaaaaaaaaaaaaaaaaaaaaaaaaaaaaggcaucauagaugucaacagcuuuuaaguuguaaagcuuuugacguuuuaaaguuuucagcauuccaccgagcagcaggucucacuaucucuuaccucccaugcauguauacuuggaugcauuccuaacaacguacaauagguggugacaguuacaucugcuuuaaaacuguccuauuucuucaaaaaaugaguuugaagauguuuuuguuuuggacacucacuaauauaaauaugcaaaaauaauucuuaagggcaagcgauacagacagaaggcuccuggaacacgcucucauggcuauggaauuuccagcguggccagaaaggacagcaaggagcugugugcaguggcggcuggcacuagaugacgaugacaacaucacggcuacucaccaguuuggugauacccccgugcugccucaccacccgccgugcucuuuuaaacuuggcaacauucgcgauagucucggcugccaaacauuuuagacucuuguguggagaaucaaguauauucaccauaauugguaagcccccaaggucaacaauauucugucugauuugaggauuaugacugauuuccuucaguauuuuuaaugaaccaaucugugugagaaaaaaaaagaugaguggcgaauauguaacccgugcuauguuuuuaaaaauuccgaguauaccuaaaauccuuccccaguuaaguuuuuuaagaaaucauuuccauucccagagguuacacacaucuggcauauucucuuucauuuaaguaaacaauccucauucaggaagcaugagagaugaauggagaagagcaaaaaaagaagaaaaguagaaaaaagagaaagcucagugaacagaaucagcaggucaucagcaauaauagcagauaaagacaagaaccaggcaacgaggcauggcagaaaccuagagcuaagaagagagcccaggaaggugggaacaagacuccgcauccaaggugacagagccacucaccuuacauuugacuucaucgguuucaagcaaauuuaucagcacuuccaggccuccaacaucucugauggccaacuggcagguuucuugagcuaagcugaaaucccucauugaacacaacgcaaucacuguagcuguuugauuuccucccuacaaagaugcaaugccagagaaagguuaaggaacaccgcauucccauagaaaugcacuaaguaguuacgaauccaugaacuggaaaacaugucucugagugggcuagaauuuguuaaaugaaucagguagagccgaagcauggaaaagcuguacagagcaucauaaaacauuguuccaauuaagauucaacauuuaaaggcaggcugucuccuuuaaacagcuuuaacaucaggugguauucaucuauuaaagagucauggggacagccuugagaggcugacugaggaaugcaagauguacacagagcuaagagaugguucccccaguucuugaacaggguauugcauaaugcaaagcacgucugaaaauuauuccuacagaugugcauagaacaguccggaauagggagaacucagagaaaaggaaaacgugcaggaagcagcaccgcaauccauacuggaaccuagaguaggugguuugagggccgugggauugggaaaagagaggcaauuccagcaggaccugcaaaugaaugggaugggcaggacgaagaagaaagcaagcuucacuguggugagcaaaauccuggcugaacgcagagucuugcaaaccaaugucuucuuggugaaucgcuacauguaaagaguaguagugagaugcuccuucaggauuaaaaaacaaaacccaaaagauuaaaaauaaaaaagaaugaucaguaaaccagaccugccaggagauuaaaaucagaauucacugcaggaacucuuagacaauguccacuggucauuucugcuuugaaaaucuucuaaggaguagugcauauuaccacuacugcuauucagcuggcugauaagaguucuggcaucagcacuaaaguagcgcaucacacacaaaagcaagaaggcuguucauuuuuguaaaaggugcugguaauagacaagccuuugaucccugcuucaaacauaguaccaauguuuuaagggaagacaccuuaaauuauguuuauuuccauuuauuaagcauuauauuuccauuaucuauuguguauauauauauaauuauguauacaaauagauuauauauauaauagauaagguaaacauugucuauuuuauaaauuuauucauuaucuacugcccauuaucuauuguauaauuuuaaaauguauuuuuaaauauauaaaauauucuacauuauguuuauauauaaauuuaaaaguuuaaauauauuacauauaauauauaaauauaaaaaauaccaauauaaaaauguauauuucuauauauaaauagauaacauauaauaggcuuagcacagcucguggaaauuccauaccagcugccaaacucccuccuccauagcacgagcuugugcauuugcaaaucuucuugugaauucaacacaauaggucaaguuuuuaauuuuuaaaaauuuauauauaauaguuguacauauuuuggggguacaugugauauucugaugcauguauaaaauguguagugaucaaaucaggauaauugagauauuuaucaccuuaaacacaucuuuuuuuguggugggaacuuuacaauuccucccuucuagcuguuuugaaauacauaauaaauuauucuuaacuauaauuucuugacuguacuacaauagggaacuugaacuuaguuguacuaucucacuguauuuuguaccucuuaaccaauuuaucuucaucccuucauaccaugucuuauauauaauaggguuagcacagaaaauggaaauuacauacaagcuucccacacaccuccuccuucuuaugacacauguacacauaugcaaacccucuugugaauucaacacaaggcuuuuaaaauaagaaaccgaaauaggauugauuacuagacgaucccaagugaagacagaaagauuuagaugucagccuuucuucuuacuccauuuaagaaaauuucuuccaugccucuagaaauguccucaacaacugucccgugaagaugucacugacaauuuccauuucccacaugaaugcucccaauggaugcagcaggcuguccuccacauucaugauuaaguucagaaugacaagagccuuaauuuuacuauuuacuaauaagucauguucuuacagcuuuuaguaucuuuucugcuuccuaucaaggagaaaaguuaccgccaccaauaccaccaauuuucguacaguugguuuuaaaauaugaauuuuaaaaauccucucuuuauaacugucagguucauaaacccccauauuugggugcaggaggcucccauaagccaguacuuccauuuccucuuuuaaaaaaacaaaagucagauauuuuauaagccauaaagaagaaucuagucugaguguggaggcaugcaccuguaaucucagcuacucagaaggcugagguagaaggaucgcuugagccugggaguuggaggcugcagugagcuaugaucacacuaccacucuccagcaugggcaacagagugagacccugucucuaaaauaauaauaauaaaggagaaucuacaugcuaaccauacuuaauuaaaggaaauuaaaucaugcacaaaaagaaagaacaaagaaaauaagaaaaacaauucauuugaauaaagcucuuuuuuucucugaauuuaaaugguuaaaaggagccagaaaccuccccaggagugucugaaguagcagagcagguuccuauauuaaggguuuggaaauccaaaccaaguacuucagcaagagagaguuauuuaggcggaggcuucagacuucaguaugacuagaaagugcaagaagacauggaacagugugucauaccuuguuuaagccaagagccuccuccugccccaggucuacgcagugaagaagacugucccauccuaacauucuuaaucgcucgugcugaggacuugcuugacugcuauucuugcauuauaauguuuucuuugguagcaauuuucgagcuuauacacucagcacaaucuuuguuuccuauuucaaguuuucuuaauuuuucucuucuagacaacuuccacaucuuuugagcuuuauuucauuaauuuuacuauaaccaaugacauaaauucauaacggccauuuaauugcagcagaugucccaaagguaagaguuuauagcuuuuugaaguaucucuagguuaauuuggaaugcaaaagacugacaauuuacaguuaucaucaagaaguuagauccuuauagaaaaaaauucuguaaaucaucagcuuuuuuucugaaaaucuggaaacauauucauaggcuugagggauuuuuuuuuagaacaguuuuauauuagggaaaguuaguuuuuccacauuucaggauuuaguucuacucuugucacugaccacacucccaaagggauuauaaaucuuucagaaugaauaccagaggacaggagccaaaauauucaacauacagagccacaaauguuagccaauugcuauucuuuaaauaccagcuaugucaaaggauuuuugaauguuuguuccacuuuguccagaugccauaaauaucgaacugagaagaaaccaugcaaauacacuccuuuuucaauuaaaucuccccuaagaacauaauuauuuaccaauacuuauuuucacauuuuaucacgcauuugcauuucugagguuuuaggagcuggagaaaauagaguaaaauaugauuuuacuagcuucugaagggcuuugaaaaaugcuuccaauaaguguuuccacuucuaaaauuaaugcaauucuuuugcuaguugucucccugccccuuuucuuuucaaacaucuccaggcucuguuggccuuuggauuuuuuuuuuuuuuuuuuuuuuuugcaauugacauuuggccauuggauuuuuuuuuuuucaauugacauuccuucugaugaccaggaggcauuucuucauugucaccauuagguuuuaaacgugcagagauugaaugaaagucgcucucuuucacuuuucuuaaaacuucuuuuugaaagacaagacgaauuaaagauaauuuccucaacuacguuuuuuuaauuacuucaaauaaaauauuugaaauaagcaaguauuacccuguuugguauacagaacaaugccccucccuuaccauugauaaggaagaaauaaacauuugcuaaguugaaaugagcaauguauucaagaguaaaacaggaagugagcugccucaaaucacuuuuguguuauuucauucaacaaauguguugcaugcuuccuauuugccaugcuggaugguuagcauuagagacacaccgguuuaccaaaacagacacugcccuugccuucaugaagcuuauaauguaguggaggaaaaagguuuuuaacuuuuuuaagcucacccaaauaaacagaaacuauaaaucugagaagugcuacauggggcaggggcauggagcuguggaagcacaucacagggaacuuugaccuaacuuggagcaucacucacagggaaagaacaucugaacugagaucuggacagaaaauaggcgauuucccaggcagagaaggaggggaugugaugaaauguccaccagucggagcaaacaguauaugcaaaaacgcaggggaguagagcauggcaugcuuagcaccuaaauaaggccagagcccagggugggagcguggugcaagaugagcugaaaaccagcugggcugcugggcccagagucugggcugagaauuuucaucuuuauuucaagauuggccaauguaauuuacaaugaugucauuuauaaaagaucacucuggcugcagaggccgcuggcuggagggggcaagcguggauggaugcagucagguuacugcagggauccagagaauagaaguaacuuggaguaggaggggagggugacucaucacgaaccauaaagaaacguuugaaagguuuuuaucaacuugguucaggaaaggaugcuacaaguguagaugaaacuccaacucuguugggcaacacgcuugcagggucaucauuugaaguuauuaucagagccccacaugaccacagugagacaggaaggaaggcagagauugaucaggaccagaggccucuuguucugucccuaccccacacagcuucuccaucugcaaucaagaagcagccggugagacuuggagaaucggcaccacuaucacauggccauccagcuggcuuugaacauucucagcauuuuuuccuucaaacaugccacucagagagcaagaaaagcaaaccccugccaguaacuguucauuaaugaucacagaggaccuggugcccagcauaaagauuggcuuagagauauucuucuucucccaggaucagaaaugguacaaagugagugcucacagugagugguguauaaccacgugagucaaagcagaaaaauacauugcuuuccuucuguuuauuugcaaaucuauuuuacacugaugacuuagcacucaaaaaccuaagacucaacagaacccugaggagaaagagagaauacuguuucccgaagaaaaauauacauauauccuuaaauaaaucagacucagguuguuguauuacaagcugcuaagaauguuuuaucaggaauggguaaggacaauacaaggaugcuacauacauucuucuaauuguauuuauuuauuuauuuugagacggagucuugcucugucgugcgggcuggagugcaacggugugaucucggcucacugcaaccuccaucuccuaggcucaagagguccuccugccucagccucccaaguagcuaguacuacaggcaugcaccaccaugccugacccauaugcauucuuuuuaauuugccauggaacauuuacaggaauugacaguuauuggaauguucuagucauugcaaugcagaaaaauuuauagcaaauauaauuaucuuacuaaaaagauucagaagaaugagcugaauaauuaugauaauuaauuaaaaaauaguucaauaaaguggacacaagagcagcauuuuaaagugaguauuuauacacuaacaauaacaaaucaaaauguuuaacuugaaaaaaguucccaugucgggauuagcaaaauaauaauaaaaauaucuaugacuaaaucucauaggaaauguuuuagauacacauggaaaaaagcuauuaaauauuacuaaauuauguaaaagauuaaauggaugaauggucauaccaugugccugaacuauuggaauucaacauuauuaaaauugcaguuuauccaaaaauaauuuauagauucauguaaaccaaccaaaaugcccacagaauuuugggguuuuguuaacaugauuuucaacucauucuaaagaugaucuagaaugaaaaauccaaaaaauaaguuuuaaaaauguuaagguaccuaucuggucuaccaaauaucaaaauauaccaaugcuguaguaauuaaaacagcauguaacuagcaugggaacauccaaauaaguuaaugcaaagagaaaauccagaaacaaacucucacgugugagacugcagaauuugaugaaggugguaucccagauuauuggagggaaaagcagauaggccaauaaucuguguugauacaauugacuguuccucuagagaaaaagaagugaaguuagaugcauaccuucuauuauacauaaagugaauuccagaaggauuaagaauuugaacuuaaaaaaaaaaagcuauaaaacuaacagagggaacuagaaauuauuuuuguccauuuagaauggcuucagaaaaaaccuuccuaguucuuaagaaacaaaaccuauaagccaugaagaaauagaagauauuuauuaauguacaaaagaguagacaaaaagacauccagcuggacacaguggcucacaucuguaauuccagcacuuugggaggccaaggcagguggaucaucugaggucaagaguucgagaccagccugaccaauauggugaaaccccaucucuacuaaaaauacaaaaauuagccagguauaguggcacgcuccuguagucccagcugcuugggaggcugagacaggagaauugcuugaacuggggaggcagagguugcagugagccaagaucgugaaacuguacuccagccugggcaacagacugagaugccaacucaaaaaaaaaaaaaaaaaagacacacuaacagaaaauaaauaccugcaauuaguauaacagcuaaaggauuaauuugcaucaucaagaauuaaaaagaugaacaaccacacagaaaaauaggcaaaggacauaauacaauggcuauuugacauauaaaaaaauugucaaccucacuaguaacuagaaauaugaaaauucaaacaagguacauuuugccccugugagaauuggccaaaauaaaaaauaacaaaaagacuacacaucgaugagaauuuacaacaauggauuccaauccuauauugacaacuuuuuuuauuuuauuuuuuuuuuuuaccuuaaguucuaggauacaugugcagaacgugcagguuuguuacauagguaaacgugugccaugugguuugcugcaccuaucaacccaucaccuagauuuucagccccacaugcacuggcuauuuguccuaaugcuugcccauccccuuucccugacaggcccugguguguguuguuacccucccuguguccauguguucucauuguagaugaacaguuuuauuaccacagggagauuuaaaagucuaucaaugccuagacuccggccugaaccaauucaaucaaaacuuccaaaaaugguaccugggcauaagggucuucuguuuauuugcuccaucguuuaacagcucuggcuaauuucacucugagguugaagguccaggguugaaaacuauugguauguuacugguagaguguaaauugauauuugcuuucuguaaggagcuaugaaacuuuuuuuuacauaaaccaaguuuguuuuguuuauuacucuucauuauuuuuuguuuaaauugaaaauuuuuuaaugcaagucuucucaaacuguagugugcauauauuguuuuucucuuuguuuuagacagcuuuauugacauauaauugauauaaaaaaaugcacaucuuuaauguauacaauuugaugaguuuggguauaugcauauaaauccaacaccugugcaaucauuacuacgaugaaaguaauaaauauauccaucaccugaaaacauguccuuugucucugccuuucuugugguaagaacacuuaaucugagauuuacuucuuaaauguuuuaagugcacaauauauauuguuaacuauagguauuauguuguacagcagauaucuggaacuuauucaucuuucauaaaugaaauuuuauacccauugaacaauuacauaaaacugccuuagcuaucacaguucauuccaauaaaaaaucuuauaaauaucuuggcacuuguauagaacucccuauuacugcuaucaaaaauguaaaugugcauucucuuugacucaagcaauuccauuucaaagaauccauccuauagaaauaauguauauauccaaacaauguguaaaaauauuagcugcaguauuguuugcaguaacaaaaacugauuucagggacaacuuaaauguuaucaauaaggcaauuguucaauaacuuaaugauauauacauuuaaugaaauacuauguagucauuaaaaggagugaggcagauaugaaagaucaccaagacagaauauuaaauauaaaaagcaaaauguagaauaagaaauaguaggauuucauuuauguauauaaauuauauauguauauaaacagagaaacaucuggaagggacuuucacuuugcauggcuugaaguuucacauugagcauauaugagugugcuauuuguauaauauuuaaagauuuuaaacacagaagggaguaagggaaacgggaagaauaccacgugcuucugcuauguccugugucacagaaacaucagcagccacaaccagacagccacacccacucagggagcaagagcugggaagaaccacagcccugcgagaaaaaucucaaaggccaauggaccaaaaagggacauggaguuuaauauuuuuccugcaaauaugcaauuuuaaauaaugaugacaauagauccauauaaagauguaaagugaaaaaucauuuauaccaaaucugaugccucuuauucacuccucaacucauauauuuaaaaauucuucagcaugcagccucuguaacaggccaugaguguguguuuuuaaaacagaaagcaaagcagccuagcacauuaucgaaacugggaaccagccaguaccacuacucuucuccaaucuacuuagcuuucucaaaugaauuuuaggggaaaagcauauuuuaaggaacaaaaauaaguguuguugcaaauacauggggcaagaaauuccccgaaaagaucuacuacauaaagcugccuuagauaucacaguucauuccaaucaaaaaucugauaaauaacuagauggguauguguaucauaucaugcucuagcugugcuggcuuauagcacacguucaugaauaaacacgagugaaugaaugaaugaaugaaugaaugaaugaaugaguugaagcuuaagggaacuccccugagauuuuuaacauugucauguuucagucguuaaguugaugugguagcauagugcuagcuaguggucgcauaaacuguuaugagucaguagcacuguauuaucauugucuuuacgcugcuuuuucuccacacauauuuauuuuugacugccaagaggcaaggaaaguuuaaagcucaaaaauuuaaauacagauuccccuuugggaaagacggagaggagccucuccauuucuuccacaaucuccuuuauaacaaaaauaaaacacgacaaauucuuuugugggcaauauaagcauacaaguaacacacauuaccaguaauccaaauacuuaaaguggauucacuucuuauacuacaauaucuaugaaagcauaaaugcagauucugaguaggcuguuuuuagcugauggaauuuaaauauguuaugauuucaaacaagcaauuaaaaaaaagucacaaaaguuguccuauucguuugucacugacuuuuuaaagaaagcucaacccacaucaauguagcaacacaucuacuaacuuaaagaauguuucucaggaacaugguacucauuugccuuucuaacuacuggaguugauucgaguggacgaacagugagcauuguuuuccguuuucgaaauacucuuuuuaacaagaauaacucugugccaucacauucuuuuccauuuuuuuuuuaaguaaagacagcagaagagcacagucuaauauggccuuccaaacaugaauacugaguuccuuuauggcaaggguucccuguugacucucacucgaaugaagaaauccaaacaagagaaagacaggaagauacaacagcaaguucugcaggccuccuggguccugaauuucuugacaguggaaccaaacaaccaggcaaugugcaauaaagauagaagccuggacucaguccuggccugcagcucccuucuguguggccuggagcaaagaauuucucagcuuuuccaccaaugaaacaaggaucaaacuaccugccacuccauacccaaaacucaaguaaugggaaaggaauuuaauuaacuguaauugacugcaaaguacaucaaauuccuacaacaaaaacucauacaacuuccaauuaccacucgaaagaacucuuuaaccaauuaagguguguguguguguguguguguguguguguguguguguguguguguuuaaucaguuuacauaagaucauuaaggaacugagccccacaaaugcagucuuuaacaaagguuuucaagucugaaaaauguccuugccaagaauccaccuccagagaagaaacccaaaaccugccagggaggagcucugggagucccuucugaagcuggcagcccgguggcauuucugaugugaaugucuuuuagaugucacucuggauuagaguauugaccacuacuaagcugggauccaccaggcaucugguggccugagaauacgcaauuugugguuacagagcacaagcauggcaagcagucuggcucaugugaaaggugaaauccacgccaguguuugaugaauuugaugauacagaacaaacaaauuaggcuaccccucaccaacccaucaugggucaggggcaaggaugaauguguaggaauggccauccuuucuaccaauguaaccccauugucacuguuuucucaucccuuccuauuagauucacuuggcacaccaccugcugcuggauucaucuuuccaaaucaaugcuuucaucaucccuuuccccacucucccaccuggacucugaucaaaaucccagguacagaagcuggcaucccacagggaggagguacauguggagaaauggcccugggaaugagcccuagaggccuccaucauugcagcaaguacucaggaauaagaccgccuggaugaagcauuucagaguaugggcagauauccaacugugcuugccaauauaacccuuguugaaccuagagcuggugccuggacaauacgggcaucuuauccuguagugacagcucuaggaaauaucuucaagggaaagaaagcauaauucuaggcccagccucugacaugccucugaacuaccaaaaagcugaccaaccaaccauguucucggcauuauucuagucuucucaauguuuuacuggauuuacugccuauaggguuaaaaccauacccacuccaccuucaauccacauugaaauggauuucaacguguuuuugaccuuggauccacaaauucuuuuucauuauaauguguauaaaaugcaaaucuacuuauaauuaugaccuuucaacauuuuaccccacucuacugaagaauacccauuugcaugaauuuauaacauauaguacuuguaacuaauauuuauuuccacauuuccaaacaaaauauccuacaucccuucuccuguuucacaaaagggcucuccaccuaccuuauuuagaaaugagcaugauuucacugaaguuuuagagagacucauagauuuaguauggagccuagagacauuaacaaaccaucuccuuuaaucucuggaagugaucaaaagcaagacauuuuccuugcaagauuuuaaaacaauuuuggccagaggaaaaaauaauauccauauaaagucagcaaauacagcaaucaacuaguaugucuacaagaaagacggcaggaaaaggaagagagagggaugcaagaaaaguaggaaagaaguuaacagcagaaggaaagacaggcucagaggcaggaagaacugcuuucagggggcugagagugaagaacagcaaagcccugccacuaaggaaccucgcccucuccccuucacaccaucggggcagagguagggaggcgagccugugcacacuagcaagaugcccugcgagauacagcaauaaauuuaauguggucucucuacucaagaaguagauaguaagacagacaaccugaaccaucaggauagcagaaggcagaacauaagugcuuaucaguaagguagcugaaaaggggguucauugcuuccuuuagaauuaggguacagcaucaucaccuaugggggagaaaagaagcuggaagguuggugaguaaaaaugugauacauucauuaauuuaaaaauuaaauuguguucaaaaaauccagaugaaaagaauuuauacauauauaaaacuugcagguugaaauuaacauaugucaaaccaaauaauuaaauacaaacucuauuuaugugccaagauaugagcucauagcucuggacgaauaauaagcuauaguucauugaccuguuuggguauuaaugagcucguuaaaucuuuuuuuuuccaacaaucagagacaucacucuacuuggaaaaugguaaauagaaagucaggucaacaugaauauuucucugcuagcuuaaaucuacauuuaagccauaauuucauaaauuaaaaugucagguguauuuauuuugagauuaccuagagacauucaauuuugcauuucacagacuuuuaauaucguuuugugucuccauauaaaauauuuaucugugucaaaaaccuugaaaucauuuauagauauacuuuuccuuuuauuggcuaugugaagaauauuuaccugugggaacuauaagaauuccaagcaauuuacugucuggccaagaguaucacauuugcacaugauuuauugaugaauaacuugugcaaauuuaaguagcacuucaucaauauauguuuucuuuagcuguacugggacagaaauagugcaucucuuuuuggccuaaagcuacaaggacuuauccuaaauaguugaaaaaacucaagacaguuauccaguaauuaggcuauuaugagaaacucucuuugccauguucacugggaggauauuauugaggcuguucacucucucacuccgugccugccccauuaaauccuaagggagaaaauucuuucugcucuuagcaccaggaucaguuauacucacuggcaacugguuuguuuuuauuuuaagacguugagagacuuucccucccuguauuaacucacucuacuuccccccuuuuauugguugcuagagaacugaaaguaaaaguugaaggccaccugcacgagucaguuaagucuccaugccacacauuugcuacaauaauaauaagcaauagaaaugauuauuauugccaacaguuacuaacuacuuugugcuaagcacuuuacauguguuguauuucauuuaauauucuuaauaauucuaauauaagagaacuuuuauuuuuccaucuucaccaaugaggaaacugaagcuuagagggguuagucaacucacccaaggccauugaguaagcggcagaauuucaacucaacuggucuuuccaacgucaaagaucaugcuucuaauuacucugguauucugcuuccugauccaucuuuuguuucugccauuuugacuuguuuccuuuugcuaaugaaauaaagauaauggaccgggacucuugggaaaaacucaggacucucuuaauucaucuucugaaagacuaugucuuggacgggcuuagaggcucaugccuguaaucccagcacuuugggaggccaauguaggaagacugcuugaggccaggaguucaagaucagccugggaaagagaaaaggaaagaggagaggagaggggaggggaguggagaggaggggaggggaggggaggggaggggaggggaggggaggcgaggaggggaggaagaaagaaggaaagaaagaaaggaaaggaaagggaaggaagaaaggaaggcaggcuaagccccaauggcccugucuagagcugcccaccucagagagagugguguuggcaaaguucuccacugccaguucuuuuuuucuuucccccagaugacaugcuuucuaggaguccaggagagguaaucacaggaggcccugugguucaguaaagaugcagaggcacuguugcaagcguggccuaaaugucccaaagcugggcauggucaccgugcgugccagucuggaccacuguguugaacuaugugguuugugcacaaauacuccugccaaagggaagugcaggagcauguggccugaaucuagcccgugcuccaugcuaguguuuccaaauucccgacagguuaaucuucaagauucaggaauaugcaaucaaaauuccuaggaauuuucaugaguucccaaaauuauauuauucuguauuuuuccuaacauuucauuuacaugucuuuaaauaauaaugaaugccuauaauaguagugaaucauugcuaucauaauaaacagugaaucauuuuuugugguagaguuaugcuaaaaauuucagagguuuucuguaaaaaaacuuauguaauaaaugcaugauuuauuauuauuaugagccagaauaugugacauaauuauauugcaacaacauguaaaaacaaugugcaccugauauagaaauuucauaauacaaaacacuaaaugagggaaacauuaacacaaaauaaaugccaaauaaaaaccauuuuaaaaauugacagaugccacaaaaauauuuaauauuuauaaaguaucacgcuuaaaaugaaauuuuaaaacucacaaaauauuaacuguucucuccaauagucuagagguuuguuucaugacaaacaguccagacuaaaaacauauuuuucauuuugcauugauguugguaaaaucauuaggagccugccaaagagaucuccaaguugagcauuagggcuuguuucguauaagcucauguccuuuuugaaacaugaaaauauuauuuauuuauuuauuucauuauuauuauuauuauuauuauuauuauuauuauuauuauuauuauuuugagauggaguuuugcucuuaccucccaggcuggagugcaauggcaugaucucggcucacugcaaccuccgccuccuggguucaagcaauucuccugccucagcaucccgaguagcugggauuacaggcgugugccaccacgcccagcuaauuuuuuuuguauuuuuaguagagacaggguuucaccauguuggccaggcuggucuugaacuccugaccucagacgauccacccuccucggccucccaaagugcugggauuauaggugugagccacugcacccugccaaaauauuauuuauuuuuaauugacaaagaauaauuguauauuuuuaugggguacaaugugauauuuugauaaauguuuacauugugcaaugauuaaaucaagcaaagccacuggcaaaugcccuugguugauuuaaccaaacacaugaaaaagcagaaagaaaccaugaguuaagucaaauacuuuuucacaaauacuucuggacgucggcuuuacacaaggccuagauaucaucaauacuuaauaucugacgucagaaaugaauauuaagcuggguuuuggugagccauuccccuugcccuccugcaaauucaaauacuuaaauacguuacaugggccaauuauuauguaaaauauucucauauaugcuaucugacgugagagaaaugaaaaugaaccaauccacacuauaagcacccacaaugucucagaaaccaugcuaugguucaaguguguuuuauuaaacuuuauaauaguccuguaguacagguauauuaauuuuauucuauggguugagaaaauuagggcucaaaacuguaacguuucaacagcuacguugcuaguaagggaaacagccuggaguuuaaccgaaguccagcuuuaaaaauccauguuauuucuuccauaccauacuacaaaucauaaaauggcagcaagucacagugucagcuguuuaccaugcccacuucccagccgggagagaggguugguaccaggcagccugguugcuccaugaggaugaaucuugcauccucaggguaauaagaccuugcccugcacaaacuuagauaaaacaacaggaaugcuuacuacucuuauuugaaagaaacguaaaguaaacuuggaagcagcauauacaucuuugggaaaguauuuuaaaugaacauugcaaacauacuaccauagaccuuucuuaccuuuaaauauuucaccagcuucugaauuugccaauauucugauggcaaaucugcacuugcuuccugacgauggucaggugguucuucaucuuccucacuuucugaggagcuaucgcuaacaguuuccucaaucuuuucagcacucuuccuaagaacaauaacaacacacauacacauguaagcuauaguguggagaucuauuaagaccuacauggggccaggugcaguggcucaugccuauaaucucagugcuuugggaggcugaggugggaggauuacuuaaggccaagaguucaacaccagccuggacaacauagcaagacucugucucuacaaaaaaaauacuuaauuagccagacaugguggugcaugccuguaauuucagcuacucaggaggcuugaugcaggaggaucacuucagcccaggagucugagcugcaguaaaccuuuauuaccucaucacaccacugcacuccagccugggagacagaacaagaccuugucucaaaacauaaaaauaaaaaggaacugcaugaggugaauaaaccugucucuauugcaggugcaauugcucugggugcaauaaucauaauaaacaaaacagugagaaauaaacaaggguauucagugaauguccuaagccugcgcuuuucaauaagacugccacucauugcauguggucauccauauuuacagguauuugaacuuauuuauuuaacuaaaauuaaagaaaauuaaaaauccaguucuccaaucacacuagccacauuucaagugcucaauggcccacgugccucgugguuaccacacuggacagcucagauauugacuauuucuauuauuccaguaaguucaacugggcagugccacaaggcccuaaagugaaagagucucuuuuaccaaagagagucaauauucagcacaucccuccauaaugccuacacugaaguacuugcaagggcacaaggugccaaagaacagcaauaacaugaacauaaucagguucaggaccaaagaguuaaccaccaacucugagagacauuaccaugcaaaguguugaguuccacagaaguacaccacauucuaugguuugaugcauggacaacaguauuacaagagacuucuggaauccaauauaugcccuacgucccugcagaggucccucaugcacacgcacacucaucacaccagcuugucuccgccucccaccgccggaugccagguuacugccauugggucaccaaauccacagugaugucucaggaacuacucauccaucacucacauguggagaggugcugaacccaggauauuuauccugauauuguuucccacauauuccucaucucacaggacagaagcaaacuuuuaaaucuucuagcuaauuuuaauauuaaauaauaccaacagcagccaccaguuuugucuauuuugcccuguguacuuuuuuuuuuuuuuuagacgagaucucgcucugucacccaggcuguagugcaguggugcaaucuuggcucacugcaaccuccgccugccggguucaugugauucuccugccucagccuccugaguagcuggacuuacaggcaugcgccaccacaucuggcuaauuuuuguauuuuuaguagugacgggauuuucaccauguuggccaggcuggucucgaacucuugaccucgugauccucccgucucggccucccaaagugcugguauuacaagcaugagccacugcacccggccugucccaggcacuuuauauucauuauuucuaaaccucacaaccacuuugcaaagcaggcucuauuauccccauucuacaagcaaggaaaugucagagaaauuaagaggagaaaaaaaaucauucacuuugaaggauccaaaauuacuuaaaauaugacuuuugccaaucacauauuaagguguccuuaaauaucaaagucacaaagucaaugaccauaauagaacacacaaguccacaauacuuuuccucuaacucugaaauccaaaaagcucugaaaacuauuuuuccccccacuggacuuaacuuguugcuaaggccuuauaugaaccaauaauagacuauuuauggucuuaauuccucucauucagugugaauauucauguuucacuacagaaaugcucauguuuuugauuacaggguauuggcucacacuccaauagagguuaucauauaauauauauuguaugaauuucauuacccuuuuuugaagugaguuuuuuagacccccaugcauuuggccacaagaguuccggacaacagacuguggguuaaaugucucauuuuaauucucucaacaaucuaugagguugucauuacucucauuauagagauaaugaguuaaaaauaauuugggccgggcaugguggcucacgccuguaaucccagcacuuugggaagccgaggugaguggauugcuugaaguugggaguuugagaccagccuagccaauauggugaaacccugucucuacuaaaaauacaaaaauuagcuggguaugguggcgugugccucuugucccaguuacuugggaggcugagguaggagaagcacuugaaccuggaaggcagagguugcaaugaggcaagaucgugcuacugcacuccagccuggaugacacagcaacacucuguaauauuaauaauaauaacaauuugaacaaaacuccaugguuagugaaguggcugugcuaaaacacauaguuguaaugggagcuguucaucuuggcuccuagaugagcugggguagucuuuuaacuuacgugugccucgguuuccucaccugcaaauuggggaugauaauagcaauuaguauguaaaaagcuuauaacaaugccuggcauagagagagugugaaauauguguuuuaguucuguauuaucaggcauauucauucaccaaacgugcauggagggccugcuggcugccagguaucaagugaaugcuauugaagaaugcugucuuucgguaucuuuguuaaacuccaaggaaaagcugugguuuuguuuuugaagauuugaucuguuuucauuuuagggaccacauaaauuaaguaacugguuagguuuuugucuuuaccucgauguucagcaagaacagaaucaaaucuguggucuaugaguaauuaccuaaguucccauuauuuuguagcucaguaccuuguccacuuuggucaccaucagaaaauuuuuauuucugcguuuucuuguagugucuuaguaaguuccauaaagguaaggaccauuucugucuuuuauacugucuccccuagcacaaggaaggcacucaauaaauauuugcuagaagaauuaauaaauuaaagcaaguaugaauaagugaaugaacaaaugacuucagucuagguuaagauuuuggaagaaggguacuucuggugauaauuccaggaaguggcaguagcagcagcuugauggacaggaggcaacagucaguaagacugaaaccagggaguguguaggccaagauuugguacugguuuuccucuugggguuucagguuuuucaagaugaugaugggacauaggaugaaagugauagucagucaaugucaaaauugucagugauaauggauccauagaaaacagcaaccaggaaagacagaggguuacacuagccucauaggaaaggaggucuaaucugaagaguaagguaguuugaagcaauaaagaggagauuucugccuacgguccccaugcccugugguuacacagagccuagggaaaagaagaucugaaggagaacagcugcugucacugaaaaguuucaauaacugcaagaaaggagagaauggaagcuuuggugcauagggugaggauauaagaaaauucauuuccuuguaguaugaggugggggcaaggaaaaaaauguagaagagagagcaaaguggaagaaugauucauuugggcuauugcagagcaagauacggaggagaguccaggaggagacaggacucauucaaguuugcauuuagaguaguguccauggguaagaggaacccaggaauccagccugccacccccuggaguaguguauucauucuggcuucccauuaaucuuuacaaaauguaucuggguccccaguaauccauaaaaggguuauugacacccuacacagugcaaaccuggagugaaaucaaccagggcugaaaacgggccaucugcagauguuuaacuuggauuuacaaaaauugaauuaguggaaucaugaucauugugcugcaauuauaaaaagacuuacgagaaaguacacuuuauuccucaucgcucuagaaguuucuaacucaacauuaaacucacgggcaaggacuaguccauuuaagccuucaugcuuauaucaauucauucucauuuucuuuguuucucucccuccucugcucucuucaacucccaguggguucucguccauaaaagucuuuucuguucuauuccauuuuggagcauaggaagaggauaggcaauuuuuaaauuuuauuaauuuguaagauuccaugauucucuuaauuucuuacagguuuuuuggcacagagagccccaauuuuugcacuuccaaaagccaauuuguguguaaaacacuaugauuaugcucucuggacccuggaagagggaaagccugaauucaagcaucuguucccauuuaaugagccaccugagugaaguuuccaguagaucaggucuauucaagaagugacuuaaacuuaacucaaagauuccagauugaagcauauaguagaauaagccuaaguucuuugaggaaagccuaaauucaccuuccuuagucuaacaagcuccuggaguucagggcagagugaauuacgucuacccaaucacuccacaaucccauuuuaaaaagcagcgccccaaagaaaagcugucuuuuuuuuuccaauugaugaauccuuugauagcuaacuuuaaaaugcuuuuccuauuugauaugauuucuuccaauccugucccaucgcaacugcauauucaggagguaaaaagaagcaaaugucaaugcugaauugaucuacaaacuccaccuuaagaaauacuucucuaccacagaauucuauccacuuaggcaagaugugacacagagaaccuuucauuuuuaucacugaguaauagcuguugcuuggauacauuaaaacuuuaccuuaucuauuacccuaagcuaauucacuaaaaauugaaauacuuucggcccaauaucuguuucaggaaagaugaaguagauauacuuuucccuauuucucccaccaagcacaacuaaaaaucuggauauuguauauaaaacaaacauaaggugacucugaaaggcagagaaaaagaagagcacuaccuagggaucugaagaccuguggcucaacacagcggugcauucccuggguuuucuuuuugucucauucuuccuagacuggguacuggaaaagccggcaaagcagaaacuccaggaggugcaggcaaaaaaaggaccuaagaaaguccugcucugucuaauucaaagggccagaaaaggaaagccuaauaagacagaaaauguuuagacaacaaaugaucuaucucaaucaagaccacacauaacagcguggcccaagucuaccucuuauagcaaaggccaagugaagagccuagggcucuaccuuuaucagacuguaagaaagcgcugcaacccaccugcugggguggccucagagaaggccugacagggagucagaugcucacuacaucguggcaaaaaugaagucacuuauccgaacugugauaucaguagagcccacugacaaaguaacgaaggacucccccgucacacuguccggcugguaucagcagaggcauagguggagcaugaacucccacuacccuccagaaauaaugaggacucccuugccugaccccccaggcaucagugaaggccuaugggaaaaccugcuauuucaauuccucaccagccuggagaagcaacacauaccucauccugccaauaugguggcagagaaggccuucuaaaauaaaagauuuaggccaggugcaguggcucacaucuguaaucccagcacuuugggaggccgaggcaggcagaucacuugaggucaggaguucaagaccagccuggccaacauggcaaaaccccguaucuacuaaaaauaaaaaaauuagcugagugugguagcgcacgccuguaauugcaucuacucaggaggcugaggcagaagaacugccugaacucgggaggcggagguugcacugagccaagauuguaccacugcacuccagccugggugacagacaagacucugucucaaauaaauaaauaaauaauuuaaauaagauccagugucucauaauaaccaaaaugucuacauuucaacugaaaauuauuugucauaccaagaauggggaagaucucaucuuaaaugagaaaagacaauuuuaaaaugccaauaucaaggugaugaagaaguaugaauuaucugacaaagauaugaaaggcaccaucauaacaauauuucaacaagcuauaugaacaugcuugaaacaaaugaaaaaaauagaaagucucagcaaagaaagagaagauagaaaagaaaaaccaaauggaaauuuuggaacuaaaaauuauaagugaaauuaaaaacucacugaaugaaauuagcagaagaauaggacagaagaaaaaauaaaugaacuugaagauagaacaacagaauuggcucaaucugaacaacguagagaaaaaaauaacugaaaaaaucagugaacgcagccucaaggaacugugagauuguaacaaaagcgcuaauauccaccacucugaagcuaauaaaaguggcugacccuuaucuuccagacaugucacuuuuuuugucaaacugaaaaucaaguaaaaauuuacuaguuggccucauauucaauuuuuaauuguuuucguuagcaauaacauagaccacuucaaaaucggcagucuuuugugaucagcaaagggaggcucagacagauacauaacuuugccaggacaugauuguucagaggcaagacaucaguuaagagcccaguguuccuaaacuuaggucacugcucuuugcauuaaauacauuucuuuucccacagucaacuaauacuaguaaaucacuguauuuuggguaacugcauuagaagaauaucuugaaaaaguauuuaaagaaauccagugugaccacuuuuacuaacauuccuaguaaccgucaguguaaacaucuggggacccuaauaggaaggaugccauuaauuugcaugcucaguagcccacugcgugaggguggcuuuagggaacucgucuugcugaccagaaacauaccgaaguaauugugcucuuccgugugaaacagauggucuugguuuuucaaguuuuccuguguguuuguccucuuggauuucuuuugcugagccuuugcuuuaaaaaaauauacaaauauauuagcuuuauugcuuuaugcuaauuaauaaaaaauaaaagauggcaauguagauauauacuccguuauuuccaugugcucaaaugaugcguguuccugacaagaguuccagccucauucugacacucggagcugucucuuucacucuuucagcacagcccuauguuuuacauauugaagaaacuuucuguccagcaccuaggaacaggucuucacaggcugccacuguuggugugaauccugcacccgaugccuucuacucuagguauguaucgccgccaauuauaguuuucuauuuucuuaucuuccccacccaacguugcaacagggccugcaccugguuuuccagguauucgcaggcuuugcauaguccuuggcauucuguguucucccuugaauaccugcuaaggaaucucaugcuugaaagaguaagaauauggaaaaagcaguauuuuaaaacucacuugccaguuaaaaaaguugcccaugcauuuuucauuuucacauugacucuuucaaacagagccacaaaagucaaacaccccaaaauugaugagaaucaaucagaggagccagugucuccccucuccacaugacuccguucuucaaacagcucucuggguuugcuuccaaaacacaaugacccugugauucccagaaucccugcaggagaaggucccugugugaucaaccaggaaucaguucuuaacccaaaaaugggacaacauagaauaucaccuacaggcugcaacuuguaaacuauuuguuaagcuuuaaaaagugggcugggugcaguggcucacaccuguaaucccagcacuuugggaggcagaagugggcggauuacuugagcucaggaguuugagacuagccuggccaacauggcaaaacgccaucucuacuaaaaauacaaaaauuagccagccguggugucacacaccuguaaucccagcuacucgggaggcugaagcaagagaaucgcuugaaccugggaggcagagguugcagugagccaaguuugugccacugcagccugggugacagcgagauucugucucaaaaaauaaauaaauaaauaaauaaauaaauaaauaaauaaauaaauaaaucucuagguauuucugacugccccagcauuuacguagcauuggcccucaauuuuugcuuugacgccuguuuauagaagguccuaaauggcacuuguuuuguauauuucauacauucaucaagccaguguccacuuuauauagguccauucauauuuuugagacucuagccuuuucaugguauuaaaguucuguuagacauuaucucuaugacaguuucgcugauuagcuccauauaauuuucaucauuccacauucucccagugcuuacuuaaccaggucucuagcaugauuuuuacauuuccccugugacugcuccaaguguuuuaucaucuuuucugcauauuacuuguccugacucaccaacuauauaaaagugaauuguguucuucucuucccuucacagugcuccacacauaaacucuaucaaaucuuucugcuuagaauacaaagaggagcagaaaggaaucaaccugcgccuuggagggacauguaaauauauauucaauauuuuucuauuauaaaauaaaguucuggccagacgcagugacucaugccuguaaucccagcauuuugggaggcugaggugggcagaucacuugaggucaggaguuugagaccagucuggccaacaugguauaacccugucucuacuaaaauuacaaaaaauaaaaaguuagccaggcgugguggcaugugccuguaaucccagcuacucaggaggcugaggcaggagaaucacuugaacucaggaggcagaaguugcagugagcugagauggcaccacugcacuccugccugggcaacagagcaagacuccaucuuaaauaaauaaauaaauaaauaaauaaauaaauaaauaaacaaacaaacaaaauaaaauaaaauaaaguucugugaaaaauuaggugaguaugguuacuaaugcugcaucugaaaacaaaugcaaauaucuacauacccuuuguaauuaacaguggucuuccaguuuaagcuugguucccaucucuuggucauuugauuccuccaaaaauuaauuugguucuucuccagugaccuuuugucugaaccagaaaugucuuugcggagggcagcugcuucuuccuucuugggggcuuugccaagcugauccuuuuccuuuugcuggucuucacugaagcuaauucccuuuauuuaaaaaaugagaauaauuuuuaaugauaucugaauuaucuaguguucucugaagauuaaugccagugguaaauucaggaaaggaagucucggaugcauuuaacuugugguccuuaguaacagcuaaacaaggacaacaucaagacuaaggcuucuguuggaguuagguggacaguaacgugauguuccuaaacucacaccucugcugcagcacaacagauacaacugcaaggcuggaccugcucauuccucaccaccaccaaaaaauucaaccaaaacccucuauugacuaaaacacaucguauuuaaauggcuugaaccaaagauaaagggaacaucuugaagguagacagguaugacauauuacagaggaaugaacauaagaauuuuaaaagacuucucaucagaaacacugcaaaccagaagaaaagagaguaauaucuuuaaagcacuaaaaaggaaaacacaaaaaaccaugucaacccaaaauucuuuacuaagaauaaaacaaaaaucuuucaaaaaugaaagcaaaauaaaaaccuucacagaugaacaaaaacagagaauucacugccagaagaccugugcuagaaauguuaaauaaaauuauucagucaggaguaauaccaugccagccagaaacauggaucuauucaaaaaauuaaaagcugcagaaaugguaaaaauaaauauacaagacuuuguguauuauuuuuaaucauucuaacauauaauugacuaucuaaagcaaaaauaguaacaacguuuugagggguuuaugacauguagaaauaaaaugugugacaacaauaacacaaaguauagggagggguauucaagguauauuguuguaaguuucuuaaacuauuugugaauuuuagaauuuuacuuaaaggagacgugacaaauuugagauauauaucauaagccagagggcagcuaagaaacuuuuaguaagaaauauaacuaguaaaccaauagcauaaauaaaauggaaucauuuuaaaaagcucaauucaaaaggggcagaggaaggaaaaaaacuacaaagaacagaugaaacaaacagaaaacaaguagcaagauaguaaauuuaaauuuaacuauauuaguaguuacaucaaaugaaaguguuuacacacaucaauuaaaugagaaaucaucagauuggauggaaaaggagaccuaacuauuuguggccuaaagaaacuauuuuauauauaaagauacaaauacaucagaagugaaaggcuggagaagaauaguuuaugcaaacaauaaucaaaagaaagcaggaauggccauauuaaaaucagacaauaucgacuccaaagcaaauaauauuaacagggacgaagaggagcacacauacuaauagaggaucaauuagcacacaaucguaauuguauauucaccaagcaacagaacuucaauauacaugaaggaaacacagagcuaaaaggaaaaguagauaaauccauaauugguagacuucaaaacucucucaguaaucaauaaaaugagcagaaaaaaacaucaguaaugauauagaagauaugagcaacacaaucagacaacuuggcuuaauugacauuuaaaagacacaccucucauuaacaccagaauacagucuccucaaauguacaaggaaaaaaaucaccaaaauagaucauauacugggccauaaaaugaacauuaauaaguuuaaaguaacuaaaaucauauaaacaucuuaauacauuggaauugaacuagaaauuaguaaaagaaaguucuacagaaacuccucauauauauugaauaaaaauaucauauaucaaauaucuguguaacauaguuuauacaaugcucauaaagaaauuugcagcaugaacucucauggucaaaauaauacauacauacauacauacauacauacauacauacauacauacgcugagacagccagaucacuugaagccaggaguucaacaccagccuggccaacauggcaaaaccccaucuguaccaaaaauaaaauaguuuauuuuggguucagggguacaugugcaggcuuguuauauagguaaacucaugucacagguguuugcuguacagaugauuucaucauucagguacuaagccuaguauccaauaguuauuuuuucugaucuucucccuccucccacccuccaaucucaaguaggccccagggucuauugcuccccuuuguguccauguguucucaucauuuagcucccauuuauaaguggaacaggggguaauauguuuucuucuuaaaaaggacaggaucacauucuuuuuuauggcuguguaguauuccauggcauauauguaccacauuuucuuuauccagucucccacugauggccauuuagguugacuugauguuuuugcuacugcgaauagugcugcaaugaacauaugugugcaugugucuuuaugcgaugauuuauauuucucuggguauauacccaguaaugaaguugcuggauuaaaugguaguucuguuuuuagcuccuugaggaauugccacacuguuuuccacaaugauugaacuaauuuacacccaccaacaguguguacguauucccuuuuuuucugcaacuucaccagcauuugcuauauuuugacuuuuuaauaacagccauucugacugguguaagaugauaucucauuaugguuuugauuugcauuucucuaauaaucagugauauugagcuuuuuucacaugcuuguuggccacauguaugucuucuuuugaaaaguaucuguucauguccuuugaccacuuuuuagugggguuguuuguuuuucucuugaaaauccauucuuuauggaugcuggauauuaaaccuuugucagaugcacagcuugcaaauauauucucccauucuguagauugucuguuuauucuguugacaguuugcugugcagaagcucugagguuuaauuagaucccacuugucaauuuuugcuuuuguugcaauugcaaaugguauugccuagguugucuuccaggguuuuuauaguuuugaguuuuacauuuaagucuuuuaucccgcuugaguugauuuuuguauaugguauaagaaagcgguccaguuucaaucuucugcauauggcuagccaguuaucccagcaccauuuaucgaauagggagucuuuuccccauugcuuguuuuugucagcuuugcuguagaucagaugguuguaggugugcagccuuguuucugggcucucuauucuguuucauuggucuaugugucuucuuuauaugccaguaccauguuguuucgguuacuguagcccugugguauaguuugaaguuggguagugugauaccuccagcuucggucuguuuuuguuuuuuuuuuuuuugcuuaggauugccuuggcuauucuuuucugguuccauaugaauuuuaaaauaguuuuuucuaguucugugaagaauguuuuugguaauuugauaggaauagcauugaaucuauaaauugcuuugggcaguauggccauuugagugauauuuacucuuucaauccaugagcauaggauguuuuuccauuuguuugugucaucucugauuucuuuguaguguuuuguaauucucacuguagagaucuuucaccuuucugauuagcucuauuccuagguauuuuguucuuuuugugauaauugugaaugggauugcauuccugauuuggcucuuggcuuggcuguuguuggcguacaggaauucuggugauuuuuguacguugauacauugauuuuguauccugaaacguugcugaaguuguuuaccagcuaaagcagcuuuugggcugaggaucccuuguuuuauaugcuccaaguaaaacauuauucacaacugaauuccucaaaauuucuucaaacacaaacaugacuagauuaaauuaaacguauuguaacauuuuuuaaaaacuggagaaauaagaguaaauaaacccaaauaaaaagacauaagcaccaaaguaaaguauaaaagauaaaaauuaaaccuaaaacuaguuccucgaggaaauuuaguaaaucuauaguccuauagguggaucaaaacaaaaaaaccacaaaugaccaauauuaggaaugagagagguaacaaugacuacaaauucuacagauauuaaaaggucaauaagagaauacuaugaaaaaaguuuaugccaauaaaucuggcaacuuacaccaaaugaacaaauuccuuuaagacaaucuaaucuaccaaagcucccucaggaagaaacagacaaccuguauacugucauagcugucaaauaaauugaauuuguaguuaaaauuuuucccauaaagaauauuccaggcccagauggcuuucaccaaacauuucuaccaaacauuuaauaaaccgaccaaacauuuaauaaacaaacaauauuaauucuauacaaacucuuccaaaaaauugaagagaagaugaaacuuucuaaaucauucuauaaugucaguauuacuucaauaccaaaaccagacaaagauacuaaagaaaacaaagcuacacacuaauaacuuuaugaauauaggugcaaaacuucuuaaaaucuuagcaaauuaaaucugauaauguacauaaaagauucaagugggguuugucucagaaauguaagguugguuugucacuugaaaaauuaaucaaagcaauuaaucacauuaacaaacuaaaagagaggaaaaaaacacaugauucucuccacaguacacaaagaaacauuugauaaaauccaacauucauuccuaauaaaaguucucaaugacucagaauagaagccuuaaccuuguaaaugguuagcaucaaacuuaauugaaagauuucccuguaauaucaggaacaagagaccauuucuauucaauuuuuuacuggugauuccagcuagugcauuaaggaaauaaaaagaaauaaaaaaacuguugagauugggaaggaacaguuaaauuaggaaggaagaaauaagaaaaugaucuuuacucacuaacaauaucuacauagaaaacccucuggaauguauaaacaagguacuagaacuaauaagggaguuuagcaaaauuucaggauauaaaaucagcauacaaaaaucaaguguauauuuauacaauagcaacaaaugacuaaaaauagaaaauuuaaaacucauuaacaauagccccaaaauaugaaacacagauaaguuucaaaagagauguauaagaccuguauauugaaagcuacaaaacauuggugagagaauuuaacuaagaccuaaauaaauggagagacauacuauguucauggauuagaaaauucaauauuguuaagauguccauuuuuccuaaauucgucuauaaauucaaggcaaucucaaccguaauuccaucaggcaauuuuuuaagaaacugacaugcuggcucuaauauucuuauggacaugcaaaagaucuagaauagccaaaaaacuuuuuugaaagaacaccauuggaggauuuaaaauaaacaacuucaagacuuaucauaaagcuagaguaaucaagacugugguauugguguaaaaauagagaaaucaaaguuacaguaugaaguguucagaaauacauucacagacaaaugaacgacuaauuuuugacaaaguuauaaagguaauucagugaaaaaacaauagauuuacuuuugacaaaugaugcuggaacaacuagauaagcaaaagaaaaaaaugaacuuugauccauaacucauauacacaaaccaaauuaaaguggaucauagauauagauuggaaagguaaaauugaaaaaucucuagaagaaaacauuggagaaauucaucauuauacuggguuuggaaaagcguuauaaaacacuauaaggaaaaaauaaguuggacuguuucaaaauugaagacucuugcucuuugaaagacauugcuuagagaauaaaaauacaagacucggccgggcacgguggcucacaccuguaaucccagcacuuugagaggccaaggucggcagaucacaaggucaggagauugagaccauccuggcuaacacggugaaaccccauuucugcuaaaaaaaaaaaaaaaaauuagccaggcgcgguggcgggcgccuguagucccagcuacuugggaagcugaggcaggagaacguugugaacccaggagguggagcuugcaacgagccaagaucgaucaugccacugcacuccagccugagugacagagggagacucugucucaaaagaaaaaacagaaaagaaaaaagaaaaauacaagacccagauugggaugaaauauuuauauuucauguaucuaacagaauauauaagccaagaacauauauaaagaucuguugcaacucaauaaaaaacugaauagcccaaugaaaaaaacagacaaagaguccaaauagacacuuuaccacauaggauaugugaauggccaauaagcacaugaaaagaugcauucaagaacugcaaauuaaaaccaaaugagagaccaguacacaccuauuagaaugucuguaguuaaaagacugaccauaucaguuaaugaugaguauguggaagaacugggacucucauacauugccuacaucaauguaaaauauugcaaccacuauggacagcaguuuaccaguugcuuaaacauacaacuaccauaugaucuuaccauuucauucuaggcacauugaaacuauaugaucauacaaauccuuguacaaaaauguucuuaguaguuuuauuuguaauagcccgaaaccugaaauaacuacacauccauuaacaggugaguggauaaacaaauuguggcauauccauacaauggaauaauacacauccauaaaagcaauaaauuaaugauagaugcaaaagcauagaugaaucucaaaaagaaacaaaaaucugcacaaaccauaccacaaaaauuauagaacaccaaggaagauccuaaaggccuccaaagaggggaaaaagccaaaacaaacaguuuauguggaaacauaagccuuugaaaugcuaacuaaaaauuaauuucaaaccauuacucuagaaacaucugagauaaaauaauaaagguauucucuaacauccgaauccucaauuuuucccucccaugugcauauuuuacucaggagggucuacaaaaugaugggugcaccaagaaaaggaaaacuggagccgggcaugguggcucacaccuguaaucccagcacuuugggaggccgcgacagguggaucaccugagauuaggaguuugacaccagcuuggccaacaugggaaaaccccaucucuacuaaaaauacaaaauuagccgggugugguggugugcaccuggaaucccagcuacuaugggggcugaggcagaagaaccacaugaacucaggaggcagagguugcagugagccaagaucacaccacugcacuucagccugagugacagagcaagacuccaucucaaaaaaagaaaagaaaaggaaaacugaauagaaggcaacuuccucaacaugcuaaaggucauauaagaaaaucccacagcuaacaucaggcucaauggugaaagccuaaaagcuuuucaauuaagaucaggagucaggcuaggcaugggggcucacagcuguaaucccagcacuuugggaggccgaggcaagcagauuacuugaggccaagaguucgagaccagccuagucaacauggugaaaccccaucucuacuaaaaaucuaaaaauucgcagagcaugguggcagaugccugugaucccagcuacucgggagcuugaggcacgagaaucacuugaacccgggaggggaggugaagguugcagcgagccaagaucaugccacugcacuccagacugcagucugggugacagagugagauggagugagacuccaucucaaaaaaaaaaaaaaaaaaagaucaggaaucagacaaggaugccugcuuuuaccacucuuauucaacauaguccaggaaguccuagccacaguaauuagucaagaaaaagaaauugcaaaagagucuaaauuggaaaggaagaaguaaaacuauuuguaugcagauggcaugaucuuguaugcagaaaaaccuaagaauacacacacacacccauacacacacacacacacacacacacacagaguuaaaugaauucagugaaguugcgaaauucaaucuugauuuuaacacucaaaaauuagaucugauuugaucacucaaaagcuguauuucuauacacuagcagugaauaauugaaaauaaaauuuagaaaacaauuucauuuacaguagcaucaaaaauaauaaaauguuaaugaguaaauauaaugaaggagaaaaacuuguacacugaaaacuucuaaacauugcugaaagccauuaaauauacaaauaaauggaaagcuaucuccuguucauaaacuggagaacuuaauaugguuaagauggcaauacuauguaaagcaauucauaaauucaaugaaaucucuaucaaaacccaauggcauuuuuugcagaaauguaaaaccaagccuaaaauucauaaacagugucaaggaauaccgaauagccaaaacaguacuaaaaaacaaaaacaaaguuggaggacucacacuuccuuaugucaaaacuauuauaacuaaaagaaagauauagaccaauggaauagaauuaaaaguccccaaguaaacucuuccaucuaugaucaauugauuuucaacaagaaugcugagaccauccaaaagagaaaggacaaucucuucaacaaauugugcugggaaaacugaauauccacaugcaaaagaaugaaauuggagccuaauggacaaaaaucaacucaaaagagaucaagggccuaaaguuaagagcuaaaacuauacaauccuuagaggaaaaacacagugcuaaauuuuucaugaccuuggauuuggcaaugguuucuuaaauaugauaucaaaagcauagguaaaaaauagguaagaaaauaagaaaaaauagguaaauuaggcuucgucaaaauuaaaaauguuucugcaucaaaggacacuaucaagaaaguuauaaggcaaccugcagaacaagagaaaaaauuugcaaaccuucuaucugauaagggguuaauauuggguauauacaaaaacuacaacaacaaaaagauucaauuuaaaauauaagcuaaggacucaagcagacauuucuucaaaaaagauauacagauaaccaacaaauauaugaaaauauggucgacauuacuaaucauuauggaaaugcaaaucaaagccccaaugggauaccacuucacacugacuacgauguuuauaauuaaacaacaaccuagaaaauaagaagcauuaacaaggaugugaagaaaguggaaucuuuggauaaugcuggugagaaugaaaaugguguggcccccguggaaaacagguuggcaguuccuccaaaaguuaaauacagaauuaccauaugacccagaaauuccacuuuuaggaaaagacccaaaagaauugaaaauaggaacucaacagauaccuguacaccaauauucauagcagcauuauucacaauacccaaaagguggcaacaacccaaguguccaucaagggaugaaugcauaaaccaaauguggucuauacauaaacaaaauauuauucuaccauaaaagaaugaaauucugauacaugcuauagcauggaugagccuugaaaacacuaugcuaagugaaagaacccagacacaaaaggacaaauauuauaucauuccagugacaugaaauaucuaaaauaagcaaacugauagaaauagcagaucagaguuaaccaggaagucagggaagaaggaauggggaauuauugcuuaauggguguagaguucaaguucgagagacgaaaaagacuuggaaauugacaauagugauauuuguacaacauugugaauguaauuaaugccauugaacccugaacaaugauacuacauuuacaguauuuuuauguuauguuauguuguaaaaaaaaaccacuaauaauaaaaagugcccaaaaauaggcaaaauuacuguuuuucuuguaccauagaaaguuguaguuuaguaacauaaugcuaugaaagcucaaaagaaaccauaaaacuuaccaauuuagacauauuuucugaaaauuuuggugauuuuucucuuaaaaaugugacaagguuuuuauaaauugaaccuuuucucucauaauuaacguccccuucaucaucuguuuugcccuuugggaaaaaacaaguuucauucuaugauuaacauaagaacaauuguaagaagcugaucaauacaucacaagcuagccacacguauuauuuucaucuccgaaggaucuauaugguaguuuuaauacaggaaauguauaggcaaaauccuucccccuuaauuuaauguuaucuauuuuuccauucauucacucauuccuuccuucauucaauuguucauucauucagcaaggcuuuacugaguaccuccuauaugcauguaaggcacucugcuguucagcagagaagugagagcuuccuucucuccgcucuccucuacucugaaaaugcauuaugaccucacgagccuuaguugaugaugucauaaaagucuucaagguuagaauuuaaccguggaaaagccuacauuucuguuugucacacucuguucuucugucuguggcaugguugcuauaggcuuauuuucuagaucucuguguaacgaucuguccacacacccaugugucucucucucucuucuugucucuuuccuuuccucauuuuccuuuucuucccuaccucuauuguucuuccauaacagaauauauauauauaauguauacacacaucacauaacuauauguauauaaauacauauaacugcaguuuguuauauauaacuguauacacaaaaacauuucuauacguaugaccaguguguuuuaaacuuuguuguaauuauugaguaguuuuaugguccuugucuuucauuuuuuuaaaacuuaaagggauacuuagauaucuccaugcuaaauaaguuauauguauguagaucaauaauaaccuuugauagaaauaaagacucccugccccccuccagaaggucaaagaaaaucauuccuucuuuugucccuuuauuccuaauuagagauuucguuuuucuaaaauaucauaaaccaaagcaaaaucuuauuugucuacugccucuuuguagaaaugagcucagugucaugcuaauaagaaaagcaccaaaaggcaugucagaaagauaacuauagguaaucagaaaagaggcuccagcauuuugguaccaacccaagccaacauguaacaacccuccaggcagucccccgugauggcuggguccccauuaaggacuuggauccuccuuguagaauuuuguuucugaguuccaaauuuauguugaagauacugagggcaggauguugcagaggugaaagcuaagcuccuucuagcugguucugugaauagggaugagacugaaaguguuuuaauccagaacacugugugcuguuuaucacucagcucaaagcccagccacccagccucuacuuugugcuacucacgcaggaaucugcaaugucguauuucuccuuucaccaggcuagguuauuaggcuccgucauuagaaucagcuaaaggaagacugaaaggcuggcagagggaggagggaccugcugcuuccugcuggcccacugucccuguuagagucaccccagcaacggcccuucuuuccacacaguggcaguugcuuccaguagcaacaguugguuccaguuuccagguuuguugauuuuucacggucccagaaacaggcucaccucacccccugggaaauaucacuaucagucauccagugcuccauuuucaaagguccaggucccagcucugccaucucuacaaggauccucuucccgagguaugagcauuaacugggcagugcccacucuucagagaucuggagcccugccucauggagauggucugaacucuguggggaccagcacagccuggaaguggacccucccaagaggucugggucccagcuucauagggcacugucuccuaccuucuacauuuagauaagccccucucuuucccuuugucccuccaacucuuaggaugcaagcugcaguuaugacaucuguauuaucucaauguuucuuuuuugaccuuucuaucauuuggaagcuguguaaugaaucagugaagugauuacguuaaagacauuuauaaaguggaaugggucacuuugaagcccauuucuuaucagauuggcuuaaugaccugcaguggagaauaagagagcuaauucugaagcuauuuuggauuugcccagcaagcauauaucaaaggaaucugcuucuaucccacagaaugguaauucauucucuguggucauugggacacacccuugagacaucuacagcuaacaaucaaaguccacuggcuuuaguuacguuuuuaaaaauuuacuuacaccauuuaaaaauacuccuccugcacugcaaguaaugcacagagucucaccaucgugagguuucaccagcacauaacaaauuuccccacgaauuugucuccacgguggggcucgacauccauuugaaaauucauaaucugaaaccaaucaucaagcaauuaacaggaguuccuuaaccuagaguuugguaaaaaguguuggcuuccacaaaauaaauauuguggaaauuuuaagcuuuccccuucuuaaaccuucucuuguaauguagacauugaaagcauuuugcaaauguaauuaugaaaauguaaauaacauaaaaugagccugagaaaacaucaaaccugagguauauucaauagauuccaagacuguuugguuuccuuuuccugagaaacguuugagcaguucuauauccuucuucaccgucaugggacuuaaacuuauuucucugaaauaaauguuuaaaaugucagcuuaaauacuuuaaacagaaucuaggaaacacaugaacacauuucauuguaucaggagaaauaucuuuuuuguaauuaaaauugcaguuaauuuuagccgugcuauaauuuuauaacagcacugucaacacaucaaguaauuagugauuuauguuuaaugcaacauuaaacguacuccauuaaauauucacuuuauuucaugcugauaauauucuaacacuaaaaauauuagaaaaugaacaugcuuuggacuauacaaacucuacaugauaucugcauuauaauuuaauaauuuguguaauagucuugagagcauuugaaaauaacaagaccaccuaaugucuucagaauugcaugaaaccccaccagaauguuuucgugaugucaccugcaauuuuuaauuuuuagaacuggaauaaaugaaucccaggaaaauuguuuguuccaauaaaauguaaaguuaaauccauagcaauaacuuccauacuuuacuuuucuugugucuuuuuuucuaaaacucugaaagcaacuuuguaacuaauuuuuaaagguuccuuuuuaauuuuuuaauuuuaauuguaauauuuuauuauuuauuuaacuaucuauuuugagacagagucuugcucugucacccaggcuggaguucaguggugcaaucuuggcucaauacaauagagguuccuuuuugaaaaagacucacaaugaaauauguuuuagagaaugauugaggaggugcagauccaauugcuuaagcagcauagcaaucuucaucuuaauuucacuuucaggaucaucaucucugguaauuuugccaagaauauuuaaugcaauugaguuuucuuucauuguauuauaaucagagcccaggauuuuuacuauggggucucuguuagcugccaaaaaaaaaaaaaaggagacaaauaaaaauuauccacuugucuucuaguacaacaaacauuaagacuaauaaauccuucaaaguccauucagacguguuucuuucauuaagcuuuuucuaaacgacccaauuagaauucaucucuacgucugagauuccauugcuuuuaggaacuuucuucuacuucacgagaugcucuaguuuguauuguaacaucaucuauauaucucccuaauagcacaaagaccaagacagucauucauucuuucuuuuuuaauuggccguggggcauuguucagaaugcacauucaauuaauacauucagaauuuauuugaagauggagaaauagugaucuucuuagaagaaucaucacuagaacuauaugugcauguguguauguguguguagcagugcuggguauuuauaaaggcuuucuuuccaaaauagcaugcuuuccuaagccuacagacccaguagcacucuuuugcaaguauucaaacagcuuaauauuugcaaugccauaugaucuuagaguuggaaagcacaucuagccauauacauaauauauacauaauuuaauuauauauauauuaaaauuauagugaaaaacaaauaccaauucauuaucaaggcugauacagaugugaaaguugaaccuagagauguugaaaacagaauuugguuaaugucaaaaaccaauaugguugaaaaugaaggagaaaguggaaaacccuuguuuagaauggagaaauuugagaaagaugaaaauauguaugcauugagauggggguggagaggaaggccuaugagacuaauucagaaagcuuaacuuaaaggaaaugaagaaaaguauagugaaggcauuaacauucccauguggucaugggauaugccaaggccuuaaggcugagaaaaggacuucacugggggagaggagagcagcgaaaaggagacaaaggaaucaaccauuuauugagcaucucaacuuaacaaccuuaugacugucaucacacagagauuuacaaaaagagcaggcagauucugaggaauggcauaaaccugacuaccaaauugccauguaccaugcaacuuggaccugaaacuaaggguuauaccaaaauucuugcagaaauggcaaaauguagcaaaggauaaguauuuagcaaauggauaaguauucagcuauauagaaaucuacauauuaugucuaccaauugaguugaauugaaugaauaauccuucaucuauuaacuaccuccuugaauucagcuuuacucuucaagacuugauacccucgccuaauaaggaguaauaggcaaggcauaaaaagagguugccauccugagguuagcaucuaaaaaauaaaaguaaaaaaaagaccaucuucccaucucacacagaaauaggcagaauucaaauaccuugugccagaaacccauuggucacauaauuccaauaaagcaggacgcauacauuaucaccuaugauuagguacuucuacucauaagaaacauuuaccacacaauuauagcaggcaaccacauucauuuuuugcauguuagaugauuagaugauagugugaacaucacauauuuuuaagaagaagaaaaauauuugccacaaaguugaaugacuguaacuauucacagaaggcugugaaguccacaguggaauauggcugagaaaaguggaaagggagacuauuaaaggcugucucugcuaaagaaagagccuacauucauuuuaaaggaaauagauugucauucaaucuauuccuuggcaguaugccgagagagaguggauucagaggccagcccuugucaucugucuucucuauugacacugaccuaacaggcuacagcccccugugcuuuccagaagcugagaagguucucuuucaaaccacaugcuaaaaucagaaaccuagaaacuuaccagugguaagguagcaggcuuuucauuuuaaagcagaaauuugauaggagcauaauauugcagccaaggaaaauuaauaacauuuucaugaaguuguacauuugacuuuuuaccuuguagauuguagaaucuuuuucaagagacucuaacaaaugauccucccacccuuuccccacuuucccagcaagauuguuucuaaaaguucaaaucacagacuggagcauuaagaucaccuucaacacaugcuugggcuuccuucaacuucccaguuuuggcaauaaguaacaagcgugacagcugcccaaagcuccuaauuuuaauuugugguacagagagaaauagcaaaggcuguccauuuuuaucaacuucuucugauuugacuguuguuucacuaaaaaauaaaaauaaaaaauugaaagcuucaugcuaccuagaggucaguagaaguuaaauuuaagacauuuagacagauuauuccuauaucucauuauaaaauacagaaaauauaaauacaucugguuaguagcucaucuguuuucccacuuucuuccacacucaaacucuuaaauccucaaacuuaccagcaagccuagugaccaauaggauauaaccaaggaagaauuuuuuuuuuuuuuagcaauuucuugaauucacaauugaacucaaauagucacaguuuuuguuuuuguuuucuaaaauguguugauuucuggcaucuuuuuaaaaaucauugguucugcaaaacccuucaugcuuuggggaguucuaauguuauuuuauuuauaaaauuuuuacaccacaguaauuagugguuagggguuuucuuggcuacacuguguuuaugaacaaaaaaacuaugaaaaaaaaagcaaacugaaggcaaacuagauccucucugaauuccuuucccacucuaaacuucuuuauuugguuugccuugggauaauaggcaguuuuucuaaauggauucuuccugaucaaaaguuauugagucuccuagcuuuguguuuccauccauuuuaaugauuuuuuucagguuggccuuuaaaaaauauuaagauguuuucauggaagugauauuucuauagauuucuaccacuuacaacauuaacuaaacugucuagguuuuguauuacaggaggcuauaucugaugaaacuccugacaccuuaacaccugaucuagcuuuuuuuuuuuuuuuuuugagacagaguaucccucugucaccgggauuggagugcaguggcgugaucucgggucacugcaaccucugccuccggagcucaagcaauccucccaccucagcccccaaguagcugggacuagaggcacaugccaccaugccucgcuaauuuuuguauuuuuaguagacaacgggguuacacuauguuggccaggcuggucuugaauuccugagcucaagggauccacacaccucgaccucccaaaguacugggauuacaggcgugagcuaccacaccuggccugaucuaacauauuuugaauugcaauguagauacauagauguaaaauguugcuaguucaucagaaaaaguaaaucugaccaaccgagauuacuuauuacugacgaucucacuagaauaaaaauaagaggauaggaacuaggggaaacagaauaauguucacaucugaauccccaaaaccuaugaacaugucaccuuacauggcaaaagggacuuugcauagaaauuaagucaaggauccugagauggggagacuauucuggguauuuggaggaagccaaacauaaucaccaggguucuuauaagaggaagacaggagggacagaggcagcgacagggauaugcugauggaagcagcggucagagugauguggagccaugagccaugagucaugagucaaggaacauaggggccucuagaagcuggaaaagcaaagaauaaauucuccuuaagccuccggaaggaaugcaacccugccgauaccuugauuuuagcccugcagguucauuuuagacuucugaccucuagaacuguaagauaauacauuuguguguguuaagccauuagguuuggggcaauguguuacagcagcaaaagagggcucacagagggacuuuaugaguccgauucugcugggugcagauagggacugccccuaucaccagcacuucagauaggaacugcacauagaagacauuuaguaaacaucuggggaauaaaugaaugaauaaaauauuucuagacuugccaaugacaugcauuguucacaaaauguauauuuucucuaaaauuaagcuucuggaauaaugcccuuaggacuuaagagauuuuuuaaaggccuguuaccuaaagguuacucacaucaagggcuggccaccacacgaaguggauggugagaggacuaaguaacaggcugaccaaauaccaaagauaccaagcuacuuaacuagagagagugaaacuccuggugagaagccaaagggcacaggugacauuuuucauugcuccuaccaguugaagccuguaacuuaacagagaagucagaaauaaaaugccagcuaccuuaaccaggcaugguggcacgugcuuuggucccagcuacuugggaggcugaggugggaggaucacuugagcccgggaggcgggaggaugcagugagccaacaucacaccacugcacuccaaccugagugacagagugagacccccucucaaaaaauaaaauaaaaauagauuugaaaaauaaaaaacgccagcuauggacaagauuuugaagaggaaguuucaguuuucaggcucacaguuucuaacaccugaagaaugagcucuuggaaagaaaaaugcugcacucaccuugggaagaucaggaagaaugagcuaucaaaaacuccagugaccugauggagaaacuuuuaaaccagaaucguggaagggagcuaaaaauucuguuuauacucuaaagcaagaaagcagaaaagugucuuuuuucuuuaauccucaguaucgaguuuaguguccuuuuuuuuuuaagagacaagaucuugcucugucacccaggcuggagugcaguggcacaaucauagcucucugcagccucgaacuccugggcucaagggauucuucucccucagcuucccaagcagaugggacuacagccgcacgccaccacaccuggcugcuuauuuauucguuggucuguuuauuuauuuauuauuuauuuuuuagagacagggucuugcuauguugcccaugcuggccuugaacuccuggguucgagugauccuuccaucuccaccuuccaaagugcugggauuacuggcaugggccacugcacccggccccauuuagugucuuacuacuuaauaaauguaugucuaaauaguaacauagaaaauaaggcuauagcuaagaaacuagcaguccucagggacaaaaaauaaauagcucaguaacaaaacuuauggccacugacccuacuacugugacuuagaaauuuuaccaaaaugcaauaauuauugucucauaaaacaauauuauuuuauagguugaguguaaccuuagagaucauguaaauucagccuuucaugauaucgaucacaaagcuaagguccagaaagguauaaauugugugugaauugugcauucuugaggggaagacagccauugcucuggugaccugacuuccugucccaacuccuaccagaauauauuuuuaucucgaugcauauauaucacugagaugcaguggagugagauuuaaaaauaaaauauggcaauauuauagcacauuugauucaaaaucauacuguaguucuaccagagaaggaaaaaaaaucagguaauaacauuuucaccaugugauucugagcgcuuauccaauuuauaaauuucccaagcuacauuagaaagaaucaaagugccuugguucuauguaccacagaugguauugccauugaguggugucauuuguucuuaguuuacagcaaauuuaaguuucauucugagguguuuuaggaagacuauuaauuucauccugucugauaagaacaaaagcaauugcaaaugauaauacaaagagaccuaugauuuccaugaaaugaaaguagagcuauuugacccccagcccccaccccaaaauuaaacguggaaagaugaugacaaauguuauaacaugaugaaaacacugggaaucauucuaaggaaaagaccaucacguaacaugaacagggcuaugcccaucuauucaauuaauaacgaucugcacaaaaggacagaaggcaguugaugaaacauaaaaccuuuccagugugugacuaaaguaucaguuucaguaucagauucucauuagccuaaucagaaaaaggaugaucaaacuucuauugacuguugcccacagugcauuuggaaugugcaacaucaaaugagaacuaaagccacaaauauaaauauauugccaucaauguccacagagaccaacaaaaaagggguagcuuaucuacuucggcagaauuucagcguagauaaaacuuaacuuguuuuggaacaagaggccugagaggucuacccacaaggagaggcauccuccuuuacuuuaaaguauccaaggacauuccuauuugguagaaacacauccagagacuccaagcucaaauccuccaggauaaucuuggccuuacacauggaugcccagaccugaguccugucuggaaggaaaguagcuuccccacuuucaauaaauguauaauaguguacuaacagcagagaagccagaagagugugcuugguccaaagggcaaugaaugaggucauggggacuguuuugauaauaaauucuuuggguaauugagaauaucucugguugacaucacuuguucucauagcaaacacugaguggcuauggguuacugaacuuucuuugguuuggggaguagaccaaggggcacggucaagaccuggauguuaaagcaucugguacuuuccauuaugaccaaaaucucagcuguacacuuugccuucuucaaggcacucuugguuuucaucagcgccaggcaagcaugguuuccuucaaauacaacagcaauaccucucucuacccuuccaacaucaaagauaucaauaacggucagacacaaaaagaauggauugagaaauuagcccaaggaaaaguuguauaguaaauaugacagaaguauaaaaaucaagggguaauuguuucaaaaugucaaaaugcccuucucaggagggaacacugugcauaaagacugcaugcagagcugggcacagcagcucaggucugaaauaccagcaauucagggggccaagguagaaggaucucuugaggccaaaaguacaagaccagucagagcaacauggugagauccugucucuacaaaaaaauagaaaaauugaccaggcauaguaguaugugccuauaguccuagcugcuugaggggcugaggugggaggauccauggagcccaggaguuugagcugcagugagcuaugaucacuccacugcaguccagccugggcaacagagccagacccugucuuaaauaaauacauaaauaacugugugcugagauauaagaauggaaauaaggcaaaaagaaucuggacaagaauagggggaaauagugauagauuugagaggugugugucacagcccaccuaacuaggggucagaugugaucacguuugugcuuggagcacaaaauuuguacaaaggcaaaacaaucaugauauucuuuucugucaucugcuuuaaaugcauuuuuauaaaaaaauauuaauuuuuuuugagauggaguuucucugucacccaggcuggaguucuguggugcaaucucggcucacugcaaccuccaccucccagauucaagcaauucuccugccucagccucccuaguagcugagauuacagaacgugccaccaugcccggcuaauuucuguauuuucaguagagacaggauuucaccauguuggccaggcuggucuugaacuccugaucucuggugaucugcccaccucggccuuucaaaacguugggauuacaggugugagccaccaugaucagccaaguaguuaauauguuuuuaauuuguuuuacguaggagaucauauuucaaagcuuaggaaaaaagcugaacaauacagaaaugacaacuucuggagaaaguuaccacuggcacaguuagaaauaaaaugcaccauuagaaaaauaagauuucaggccgggcguggugguucacaccuguaauucuaacacuuugggaggcugaggcaggcggguugccugagcucaggaguucaagaccagccugggcaacauggggaaaccccgucucuacuaaaauacaaaaaauuagccaggcgugguggcggaugccuauauuccgagcuacuuaggaggcugaggcaggagaauugcuugaaccagagagguggaacuugcagugaaccaagauuacaccacugcacuccagccugggcaaaagagcgagacucugucuccagaaaaaaaaauaaauaaauaaauaugacuucaaacaacucagagagaaggcugaccaauagaagaauuaaagagcuuuugaaauacaguuuaagaaugguuuugcugcaguucuaaaaaugaaauucugacuuuauucucacaaauaaucccaaagggagaaaagggaaaaggcaucuacaggaagcuuuggcuagcuagggaacuguuuuuauaugaucagacuuuaaaaguucauauccagaacaaagaagaacaaggugguagaaaauagaaugccuaaggugcaaaauaaacugaggcuggcaaauauauauauauauauguguguguguguguguguguguguguguguguguauuuguuagcuuacuuauuguauaauuauaaugcuuaaugaacuaauacauucuuauacaauuauauuuaauuuguucacauaauuuaugcguauguguguguauauauauauuuuagccauguuugaaugagauagauugagaguucacuguuugagacagaaguaaauuuuuuuucaucucagauuugaaaggcucuaaucugaggacaccaguaauucuuaagaauucucucccuuauauugggcaaaaucaaaauucaucauucaucaccccuccccgccgccuccugcuucuagcccaggaauugaucaauuuaaauaccagaagagauuucaucuacaucagaggucacgaaaccaauggcuccuggcaucuggcagguaauacggaaguaccccauacauuuauagaaauaaaauucagaagaauauggaugaccuggugugguggcucaugccuguaacccuagcauuguagaaggcugaggcaggaggaucacuugaggccaggaauuugagaccacccugggcaacauagugagaccucaucuguaaaaaguauauauauguguauauauaucuccacauauggguggaaaggccaggcauaaagcagcaauggauguuggcaguguagugaccuggauaacggaugcccuguuaaaagaaauuuacccacaaaaauuaaaauuuuguuuaauuugaaaaauuuaaaacuuagaaagauacuguguuggccaagcugaauauccucagacuucaccugugugucucugguuuucauucccugguuuagagggcuucugagguucagagagguuaggugacuugcccccaaaccuagaaccaauugauaauacuauguacaacgaagauaucaaauccuagaagcaaguaacuggcuuaccugacaacauaaccugauucaaaugcugagggcgccaaacuuguguuccauucaagugguuccacaaaaacaaauuuugccucuugaggauguuuauagauaaaacucuccacaaacacaauaauuucuuucaauaucgcuucauuuagaggggugauuucgaggauuccaguuccauguccggcagcaguccacugcgucaauuuccucagagccacacccaugggauccaccgugcucagaccugagcuuagcacacgcacuacaucagagcagaaagagaaagagacaacagcguccaccuuuuccuuggaacauuuuucauucucaagacuuuaaacuaguacuccccaucccacauucugcuuauuaaucuuggaagauucuuuuaacauuaucuaauugcucuucaguucaaugaaguaguaaaccagcacuagauaaaacugacuaguauuuaagaaauuuccgguauuugcccugaaauuaauaacuucuuucuaauuucccuagggccuaagagagaggauucaaacagauaggcauaaaacccaaauagaaaacuccaagaguggaaaaaaaaggaaguggaagagguuuauauuaagggcuuuuguucacagcucuguugggagccagcaguuucagggacaaacauuccuuucagccaggacacacauuguuuagaauuacacuauuaaacugaauacuguuaucccgacuuucuuacagugacaauaucugcaucaucacaaugaugacugaagaacaugauucugguagcucugguuuccccaagugcauucugaguuaaaaaagaaauagaauaagaacaguauugugaaauauaauuuuuuuucuaaaaauugauacaggacacauugauccuauuaccagaauaucuggacaauccaaauacuauuuucccugccuguauauccugcccagaugacauuuuacuguaauucacaaccuucuuaagaguuaaugugagagauguaggaauaagugagacucuuucagccuuuuuaucuaaauuaguuaucagaagagucuagcaguaaaauuuaaaaccaauucaagugagacaaauuucacauuggcuaaauagaaauuagucuguaaaagaagaucuuuuaaaaaguaacaaaaucuguaacguuaaauaagagccaaguuagaaagcacguucugacuucauaaugaacauuuaaugcuuuuuuggcagauaaucuauacuuguuucuuuucucuuuuguauagcacuuauugauaaaaucuuucuuccagaauauuagaagaaugguuauacgguuaaauauagaauaaaauuggcuuuuuacucccaucauuauuaaaaaggcuuaaaguacaaagauuagacuuggagauuuuacauucuguacuguauuaaaucuuugaacuaucuauuaaauucaaucacaggagaucacuggauggcaacagggcaguacuuccugcugauaaagaguauagaaauauuauagagaugucuaguuaucaacaugauaggaaagggggcauuaucggccuuuaguguugaggaccgacaauguaaaauauccugugcaggauaguaccucagaaggaagaauucugcuguaaccuccaggcaucuaguaagugaaaaacuucagauaagcacuaccugagccuagaauuuuucugcacuuugcaaaaauugcagaguauuuugucacaguuuuauuacacccugaauuuuccagaauuguagcuaccauaaacgaaaagaagguuguacauauuuuguuuuacauggaauuuuaccaagagcucagcauuuuggaaaaugacaccauugauggcaauguuauuugagaaauuuaaguugcaauggcacaucuguaucagucugcauuuggggcugcuguguucacagucauucuguguaaggcuggacaucugacuacuucccuauauauucuaguguagugguacuugagcguuuacaugccaaucuuuucuuacaauuauuuucuuucauuuuacaguuagcacacuaucaauauuuaaaacuauauuaaauauguaagauuauaaucuaugauauugauuucaggauagcaaagcagccuuacaacauauaugcuauaaaaaccaaguacuggaucagauaggguggagaacaacugauccagacauauauaccaaaguggucaugaaauaaagugcagaaauuagugcacaaauuuguucuggguguuuguuuuaguauucuagcauuuuguuucuauugcuaaccgaugagaaaugcuuuagauuuaaacacauaaacauguucugauguguaugugugagacucuugaauuucccauuguuguguaaaauaagugcaaaucaguguaaaauagugugaaauaagugcaaauagcuuuaucuuauacagaaaggcuuaggugaaaguucugucugucuuuaaucuuaaguauaacauuuguuuugguaaucuuauaaagauugcuucuugcacauuuuuaaagaaaaaaugcgaaauuaaauagauuauguaacgcuaugguagucaacauaccauauaguaacuucuugaaggacccuuaacacagaauuaagaaaugcaaaaucguuauuuucgucaagauaaauuuugacagaaauguaacauuugaaucuauucaaauuguauuuccaagucuagugaaccguagcaaugcacaaguuuuauucaagaagguuggugaguuuaagaaaaccucaggguggccuaugacaauccagaaggcaagaucaauguuauuagaaaauaaauaaauaaauaaaugguguucaaaaauggucggcauaacucaaaacuaagauuuuaaaaucaagaccaguugcuccccgguuucugcccauugccaagcucuuuuggcuuaagaaccauaguuaaaaugaauccauguaaauacacagcacacaccuuugaaguaaagaaaguaaguuuaaagauuaaaaggaaaaaaguuuugguuacguguuuacauaaacugggauguuuacauaaacugggaaucacuuagcacucauuuuucucuuuauccaauagauaccacagauuguuuuucuuucuaaaggucaauuucaagcuuccagcaucauuagugaaaugaaacccauucgguaaucacaucguuaacacuuaaacagaagcacaaccgaauucuuuagggggcuacggaaaggcagccaucagcucugagaucuaugaaaugugguugguaacauccacggggaguccgcgcauacacugcuuucugagaaugcagaaguuacucaguaagaccgacagaaaaucgaacuuuuagacaugacaugaacagggcccuaaguaaaaccaaagcuaagccuagugugggaugacggcccccaccagacucguuacaagaagggggcgucagagcugagacccuaaguuuccaggaauggauucgguaaggggacgaggagggaagggacggcgaaaaccacgcugggagcgggaggcagagcugcaaagggcggaggagaaagacgggcugggggaaggagaggcagggaagcggcgggagaaguggagagcggauccgggaggugauggggccgagguagugcagagaggggcgcagggacugaggagcagacgguccccaaccuagggccgaggcagggucucgcggggaggaaggagugagauggggcugggagagagaagggaagggggcgggucuugguccccgggagggaaaggggagcaggcgagagcggcagcggcggggccagagagccgccucuguuucccgauccacgcgggcggcugcagaaccccugcgggggugagcguggagacccccagccgcacucaccugcagcacccugccccccgcagucggcgcccgccuguugcuaggacgcgggucaacacugcgcgcccugcggccgcgcacgccggcgcccuugugggaggccuacagggcccgugcccucccccgggcgccgccgccgccgccuuccgcucccagccucacccggccgcgaccgcagcccaguccguuacccuggucucgggaccuccgcgcauccaagauucccgcggacccguugcaccguau

SEQ ID NO: 192732 - RNA, 235046 nt, Homo sapiens
aggccccgccgccgccgccgcugcugacccggcggccggccgccguuccgcccccucccguggcggcgagcgggcgggccuccccacacgcccccgccgcccgcgccccgcguccacccgcgccccgcucccggggacugggagaacaggauagcagcaggagucggggggccgccgaagauggggaacacuaccucgugcugcgugucguccagucccaagcuccggaggaaugcccacucccggcuggaguccuaccggccagacacggaccugagccgcgaggacacgggcugcaaccugcagcacaucagcgaccgggagaacauagacggugagugcggcccgccgagcccccuacccgcccccgcggcaacagucgcacagccaacgucggggcggcccggcugcucuugcuugcccagccggucucggcgacccgugcauaaccggggcuucgcccgcgcagccuaggcgcccggggccccgcagccucugggcguaccccucgcugguuacccccaagugagcggccgcggaaacuuugcaggcccgcggcaucgagcacggcgggccuagggcgggugugugcgcgugggucgcgaggugacaggagccggcccucguccuuaauggagcggccagagcugggugggggcggcccgggagcucgggguucccggcacuaccugaaugcagcccgaagccaaguugugcacgcguuuguccuauaaaagcgaagugaguggauucccauuuuggaaucccggugucuccaaccucgaguuggagaaccauguugagucaguuccccggaaccuuacaaauggacuccacuucccccguucccauucuaccguuuuuuuuaaaaaaugauuuuuuugaguggcgguuccaggauuagucaaauagcuucucccgagaaugcucuuuaaaagauugucagacaccuuuggguuaagucucaguuuuugcaugggcccgaauugcaguccuaugaauuucugauuuauucaggugacuuuugguuggucuggaguuugcaaaaagaaaaaaagcuaagacuaauuacugcacgcaguaauguuuuauuuauuuuauugguuuggcaacauauuuauuagcacuguugcucagugauaacgacagagggauauuuaugcaucaugcuuaaaauauaguuuauagaauuuucaacugaaaagauuugaaauuggaaguaucuuuuuaugacaaggugauuuuuuuaacccaaacaucuucucauaguuaaucugguugaacuaauaugaagaaauuuuugugugaaugaaugaacacaacuucauaauucguuccuguccacuuuaggauggaagauucucuccacuguggaaaggccacauuuaaacuuugcuaaaggaaagauuuuucucguuugucuucguguaauuucuucuaaaugguaguuuaaucuuuuuaggagagcaucuuuauuaaaugagugccauguauaaagggaguaacacaacgucugguuucuaguacgcgcuuaguaaauuaugguuccauaugacgugucuaguguuguuauuuuagauuuccauuauuuuaaacauacgcuuagaugucuuugaacuacagccauacuuucuucuuaaauuuaugcauuuaaaggcaucuagaaggaugaaggccagaucggucuugaucacuuucacagccucuagcaccugaaagaaaagucuagcauauaauaaacaguaaguauuguacuuuaaagggaggaauaaaugaaugaguuuauuacagaaagccauuacccaguccuauacuauguugacaggcgaaaacauuuggaaauaaugucuucuuuaugaugugcaguaaauuuccuuuuuauguugugcaguaucuagcggaggcuuuguuuugaaugauggaucaaaaaagaaaaaaaagaagauuuacauuucuuagagccaggcugcauacaguuauuauagacuauuguaaggaaauaagguggaaaaaauaaguguaaccagguauuuggcacuaaggcucaguacaauuuugccagaguacagugaaaugauauuguguguucuuucauuucaaagaaaucuuaaguuucagucaucaggaauuuuugagagaauguuuggaagacucuuuugcagauucaggauaguuugagagaguauagggcagguuuccaaucuaggcuguggagugcccucucaucccagaucccaguucauaugauuaugcuaguuuaaaccccgaaauauuaauucaccuucugucucucaaauucaauaaauaauacuucuagcauugacccagccagcaguucucaacauugguuucaguuaaaccagaaaucuaguacuggacauugccauuaauauguuuaaaucucuccaaggugauucugagaugcagguaggccugagaauugcuggcugggcaaaucuuggaaguguuaccugccguucagggacauuuuugguagaaauucauuauuagaggcugagagaagagaacagguuuuaauuaaauagaguguauauauauacacacuauauacaucuauaugucuguauuugcucaucuauaucuguauguauuugaacugaguuauauugauuguuagguuauuaguaaacauuuuaaaacuacauuuuaagaaucauugacucuaguauauaucaaaagcugaaguacucaaauaccauauuuuuuauguccugaaaaacaucccacccagcugguuuagaaagguuugaaguucaugggucuucuaugauagguuagugucuuuaaaucacagagauaugacauauguauccaugcuuucuucccuuugucaccaggcacaugaagggguaauacuuguccuguagaauuucaguaauuuuagugucugggaacuuaggugucuauggugcuuaauggcaacuuaaugugucuuuuugcucaguuuaucuuaguguuagguuauucauguuuuugaaauugauauuggacucaugcuuuccagguauuauuucuuauaaaaucauucagagauugagaaaaaacagcaacacauaacaacaauaguaaucuucagaacaauucuuuaggaaaauaaaaaaaugauaguaauaauugcagccuauguauuacuuacucuguagcagcugucaccagcugccgcucuaaguacuuggauuccauucauuuacuuagaacucacaguaacccuauggguaauauuacccuuacuuuaagacaaagaaaugagucacugagaggagaaaugacuuguccaaagucacacagccaauacauggcaaauggaaacuuuccauuguugcuugacuuagccaucaaacguuagcuagucugggguugccuucugggauagggugucuugucauugcagucauauccauacuuucucaaggauaaacuucuucugucugcagcaguuauucaguccagacuuccaggauuagauuauuucugugggaggagaaagggagggagggacuaaagagaauuuaaaaugugaggagaccaaauaaaucaggauacuuguaacagcuguaccauaguguccuuguaggguuuuaccuuaaaaugguugauggcaacuucauucuuuuuuuuuuuuuuuuuugagauggaguuuugcucugucacccaggcuggagugcaguggcauaaucuugguucacugcaaccuccaccucccggguucaagcaguucuccugccucagcgucccaaguagcugggauuacaggcaugcgccaccacgccuggcuaauuuuguauuuuuaguagagaugggguuucuccauauuuguuauacuggucucgaacuccugaccucaagugaucugcccgccucagucucccaaagugcugggauuacaggggugagccacugcuccuggcccacucuuuucauuuuuauaguuuaccugucauccuugacaacucacuuucucccucguccuguaucauaucugguaggaaaauguggcucucugcccucagaauauaucagacuuugaccacucucaagaccucugcugcugcucuucuggagauuuaagcagcugccaucucccccagcccaccuggucucccugcuuccacccuugccugcuccagucuguucucgacacaacagccauggcuaagauccuuuaaaaaacuugaacuuauuccuucacucaaaaacggcagugacucguuauugcacaaguaaaagccuuacaguggucgcuggggccccuugggaucugccugccaucagcucacucagucgcuugcucauuccagccacauuggccuccuuccuugcccuuccuggaacauaccagacacaaacuuccaccccguucucucccucugccugaaguguccuccaugugcucucuuggcugagucccuuuaucaccugcagccuugguucaagccugaccuuuucagggaggccuucccaaucaccuuuaaacauccuuucugccgcccacuggcaaucccaaugcauauucccugcacuccuguuucuuuauuccuuaacacuuuaugauauacuauauaaguauaaacauaaauacuagcuacuagcuacuagcauguaaguuccaauagaacauuuauuguuugguucacugauguaaccaagugccuagaguagcaccugauuccuugaagauacuauaaauauuuguugaaugaauuuguugagugaaaccaaccauugaaggaugugaaugaaaacaucaucgcguauguuuauugggugaggggaaacaggaggcaaggagaaugaagaggacuuguaauaaugaaaguagcguggaugugaaacuuuuuggcuuuguaguuuaaccugagagguagcagauagggugaaguacugaaaaugaaacuuaaagguuuuaaagcuuaaaaagaaaaaaagcauacccaggcugaaaggaaaccuggcuaaugggaaucuguuuaauaaugugguauguuuagucuuuuuuccuuguuucuuucaacgaaugacuuuagcuguggccuuacauccuuaaggaucaaauugagacucaaaugcucaauuaaccaaaaaauacuagaugaacaucugcaauuaugaacauagucacuuauguugauuuucuugucugaaacaugaagugucuaaugggauauagguacaugguguuuuggcugucuacagccagagaagcuagaagccucagggacucaucccaagcagcggagggauaacuggcaaaacugcuugccguuagaagaguggggacacagggcaauuugaaaucuaagugccuguaggaugagcuugcauauugcucuuggcuuccuugagucucuacaaucuauuuaacaucaccucugcagcacucuuucuugaaucuuggucccacauuaacauuaccagcccuggugggcagaacauaccguggacuuucuuuccaggcuaagacuuaucagcccugcugucugcaagguauguggagacaccccgaccaagcaugugacuucauauuaguuagcaguguggagaagugcaguuuaaagauuugucaagagagccauucuccauagcacugaccauggguccaugaccugucucugcuuacuuuucauguuucucuuucacuuagaaucagggagucguuugcuuccacacacccauuuuacaggugggaagacugaaucucagagagguguaguuucuugcccaggucaugcagaucauggaugaugguaguagaauuuacuuuguuaauuuucggccaacaaccgugcuaauuacuugaccuguauuguuuuucuuagucuucuuaucauucuccccauuuucuaggugaagaaauugagccuuaaagguuaaggcauuugcggaagguuccucaguuuguuaguggcagcugggguucggucugcugucagcuugccuccaugccucaacugcccugugacagcuaauuagagaaugauccgugucuagaaucugaaccuccugauggccuggcccagcccacuuuguuucaagagauucauaguuauugccuauaugcuuuugucuagcaauauuuuguguaaggacuuuuacuuuccugccugccuuuuuuuuuuuuuuuuuuuuaagacaggguuuuacucucucgcccuggcuggagugcaguggcgcgaucuuggcucacugcaaccucugccucccaggcucaaguaauucuccugccucagccucccgaguagcugagauuacaggugcacgccacuacugcccagcuaauuuuuguauuuuuaguagagaugggguuucaccauguuggccaggcugguccauaugauccacccaccuuggccucccaaaaugcugggauuacaggcaugagccacugcgcccagucuccugccugcuuuuugagaguaaugaaaauuaaauaauuccauggagugguagauuuucucaccuucucacccuccucuacaaagcugauggucuuuuuuuuuuuuuuuuuuuuuuuugaaacggaguuucgcucuuauugcccaggcuggagugcagugaugccaucucggcucacugcaaccuccgccuccuggguugaagcaauuccccugccucagccuccuaaguaacugggacuacaggcacgugccaccacguccggcuaauuuuuguacuuuuaguagagacgggguuuugccauguuggccaggccgaucucaaacuccugaccucaggugaucugccugccucugccucccaaaaugcugggauuauaggugugagccacagucuccggccugauggucuugcuuuuacauuucuggcuagaugaaacuaaugcaaggauuaaauuuauuucuauccagcaaggggcagaaccaaaaaauaccaagaagcaggauauguguguggcuuugaaauucuguuuuaaucacauagggucagagauuuagcuccaagugugucacauuggauugacuuugaggaaacagugcuauuuuucacaagagggcuauugacaguaucauacuugucacacuucaaagugugaauccuuucaugauucaacauugggcugugaggguagguccccagcaaugacaguugauguaagucccucauccuuucaguauuauuuccaguuuauagcuggaagaagggugagaguucacuuucccugcagcauuucucauccucuucagauguugaguaguuuguugcuuggagccuuggucaggagaccauuucuucucugauucucagcauuauucuagccugucuuuccugaagaaaggagaggcucaaggaagguaaagucagagaaggcucuucucaggggauuuauagggugugcucccagcucugugaaguaugguggagggcaaagagaggaagccuuguaaugggaagacccgcauuccagaugagguucuacuuuuacugaggggccuccguccugcugagccucaccuuccucuucugcuuaaaaaaagugcuuaaaaauacugccuugccuugggcugggcgccguggcucaugccuguaaucccagcacuuugggaggcugaggcaggcggaucaugaggucaggagaucaagaccauccuggcuaacauggugaaaacuggucuuuacuagaaauacaaaaaaaauuuuuuuuucaguugguauacuuuauuucuuuuuuacuuuuuaaauuauacuuuaaguuuuaggguacaugugcacaaugugcagguuuauuacauauguauacaugugccauguuggugugcugcacccauuaacucgucauuuaacauuagguauaucuccuaaugcuaucccuccccacuccccccacccgacaacaggccccggugugugauguuccccuuccuguguccauguguucucauuguucaauucccaccuaugagugagaacaugccguguuugguuuuuuguccgugcgauaguuugcugagaaugaugguuuccagcuucauccaugucccuacaaaggacaugaacucaucauuuuuuauggcugcauaguauucccugguguauacgugccacaucuucuuaaugcagucuaucauuguuggacauuuggguugguuccaagucuuugcuauugugaauagugccgcaauaaacaugcaugugcaugugucuuuauagcagcaugauuuauaauccuuuggguauauacccaguaaugggauggcugggcgaaaugguauuucuaguucuagaucccugaggaaucaccacacugacuuccacaaugguugaacuaguuuacguccuaccaacaguguaaaaauguuccuauuucuccacauccucuccagcaccuguuguuuccugacuuuuuaaugauugccauucuaacuggugugagaugguaucucauuaugguuuugauuugcauuuuaaaaaauuagcugggugugguggcgggugccuguggucccagcuacucaggaggcugaggcaggagaauggcgugaacccaggaggcggagcuugcagugaaccgagguagcgccacugcacucuagccugggugacagugagacuccaucucaaaaaaaaaaaaaaaaacugacucgccuuacacauugagguaguacuaugaggauccaaaugaggcuaaaaugcuuaaaaagccacaaaguacuagaugaacuuaugucauuaugaaugugguacucauauugauuuucuuguauuauaugugaagugugcuccaguaucuccaccuaauuauguuuggacuguccauaguuggagaagcuggaagccuaaagagcuuauccuaacaaagacaucaaagcaggcuucaaggcagucccagagcauaacuguaauuuuagagcuggguaggguaagguuauauagagcugucugaccuuugagugggaugcuugcuggcuguagaauuuggaauagaaauacuauuucucagauucauuacucuucugaguugcaucuuucugaagucagugugaugccacacaggagcagugggaugaauauuugaagaagcuuucccugacuccugggguaauggaacccacccaggcugucugcuaacuguguccccggaaccacauuccuaggaaugucagcaugcacccuuagguguaagcuggagccagggcuugcuugcuugcuuauuuauuuauucaaagaauaggauuuugaggcaugcauaaauaugcuuuauuauauuaaaauacugcuuuuuaauaaaggguaguugguuaccuaaaauaauaagaucaagcguuccucagcagguuauuaggggcuguuguucucauuucuuuuaggaaaggaaucuaacuggcuagacccacaauugcagggagcucaggagauaccccacccaccuuuucuuucuugcuguuggcucuguguguugcugguagcuguugcuaggcucucugucucccuuuacuuuuucuaggggcuuccuuugcuauuugccagcuuggaaagaagggugugcuaaagcuaaaauugagcaugucagccuggcaagucacauugguggaucccacacaucagcaagauuuugccuguaaagucucuugaugacucuggcagaagaggucauuucagggguuggccaacuccagacugccacuuuguugccuugccaggaagguugcuuuucaaauagauaaguggaaaaccuguaaaucuguuuuuuucaccuuugucagaagauggacauucuauacauuagguuuuacuguuuuuuugagauggguuuuguucuguugcccaggcuggagugcaguggcguuagcucacugcaaaccuccgccuccugggcuuaagugauccucccaccucagccuccugaguagcugggacuauagucgugugccaccaugcccagcuaauuuuuguauuuuuuguagagacaggguuacgccuuguugcccgggcuggucucgaacuccugggcucaagccaucugcccgccucggccuuccaaagugcugggauuauaggugugagccaccauggguugccccauuaguuuguaaagaaacuuuuuuguuauuguuuuguuuuguuuuguuuuuuaguaugguuuaaaaacugaucugagaggcaguuucauaaaagaaauuguaaaauguuuugggccaugguaacaacucugggcugagucuagucucccaugguuauacuacuugcauuaaaaaguacuucacugcagacacauuaucccuuauuggggauguguaguggggcuucagacacauugucccguacuggggauguauaguggggcuucacuggguaugguguauuugaguggcuugcucagcagagaugugugagcagcuuagacaugucagcuggcuccugguacugagagaaauacagcugggcacaguaaggagaauuguuagcaacuacaaucacauccgugccaguuugcuuugugagcuuugcagaaaucccaguuggguggugaaaugcaagucacuucuauuuuggaugccucugauuauagaccuucugacuguugaaggcugacuaggaaauacucugcaugggaguucuauguaauauagcuauauguuucaaaacugugagugcagugcuuacaacauuuuauaagcaaguucuuuauuuuggguggaugcuucuguucuugguggucaauaaggaaaaagagcaguuauuaaggauauuuuguuuauauuugguaagcuccuugucucacacugcagauuuaacaugaaucagaggaauuaguguauggguggguaggaugaguucuguuuuuugcuucucaagaaaagauuucacuccaaauuuagaauucugucuauuaaugauuauaugaucuuaggauuuuaauugacuuucaggauuuuauuggauacauuuauuccaguuagugcaaugauaauaauccuuuaaauuauuucugguucuuacaguagguuuguaaaauuuguguaguuguuuaaaaguccagguuuuacagcuccucgucuguguauccugucaaagucccggaggagaaagaagucauggugcuguguuuaauccaguuucaaaaauuucagacgcacauauuuaucaaggauuccuuucauuuacagugaguguuaacuuuugucaguuuagggauaaucuuauuuuuccacagccuuuuuucccucaagcugugaaccguuauugcaccauguagugcuuguugcucuuuugcuugcaaagugaugauaagcaguuuauauagcauuagagauuguguucuauauucugaaagccaaagcugauguuauugaagaguuacaaguuguuuauucacucuaauguuagcaaauauucgacucccacuuuucuguaagauaagucugaugucugauuugucauuucuccuauuuggugguagggagucuggaggaagccuagcaaccuugcuguucagaaaggaugaugccaggcauaaccacggagggguccaucugagggcugcuuugcgaaccacuggcuucugaggaagauuguugguuccguuagggcacauaucuuaagcaccgugugugcucugcaggcacacuuggcuguugguugaguucucuucugaagcaggaggauacgacuucgucacucacaguacgaagcugccugcagucucuggauguuggaaguguaagaugugagcagagaauaugagcaggagcccccguccagggugggaugagucagggaggaccccauugcaagauagcagggcucugaaagcccggcagggcccugagaggucagcagcaggcagccagaaguagguugggugcuuuuauucuuagcgauguuugggugccugugugcugugcccuggagaaugguucgggcuggacagcuagcauggcagugauucucagucagggauggucugaaucuggacacaauuuccuucuuucauggaacuaauauucugagagaaacaguuguugaaaucuaaguuggguuuuuuuuuuuugaaaaugaaccuuacucuuguauccaggauauuuuguaagggagcauuguaacaggaauccagugacccuugaacaacacuaacuugaacugugcggguacacuuccaugugaauuuuuuccaaccaaaccagguugaaaaugcaguguucucgggauguaaaauagagggccgccuuuuuguguaucagcggguuccacaggguggacggugggacuugagcgugcuuggguuuugguaucugcagggguccuggaaccaaucccccucggacacugagggauggcuguagagguaagagugaaggguaccucuggaaggagagcucagcaggugaguuagagaagggaugguguagaugugugagcagucugcuaggagacagccagcugccucauggacacagcagagccucuccuugcuacccacucucccacaaccucagacuacaucugugucuucacuuuggaaguggcauguugacagucaaggccucaaaugagugcauuucccugcccucuuugucuggcuuuaacaugguuugaaacaugauguuaaacuacaauauugaugccaaccagagaaggacagugugcaaguuggcgauacacuucuuaguguucuguucccuaagcucauuuucauaaauggguuucuuucuugauuagucauauucacauaugaauguguauuugcuaaaucucaauucuuggugugaaauucaaggacacuuuaaagcaggaauugauaaggaagcuauagcaggguuucucccucccagcacuguugacauuagggggggcugcccuauccauugcaggauguuuagcggccucccaccucuguccaccagaugccaugccagcugcagcaacagcacccuccauaacaacaacaaaaaaauguuuccagauguggccaaaugaaaucuccccugagagggcaacuccucuacucugccugaaaaucagugccuuacaggcucuaggauuccaggugaaagagaaauuuaguagagcaauuugcagugguucugcuuucuucguaucugucacuugcacacaucacggccucagggguugcagggguugcacagcuccagggcugccauuagcaucagauuuugaugggaaugagcccuaugucuccuccuccagcuuugcaaagggcugcguuguuccuuuugacuccuuagaacuaacauuagguucuaagaugguguuccuaaugguacuguugacaggaaagacauuggccaccguucugacaauggguggugggguagcuuucugugugcacuuggaaguuguguaauuucuuuaacucagauucauaauucacuuaauuuuuugcccuuauuccuuuugcuuuuuucuuccuuuuuuauugaaagaguaguaaauuuuucuucuuuuauccagcaguuuuguuucuuauucauuuuucacauuagcuacuucuguauguguguguuucauauuuuaugaguacucacaguggacuuuuuuuuugagagucuauucugaugaggaauauguaaauggaaugacaguuaagagucuguaaaguucuaauccgacuacauuuucugacaguguguagcuuuggcuugguucaggugcugaauugguuuuguaucuuuguggacuguuugaaaucucagcugcagcaugaugaccuggccccccgaggcagguggugaacugaacaggcauuugauucaggggucuggcauucaagggcauccuuaguggaaaacuuugaaggggagaaaaacccuugguuuguugcaucucuguugcacuguugaggaaaaauagugaugagaucauuuaaauuauuugaucucaagagucacuuccauuagucaggugcacugcugcuggauugaggaaauggcagcguggguuucuugaaauagagguuuagaaauucgagucuugauuuucagcuugccuaggugaaggaagcuccaaagaaugucgugacacaguauuccugacaaacauugucucuaaguauauuugaaccaaaaaugucaguuccuuagaaaguauguuuauaaauauacaaauggaagugauucuugaaauugaaggugccuuccaaaagucugagguuugaaaacauuuagucaacucuugcccuguccauauagcacacaacuuuuauuaggaaaguuaucauuauaagagaguagcuauucauuaaagaggugguuuucaacacugcuauuacagagcucaaaggggacugcccaggccauuaccacaggauuaaaaaggccccugcaugugauugucaggacuuaugucagugugugcacaaccaaucaggaagauuauuuggaguugugaaaaugaaccucuucuguuuauacgacacaucuggaagugacguggaagaugaacucuucaggucaauuuaggcaaagcugccaaaccuugauuacuuucucuguauucuuuugguauucugugguccuucaaagugacuuuaaguacuguuuuuagagugauucugaaguuuaaacaagcucaguauaugccuaauuuccugaaauaggaggucucucagggaagguccagccuaacccaaguuaaauacguucuuuaguucuaucagcuguuuuucagaugcaacuaaucuagaaaguuuguuugcacaaaauaaaaauauggcaaaauguguuuuauacuacuuacauagugggugcuuaguuugugggaaacagggauauauuucugaaacaaggacaauuaugcuuacagaauauuuuaagaauuuuuauuuuaaguauauaauaccauuggaacaagaugaacagcacugcuucuuaugagauacccuuacaggaccuuuuuugguaaaaggguaacuagcuaauuauuaggguaguguauauguagggagaguauuuauaauaagccugaaaucacauucucuuugcaaagaccagugcuccuccugaaugucuucagccuaauaaucuaaagagccauuuauuauacacuuuggugguuggauuuagccaucuuguggugggagcagucacugagcuccaaguuaaguuagccacauuguuuuguuugcuucugaguguguaagugaucuaccuaguuuucaaguauuuuaagacguuuggcauaugauauuuucgccuucaguucacuuauuuuauuccauugaaguguuaacgcugacggugggucacuguguggggugacaguggcugaaaaacugauugcaaagcuguauuuaaaauuuuuuucagaguucaagaguggugucaguucuucaguuugacauucuugcuauagauagagguuauguaaacacaaugcuaguacuccaaggaacuaaacaagcugagaaguuaguggaguuccuuuccuuucucguuaagcuaacauuuguagcaaguggcugcauccccuugaaguguuuguggaauguguucucuucauccacagagaagauguuggagagaaaacagaauuaacuaggcaaguaguuggcugagagaauuaccagugccuggggugacuaggcuuagagccacagccauuguaggugguccacaaauaugguagccugagcagagggccauuuucuagaaaugugagaauuugauguccccugugggaauucgagcuucaguucuucaguaggucaacaaccauuggucaguccaaguucugccguccagccucccugcuggaugcugggaauacaaaggucaacguuauuuggaccuugcgcuuaaggacauaaugaucuauuaggugagacagaugcaaauaagggauuacaauacgguguguaggggaagaagggacaccagaguccccuggauggcagaggauguggucaggguaaguuagcaaaugagcgcugccugauuagugaggggaaagaguggugaaggggguggggcagugaggcagaggccgguaaggccaaggcaggcacaggguaauuugcuucugaaagauccaggcuggacugggcauauguuccuuuuuucuuucuuucuuucuuuuuugagauagggucucacucuguaaccuggacuggagugcaguggugagaucauagcucacugcagccuugaccucccagucucaagcaguccuucugcuuuagccucccgaguagcugggaccacaagugugcaccaccaugccuggcuaaguuuuuaaauuauuuguacauacagggucuuggcauguugcuuaggcuggucuggaacuccugggcucaagugauccuccugccucagccucccaaagugcugggauuacagucaugagcuaccacacgugguggguauauguuccuuuugaagucaguagguaguuuaguugaacuuguucguagcuuaguccccaaagauuuaaugaauugugcucauuaagaggacguuuguuggaaaagagauuucacaaugauggauguguacuggaguuucauguauauuuuuauauacucuagauucuggagaaugaucacucaguuuuaguguggaagacagaauagacaucuuuagaacuguaaaaggaauaagcuauuuuuguugaguaugagaagaagauagccuucguagaaucacaggcuguucagagcaucaaggaccucauacuguaggagauccucauguuacagauaggacagcugagcugccaagaggagcugcuccucggcuccccaaagcugguucacagcaguucucagucugagagcaagucuucugauacuggggucagauccuuucacugcaacacacuguaccucuuuuaaaccaguucuuauagcaagguaaaaguuucucaagaagaaauugaccuaucuuaauguuuuucuuuuuuaaugugauguuagucuaaguaagaauuauguuuuagggaauuguauuaguugaaaagcuguacaagaaauuaccccaacauuuaguaacuuaaaauaacaacauuuguugucucucaguuuuugugagucaggacucccaguuuagcugagagccucuggcucagggugucuccugggauuacagcugagcucucagguggggcuguagucaacucauggcucaacuaggggaacugccuccaggcucacuuacguggccaaugcaggcaucaggugcucacuggcuguuggcuggauacaucaguuuccugccacacuggccucuccauagggcagcuggcuuccccuggaccaagugauccaagagagagcaggagagaccaagagagacccacaagauggaagccauacauagucuuuuuuuuuuuuuuuuuuugggaugacaucucacucugucgcucaggcuggaguguauuggcgggaucucagcucacugcaaccucugucuccuggguucaagagagucuccugccucagcuucuugaguagcugggauuacaggcgcccaccaccacgccuggcuaauuuuuguauuuuugguagagacgggguuucacaaauuggccaggcuggucucgaacuccugaccucaagugaucuguccgucuuggcgucccaaagugcugggauuacaggcaugagucaccgcaccuggcuggaagccauagucuuauaaccugagcuuagaagugacauuucgucacugcuauuugauagaaucaagucauuaaguugaggggacaguauuauauuaauacaagagugugaauaccaggagauacauuggggcccaucuuggaugcugcccacgacaaacauggauuaagauucuguucauuguguuuaacagaaguucacuaaaacugacuuccgcaaaacagacggggagugggagagagaauaacuaugggaucugaggauuuuucauggagacaaagggugaggagcauaacuaagucucaugaggaacuggacuuggaagguggacagucuguaggaacugaggcagcuuucuccuucaguaucuuaauaguaaauucuccuaucuuucuaagucagucuuauguuucaggugucucaaauuuauuuuucuuuuaaucuuuauucuuuauaaaauagcuauuuuucuuugucuacacaugguggaaaauggccaccccagugguucuaggaccauaaaagacuaaugggaagaauuucugugucccaggagagaggauugaguuuccuuugccccacuagugggauggcucccccuaugaaaguuguccagugagcagggucaagguuuagguuugggguacggacaugagugcaggagccuuacucuccuguguguugucagggauggauaaaggggaugaaguuggagggguuuagugaaugguugggacagcaaauuucagagaagagcauuuggaaauaauuuucucaaauauauauuuuuaaaauccauauuugauuuuuuucccucagggauucccaagcauaguagagcuaaaaugaauuaauuuggguaaaaguaaaguuaaggcuaaguuaggaaacacuuuuaaaaacaggaaccugcugcgugcgguggcuccugccuuguagucccagcacuuugggaggcagaggcggguggaucaccugagaucaggaguucaagaccagccuggccaacauugugaaaccccaucucuaccaaaaauaugaaaauuagcugggugugguagcgcaugccuguagucccagcuacucgggaggcugaggcagaagaaucgcuugaacccaguaggcagagguugcagugagccaauauugcgccauugcacuccagccugggcaacagagcaagauacugucuccaaaaaaaaaaaaaaaaaaaaaaaaaaaagaggaauguuaguggaaaagcaagguuuucuauauuaauuauuuaaaaaaugucucugagacuaguauuaaccuggaaaacuuacugauuaucguaaguacuauuucucucucucucuuuaguugccccuuauaaauuccagguuuaacaacuuuuuaaaauguucuuaugccaugaacaucugucagcuuuccuaucuuagauuguuuuuuuuuuuagcagcuuauguaacuugaaaugaaauuaccauuuuuuguucuaaaacugcccauuuaguguguugauaggguuuugcuuuuggcuucaguugauuucaauagaugacaaagaugcagaaaagguuuuuauuuucauuuuugcaugcuuguucacuuccauggcacuuuaaaaugaugcacacucuggcuuagcugcaagaaagcuuguauuacaaagauagaaaccaaaagccuuuucuggagguguuuuucuuuuugcuuuguagauaagucagaagaauccugugaaaccuaaagacagucuaccacuugcauaguuggguaguuuucauuuuuguucuuggaguuggaucugagcaguacagcaguagcagcaauuaaagcauguuaguguaugguaaacacuuaugcuuguacaucuuaagauguugcuuuguuggucaaaauccgauuuuaaaaguugagacuggugcagugguuuugggaauuaacacaugguaaacagcucuguucccagcccccaauucuccaugacuccgcguggggguagcugguguuguagcgcauguuugaggacguggauguggcaacgggaagcgugcuucacaugggguggguccacagagccuagcaugguuggcuggguggugcuucuucagaaaaaucugcgcccacuccuuaaccucuucauguuuuacucauacucugcuauuguggguuuagguuuggcaauaaugcugcuacuuacauugagaaccuaauagggaaaaaagacugggcuuuguaguugcaacgauugcugggaagaugcaacaaguuuuucuagcuucuuauuaugguuuacugugauccauucucuuaaaacuauucuuucuuauaauccucucucucucuccuuaacagaugaggaguugaucaugccacugcccugcucacaaucccugaguggcuucuguugugguuagaguaaauacauacuccuccccguggcucagagucauuggugucuguccccugccugccauguaaaccuccuuucucguugugacuccaugcacaagggccucccaguguuuuucaagcuuccaacuuugucugucucaggcucuguacagauguucuuccuucugcccugcaugcucuucccaaagcucaucaccuggcuggcuuuugggcaucccgcaucaccccgcaucaccuguucagguuuuuuccuaagaacauaauccagagagagcagccccugcuccugccccugccccugccccagccccagccccagccccagccccaucacgcucagucacuuuaccuuuaugagguaauguuuaccacagucugaaauuaucuuauuugccuguugcuuguguuucccccacucccagaauagaaacacaaugaggacagggacaugucuugcccacuacgaugccuccaucaccuaacacaguacuuagcauauaguaguucucaggaaauacucgaaugaauagaagugcugcauucauuuaacacauagcaaacauuuuuuuguauguguguuucuagaccuuggcauuuuuaaagagcacuggucaguuuguaaaauaucccucaauuugacuuugucuaguguuuccucuggauuagauucagauuauguauuuuugguagaagcagugccucgugucagaaggcacgugucuguuuaucccagcauuggggaugcuaacuuugaucacuuugugaagcugugucauauucuagguuucuucaguguacuguugcugcuuuuuccuuuguaauuaauaaguaauuuguggggagauuuagacuuuguaaauauucgauuucuuaucaaacuuucacucacaaguuuuaguauccauugacgguuuuuuagguccuucuguaucuauuagcaggcauucucuuguaaggaaaagcucucccuucucaucauuuauauauugaucaguaugggucauggauuguuauuucauugaguuuuaaucuauuauuuuuuuuuuguugcuuaaguuguccaaacuuugacuggugggagccucuucaaacugguuucuuuucaagcuguguucuuuugcuauguccuuaucauuccuucagugcuuccuuaauuucuggcaggacauuugcuuuuuagaaaucauuuuucucuugauuuggaaaaugcacuuuuuugcuuuuuuugccccccgcaagaaguauggaugucauacuucccuuuacagaacaccaccauaacaucuguacucauucaugauaccuacaaaugugaccuuaagcaagucuuuuuuuuuuuuuuuuuuaaacucaugauuuuucuugcuguuucugugaaaucuaagaggagcagcuugucugcuuguagcucagggacagaauagcauugugugaggugguccacauauuuauugaauacugccagugcauaaagcauucuaccuggagcuggagagaaucacacaagagaguagaagagaguuauguaucugcucucaaggauggcaggauucaguggagaaagaccagacuguacugcauauaggaacaaaugaaguugaaaagauuaauuuucacaacuaacagucuuccuuauccugcucauggguaaagauuaccauuuaauuuguagcaguagugagucggugccauuuaugaccacuucuugucaagcucacacuugagacaagucaagggccaaaaaggccugaccuguagauacaacaagccacuuguagauuuaggugguuaauuacuuauagagacagagaaaagaagaagaaggcaaagaugccagcuuccuguaguucuugucuagcauaccaagaagggugacacugaaacucacagcugaugaccgugagccacaggauuccggcuccugaggagcuagauccagauggcagcuaaguggguuuauguucuggacccuuauuugaggccaggugaagggaugcccagaaagccccaugcuucaccagaacccaggaggcaaugaggaccugucucccgucggcugccagggaaguagggaggugagugggcgcugacauagcaucccucucuuuuguguuccuggagggucauaagguguucuuccaagacagacaaagcaucugugcuucaggccuugccuacauggcuuauuagguaagugcggacugccagggauuuguggcagagcuguuccccuguacuucuuuggacuuguagugugacugaugucuccacauaacagauaaucacaucaccucucaguguuacuccccagcuguuuugccucccccuguccuguccccucugugggucgacagaugcuguugugugaaucaggcuguucuuggggccuguuuucugucugccuccucuuuauaucugacauguaaacauggcugucauugguuugagaauccugguucaggcucucccuguacauauuuggagccacuggacuguggcagauacugccucauuauuuguagauggcuguguuuuuuguuuauuuguuuaaaaaacaaauuugugguauaauauaacaucaaauuuaccauuuuaacucuuuauuuauuauuauuauuauuauuauuuuuuuuuguagaggcaggguuuugguaugcugcccaggcugaucuuaaacuucugagcugaagcgaucugcgcgccuuggccuuccaaagugcugggauuacaguugugauccaccacacccauuuuagccauuucuaaguguacagcucaguggcauuaggcacauucacauugcugugcaaccauuaccaccauccaucuccagaacuacuucuucccaaacugagacuccgugcuaaguuguuaaaaaaccccaaguccucauuuccucauccccccagauccuggugaccaccauucuuuuggugccuaaauuuggaccucauauaaguggauccauacaauauuugccuucuuggaacuggcuuauuucacuuaacguaauguccucaagguuuauccauguuguugcauguaugaaaauuuccuuccuuuuucaggcugaauaauguuuuauuguauggauauaucacauuuuguuuacccauucaucucuuguuggacaguugaguugcuucugccuuuuggugauugucgauaaugccgcuaggcacacgaguguugaaacauuuguuugaguucuugcuuucaauucuuuuggguauguacucagaaguggaauugcuggaaggacugaaaucuuaguuuuuggugaauuuguauuguuacuuaauguuaauagcuguaucaccauauuauaugggccuuaugaggccaaagggaugacuggaauuuuaaaauuaaauuucuuuuuuuuccuuucuuuucuuuucuuuuuuuuuuuuuuuugagauagagucucacucugucacccaagcuggaguguaguggugugacuauggcucacugcagccucaaucuccugggcuuaagcgauccuccugucucagacuccugaguaacugggaccacaggcaugcaccaccaugcccagcugauuuuuuuuuguagcuauggggucuugccgugcugcucagguuggucuugagcuccugggcuccagcaguccuucugccuuggccucccaaagugcugggauuacaggugugagucacugugcucugccuaaauuuuaucuuuuaaaaguaguauuuauuauuucccuccuugauuuuagaaaauuuaaaaaaguauauagaaaaaauuaccuguaauccuaccacacagagcaaugcuuguuuuuaaaauuuuacauuaguauuuuaauauuaauaugaacauuaauacucaucuguauaugauuauauacaauguauaacuuaaagaaaauuugauaauauauuaauaugucucugagucagacacauuaaucaagcuucuaugguggggauuuaccaaaaugcagauuguuuuguuuuguuuugagauggagucucacccugucgcccaggcuggagugcaacggcacgaucucagcucacugcagccucugccucccggguuuaaaugauucuccugccucagccucaugaguagcugagauuacagacgcccaccaccaugcccagcuaauuuuuguauuuuuaguagacgggguuucgucauguuggucaggcuggucucgaacuccuggccuugugauccccccgccucggccucccaaagugcugggauuacaggcaugagccacugcaccuggcccauaaugcagguauuuauucauccacuuauuuauuguuucauuuucucucagauauguuaucuguguuuacauauauaccuguggauguauauuucuuucauaauugggaccaugcuuuaaauaugacuuuauaauuuuuuugucuuauuauaaaaguguugccucuaaacaaucuucuaaaacaugauuauuaauuaccacagguaauacaagguacaucaauuccacaauuuauuuaaucaugacaguacuaauuauacuagcauuaauugagugcuuagauuuagauuuugguucuuuagguuuuuucuuuuaauuuuuuaaaaaacucauacauaauauuuuguuugccuguggggggcauuuccuuauuucuaaaagucaacuuuaugagacaaaggaaugaaacuuuugauacuuacugaguaggcaggaacugaauguuauuuuucaggugcaugugauuaacuuuuaauaugggucugagaaucggcauucugcucacugucuucacuaauucucuaagaaaauauuaagcaucuacugagaaccauauuacauuauguagauauuacaaagauauauaagacauggccucugauuuguggagcacuaaauuguaauugugaaaaugagaaguauggggcugagcaucccugaucugaaaaucugaaaucagaaaugcuccaaaaucugaaaccuuuuaaaaauguuugcccccucaacacacacacuucagcacccaaaaucugaaaccuuuugaaugccaacaugaugccacaaguggaaaauugcacaccugacacuuuugcuuucugaugguucacuguacacacauuuguuucaugcacaaaauaaaacuaauguauaaaauuacuuucagguuauguguauaaggugaaugugaaacagaaaugaauuuuauguuuaaacuggagccccauccccaaguuuaaacaaaucuuccaaaauccaaaaaaaauugaaauccaaaacacuucugguaccaagcauuuuggauaagggagacucagccuauauauacauuaucauuuaaggcagcaugugauacauacuauguuguacagaaguaggugcuaaaaucaaauaaaaaagagugugcaauaagaugugcaagguggaacaggugacuuuuggccugggugaucugggacaguuucauggagagagagauugaguacugggucuuuugguugggugguucuugcaaauagaacauuucuggcaguagggaaggcaguaggaaaguccuccaggugacaaaguacaggauguauuugggucuuggcaacugaauuuacuuaaagacagggaggauaguccagacgaggcuugggccacuugcagccuaagagguccaugucguguagggaccugaaugccaagcuagaggguaccaguuuuuuuuuuuaauucuccaauuuaaaacuuuuaauuaaaaaguaaacuuuaaugucaaaaaugcaaacuuuggagagggcagaaagaucacacacaaggcugucacuucacacuuggaggguugcacagcagccagaggcgcuccucacuucccagacggggcugcggccaggcagaggcgcucaucacaucccagagggugugggggccggccagaggcgcuccucacuccccagauaguuggcgggggggccaggcagaagcacuccucacuucccagacaguggggcagccaggcagagguacuccuugcuucccagauagggcggcagccggacagaggcgauccucacuucccagauggucgguggccguacagaggcgcuccucacuucccagacagggcggcggccgggcggagacgcuccucacuucccagguggugggccgccggcggccgggcggagacgcuccucacuucccagauggugggccgccgggcagaggcgcuccucacuucccagcuugugagguggccggcagaggcacuccucacuucccagacgguagggugaccaacagaggugguccucacuuccccgacggggcggcagcugggcagaggcgcuccucacuucccagacgguggaguggccggcagaggcgcuccucacuuccccgacagggcgguagcuggguagaggcacuccucacuucccagacgguuggggggccgggcagaggcgcuccucucuucccagacaguggggcggccgggcagaggugcuucucacuucccaggugguuggggggccgggcagaggugcuccucucuucccagacgguggggcugccgggcagaggugcuccucucuucccagacgguggggcggccugguagaggcggggauaccagauuuugggguaguaggcuuaccugaucaaagugacccuggaagauuaauaugcuggagaugugggaacuagaugggaaugggaaaagacugaaucagugagaucagcucuguugguucuguguagugggguuauuggauuggaaagggaguuguagaagcaagucugguguugucacuccgccccacgaccuccccgagacugacacugucagucagaggaaagcuuuuaaaaguuuucguauucccugccuaccuggcacugaguagguaugaaaucauuguugaaagagugagugaaccagcaauauaauuuugugccugaaggugcagagagagggaggauucagaguugacccugagucuuuggaggcaggguaacugaaugaacaugcuuuuaguguauggauauuggagaagagcggagaaagauuggcucugaggagggacaggguaauaauuuuggguuugaacagguuuauacagucuugcucaauguuaagggauauuuguguuuacaaacuuuauuuuaauauguuacuguugagaauauaauuuucuaauuccaguaauggaaaaagaucugaguguucugaucuccaaaguggugucaaagagaugauggaaggaucuggauuaauagucaacuuacuugaugagaauguguauuuacagcaguucuuggugguuugggauccuuagaucucauuucucacgugacuucuggucauuuagcccuuucacccguaauucaccauccgucuaaacaauggaaggagcaagcaggaguggaauucaaauauauagauuuaacaaaagcuucuuuuugguuauucuuaccuuuuucaagguagcauuggucuacauuaacaccaauaacagaaaguuaacugaauuuuacaugcuguuugucccaccugucauuagauacauugaaggacugacugcugaccaucagauguauguuuuuaaauuaguuuaaaauaauguuacguauuuaauuuaaaaauaguguuguggugggggcacauaugccaguaggaugcucuuugaguguguucauaaaaguauaaaauauuaagagaugacauacuuauuuauaaagaguuuugaagccuucugugaaagucagcuucaauagggaacauuaccugcauuaauauauuuauuaggcaguucauuucugugaauuguguuuuuauacuucauuuuuuccagcuacuccuuuaguguuuuuuucagaaguuugaguuauuuauggauuagccuaauagcucauucuuauaauuacugcaauuuuaaaaaccaucuauuacaaaccaaagucuucaccaaagcaaagccuguauaaaucugauugggaaaugguucuaagugagaauugagcccuucucuaaguguggaaauuuucuguugugcauuuuccuagugcugguuuaaguccaagcucaccauguauaugcuuuugaaaugaaccaauuagggcauguuuaacuaucaguaggcuuaaacaaauguauuuccucguguuggaauuuggacuuaggacuuuggaagguggaaaauuccaagugcaagugaaagauuucuauaacugggcuccauacuuaacagccaguccugucucaaacuuaaucugguaauguuuauugagcugguaacguuuauggaguuauacaugagauaggcuaucuuuucuguaggacauugguuaucuucacuggaggacuuuugaaauugaaagaaagcaagaguaacauaaauuugauacucagcuagagaagaagauguauuuauauuuaacuuguccucaugauauaaagacuugcuuugugucuuuaaaaaagugguugcuguuuuuacugcaguauuaauaucuuaaagccaauacauagauucauuucuucuuuguuuuccaaauucaaaaugaggagacauuuauuucuguguuuccuacuacuacuugaaaaaauguugaauauuaaaaaauugcagaagaauaaacagcaagagcuaaaguucucauuuauuuguauguuaccugcuccuggauuaccuaucgcaaauuaggauguuuuugguuaacuuugauggguuuugagauugucacuucuuuccauuuaaucuuuguaugcuuagaaacugccaguuuaguaugguauuaggugaaaagaaaaugguuagaaauauaaauaaaaucuuuaguggauaguauuguaccaauguuaauuuuuuaguuuagaaacuuauauuauggcuauaaaagguauuaaccuuagaggaagcuggguaaaggguauaugggaacugaacuauuuucacaguucuucuguuaucugaaaauuauuucaaaauaagcuaaaaaaugauuagacuaacucuacagcuacaaaguuauuaguguauauugcaaaaccagagacaagugauuugugugugucuagggaauggacagagauucucuucuauuuggaugguugaaauccuuguucauuuucauugaccugaaaaauugagaguuguugcuguaucucaugaggaugaagaugcuguuagaguauguuuaguaaaugcagacuucuuuuucuuuuucuguguuaugaauauaugcauaaauacacgacagauaccaauuugcaaacauacaugcagugugugcuucuaaaugaggugauuggcuuucuaaaaauaucacagaauuucauuuuagcuuguuacacauuuguuuccuugaugagaugguggcaaucauuugccuuuugagaauaaauuagauucuuuuauuuuggaaacaccagcaugugauuuggggcuucauguauaaauugagugaucagacuuucuaauucugaguugaaucuaaauuuaagaaaugaguuuuuuaaaagauaagugaacuggcucugaauuuauuuccaaagaauaguacagaucuuuuugugguuccugcaucauuggacuaagucuaauauuugcagauuucaacuuuaaaggauauuacuuguguucuugauuuauguuuauuauaaguuauuagugcuaucuguauuaacagagaugggagacuccaagguuuuucagcaguugcuuucccuaggcccaugcuguagcugaguguggacauucagcuggacauuugggcugcauuuccagucuucgcuaguucuaccccauuuuacccucuuggaacucacucuuuuuguucuacagcagcacuguuauuagagcuuucugugaugauggaaauguuauauaucugcacuguccaaugugguagucacuagccacguguggcagucaaacauuugaaacguagcuagugugacugaagaacugaauuuuaaaucuuacuuaauuuuaaagaauaaauuuagauagccacguguggcuagagucuucuguauuaggcagcacagauugagggcuaccauugcuaauuccuugaauggucuaccuggaaugccaauuuaaguguggaaggagggaauggacacagacauuuacaguauaacugaauugucuguuguucucauauaaaauucccuuuauaagcauuuugauugacuugguguggaaaugauguuaccaugcugauuccuugcuuuuggguugccuuuuuugagagguacucuuuggguaccacuuuaaaaccugcuuuuuuuacauaaauuuuuucaugucaguaaacacacuucugucucauuguuuuuaaugacuguagaguguucuauuuuauagacuacuuuaugacuuuauacuaccuuaugacuguauaguauucuauuuuauagacuguauaguauucuauuuuguaguguuccaccaugcacuagcugggagccuugggccuggugccuaucuuccuucucuguaaaaugggacaguaaaaaugucuaccuuguagaauuauuuuggguguaaaaugaaauaagauaaagugcuugguacaaaguaaaugugcucaauagauauuaguuauuauuaauaauauuguuagguaaaggucauuucuugugagauaacaugggucuacaucucauggauuuuauagaauaaaacagacacuuuaaaaguugggacagguuaaaccucucuggaaugcagaucugaaagcagcugacuucccaggguggcuuccgccauagaagucacuuugugagagcacaccuuccugcugcugccuggagcagugucuuugggagcuggguaggguugucagcgugcgcccaugucagugccucuuccccuuagagacuauugcaggucugcaguuaaacaaaaguaauuuuccuaaaccugaaaaaggcaugucugaauuacuggaugugaaauauuucguuuaacaaaacugacucucaugggaccucuaauuuugccuauacuccuaaugaggcacaagaaguagucacauacauacugccccucucccacaccucuuuaaaaacuuuggaguguaaaugcuggcuuaagguguuuggcucauacuuggaagucuguuagaaacgaguuaaaauucucugaagaaugacuuaggugcauaugcuaggaaacuuuugaaagauuggauagagucugcaauugauuacaauugaggcuguggagucuuucugccuggagguuguuagaacaacgagaacugcuuauuugggaaaucagcuuuguaguggaaaaacaccugcccagaaaucuggagaccuggcauaaugugugcuuagucuuuagcugcaugaccuucggugagucuuguucaguuuucugggcuucaaguuccauccucagcuuuaguauuaauuuauggacugugucgcaguguuuuucauuugcagaaacugcuuugcacuaaaauggaaugaucauaaucuuuuucuaauuugcagagggaaaaaagcauuuucagcugaacugguaggcuuuuauuaguuuuucuaauguaaaauuaaacuuuuuugccauucuuuaucugcuaccaagugcucauguuauuauucucauguaugugguacauggcgguugucauuuuauacucuguucagaugucacaggcacaccucugcuagugaaagcauucccagguuggacuguucgcauccacauuucgugguguuuuuggagugcucuccagagacacagugacuccuccugggggugucagcgccugggugacucccuccggcauugacugcucuauagcccggccccaggcgucagggcaggccgcuguggggugggcgguguggcauaggagugcccuuccaacuugggaauaagguagaagcuuucugauguggagaguccuaaaucagagauagauccucaaaggggcugcagaguuccuuuuccuuggcuuuucuuaaccggugcucggagguaccagaggaagugaggcugggaggguggggcugggccuagugagcagggucucuguacuuccacugcucacuucugagaucuuaucacuauuuggcuucagaaguuguucaguuucuccacuuuucugguguacaggaaggagcagcaguaaccugccuauuacucugaggaacuuccuggugauuuacaucguggagaucuguccugcuugcucuguggaaguaguccagggccaaacauucaaaaagcagucugaacugauaaauauucaggccgaaaugaccuugcaguagacuguggacagcauucauuaagagugugugaggugcuggugacugugccuguccugauuuccacuccugugugagcaucagcgggacaggaacagagcaggauggugaggcuugaggucccacuugugaccuuggaccguauuuccuccugccagaggcaucugccaaacuauuaagggcaugaacauuguuugguuucagugauggauucguuacuacauuugcaaagcuccacacgguuuagggaaguuguggccuuaggaaagacuuaaacagcuguuuuuguaaucccugagaacuuggauucuugcuuucagaagacacagaagaaauuccagucaacuuuuuauggguaagagucaugagaauauaaauuaagagaauacauucuuggcuuaauauauccuuuuugagaaaacuacucuauugaggcucuucccuauuuaaguuuaucuugccugagauuaucauaggauuuuuauuagugugcugagccggccacuuaagugagcugaagauacauacaaauuugcaauggaaaaguuucugagauuaagccuacuaauaugcugcuuaauguuucuuguucugcacauuaucucaauuugugugaauauuuuguaaauuggaccucauaaauuuuaauuucuaaucaauauuuuuauuagaggugaccaaauaccuuaauaaaguguauuugaaugaagacucguuuaacuccaaauuuuguaaaccacuuuuaagaacauuuaaaaaggugaccuguuuauucucugcauuagaauuaauuaccuggaugacuauuuaaauauucagggaucagaugggaggacaugcauuuuuuaguaagccuuaaaguuugagaaucacugcuuuaguucauacaggcuucacaguaaccccagaguuucauggugaggguaugagcuugagaguacccucaagcauauacauaugcauauacauguacaguaaauuguuuguuacacauauccauguuuuuuuuuuuuuuugagacggagucucacauuguugcccaggcuggagggccguggcacgaucucggcucacugcaagcuccgcuucccggguucacuccauucuccugccucagccucccgaguagcugggacuacaggugccugccaccacgcccggcuaauuuuuuguauuuuuaguagagacgggguuucaccguguuagccaggauggucuugaucuccugaccuugugauccgccugcuucggccucccagaguguugggauuacaggcgugagccaccgcgcccggccguuccucauccauauucuuuugguguuuauguauacuugcucugugccuggaaacaggcuaaguaugaagccuaaauugaacauugucauuauaaauuuagcuaacuauagaccuuggaugauaaugacuaggaaucuucucuggcucuguuuuuauugugugcaguuauuccagagacuggccagguagugugaagugccuuauauuucccuauuacaacacuuuucuuccuuugguuaacuaucugaucuuggauaaaacuauuuuauuuuauuuuuuuuugagauggagucucgcacuuucgcccaggcuggagugcaguggggccaucuuggcucacuacaagcuccgccuccuggguucaugccauucuccugccucagccucccgaguagcugagacuacaggcaccugccaccacgcccggcuaauuuuguguauuuuuaguagagacaggguuucaccauguuagccaggauggucucgaucuccugacccagugauccguccgccucggccucucaaagugcuaggauuagaggcgugagccacugcaccuggccagguuaaaacucuuaaaacuuguucauuauugauugucuguuagguuauuuuacuugcuguucuuugaaaugguuuuaagagggcuggauuucuuuucuugacuucuccacguagccuguaugucccuucaaagcagggacuauauggaucauguugguaguaccaccgcccagcccagugcugggauacagaagcaacgugauaccuguguaguggcugacggaugagaggugaccuggacauuguaucagcugauacuucuuuguuauuuaacuuggacucucaagagaccucuccuuccuuucuauuucaauuguggccacacuaguuccugccuugauuuacugagccuggauuaguugucuuccuugccuuuaucucuuugcuuuuagguccaucuuucacaauccuuccaggcuaguuguccauccacacuccuuugaacaagucacuuuccuucucagugaccuucacugaccuucccuuguaugugagguucuccaugaucucaccuccaccugccuuucuuaaugucucauacugaccuucccaaccaagucuggcuguuugugacaggugcuuucauccucccuacaguuuuaacgugaggccucagcuugggaggaggacuggggcacaguagagaugcuguaacuguucccauggcaugggaagcuggggcacaggguggaggcccugggccauguggcacuugugucugugaggcacggggagaagcgaaaaccaagaaggguggucagagcuagggcaggaaccgggagaagcagccacagaagucagaggaggaaagaacuucaagaugaagaggaugaucagcaauucugaguucuuaagcaaguccaugaagacugagcaaguuucauugcaugagugauugcaugagugauugauggcaguuugguguguuucugaaagauuucaaugggaacagaagcugaauuacugauguucaagguuauaaaggaugcagcaacaagggcagaccacuccugugugagacuggggugugaaaaggcagguacuguguuuuauauuuacauuuuccugcaacuggcagaugcauaugugcuuugaaggcucagaggaugaagcccagguuagagggagagauucaaaauaaugaaaggagucacucuggaggagggaaaggaugggggaacuccaggguucccauucacccugacagugaggaaggagaggaggggacagcaaggaggaguggcugcauucagguggcuucauuuuuuucugucgauugggagaggaauuuaaugcguuagcagugcgcaugggccagccugaauuguuucugcaaagauuacucuuccaaaagucagucuucuguggucuuaguccugugaauccuuagacgauucacucugagucccugggaucagccucgggccuuccagggugugcggaggucaugcaugaaguguggcucagccagcucuggccuuucucucacucuuggcccucucagacucucuauuccacuugucauucucugagcacucccuacauuguuuccugauuacgugccuuugcucacucuggcuuguacuuuugcugggcaucagcccuuccugccccaccuuccucuuuugugucuguucugugucaguuaacuguguaucccauuucauagagagcuacugcuuacaguuguuuauuuauuuugagacggaguuucacucuuguugcccaggcuagaguacaauggcgcgaucucagcucacugcaaccuccaccuccuggguucaagccauucuccugccucagccucccgagcagcuggcguuacaggcgccugccaccacaccuggcuaauuuuuguauuuuuuagagacagggcuucaccauguuggccaggcuggucucaaacuccugacuucagguuauccaccugccucagccucccaaagugcugggauuauaggcaugaggcaccaugccuggccaguugugguuauuuuuauucaugcucuuauuuccucugcuagauuguaaacugaaaggauuuuaaaauccagggauaauuuuaaauguaauaaaauguaguaagaaaacuuaaugaaguaucagaagacaagccugagucaggcagucuugaguuugaauccuggcccugcuucuuccuggugcgguuuugggugauugcauccugucucucuauucauuuaauuaauuuacagaguggggauaaugaaaccuacuucuuagggcuguuaggagaauaaaugagacaaagccuguaaagcauuugaccuaggcugacuccauuguaggugcuuaguagaccaugcugcagcugucagcaauggauuccuugccacccagcaguguuggguugagcaccuggauggauggugagugguggaggagugugcucaccucccaccccacuuauguugagggcaaggaugguguacuuuacuuuguauuucuaacaugggucuauauauauaguaaagaggaacggcauaccucuuauaacuggguccacuuauacauggauuuucuuaugccucugcuccccugcagacagcaaaaccaaccccucuucuuccucaucuuccuucaaccuguggaugccuaggaugaagaccuuuauaaugauccacuuucacuuaaugaauaguaaaucuauuuucccuuccuuaugauuuuucuuaauagcaguuucuuuucaguagcuuacuuuguuguaugaauauaguauauacauauacaaaauauguauuaauuguguuauagguaaggguugcagucaacaggaggcuauuaguuaaguuuuuggggagucaaaaguuacacacagauuuucaacuccaugaagggguuguuucuccuaaccccugaguuguucaaagaucagcuguauuaacuuguuuucucaagugccccauacaaauaacuuuuuucauguuaauugcauagaaggaaguaucauuuuguacaguuuuuugaaaauugggaacugguuggaaaugacacauaauaagguguucauaacauuuauagcaagaggugcagcuuacagcguuuucccaauuaaagccccuuugcauuguuuuugcccacagaacucuggacauauugaaugauuuauauuuuuggcccuuuccuuuguagaacaaauggugaggccuagaaguuuuagugcagcaguugugugaaguguacauauuauauaguuuagccagagauggaaugauaccaugggguuaauuuuuuuuauuaauuuuuaauacauuugacauuguuuccagguagccaauccuuccaguuucucaggaacacagaugucuccucauaggaaacaggaaaagaagcuuucucuaggagaacuugacaaaccaauauaaauguuucaucagagugcccuguugaucuccacggccagucacagggguuuuaucucucaucuugugauaaaugaguacauauuaauuuuuagugcuguaaaaugugucuuauuuguugcagagacuagggacaaacaacacuuucaaccaauauauuguauggagauguuuugcaguugcaggugggauaugguuuccucauugagcccguuaaaaguauuccauugaauggcgaugcaacuguggucuuugugaacuguuucuugguuugucagguguguccauguuuaugaauauaucucugaaucauuuuguauuuauagcauacuagagauucuaauauacgugucucugaaaaguagcuacauauguuaaagauagugggaaaaaaaggggauggaaaaugaacuaauuguccauggaagaaauuuuggauuguuaaaaugaggaugcagagaagacagaggcaaauugucaacacuugucacuaagugauacuaugcagcuucucggaugcuugucauuugauggaaaaaaggguucucagacuguaagaaaggaaguugacaaucucaagggaaaagaguguggccaggucagggccucuaucuuaugaaaugaguugggguaugagacuagggagggggugauucuuuaaaguacauuuuuuuuuuuaaagaaggacuuauacuguguuaauuuucuauugaugccauaacaaauuaccacagaguugguggcguaaacaacacacauuuauuauuguauagugcuguagguuggaggucugacacaggacucagugggcagaaaucaggcuuucaguaggcuguguuuccuguugugggcucuaggggagaaucuauuuucuugccuuuuccuugcuucuagaaguugcucacauuccuuggcuucaggcccuuccuccaucuuuaaagccagcagugguagauggaguucucacaucuucucucucuggcucuccugccucccuuuuuaggauccuugugauuauguuggguccaccuggaaaaucugggcucaucucucuaccuugaagccagcagauuagcagcuuuaauuccaucugcagccuuaauucccauuugcuauaugagguaauauauucacagguuauggggaaauguucuaaguauugagucaucuuguuugaauuuugugggguacugaaguucaggaaaacuguucucuccagaagucaccagaggcuugcuuucaguauagggaagucuuaguuuuugcugccucacagauguaauaaauauugcaaaccucacucacagagggucuacccuugggauucuggagcagcacaaaaccuacaaggaguugagagaaauugugucuauaggugaagcagguucuuagcaucaggaagggaaaggaggcgaaggcgugaugaccugacagguguguggaaggagcucagcagaagcaagagggagagaagacacacugaggugagaaguaaaaaagggugagaauagaguggugggcauuguggcuugagagccccaggcaccaguggaagacaccgaaaggaggacugcucauaccuggggugggcugggugcaguaaagucauucccuguaccgugccuuggaagcucugaggggucguggcucagguauucugucucuaagccugagcuccuguagcacaugaugaccucauacggaaggagacuuuuaucucagcaucccucaaccuggcacagcaguuauuaaacuuuuuggucacaggacaccauguauaguguuaaaaauuauugaaacucucauacauugcugguauaaaauggugcagccacugaggaaaacaguuugauaguucaucaaaaaguuaaacaugaaguuaccguaugacgcagcagugccacucuuagguguaugccgaagauaacugaaaacauguuuauacaaaauguauacacaaauguacacagcauuauuggugauaggcaaaaggugaagacaacucaaauguccaucaguggaugaauggauaaacaaaaugugguauauccauacaaugggauacagguugagcauuccuaaucugaaaauccaaaaucagaaaugcuccaaaaucuaaaacuuugagugccaacaugaugcucaaaggagacacucauuggagcauuucagauuuuggauuuuuguauuagggauggccagcugauaagcauauaaugcauauguucccaaauccgaaaaagccuuuaauccagaacauuucugguccuaagcauuucagaugagggaugcucagccuguauuauuuagccguuaaaaggagggaaguaaugauaccugauacaacaugggugaaccuuuaaaacauuaugguaggugaaagaagccagucauaaaaagccacauauauuacgauuucacguauaugaaauguccagaacagggaaaucuaauagagacaggaaguagguuaguaguugccagagauggggggagaagaggaugggagugacugcuaaaggguuugggguuucuuuuuagggugaugaaaauguuuuggaauuacauagcagugaugauuguacaacuuugugaauguacuaaaaaccacugaauuguacaguuaggcaccacauaaugauguuuuggucaaggauugacugcauaugcaaugguggucccauaagauuauaauggaacugaaaaauuccuaucgcugaguguugccguaaugucauaguauaauuacuuuuuaaaaaaauauauauuuaguguagccuaaguguacaguguuuauacaguugacaguaguguacaguaauguccucagccuucacauugacucagcacucacuugcugacugaccuagagcaacuuccaguccugcaagcuccaugcaugauugguacccuaugcagguguaccauuuuuaaucuuuuauaccauauguuuacuguaccuuuucuauauuuagauacacaaguacuuagcauuguguuacgauugcccauaauauucagggcauuaacauguuguacagauuuguagccuaugaacaaccggcuguccuauauaaccaagugugaaguaggcuaugacuaucuagguuuguguaaguacacucuaugacguuugcacagcaacaaaauuaccuaacaauacauuucucagaacauaucccugucauuaaggaagcaugacuguaccuauuuaaguggugaauuugauggcaugugaauuacaacucaauaauggaaauuguagagaagaauuuuuaugucuguagauaucauauuagaaauuaaaacuuguaauaaaaauauacuaauuuaaaaaauaacauuauaauguaaccauuauauguuaacauacauuuuuauuuuaaaaaaucuucaaaacaaaaaauuaaguaagaagaguagcauuaccuuacauuucuauuauaucuuuaaugucugguuaguaggaggcagcaagaacaucauaugugcuucugugucagucuuuugugcuauguugcuuugugaaaguaugugaagaaaauucagccuuacacagaugugauuggaaaagaaaggaguauuguuuuauggacuuuuaagauaacauggauauucuuugacacuaccucaaaaugugacaaaugguaauuuauuaaagguuaguugcacuguggaaucugaaaucauuuauguuaaaguuuauugaucugucuuauacuuuaaauggaccuuuuaccacaugcaagauuuugugucaucaugcuuugucauuugggaaaguauugguucacuaauuuaugcagaucuuccaaauauugacucauuucauuauucugucuaaaaucacauuugcuaauaucaucccugaccuccucagaagucuuaauuauugggaagcuuucaagcucauggugguagauacgaguuuuccagaauucugacuucugugugaugagagccugugucuuuuugguuggcuucagcgggugugaucuugacuguuuuacaauauaaaagaaaaaaggauuuuuugggagaauuugugagaauagagugcuggugcuaaguugucuauaugggugacuuccuagaagagguuaccggagcccucggugguugcuuuuuuggcuagggugggguguauguguguugagaaaaguuaggaggguuuuucuguuugagcacggagcuagaaggacaguagaagagcagagcugaguguugggcgagggagaugaagcccgggacgugcugggggaguuagaauaugugugagucaggauggcuugcagagugcuguuccacauccugccccguucgauccuuaccaugaucuuacuaguuaggcacagaggguguacuguuacacuucuuuaguaggugagggaaaugagacccagaaauggcaguggaauugucuagagucaucugguuaguuagggguggaauggguaccuguccugagccucugcuuccuaacuuaugcugguuuguuugcaacugcacuaggcuugcuuuauuggugagaagcugagacagagguuucucauggccagagucaagggagacauugguggaguugaugcaccaaugcauuuuuggaugaagguugaaaggaguaugcagggucuuuuacuuugggaaaugcuguugccacuguacagaggugggauggacccacacaaaguuugguucacgugucagccugaugagaccucacgauguaccaagagaguaagaaaaggugaauuauucacauaguaaagcuuuugggggagagcaggcaggcucucggguccaaaagugucuugagagagcagggaaaggagacuggcuuggcuuuuacaugauuagggguuggggcuggucgaaggcuuccuucccugccccccuggaccuggaugguuugaacuuccugcaagugccaaaggagggggccccaggcuuucuuaucagcuugcccagaugggggcagaaggggaagguggggagcgguggggccugaaaacagcagucagaugucagaaauggagccagacucuguauuacaggaaaugacaucuuuucucaagggaucuagcaaguagcaauuugauucuaaauucaagacuuagaaccagcgagggaagugauugagugagcuacuggcagaacuuguugacuuagcugaagucugcaugaucacagcucugcauauccuggaacuccacauuuccuccuggugacgaagugauguguuucagcugauuuagaauguuggccuauugagaacaaagcgaagcuugugggaaaagaagauaauguggugcaggaaggcccugaaugcagggauguugcuuucuuuuacugagaauucucucgugcuugccuuugccuuuauccacccccuaccccuucuuuccuuuuacccugagaguuguugggaggaaacuuagcugggccaacagaugauggagccgucuauuggaggcuuugaaaucccacuuuaccacacaaggaggagaaacauagcugucaucuccaggaauuuuaguacucaucagucccaggcugucauaugaagcauuccacucagcgcaguaaaaaaaugugaacuagucaacaguuuguaugggaggacuacuuuguguuucgaacguuuggacuuggaacacugucccagauauugguuagguuacacuuggaagauguuguuuuggaagcgaguaggacuugaacuccaacagauacuggguuaaggaggcugccagguaccagucuuagauccucgagggcuuggaucuggaagugcugcucccauuuugguuuguauuuuguaaugaaugcuuggagucagcucaggguccaaucauugaagcauuuaugugugaaacauugauuaugcagugauuacuugaggaggugacugguggucacagcuuauuucucuaaugucuuucccuuucucucccacuccugauuuccaccugggaauccuauccuuccaguguggaauguaucagagaguuuuaaagcccaaagagaccuuggaggugauuauuucucuuacguguuguauuuaaggaaccugauaauaacuaacuucaaacauuuauuucagaaaguuucaaaacuauacagaauuaaagauaauaguacgaugagucucuauauuucacccagauuuaguaauuuuaagauauugcccagguacaacuaucacauauagagcacuucacaugcuuuacuuuuaucaccucccaauagccuuuugggguuagauacaaauauauuuccucucuugaagaugagaaaacugacaggcccagagagauuaagaaccuugccuggggucucccaguccgcagccagccgccugugacuucacccucucugcugcacugccuggagaaguuuuaaaguuugccugacauacacggucagcugaggucaggcuagaaguggaaccaagagaucucacuccuucguuguuucuuuuauugugauuuucuguggcuuuucucuuuccuuuauucuuuugauucuuuugcaacugacuuucugggcuugaagcguccgaguaccauuuuaacucugauaggcagacagcggcaucccaaggcugggguggugggaguggucugcuccagugcuggugaugaggggugcauugucuguggaggauuuaauaacaguaauaaaagcauccagaagucugccuguaaagucuaaaugucuagaauuuugccugcaguucuaaacaaugucggugauauucuuucccccaaaaucuuuuguugguguucuaaauaauugcuuuauugaguuuuaauaauagauacguaagcuucaagugaguacuucuugaguacuuagccuuuaauagauacuguaggccgagcgccauggcucaugccuguaaucccagcacuuugggaggccgaggcggguggaucaccugaggucaggaauuugagaccagccgggccaacauggugaaaccccgucucuacuaaaaauacaaaaaauuaucuggaugugguggcacgugccuguaaucccagcuacuggagggggugggcugggacaggagaauugcuugaacccgggagguggagguugcggugagcugagauugugccauugcacuccagccugggugacagagugagacuccgucucaaaaaaaaaaaaaaaaagaaauacuguaugcaacauggagguuaaaucugacacuccuggugucagauuagcccuaaacacauggggauucagcugcuugcauucauuuccagaguaacuucuuaagacuuuagaauuguucagaaagcuugcuuaggacagucuuguguauuuaacucuguaguauuacguauaucuguuuuuaaacaguagauuugaaauaaaugauaguguuacugaugacuauaauugucacucuguuugaucacuuggaguuuuuguccaagaguccuuaaaaauuacaacagugaaacagaaugcaaaccaugagguguaauauuuuugcuugguaagugcaaaaauaauaucuguaaaauuaaaacuuaucacauuuaagacaguuguuuuaaaacuaaagaacaaaucaagaaaauaauaguuacugauuuuuacauaacuauuacugaaaauaauuuuuuucauacauggaggguguguuaaaaaauauuccuuccugggugucuaauguguuagauaugccguuguaggcgaaggcuuuuucugugauucguuuuuaagugaggagauugagaaucuuucauaugugcaacuggaaccguuaggauaggaagaaaguuacacagggcauuacuuguacugaaggauuacucugugucugaaauugcuggcacuugguacagcuuugucucacuuugauauuugucaagcuucaggccugucugcagugcugacagacugugugugcgacagaggcaagagcuccugccggcuccuuugcuuggagcaugcaaagggggcuugaugccuucucuugggagggggccguggcgccuuugcagugguaagaccucagccagaacccuggcuucuugacucucaucuccagcaucacuuagaacagugcuucuccauugauuuugcccccagggcacauuuggcaaggucuggagacauuuuaguuaucaccacuggaugggggcugcuauuggcaucuuguggguaaagacaugacuccugcuaacuguccugugguacacaggacagccccucuaccccuccaguaaagaauuaccgggcccaguuguccaguagugcugagcuugagacacugacuuagggcaaguuacuuaaacuugcauggccggcuucuucauuuccucaaaaugggaaaaauaacagcaguacuuuucucauaagguuguugugaaaacuaugggagacaguacauuuaagagcucaguaauuauaauuguuguuauuauuaugauuaacuuagugaaaauaaaauccaaaagguaaaaaacaaacaaacaaacugcugcugugauauacucaugaccaguagagagucaaccauacuacacucuguguacccuuaguacuacacagcugacccugaacaccuugggucugagccacauuaguccacuuauauguggauuguuuucaauugaacauggaucgaaaacgcaauauuucgggaugcaaaaccugcgugaccaagaacugccuuuuucuguaucuguggguucuacagcuccgauggggagacuugagcaugcacagauuuugguguuuguccaaauaccagucaccugcagaugaccuaggggugacuguaaauggauaacagugcuuagaauaaugacguugaaucaauauucagcguaugaaacuuaguaaaguaggaaauugaacuagaaacuuuuagaaacauuuucuuuucuuuuuuuuuuuuuaagaugguguuuugcucuguugcccaggcuggagugcaguggcacaaucucggcucacugcaaccuuugccucccagguucaagcaguucuccugccccagccucccgaguagcugggauuacaggcauccgccaccacgcucagcuaauuuuuguauuuucaguagagacagaguuucaccauauuggccaggcuggucucaaacuccugaccgcaggugaucugcccaccuuggccucccaaaguguugggauuacaggcaugagcccucgugccuggccugaaacauuuucaaaagaagaaaguauuucuggccaaauguuagcuuaucaauauuuucucaacuguucugauugugucaccucaugugccuguuaagcuaccugaccccucccuuaaaguuuuugauaaagggaucggggaaucuuguuuuaacauaauaguccuagaugauuuuuaagaucaagcuagauuggggacaguacuuuuagguagaaaaaagauuuaucaacuaagauugggaaaaaccuggcuuagaguaaagcagguuucuuuccugcacuacucuaagcacuuuauauggucaaugguaaauuguauuaugcauuguggggaaugagaguaagaauauauauauauauauauuaaguaacauuuccuaaacuuaacuaugaaauguucuguuaaacacauuuucugaugauguuucacagacagcacacugggaaacaauuacaacucccucaccauaaauucugauuaaaggaggguuuccuuccccuucauauuuuagcagaauagcuauauaaacccaaaaguauuugagacaggucgcaaucaguuuagaaguuuauuuugcuaagauuaaggacaaugacggggauuaaaaaaaacauggcaucacacaagcaguuuauagucugugcuuuucuccaaagaugauuuugagggcauuaguauucaaaggggaaaagcaggcugaaggggaaagaggguaggguauuacugaauccacauguugcaagagaaaaggagcagguaggggaauagucaguuacguauuccucuggaacucaguaaaucaacacuuuaccuagauaaggugaacauagaguagccgccuguggagauacuuaacguuuuaucaguagcuaucuacguaggaacaaaaggaaaggcagcaucuugcaugacuuagcuuucagcuuaauauuucuccuuuugacauauugaauuggagucccaaguuuuuguuuuccuuucacagcuacuuggcuuucgaguggcccugcaguggaggggcgggguggguacacaucacgacucacauagggugaguccaucugggucuauacacucauguguggagaugacuccaggccaguccugggcacauaguuugccuguccuucucccccagggacaaggugccccugggacccuuucaguuuagguuugugggaagagcuuuccucacaaauugcuuccgugggcuuccgagacagcaggccugccgucugagaauucuguuggcuccucaauugaugccuuggugggauuaucuaauuucugccaugguccauacccacauuugccucaggaaguuccugccugugcucaggugacugaugaguuccuuuugggcaccauuucagcuaaaggcagucaucucuaggaacucagauuaaugcacaaugucagaucuacagccuucguuccuaccauauggauugagcuuaucuguauuuuauagugaguguggcagaaagauaguagcagagauccagguacauaacagcuaucgauggauugagaauugauaguggcucauaaucugguuacuuguaucuuucauuauugugauuugauacuauuaaaucucaaguauagcaauaugugaauucaaauuaucauacucuuauuguuuauccuuuuuagcccuaauuugcagaaggugauuaacccagagcagggauaugcgaguggucucccucccucccucaccguuugccagcaauaaaggauuauuuguacaucauuuguauuuccaacuccugugguacuccuguacuaaaugggugauucagguaaaugaaguuaguucagugauugugaucccugugugaccacuuuaguuuuuauuuguguuuaaaauuaaaaacuaaacuugaggcauaauaucauuugguaccugcaaauuuuaauuaacacauggaaugcuuuguccacaguuuuccaaagugguuaugccacuguauacucccagaagcaaaggugagaauauuccaguugccccauauucuuaccaauaccugauauuucuuuaaaacacgugaaauugaguuucacuguaaucuuccuaauaauagauaagaacguuuuaaaacccaguugcccuuugcagugugcgucaucagaaccguccagucuuggggugccuuccauaaaugagaacuuugugaucuccucuuccacgaaugagauauuuaguuauuuuguugaggagugauaccagccuuuugcucagccucuugaaagagaaaaggucagcaucaucuuagggauuucauugagcacaaaaacagaauuuaccauaagcaugugugagcucugaaugucacuacauaucuguccuaaugcgucucauguuuuaagugucuugcuccuuugucuuucuguuuuuuuuuuccccagcaaucugauugaaaugggaaacagagggauaggaauagcgugcgcuuuuggaccucuggauauguaauucugcuagauuuagccaaaaauuugugucacguuccuauagaagagagcuacugaccuggggaugcuuaacuuggggccggcuuguugagaagucauacauuacauucugugaauuuaucuuuuuuaaaucuucguaucgugucagagucucuggaaccuuuuuuguccuuagcucccuuuaaccuuugugcuagagaaaaggcagguccagaauggaaagggauuucccgguaaagcauggcagcuuuucucauccugcaggucucucuuaagagagcuaugcauccugguucuuagaagauggcaggugaggaaggggccucugauauccaaaguuagacuugauuguucuuuaguagugacugagucuaagggaguauuuguuguuuggagcuuuaaaguuuauuguauauaagcaguaucccauuaugucaguuuccauuauaaaaauacuauacuuuauuauuggcuuuuacaauaugagaaugcagguuucccuaaacugaugacuuaaauggacucgggaguccacaugguggugacuugugugagcucaucuugcaguguacggccuuccaauauugaccgaguugaaggaaacuuggagguuuucugggaacuaaucuucaaaugaggcauuuacaguauauuguuacuuuuguaggauugauuauguguggaaaaugcauucuuagauaugucaagauuccuucauugauuuuuaauaaugaaggucuuuaguaaaaccuguuuuuuuguuuguuguuugguuuuuauggaggggugggggauggugcaauucucugaaagcguugggagugaaaagcuggcaguggcccaaaugcagugcugccuuugugcacguucacauucuucagugaacaccagcaggccuucagugauuuccugcuguugggccaaaacauagcuaguaccauuuuaugcucccccugagcugccaacauacuacacuacugagaggaauuccacuguccuuuuauucuagaggugaaucuauucugaacuuuuaugggagagaaaugagacugacuuaaaaaauacacaggaaaaaaucucccauuccucuuugauuaacuuaugaacaaaggaaaacaccaaaacuuaugauugauugcuuuaaaaaaguuacugccagugagauaguccuuuuccuccucaggaugcugaguuccuuccccauguagcuugcugagggguugcgggagcucccauaagaaugccuggugaugauggugguucugaggcuucaggguucugccccuucuggauagaaaugcagaggaggcugcucuacagcuggacaguagugagcucugggccgccaugagacugccugcuccauguuguauguggggcagaugugggagaaggauggugggaagaauggcuuccaaacugucgauugaucagauaaacaagggaggaugccaggggauaaugccaagaagagguggguaaagaaaggaaaggaauccacaaaagggaggaggggagugcaggugugcauguguucugaaaagugcucaugcacauacaguuugcuuauuauuuaaaaacuuacuguguggaguuuucuaaguguauuuuauaaagcaagauaaauguuuggguuuuguguaaauacauuuaguaguuaauguauagcauguagaauuaagcaucuucuuccugagugaacucacugccaagauccacguaagaauauuuaaagucacagaucuuugguggauucugaacacagcuguaggauuccauacugaagcacagcuuuccugaaaauagccaaauuagguauggcccuuccccucuggccuuaguucuucugccuuugugcacguucacuuacuugagaugacuuaguugagucaucucaaguaagugaacaaaugcugggccaguguccaggaggaagcagccccuuuguguguuuucauguuccuuuagcauuucagaauguggccugacagguaacuguggggcuauauuugacuccuggagagcaauucuagagaaggagaugcucuggccccaggccaggggugggcugucuucugcagccuuuccugguaucacauuuaaauguugugcuccauuuguauuuggagaguguauuuguagaguauauagguaggcuauauuuguagaguguuggcugacaaaggcugaaacaaaauagauugucugagagcagacaucucagaaggcccagaugaacacuuauauauguggcacagaaguacuagguggcacugcaguuucuguaugaauaguuaauggccuuguauuggcaaguaguuugucuuccacaucacagcucuguugacuggugagucuaugaaagauguucugggagcaggcuggaaacuuagugucacaugauggcuauauaccacucaacauuugcauuuuugcacccagcuuuagguuuaaugagcuuccucuccuuguuggguguggcugauggaaugaguauucucuuuugacauauaaauaauugcguuuucucuuuugacauauaaauaauugcauuuuccaacagaaaggcucuguguucauuuucugcugcugccacaacaaauugcuaugcacuuucuggcuuaaaacaauacaaaugcauuaucuuauacuucucuaguuuagaagucugaccuggguaucacuaggcuaaaaucaaagggcuggcagugcugagguccucuggaggcucucagggagaaucuguuuccuugccuuuuccagugucuagagguugccugcguuccuuggcucauggcccccuccuguuuccaaagucaguggccuaccaugucuggaguguacuucugucagcacaucccugucucuucugccuucuucuuccacuuuuaaggagauugcuuuaggcucacccagauaauaccaggaacaucuguuuuauagucaguggauuaacaacuuuaauuccaucugcaaccuuaauuccccuuugccauguaagauugcagguuccagggauuaggacgaggacaucuuuggggacguuauucugccuaggacaggcucucuuucuguguuuccuuagaacccucaucuauaucagauuauauuagaaguugucuguuuauauauauuuuauugcugcuacuacuacuacugcuacuacuacuguagucuacuacauuuuacagacuucucaaggucaggcacuguucguuucaucuuugaauccuggcauuaccacagccccugguguacauauauggugcuuaguaaguguuugcugagcuaaagggaacucuuucaacucccugauuuuacuuaugaacaaacuaagaaauagaaaacugugcuuuuuuuuuuuuuuuuuuugagacggagucuagcucuguugccaggcuggagugcagugguaugaucucggcuugcugcaaccucugccucccggguucaagcaguucuuuugccucagccucccaaguagcugggauuacaggcgccugccaccaugcccagcuaauuuuuguauuuuuaguagagauggguuuuacugugucggcaaggcuggucuugaaccccugaccuugugauccgcccaccuuggccucccaaggugcugggauuacaagcaugagccaucacacccggcugagaauugugacucuuaaaguagugagaacucaaaaacccuuuuauguugacuuccauaaaacugugaaaugccaaguucaauucuucaugcuuggaagaaaacuuggguaugcaauaagaauguguuauuguugccuucucucauaaaggcaucgucugauauuggucaugagcauagaacaaaaugaacaaagugaauuauuuccuaucuaucugaagacugcucucugcuaaacagaguaucacuuagucauaaaucagcucaguguuuaguaaauggaaaaugaggaagaucuccuaccaggcauucauuggcucgcuuuuaaggauuauacuuucaaaaugugagaacuaucagauuauguuuguacaaaauauggcauacaaauuaaauaagcacaguagcauaauuugaucuugcuuuaucccaugcacuuguggcugaauauagauaaauucuugucaauuaguuuugaccuugucuaaaugccuugcaaugauuaauuaguaggaagcaaaccuaggauggcaaaacaccccaaaauaguugcccaggaugccuggugugccagcagacgguauuuccaucccaggaucaggcugcugaggaaacccauguucuuuugcaagauuggcacacauucaggugguuuuaaaauagagcugcuuaucuguuguguuuauuuugguauuugaaauuuuuuauaucaaagcuagcccuaaagaaaacaacagauuuucuuaaguuuuuauuuaaauacuggcugcuuugaggaugugccuacagauuugguuuuggugugaaccaaugauugacaguugucaccugauaaaagggcucccuuaccucucccuuacuucagugccuuggaacuuucugggccuuagaguugcagucucauuucccucugcuucccagccuaugugcagggcagaccucuucuucccucaguaacccccagcucagcacacuugcugccaaagaugccuuuguacuuggcaauguggcauagggcggugauuuucaaacuguuguuuaguuugggaagucauggaacuccuguauuauuauuauuauuuuuaaugacauguaaaugcucaagauacauaacaugaauuaaaguggaauugcugagguugaagaugagugggaacccagggcccugcugaguuggggccugaggccaaguguccaggaaucccucugggaacacggaacccaguugaaauauucuuaaaguggaaagaguacagacuccaccacuuacuagauggaugagaugugugacuuugggcaaguuauuguuagaaaugaaaugcuuguuccccagugccgcaaagaaauagcacucaaacauaaauuuaauucucucagcaaggcaauuuuuacuuucugcagaaagggugcucauugcagauggaacaauggccagagcacaccuggacaggggaggggcagggguucuuauuccugaugcagguagccccuacugcuauguuguuccccuauuggcuaggguuggaccgcacaguuuaagccaauucugauuggcuauuuuaaagaggucauggguaugaggcagaguggcggggugaguaguuuggcgggaaggccaguuaagaacagguaacuaaaggugacuuaggucagagcaagugaccaagggugacucaggucaaagcagaugaccggaaugagucaggacagagcagaugaccaggggaacagaugugaacuacugauuaggacuggccggaagguuguuuacugaaccuagaagcaagugggcgaugagaaccaggaaguuaaacuuuaaaauggagaaucaaagaauaagagagcugaaccuacugacauacugauucuuugaagagaaacuugggguucaccauauuuaacauuacccuaguuuuuagucuucucaucuuuaacaugggaaugauaguaccugccuuacuggauggcggcaaggauagacaagcucaugcuuggaaggagccugggaucaagcagguucucagucagugguagacauaacugucacuuugugauucuucucccugccccuccucccucuuccuguuaucccccuccuacuccccgcucugcuaccguuccucuucuucccucuuccuuuuguuuuuaucuaccacccuucauggccuggcuggugcuggccucacuucucccaugacugucucauugccuguuccuagucacaggaaucgcagccuucuauaacauuuauuccuauaacauuuauuauuuguuccauuaaaauguuuucaaaaugacauuuuaugucauuauaaaaggaacauauguuuguaaaaggaauauauguuuauugcagaaaauuuagaagauauguaacuacaagaucuuucaagauaggaacucuuuuuauauuuuuuuccugcugcguauagugggaaucauccauuucauacuuaauauuccugauagauaaaaaacaauuauuaguuuugagucuguggaguuuuauuaacucauuugaaagaaauuuuuauuuuuauggcaaaggaggaaagaauguccuccaugaaguugagaacauaaagaccagaggaaggcacuguucuggguguugugaaggauguagagugacccaggccaggcuuccuguccuucaggagcucauaguucaaauaggacuaaaugcuauuaaaaaaauaaucuaguuacugguacagagagaaugucccguggacucauugaggaugaggagguccaguccugcugggguaucugagaaagcuucagaggcauuggaauuagaaccagaucuugaagggaguaaggauuuugacagauggccagauggcacugagaacauucuagugguggggaagugaagugugggauguguuuaggugaccccacugguugaaagcagaggagagggucagcuggggagcugggccuugaaugccaggccaguccucagagcuguacagucaccgcagaguugggaguggagaagugacaugaccaggugacaggacuggugggaagguuugagguggagcggccaggaggacuuuaguuguggccauuacagagccuagcccagaugacaaugaccaucuccuugaccagaugcuacucagucuccuucgaguccucuuuuugacuaggccuuuuucuuggguccugucuucaggcugcauagcucugcuaagucaguuuagcuacaaccucccacccuugagcucuccucccccggccuacguucagcaagaaucccccuccccuugcugucuccugugaguuauuuuccauccacugacccugcucccucugcgcauuggugcuaaguccccagcugcccuguguuuucugaguugagcuccgucuccuuccccuauuaggauagucuuagcaucugucacaguaguccugggaaagucuuccucaccauuuuaauaagcgucagaguaauuuuuucuuuuacacagaucuaguaaagagaugcuccuauaaguauaugaugaauugaauugacuugaggaaagaugaggcaaucaaauaacaguguuuucucaaaccuugcuguccgggcuuuuuguugucauuguccugagugguguccuguguuuuuuauugacucagaaaucguggccugguuacuauuugggaaggcaugucugugaaccagugcaaauugguggcguuuaguaccccugcauuuccuuuuuaaauucaccuuccgcuuucccuuccacccuguuguagggacaccugccuugcucacagguuguuccuggagacuuugcgugaaggcugguguugaccugaagcccuccugcagcucguuuugccucccuuguguuuuuccuuacaucuuuucccuucucuggcuuccauccauucucugugaagaggcagcucacuaggugagcuguggcuuuagagcuucuuugcauucaguagauuuccaggccauuuucuccaggcuuuuagugcauggcgaaggcaucauuggaugaguaucaucaggagggaaagggcagauggcuguguguggacuguuaaagcagugugugggcacgguggcacgcaccuguaguucuagccacuccagaggauugcuuggagccaggaguucgagaucagccuggcaacauagcgagacccugucucuaaaaaaacaaaaaaguuuacaaaucuaggcuuuuaaucuguauauaaaaaaagaaaugaaacaacagcaaaaaagaaugcaguuuguccagagacagggaugugacuggacagcaggagugaguugagccuuucuuugccaguguuugguucaguggacccguucuucacucuccagugcuccgugcaacuuauguuuccccuccuguaacgacugcugggaaacagcauucuccaagagacguggagcuguggcuagaaauggccuuguggcuaugguaaugcccaagucuuccucauagagaccauuuggcuguuuucugauuucuccacuccuaauuaaagcuuuaguuaauugccugcacuuugagaagccugguagagauaacuuauaaggauagguuaauggugaaaaugcugaaauacaagaacugcccaaacugccuugauucaauuaacaugugcauuuuucuuuaaaagaauuucgcgcugugaaaagccuaguaauugugauuuaaauuguuugauaaaagcguucauuugauugcagacuugaguaacucacauuuguuuaaaagacucaugauggggacaagggggguuagguugauuggcuuaagauccuaucugaaguugaaguguaugggucacacggccggcuucaaggcauuguuuggaccggucagaggugcaggguggcacuucauggcuuucacgcugaguugguucucagccaggcuggucuuuugguaugcugucgcauagacacuuguuaauauuuaaaguaucucugacaucuugugccuuuuaguucaagauuuuuguuuguuuuguuuuuagggcauguuuuucauuccuuacuuaaccucuguuuugaagggccuuggugaccacaccauauucuccuguuuaggugaccccaguggcugaaagcaggagaaaguguuucaucacgggcccucuccuucugaauacugugagucugugccuuggaaaauuaaaugggaguauuguaaaacucacugagggcuucucuuuggaaacuucacauccauucgccacauauucuucccacccucccccgccccacaauaggaauuaaaaauuuggaguugaagaagaaagcuagaaguauuaugaagcagccuuguuugcuuuaauaaaguaauaguucuaguuuauccucacuuuccuauguagugugcucccuuaaagaugacucagacaggugacucccucagucuucucccugcggucucacuaccugggguacuaacaguuaagaaguuuuuaccagaaagugauggguaauaguacuggcuuccucaggaaaagcuauguguuguuccauuguuagagaaaaaagccagagcuggguaguaguuaagguggugaaaacaguuuuacucaggaaaacuauugcaguaggggaggagagauuccaguauaaaaccaggcucaauggcaagugcagcaugggccacugggaauucagaaccaaggagcagugcgaaggucauuguauggaaauuacuagagguaaccucagggguuagggggauucuagcucaacugacccaacgaggauucuugcugaggauaagucaggagaaucagaugucaccugggggguugugggggacaguagaggacgaggaacacaucagauauugagggugaucagauguugaggaggggggcaauucagcuaaacugacuuagcagggcuuuugccaaagucaggagacgcaaagaaagauauggagggccaaagguggagguccauuuuggaagagccuucagagcaguccgacuaaaguuugguaagagagagacgcugucagcgccugguuguguguuacuuuuagguccugugcacugucuuuuuucaguugaaaggacaaacccucaccuucagcuguccugggugcaucucugaggcuggguuuagggcugggccucuccaguggcuccuggggaugggggcagcacucacccuuugcggagguuuuacagcauccccagcuggcccagugugcggguguuguggggugcauagggcccccgagagaggcuuugggucugucucagugugcauguuacuguguuaugcugugguggcucccucuuuuugccucugugaauggugggcuccagagggcugggauacugacuggcucuuucauccucucguccccagcauggcguuuugcacauagcaggugcuugauauguagugugugaagcaaugaagauuguuugugaaaauuggguucaguucuuuauacucauggugguaggaucgggggaucacaguguagaaacuaguugagagagccuggaguauggaaagcuauaauuauuuuaaaagcuuucucucaacaggucauuucauucucacaccuucccaaagcacucaccagacaggccgacuggaguuucaccuccccaucugugcucugcuccccacccuacagcugaguuguaagaggcaggugccgcaagaaggugggguggggggcagccagccugaguaucugcagguuggagaaugagcccuccuucuuggcccuccguaauugaauguuaugcugccucucugguacuguuaaugggccagggugccccgauguucucacugacucugaaaugaaccauuucucuguugcguguucucggcaucuggcaaggccaugguggggagagagcgcuccagccuugccccaagggcuggugaggagguccagacaguuucaccuaggccucagggacgcuucccaugagaaaagaggauuccugcugggccaggcacuccuacccugcagcgugggagcagucgcuggaggugcuugaguugcugggugcugugucccagugccccugcaguccucuucgugcucuccccgugaggcucccaaggcaggaucuggaggcgcagacuguucaggcagccuugucuggcuugcaggauuccucuaagcucuggguuuucuaggauuccaauuacaaaggguuauaaucccaucuccuguuggguaaggaaaauucaaaguacuggagagagaucaauuuuucugccuguuacaguucugggggcuggcucagagggagcagguucuuagcacugcucacguggcagcuccaggugccccuuggaccccacacuuuaccacauagcccuguucuuccuagggcuggggucccucugccacugcucuguggacuuuugugcaaaacacacgcauacaacaaacuuggagcuaguaggaaaccuuuguauucagaagaaaaguggaaacaaaacaaaaguguugaaguuguucugguagccggccuugugcaggcagcaguggugucucuagugguuccucccuucaaaccuacuuaccccaugucauuauauuuagcacaguaccuguaauccuuccacuaaguucccuaaccuuuauaauuauucagcagcaaauauuguaccuuugggauccuaaggagcuagcucuugcuuccuuccccccuuaucucugggagguagcuugucgcagacccuaccuuagagguacucaguuacuuuggagggcagaauuagucucugauggggauaccauuucccucuuuggcccuggauuggggaggaggaauucuaggagguaggggagagacacaacauuggcggugggagagaauaacacuucuucuaaggucaggucagccuuguaugcaggguaccaaaugaacccugucccugggaccaaagacugagaacuugggcuaggagcagcagugcuggcagugcuugaguuaugucugaaccaucccaggagauuccagaauuauggagcucuaucagaaauggccccagcugugugugggcugcugcaucucuccugccuggaugcauguguguccuuucccucugcuguccuuccaguuucucauuuugauccuuagguggauuaaagagaggaccuuaaauugccaguugcuaaccuugagugaggauucccagaggagugcuggugcaauauaggcaggacuucccccucuggugaugugcuugcuuccagggccgagggaaggggaggcacagugagaccagacucuguucucugagcagugcuggaggagaaacacccucauccauguggagugggcauggauggaggcagcagggaggguaguagcugggcuuccuggggcccguggaggcugagagcaaagccauaugaucaaggagcaugaccaggaagccagugggggucccgucugcugcaugagagccacccccuggagccuagggccccgacugugggcagagcuggcccuccauucucugcagugaguauggggacagaugugauugugauccucucagaggacugaugcauuuugccagagacauggaaguggcuuaaaagccagcaagguccuugguggacaugauauagauacagguuguguuccuuggaagugaccaacacguguccuuuugcauggcggagauucggaaaugcagccugugcuaauccucucagguccuuuuguuacgacuguggagccccaugauuuggucacuacuuggggucauuuaugugucuggcugguccaguuccuauguuuugacugcugggaccaacagcugugugugauuagggcauugccaaguucccggugguagaaaucguuuaccauaugguucucgagaugucauuguguaauucaaacuccuaaggcuguaaguuuugcuaacugcucuugguggggcucucccugcauuuuacaaaaugcucacuaguuuuugucuaaaaacaaaacaaaacaaaaaaccguaaagugaccaguuaaguaaauuugcagauaaaauacccuuacaaguuucuuccuuuaaaaucacugaaaauaugcucaauuuuuauuuaguuuaaccagaccacauuugugaggguaagauauucccaggcuauucugagaagggguuuagccugagaacugguggagccugggaagggauaaggccugccuugccugacagagcugccccugugaagaaucagacauacgccgugcuugcuuuccuggccuuucagcuugguaugucagucccuuauagcguaggcuuguagcagacucgcugcagaaaugcauuuuaaguuccaagcaaauguacaaaugaacuuugagaacccaacugacuugaaagcaugagcugauuggguuucucacaugguuucuucccacauuuuauaaaguuccugcuuuuuaaccaugugugcuugacgguaagacaacuaagggcacuuugaaagugaggguggcauuuuggauguuccuguugagcauggugaggucguagcucccugcugggccguggaggcuguggacugcaugucuggcugcuaacucuuggcuugacugcccaggaugcuuauccauguuugagguuacuucucggggacuggugucuugggugucuacuccacuuuucuggaagucuuuuuacuccaccacagaauuuggguacuagugugugaaguggugagaaggugacaugacuuacagaccagccugccugccagguggccgacacaggacacaacgcuguuuaauucaaggugugaagggaggcacaggcuauucugcuuccucaauugaaaaggagcaggaugggugugguguuucacgcuguuaaucccaacacuugggaggccaagguaggggguuugcuucaugccaggaguucaagaccagccugggcaacauaacgagagucugucucuacaaaaauaaacauaaaagauaagggguuaucucucuucugcaguagaucuuuuaugugcggaguacugauagggagauacauaacuggacucccccuuagcagaucccaguaauaugcucccuucagugccaugcgggggagaaaauucugacuguuauguagcaaacccugagaagacuucuuccuguagauuggagauguucuggcugaacacaggauugaccuccaaacugguguuuuuguuuuuggaauaagauacauggcuaguagagauaaaguucuguugacauggaaggcuagguauguucuccaguuuacauggggacucagaaaauauguggagcuggagucucagagaagggacaugcaaugggucccuucugacaccugccugcuucccaucgcagaucucccuugccugauuuuagcccuguggauagcuguucuguauauuuggauuuucuuccagcaccaucuauuugauguaggcaguuuuauagaagaauucuuuuggauuuuguaaaauacuaaaaacggcuucuagugguuugaugaaaggcauucuguuuagaaucucccuagcacagugcagggggcggcgggggugguggggugggguuguuuccccucuuggagaggaagcugcacagaucccucccuguuuucccccuccccucaccuugggaaugaauuccuggggcauuuagguuggucucuuugaauuagcugguucaaagagggagagaagaugcuucacgucguggaauggagccuuguaauugcugacuugauuggauuacccgaaguaaccuuuuaugcuuaguuaagaauaugcuuuguugagaaagcauauuucuguuuuaaaauauuaguaauuuuuuccgaccaaccucuucucuaaccucccaacuaaaagaauuaucaguagcuguuuccagaguuaucuacuguucguuagauaauuaggggcaggaauauuuauuaauggugcaauauguacuuaaacaguauuuuugauggggagaauucaaguacaugaaagcaagggcguguuuucuccucccccgggauuguaacuugacuucucucucucuuuucuagagucucuuaaagcauuuuggaauggaaugguugcuguuacaaguugagccauggugcaguugcuguggaaacucuagcaugacuucccagacuacuguguguuuuuuaauaguaggcacaccauggcauugaacuauuaucuuaaugcgcacuuuuuuuuugagagagaaauagaaggugguagagaagagaagagacuuucucaaauguacacuuuguggaauacuuuacugaaguaacugugcucugaagggugugcagcagcaccuaggguggaggcccagcaacuggccggccccggcccagguggcagcugaguuucagcucugucgagcaucagcaguuccuauuuuuuguagaauuuuauacugagcucugugugcuuagaauuguuggacucuaccugcccuugugauaguuccuucucagguuuaauaagaauagaauagggagcugagaggcagagaugagugcagaggacugcguagaggaccauuugcuuaccaggaaaggaagcugcaggugugcucuuuugugauagugcugucugucugucugguuaaaucagcauggcuggaggugauacugaaacccuggaaucugcaggaggaucacaaaacacuuugccguccaguucugauuaucugccaguuuccuucuuaaacagcuauaacaaaaauuuauuuugccaggagagagaucaauucuaaauuucccaaagaaauuuucuuuucuuuuuuuuuuuucuuaggagguacaagcaaaggcaucuuccuuucucccucugaauuuuuuuuuuuuuugcucaaaauuagcaguaguaauugucucaugugugcgugugaagagaccaccaaacaggcuuugugugagcaacaaggcuguuuguuucaccugggugcaggcgggcugagucagcaaaguguggugggauuaucauuaguucuuauagguuuugggauagacgauggaguuaagagcaauguuuugggggcaggggguggaucucacagaguacauucucaagggcggggagaauuaccaagaaccuucuuaaggguuggggagauuacaaaguacauugaucaguagggcagaaacaaaucacagugguagaauaucaucaguuaaggcuauuuucacuucuuuuguggaucuucaguugcuucaggccaucuggauguauaugugcaggucacugggaauaugauggcuuagcuugggcuuagaggccugacguuccugucuucuuauauuaauaagaaaaauaaaauagugguaaagcguugggguggcaaaaauuuuugggggugguauggagagauaaugggcgauguuucucagggcugcuucaagugggauuagggacagcaugggaaccuagagugggagagauuaaacugaagaaagauuuugggguaaggggugauauugugggguuguuagaaggaacauuuguuguauagaaugauuggugauggccuggaugcaguuuuuuaugaauugaaaaacuaaacggaagacacaagguccgaauaaaagaaggagaaaacuagguauuaaaggacuaagaauugggaguacccaggauguccaauuagaaaguguccaaagggguucaguguuauuguuugcuugguuggcgaguuuuugggcucuauccuugaguuuuucuauguugucauauaccaggccagauugauuuagguaaaaacaacagucuucauuuaaaaauauagagaguccucuuuuuuuagcagugaguaaguugaggucuccgugauuuuggaggaaagagaaaugcaaagccagcaauuguuuguuaaagaaggauuagaaacgucuaggagacagugaauuugauagugugguagagauagcuggggagagguagaggguggcauaagaacaggaaugagaauaagaguaaauauaaaaguaaagaauaggacuucaucagggugaaaguauuggaggauaccuugucacugaagaucuucuguccacuucaagagagacuuaaggguggcaauuugagguaaaaccaggagccacuaaauaccaagagccugagaaacugcuuggguaauaugacuaguaaaggcccguccguuaaugggacuguauagaggugggaaggcuaaacugaagaauuaugucugacagaagggaagaaaugacugugguggccuucucagacccugugggaaaggucucuacccaucuagugaaagugucuacccugaccaagugguauuuugguuuccugacuccgggcauguggguaaagucaauuugccaguccugggcgggggaaaaucccugagcuugauguguagggaaggguggggugggggggguuggccugaacaaucccugagggguaguggaauagcacauggaacacagagaagugauuuccuugaggauagauuuccacgacggaaaggaaaugagagguucuaagagacgggcuaguggcuuguaaccuacauggaagagguuaugaaaugacgacagaaaagaaugggcuugugaggcuggaaggagauauuuuccuuggucuaagaaccauuugccuugugugggaagagauugauagauggaaguuucagcagggcaguagguggaagugaucgaugagaaggagaaaaacuggccgugagggacagaaguuggaauucugccugcuucuuuagcuaccuuaccagcauaagcguugcccugagccaugggaucugauguccuuuggugguccuugcaguguaugacuccagcuuccuuuggaaguaaagcggccuugagaagaguuuuuauuaaagaggauuaaugauggaggacccuugcauagugaggaaaccucuuucagcccauauaacagcauggugaugcaggauauggaaggcauauuuggagucaauauaaauauugacacguggucucuuugcaagagugagggcuugaauuaaggcaaugaguucggcuugcugagagauaguggagggaggcagagcgguagccucaaugauagaugugggagauacuauagcauagccugccuuugcuggugaguggugauuaggccugguggaacugccaucaguaaaccaaaugugaucagggugaggaacaggaaagaaggaaauauggggaaauggagugaaugucagguggaucagagacauacagucaugggggucaggugugguauccggaauaaugugggaggccggauugaaguccaggccaggaacaaugguaagugugggagacucaacaaagagugaguacagcugaaggagccagggagcagaaaguaugugugucagaugugaggaagaaaauagauuuuggaaguuaugagaacuguagagagugagaugagcauaguuugugauuuugagggccucuaaaaguauuagggcggcagcagccacugcacacagacaugagggcuaggcuaaaacaguaaggccaaguuguuuggacagaaaggcuacagggcgugguccugguucuuguguaagaauucugaccacacagcccugcacuuuggcuguguguaaugaaaaggguugggaugaguuagggagagcuagugugggggcagcuucuagggcuguuuuuaaggaacagaaagaggaguggugaaaggauuuaggaucuauggagucaucuagguuugguuuugugaguuuauauaaugguuuuguuaggauggccgucaauacccacaacaguuauggaggcaagggaaacaggcccuugaaaauaagguaauguggagugaguagucuccuuauugauuaagaaggggacggauuuaccuuccacuguaagaguuacccaaagcuuggcauccgugaugguccagggggcuuccgaggcuaucuaaaggugaaaguauccaaacaugcccaggaaggaaaggaguuguuguuuuguggaagggguugggguuugggagauuaguuggacacaaucagcagggagaacacguauguuuuaaugaagaaauaugucaagauagguaauggaugaggaagaaauuugggcuugacugaaguaguaggggcuguccacgaagccuugcagcaguacagcccagguaauuugcugagccugauggguaucagggucaguccaagugaaagcgaagagaggcugguaugaagggugcaaaggaauaguaaagaaagcauguuugagauccagaacagaauaaugaguuauggagggguuguggagggagguauugaggauaggagaguauaugacuuuggcaccacuggguggauaggcaagacaauuuaguugauaaggugcagauccugaacuaaccuguaaaagccuugucugguuuuuggacagguaaaacaggggaauuguaaggagaguuuacaggcuuuaaaaggccaugcuguaacaggcaagugacaacagguuuuaauccuuuuaaagcaugcugugggaugggauauuggcauugagcaggauaagggugauuagguuuuaaugggaugguaaagggugcaucauuuguugucaaggagggaguagagguguccuaugcuuguggacuaagaaggggagauacaaggagaggaugugaaggaggcuuugaacuggggcaaaagguggcagugagguacagcuguagcccaggaauaaucagggaagcagauaauguaguuaaaagucucgaccuaauaagggagccgggcagguggggauaacuaaaaaggagugcauaaaagaauauuguccaaguuggcaccagaauuggggaguuuuaagggguuuagaagccuggccgucaauacccacaacaguuauggaggcaagggaaacaggcccuugaaaauaagguaauguggagugaguagccuccauaaugauuaagaaggggacggauuuacccuccacuguaagaguuacccgaagcuuggccuccaucaugguccagggggcuuccgaggcuauugggcagugucagucuucagccacuaagccgagaagaucugggaaggagucaaucagagccuugggccaguuggacaguccaguuuccagugggguccugcacagaugggacacgguuuaggaggaaucccgggcugcgggcauuccuuggcccaguggccagauuuccggcacuugaagcaagauccugggggaggaaguucuagaggaaccccuggcaacugugguucaggcguuuggaguucuugugugcuggagauguggcugggguuugucucacaguggaggcaaggaauugcaccucagaaauacauugcuacuuggcugccauuacucuauuacuguacaccuugaaagcgagguuaauuaaguccuguugugggguuugagggccagagucuaauuuuuggagcuuuuucuuuuuuuuuuucuuuuuuauuuuauuuauuuauuuauuuauuuauuuauuuauuuauuuauuuuuuuauugaucauucuuggguguuucuuguagagggggauuuggcagggucacaggacaauaguggagggaaggucagcagacaaacaagugaacaaaggucucugguuuuccuaggcagaggacccuguggccuuccgcaguguuugugucccugggcacuugagacuagggaguggugaugacucucaacgagcaugcugccuucaagcgucuguuuaacaaagcacaucuugcaccgcccuuaauccauuuaacccugaguggacacagcacauguuucagagagcacaggguuggggguaaggucacagaucaacaggaucccaaggcagaagaacuuuucuuaguacagaacaaaaugaaaagucucccaugucuaccucuuucuacacagacacggcaaccauccgauuucucagucuuuuccccaccuuuccccccuuucuauuccacaaaacugccacugucaucauggccuguucucaaugagcuguugggcgcaccucccagacggggugguggccgggcagaggggcuccucacuucccaguaggggcggccaggcagaggcgccccucaccucccggauggggcggcuggccgggcggggggcugacccccccccaccuccguccccgucggggcggccggccaggcagaggggcuuuuuggagcuuuuucuaaugucgggagcggauuggguaauaaaaugcauauugaaaauaaggcagccuucuggccccucugggucuagggugguaaagcgucuaaggguuguugucaaacaggccuugaauuggguugaguuuuuguauuugaugaaaaagaaccuaaaugcuaacugauuugggagaggucagauaaagaaaaaaggagcauuaaccuugauuaugccuuuagcuccagccaccucuuuaagaggaaauuguugggcaggucggggagggcuagucauggaacgaaacuguaaaccagacuggguguggggaagggaggugauagaaggauuauaggguggggaagcagaggcugaggaagaauugggaccuggcuuggccuggcaaggagcagccuggggaggaggggagagaggucagaugggucccuagaaaaggaagauucaaaagacucagagacgcuugggguuaggacugaaggaacagacaggagagaaagaagaaagauuugggacgacucucauugggagcagagacuagggagggaccaguguguaaaagaaugccuggacaucaggcaccucagaccguuugcccauuuuacgacaagaauuauuuagaucuuguaggauggaaaaaucgaaagugccguuuucuggcuauuuggaaccacugucgaguuuguauuggggucaagcggcauugcagaagaaaauaagacgcuuagauuuuaggucaggugagaguugaagagguuuuaaguucuugagaacacaggcuaagggagaagaaggaggaguggaggguggaagguugcccauagugaaggaggcaaguuuaaagagaaggguagagacacggagaagggggguggggagcagccaaagcaggcgucuccgcacuugacuugccaccaagggaauguggaugaaugaccaaggcagacguccccacggagaucagacaccaguggaacgugggugaauaaucagagaggcguccucgcaaugauuaaacaccaagggaagucugccuucccgaguccgugacuggcgcuggaguuuugggucaauggauaaaauaugucuccuuugucuccaccagaaaaugaaaggaguugaaauuaagagaagggagagauugaaggguggcgccaagauuaaaaggagaaagagguugagggauagugagagagguuggagaagagaguaaaaagaggcugcuuaccugaucuaaaauuggggagauguuccuugggcugguuagucugaggaccugaggucauagguggaucucuucacggagugagggugaggacaggggacuggucucccgaaggagucccgcugaccugggucuucggcaccaaaugucucacaugugcaugugaagagaccacaaaacaggcuuugugugagcaacaaggcuguuuauuucaccugggugccggcaggcugagucagaaaagagagucagcaaaggguggugggauuaucauuaguucuuacagguuuugggauaggcaguggaguuaagagcaauguuuugggggcaggggguggaucucgcacauucucaagggcggggagaauuacaaagaaccuucuuaagggugggggagauuaugaagaaccuucuuaagggugggggagauuacaaaguauauugaucaguuaggguagggcagaaacaaaucacaaugguagaauaucaucaguuaaggcucuuuucacuucuuuuguggaucuuuaguugcuucaggccaucuggauguauacgugcaggucacugggaauaugauggcuuagcuugggcucagaggccugacaguaauaugauggguugagggaaaguuaucagaagagaaaaagaacaaaaaaauuucuagcuuuacuggagaauguugaagaugggguaagcagagguuuacgcuagaaauggauucaaguagacaaacuguauuauuucaucauaaaugccucuacuuuguucuuuccucccauuacccugcucaauucuuguuuuuguuuuuuuuuuuucauucuaguuaugaagaaaaacaaaaagaguuauuuugucuugacccaaugcaaagaugaaagcagaaaucagauuuacccuauguaauagcuuauuacugggcaaagaaaugaaguacauuaaggaggccuuuuuuuuccuccaauggcuguuagauuguguauugcaaccaggaguugucaagcuccugauccuaauccaagcuggggacugugguacaguguggccagcugccuugccagcugccuuaccaggcaggucucgcaucugccauugucaucccauuggaaucaaguugcaagccagugaacuugcuggggugugcccaggucagaacaguuacagcuuaaaagccuuugcugcccuuuuucagauccuguuccugggagagucucccacacuaaguucaguguggguaccagcuguggugagggugugcugccacugcagcugcugucugggcaucuguguuagggccaauacuucaagaagugugagucauugugaagugacuguaggcagcugggaaauaacagcugugaacagaaaaaagacuggaggcgugcucucuggaggucugggcauagugaugagaggcugaggaacagagagggaaaagaaaaaugcaauucuaaaauuaaaaagaaaaccuuaauuuaaaccgugauuuacagauaauucccaugugugagagacaguauaggaaacacuccaaagagcuugcguuaaaacaaaaauaaguaaaaauguaaagauuuccugccccuaugugaaaaaagcaaucugugauuguuuuguuuuauuuuguugagacagggucuugcuuuguugcccaggcuggagugcaguagcaugaucacggcacacugcagccaugaacuccuaggcucaagcaguccucccaccuugaguagcugggaccacacacauguguuaccaugccuggcuaauuuauuuuuuguagagacagggucuugcuauguugcccaggcugaucuugaacuucugggcuccagugauccucccaccucagccucccaaagugcugggauuauaagcaugagccccugcaccagccaugugauuguuagauugugcaacuuagaugguacagaaaagcaaaggaaggaaaaauaucaaccuuguccugucacccaggaggagggagccagagacagacacaugguaagcacagacuuugaacagugucaaagcuuggaauaagcugagccuuacacaaaugcuaaagacaaaacaaaagaggaaaaauaguuuuacguuucaaacagcaccgagaaagagaaaugaucaauaaguggaagaggauaucaacugaacaauuugguuuucuccaacuuucuucccagcaccugcucuguuggcaugccagcaugaaacccagauaaggagagaaauuucuaagagauuuuuuucuuuuaaaaauuaugaugaaccagacgcuaagagaacuaacacaugugaucacggaaacacugcagauaaauuuuaagaaauuguuaacaaugggaaaaaaaugucacaaaguaaggcaaauaggguccuaauuuuccaaaaagggaggaaagaguuucugugcacuguggauuggugagcuuaacuuugcuucuaggcaaaggugauagaaagguugauuaaauaguuucuggacauuuggaaaacaaagaagagcuaacuaacuaaaagcaagcuuaaguucaagaagaagaaaucagugcaagcauaccagcuucaguuuugagaggguuguuccaaggacaggcaagugcaccagagcucugcuucucaaacugcaucugcaucagugucauuggagggcuggguuuugagacaguaagucuggaguagggugggaguuugcauuucuggaguuccaggugacgcugaugucgcuggucuagagaacuacugcuaguauacuugguguuguuggauuuggggaagacuuguaacuuuuggagaauauugagaaauugguugggaauauuaaugguggugugugaagggugagggcuuuuaacugauuaaacaguguacaacuucguugucauuauuuuaacucggacaguugucuuuaguauuuugucagaauacucuggccuugacccucaucuguuaaguaauuucaucagggacucagacgacaaaaagguguguuucucaaaucugaaacacaaaaagauucuagcuaauaauguugaaugguugaggguuuaagugaucuugguauguuagauuuagcagcgauaggccgggugcgguggcucacgcauguaaucccagcacuuugggaggccgaggcaggaggauaaccugaggucaggaguuugagaccagccuggccaacauggugaaaccccgucucuacuaaaaauacaaaaauuagccaggcauaguggcgcgugccugugaucucggcuacuuggggauucuccugaggaagaauugcuugaacucaggagguggagguuugcagugagcuaaaaucaagccacugcacuccagccugggugacagagcaagacucugucaaaaaaaaaaaaaaaaaaaaaaagauuuagcagugauacauguaaaauggcugcaguuaguuacaggaggcucuacaauacaauaccuucugggauaaaggcauaggaauuuggguugaccucaguauuguuugagacaagguuaagguggacuauaucucuuccaucugacaaccuguuucucaccccuaccugggaaagaaugcagaaacccaagacaaguuuuauguucuacuaagagauuucuuccauggucaggccauaucuauuguauuuagugcaguucuagcaccacauuugaagauuuuggcaaaauuugauagcaucuugaagaaagagaccaagguguuuaaaucuggaauggauuugcuaugauaacaacaccacugucucacuggcuuuuccuaacaagccuuaauuucuugcucauaucaugggaagguugcaggugaacuguggcucugcagggcugugcuugguuccaagugucuuccuucaggacucagaccaaaggagcagcuccugugugggucugagacaugcuguucucaugggaaagggcuggagugcaagguggggaagaugccauguuugccuccaucuaauuggcugagggugccaaggucagggagguggagaagugaccucccacuuaaugcaagggcacauccugugacuagggggcagagggggaaguuguaacuucguuacagggagggagugggcaguuggaaacaguaauccaaucuacagcagauggagauucaguuacuuuaacauuuauugauugccuauaaaaaauuaggcauugugcuaaggcauggaggauucagagaucaauagaaacccuggaggaacucaguauagaaggacagagggaguauaaucaaaugcauugcuauacaacuugacagauagaagaaucacagcauucccaaguacagaggcugcagagaagagggugggaagggcuggcagcagggaaguaugaggucaguguucucagaggaggggggacauccagccuagcuguugaggauuuaaugaagaauuugcagcugggcgcuguggcucaugucuguaaucccagcccuuugggaggccaagguggguagauugccugaacucagaaguuugcgaccagccuaggcaacacggugaaacucugucucuacuaaaauacaaaaaaaaaaaaaaaauuagcuggguguggcagcguguuccuguggucucagcuacuugggaggcugaggcaggagaauugcucgaacccaggaggcggagguugcagugagccgagaucacgccacugcacuccagccugggcgacagagcgagacucugucucaaaaaaaaaaaaaaaaaaaaaaaaaaaagaauuugcgcggcgggcaagaggauguggaucacgcuuuggguuggggauggcauaauugcagcuggaggcuggaaauaguggacugcuuccugggggccauguuuugcuugcugcuguaucuccaguguccagaacagugucuggugaaugaauggugaguuuagucuuuugguauuguguuggagagauaagaaggaaggaaccaaaaaaggaagacaccaagagguaauuuuaaugccauuuucaugggacacuugggagcuagauuagaagaagccaagacuagaaucggggagaugaguugcagagggaaguggugaaggucugaaggaagguaggaaaaggucggacacauuccagacauauuuagggguggaggugguuggauauggggaguuuaaaggggaaggaauguggggugaacuggguggugagucaguggauauuggugacugaaaucaccacugcuaggaauacaguagacagagagcaaaaauagugaaagggaagaugauguauuuuguuguuauguuuagaguuugaggugacugugagacacugaggugaggauaugcagugagucauuggauauaugugauucugcccuaaaaauguauauuugagcuuuaucauuagaaugggugaaauugcagagucagacuguaaaacuuggaagugucugggacagaagcucugggacauacaguguaggaauggccaggggaggaagauuuuugaagauuuagaggggauauucuuacagcgagagcacaaccagggaaggugauguacuguguggaggagagcguucagcaggagagaguggccgucacuaacugcagggcaggcaagcucagggcccagcaccauggcuaugggaauaucgggaguugaggaagaaaaaggcuccaguggcacugaagcgggaaaugcgguagagauuuggaggcucaacuuuucagaacuugacugagaagugagggagagagagaggaguucugacaugcaucgggcacgucgcuuuugccccacuucacaaagggaggagaagcagagccacugaggcugaccuggacuucacugguuccccucugcaguugagcugcugucaaaauguagauuugcaaauaaagauauguuuuuuaacccaggguuuuucuaggcuaaaaaauaggccuauuuuuuccuguguuaguuuccuugcuguguaacaaguuaccagaaacucagcagcuuaagacaacacacauugacucuaucacaguuucuguggggcaugagucggagcauggcuuggcuggguccugugcuucccagucucugacgaggcugcagucaagauacuuccauggcuagggucucgucugaagacuugccuggggaggauccccuuccaagaucccucgcagaaccugggugcuggaaggauuccauuucuuucaaguuaugagacugagggccacaguuccuugcuggcugcuggcuggaggcugccccacguuccguguccuguggguuuuuccaccaugggaguuauuacuucaucaaagccagccagagagagacaacuugcaggggggaagucauugucucaugcugccuuagcacagaggugacaucaccugugcccuauucuguugcuuaucagcaagucacaggccccucucgcacuuaggaaaggggauuacauaagagcaugaauaccaggaggcgggaaucauugggugggugagaaccuuagaccugccugccacagaguaggacuccgugauacaucuuguaaucgugagacuuuugcagcaugacuucagcaaguugggggccauggugggagggagugauucacuucacuaucagaugagauuuucacggugaaggugagaugugaacuggucuuugaagugguagcuccagaauuuucacacauaaaagaggguuaggguaacagucugguuggaagcgggguacaucacaaaugcaguguauuuggaguagcuugagcaauugagcugaagccuugucaagccgugcuuugagagugacccugcucugaaggaugcaaaaacuuaguuccauaaagaagagacaaggacccaggaugaaguggaucauucuaggcggagggaacagcaggagcagagaugcuggaacuuggcaaagcaugauguaguuuuaggggaagaucaguaguuuccugaggauggauuuuaagucauauaaaaggagggagaauaaagcugggagaguggcaugggggcaggccgugcacucagaggagauggagccuggcccuaagggcagaugggcuuuguugguccucagaggagauggagcccaguccucagggcagaaagacuuuuggguccuugagaggauggaagcccuguccugagggcaggagggcuguguuguuucucagaagagauagagccugguccugacggcaggugggcuuuguaggccuuggauagauggagccuagccuugaggguagaagggcuuuguuggcccucaggggagcuggugccuaauccucagggcagaaagccuuuuugggccuugagaagauggaaacucuuuccugaaggcagaagggcuuuguggacucucagaggagauggagcuggguccugagggcagaagggcuuuuagccuggguaaugguaggauuaguuuugggcuccuuuccucagucugcaggggaggcugcuugggaacauguuuguugcucacaucugucuccucugcucuuggcaggagacaagaaaggaugcgagucgagaagucagagcugcugauguguuucccagcuucuguugcauccugagaagccugggucaggcugagguuugggggagauugggaauguguggccccacucaggaauugggcugcuuacuuccagaucacuguaggccagcucccucuugcuguaccuuucacacaugggcucagccauccugugggccgagcagguggcagugcccgcucugacugcacagaucgacagagaguuuuauagauaaaaaccaaugauuuuuuaaaaggcaucuuuucuucauuuagaauugguguauuggaugucaggaagaaauuaguugcucuuuuuucccuauccuuccugaaagagcagcuuuauacaauguuuuuggcagcugauguucaaagaagaucaaagaagaaaacuggcauuuuuggcagguuaugacacugguacccguggggugcuguucagugccauguuaccugaucuggaaacuuguggcacccguguguguguguguguguguguguguguguguguccuuguagggugcuacuucucuccuugccuaccuaccguguacuuugaugaugcugacauugguggauuucuguagaugugcuguuuagccagguaugcagcacucuuuauuuaaaguggagggccauuaaugguggcucaugccuguaaucucagcacuuugggagguugaaacgggaggauucuuugcgucuaggaguuugagaccagccugggcaacauagugggacaccgucuucuaaaaauaauaaaauaaaauggggaauccuuuugauuggggagaaauuagaaucuaauuuuggaaaggggcauaaaauaauucaugaguuuggggaagcaccaugacguauaauuaccuaguuaucucuuaaauuucaaaauuggacuuaauugagcaaaugguggugaagauaccauagaacaaaagauuuccuguugcuuucugugcuuuuuuauuauaugaaaugauguggcaugauuuauuugguuguuacugucugguugugaacgugagcaaccuuuaacagauggcugaaauggggcccaguuggaaggagggccgcggaccaccugcuuuuguggcccuguugcccuggagaucacuccagcugugacuguugauggccugugggggcaaaaucaacucuucagacagguggcagcgggacuacacucuagacuagaggaaaccagggaagagaaagcccagccugaguguagcaggaaagaaacugaagucuagggucauuaauacuagccuucauaacccaucaaacagugaaaguguauuucuugcuuaaacaaaaccaugcagauuaacccuccuccauccuguggccaccuucuucagcaguaacacagagucgagagaggcauacuuacugccuuacuguggaaaugaaacacaucacuucuuaugcuccauuguggcccuggcugauugcaaggaugaccaggaaaugcugggaagcacguggaaugccagucuuugcuuugaccucucaguacagcuuuucugucgaggagguauuuagaaucagucaucuuuguggauugcaaagagguguucucauuccacagugccuuucagggaguaagaggacaagccgaucccauuagcuguggagcagaguggcccagagcaggggcucuggcaucugagucucagcucuugauucaccacuuaccaugugacuuugagcaaaucauuuaacuuuucugccuuaaugucaccaucuguauaauggggucacuaauaggacuguuacaaauaugaaaugauguaugagggaaagagaaguugaugauggucaguuuuagcuaaaauguuugagcauguuuuucuuuguuuuaauaaaggggaagguuaaaacaaaacuccuuaagagguguuuauagacaccagaugauuuguagagcuuuuggucguguaguuuuaauucuaggguguuugccuuuuguuauuucuuuuagguguuuuaaggaaucagaccugcaucuuuuaauggcauuaauuucuuuuaacuugcauauucuaauaauaaugaacaagccaucuaucagagcccaaucuguuaugcuccagagaauuguaagagauuaaauuacauuuuuaggggucucuaauccugucucuggguugacagaauugggagagugaagaggaagcuaccaggaauaguucaccucucuagcaaucuguucucuuuuuuucaucagcuguuuccaaaagccuucagcaagaugcugugugacauucagcugguaccauuuccaguaagucuaaaaaagcucuaagcccaggccuuuuggaauaugucuccuuuaggaaaaaucaucaguaaagcuugaggauaagacuuuugaguauaaagugggguuuaugcugcaaaguagaaacugaaucauuuagcuucaauuuuagugaagggcugagaguuuauauaacagaacugccuaaaugcucucuuuuauaucagggcuugugaauaucaacagcagggagcagggaaguaggaaacuuucuucagugaccuggauggagaguuuagugagcuuuuucuacaccaaauguguagcugugucugccuguagccggggguggaggaaugaaaaggcugagaaacccccacccccggcuugaucaccacacuuucucaaggaaaccuguacugcaaagcucucuucuaccaggagggaagauggagagaacaagauagaaaaaaacaugcccuugcuugagccuauggagaaauugggcaaucaguuuucaucuaugaagcagugggagccauguccuacggacagaauuaaauguguccucuuguccacaggcccucuccugugcauucaggugguguggucguggugccccauaacaaugauaacagaugggguaagcgguaacugagaauaugccuccguugcucagaguagagggugcucaaguguagggggcguaugugggggacaguggagguagagcgagcacagccuagcaauucccagugaggcucuggagucagaaugccugguaugaacccuggcccuguugcuugcucaugugaggugugauguaggcgguuucuuucacucugcugugcucaguuucuucaucuguagaauggggauauaauaguaguuuuuuuuuuuuuaaucucucugucaccaggcuggagugcaguggcgcuaucucugcucacugcaaccuccgccuccuggguucaagcaauucuugugccucagccucccgaguagcugggauuauaggcacgcgccaccacacccagcuaauuuuuguauuuuuaguagagaugggguuucaccauguuggccaggcuggucuugaauuccugaccucgugaucaacccgccucccaaagugcugagauuauaggcaugagccaccgcacccgggugggauauaauaguauuuauguccuauuguccuuaugaauuaaugcaugugaaguaguuaggauacuauuuugacauacugugggugcucaauuguauuacuauuauuugggaauucuugaagaacaguuaauuaaaaaguagguugaaguuuauugugaagcaucucuaaugugguuugaugugaaggaauuugggcuuauccuuugagcauuaaaaauuuuaagcaaagaaaugguaugaaggaaguguuuuagagguauugaaacccuggcagaauggcacagguuggauccgagguagaaagagaaaggugguaggaaggcugacgggagaaaaaguaauccagguaugacccaggguaugugcuagggugguggccauggaccaugagggaaggacuggguugcauuagaccguuccuuuuuuuuuuuuuuuagcaaucuggaggauuuuuaaggugauaaguuaucggucugaggaaguuauuggauagcuaauuuggagauaauucaaaacuaaaccccauuagauauacagcucauuuuaguugcauaucaacucauuugauauacaacucaauuaguccuacagauugauuuuaacugcuuuaucucaugucucucuuuauauacguuuacguaaauauaugugugcauuuaugugugugugugugguauauaauacuuuagguuuugauacuuuuaggucauucauacagcauugugacugcugaaauuaggaaauaggcugacagauuacuaauuucuaggcaaacuuuauaauuaaaagaagaaauagauauggcuguaauuuuuuuuuuuuuuuuuuuuaguacaguucaaaauaaauggugcccuuugguccugcagaugguuucuuucuuaucuaguuuuuucucuacaugaaaaguuuugcugacuccuguucuuaauuuucuauuguucuuaauuuagguccuaugucugugcuugccugauuuuuccugugacuaucuuuuacagauaaaauaguggaagaaucaucauguauauaaguucaagaaguuuucauuaagcugcuaauuuccuaaagaaaucuggaucauggugcauccuuuguuugugugugggaggauauagugauacugaaugaaucaugucuugcucuguagcaagaggaauauuugguaaaguugauguuguuugcuuuggugagcaguggagguggagugggauccgaccccaguggcccuaaaagcagcgagcccuagaaaccaggcccaccuggguuuuccuggcucucucucacuugugcccucuuguuucucaugaaaaugugaagcugcugugauauuuuggggucucugauuuggcacagguagcuuuucagugacuuugcaacuacucuuucugcauaucuucaguuugagaugaacauguuugugcaacucagcaacucagcaccugauggggauucuggagagugcacugugggaucuaggaucaccuuacccaguucccaaugaccaauucaugaggaagucgcaaucucacaccagaaucucacuggaaaacaaaaucagacucucaccuaaaaaguagggacugaauaugaaguaaacuuuuuuaaagcaaauauguuuucaaaccgcaaaaacagaugcuuucuuuuggcaguuuugcucaucaaaccuaagcugaaugugaacggagacuaauuuuuaacuguuaauucacagccuaaauggcaaugagucugaauucuaauuucaaaaucuuauuugaacucuguguuuggcugacugaagugaaaaauguauuguuguuuacugauucagaaucauacccugcagcauuuuaagccaauuuugagcaagucauggccaaguguaaauuugcguacuuaacauuuauuuguuagucacacagccagcccaguggauaggccuguuugaagucaggcugugugcaccuaugccagugccggcucugcuuuggggugggauuuuggguguaggacgagguucaaaggaccuggcugaggacggccacacggguuggacaggccgcuucuggagaagcccacucagguguuguuccuggaucaccuuucuaggccaaguguaaaaggagagggaauuucuuuguuaaauucauuccugguuucagggcccuuuuguuaccuucucuuccacaugagcucccgucucugugcugcaggaaguucagaggcacgguuuaucaugggugcuuggcaccacucucucucuaacuauguggauccuaacuccagucuccugauggucagcuugacgcggguucacuggaucagugccuuccaguccugggcaggugcucuguuucuguuauucuagaacccccgacccagggaacacagagcuugcuggucugccuucauuuucucaccuccaauuuaagaccaaguaauuuuauuuugccuucauuugguauuuagaagcgucggguggcuuuugucagggacaguuucaugccucucuggcuuuuguccguguugccuggugcucuucuagcuggcccugcugacuggagucugugauggacucccauuuucuugagcugagucacuuguuuuccuccaggaugccguucccuacagcucauccugcuuguuuucacuuacuuuccuguuuucugcccuugcucuuauauccaggccuguuagaucugaaucuagucauucugcuuucucuucagagguuucucuugacaguaaauauaaauacaguaauuucugugggccagauaugguucucaguguugggugaauuuuaauucagucuccguaacaaucuuagguggauacucaucuccauuuugcagaggggaaacugaagcacagagaaagucacugccccacagucaucagggugccaaguggaggagucaggguugaagucagaaaagcuggcuccugagccugcacucuuaaaugcuauucuauauucuuuuuaaaacauuuuuuugacuuauuuuguauucuauaaauauuuuugacucauuuuuccaucuaauuuuacaccuuucuauucuuuuaaaauuuuuuuaaaauuuaaauuuaaaaccuacagucgucaauaaaacauuauucuauauucuugcuggcucguggcaccucagcugucuggaaucuucuauguggccuccuugaucccgggaugaguuagcuuuuucauaugauauucagcuacaauucuauauaggcaguuguguuuugaaaaaagcauuggacuuagcauuagauccgagcuccuggcugcagugcaugacugauuguguggccuugucuaagcucuguaaccucucugaccugcguuucccugucuuguaguaugagcugacucgugggcauuugagaagauuaaaugugaguaaguagcaagguacuugacacauaaaggcaaucagaaaauggcaguuauugugcuuguaauuuaaaaaguugaaagcuguuauagacuuucaagauauguuguuuuauguuuacauuuagucaguuaauucugguuuauaauugauuaggccaagaagagaggucucuuaaucagcauuccauuagagauuuauuuauuuauauuugcuuauuuuuuugucauuuaagaguuaaaggaauagagagaauugugccauuuaaaugaaaucuuuuuagcauuaguuacguguuaggaugucuguuuauccuucaugauuuuuuuguuuuauugcuaaaaaacauggacucauuuaauugucuagcuaguaaaaggccuuuauaaaauuuuucucuaagagcacaauaacauaguauuugcuuuuauuuaagugcagucuuuguaacugacuuuacauuuuguuagaugguacugaaucaaccacaguuacugcuuuaguuaauagcacugaaaaaucacuugauuugugaaucuauuucuaguguuuuguaugcugaacucuccaccuccccagucuccuaaaguaaaaugacuaguuguccuuuggugguguuuagucugugugauguuugccuuuaauucauuuccacuuuuuuuuauagagucuuuuuucauuuauuuaaaaauuuucggccaggugugguagcucacaccuguaaugucaacacuucaggaggccgaggcaguuggauugcuugagccuagguguucgagaccaggcugggcaauguggcaaaaccccgucucuacaaaacaugcaaaaaucagcugggcauggugacgcgcaccuguauucucaacuacuugggaggcugagguccgcggauuaccugagcccagggagguugaggcuacagugaaucaugauuauaccaaugcacuccagccugagugacagagggagacccugucucaaaaaaaaaaaaaaauucugcugaaagaggcuuuuuuuuuuuggugggguggggagacguacauugaggguguuuguuguaagcagcagguuauuuugguacacuguacauuuuauuaagggauuuuuccuccuggguuuguugaaugguggcggaugucucaguuugguuucaguaacugaauccuucagagacccaugcaaagaaaccuuuuguccaagaagaacuuugaccugccucaguccuggguugcuggcuaugaccagauuagguaagugauuaaaaauagcagaacucuuuuguagacauaauccuuugaaaauucucaaauuugcuuauuccgaacuccuauaagcuuacaauuauccgaaggucacuuacuuuucaccuaauagaaauuauaagaagauagggguuagagaagaguuuuucagauaguaucugagacgaucaccucaacauggaaaugaggaaacugaggcugggguugggagagguaauucccauaccaguaacaagguggcagaacagagagagggugagagccuggcucuguggccacacugccuggggcucuggggacuugacuaaguuguguggacucucggagccucguuucucaucugucaagagggagaaguuaguaaucauagcuccugcagaguaguuaugaggauugaaugagucaguauaccuuagagcauucagacagcacccagccuagcauaaguucucaaauguuuuuuucuuuucuuuucuuuucuuuuugagacggaguuucacucuuguugcccaggcuggagugcaauggcgugaucucggcucaccgcaaccuccaccuccagguuucaagcgauucuccugccucaaccucccaaguagcugggauuacaggcaugcgccaccacaccuggcuaaguuuauauuuuuaguagagacgggguuucuccauguuggucaggcuggucucgaacugccgaccucaggugaucugaccgccucggccucccaaagugcugggauuacaggcgugagccaccgcgcccagccguuauuuucuaauaauuguaguaaacaccccccugcauuucugcauugccuuggggcuuacagaguauuuucucacucaucucauuugaugcucacagaaucaacacagggaggcaugucugauacuauuaagugcuugccagggucucccagcucucacauagccugaucagagccuagucuugcaacuccuaagucuagcugagaaccaaggcguguucccaagugugccuggccaggcgcauaaagauacaaaaucgaugcuuuaaaacuuguguacaguguguucuuuagaaagucccugacgcuguugccaagaaccuguuuguguuagggaaaugccuaauccacacuguccuccagccacaccagguuggggagucuaagugaagauguaagggguggcacugguuuuaaaaacaaaaacagaaucaugguuucugccucugagaaccugcucccaccccgguacaauggcugcuuccaaagagguccugcugcugugugcuguguucccaggaguggccaugaagauuccacuugugcugugagcauguauagucauaccuccugcaugcacgggagacacacacuguuccucugccccagaaacugccaggccgauguuggagccgcugcccuccaaacaagacugguuucaggcuugcaguucccauuucccacagcacuuugugauaauaguucauuugacuuacucuuuguuguuuucuccuguuuugaucaggagccuuggauaggccugaagauuauugcauugguauuguauuagauuaaaaaauuggcucucguaaacugguacuuccugauuggaaggcggcuguuuaaauuuauucaugugcuuugaccuaggaauuuccacuuuacagaguuuaucccaggaauacucauacauguuugcaaagguagggauucaucauagcauuguuuauuauaacuccguaauagaauauuaguugaguuaugguacauucauagagugggauguuauauauggcuuaaaaugaauuuuguaagugugaauauggaaagguauccaaaaauauauaacaaagaacaguaugguaagaaugcaccaauguuuguuuauagcauauguagugugggaacuccaagggagaaaugaaugauuuaaucuggaaaaauguguuguaauaguugggagcacgaguguaccuuguggagggaauguaaccuugcuauggaggacuuucugcuuucuaacuuuuacaucuguguaaaucuguauaaauguuuaguuagauguauugcuuuugcaaucagaaaaacuacaaacuaaacaacaaaaacuuacccuuguuagugacucauccagugcccuuagugaccaacucugaccccaauucucuucuaggagggcagucucuccaucuuuaugcugcucagaggcuucaggagaggacugcagcuuccuuuucacccugggggagacucugaauccuggccauagccagcagcaccaaggagcccacucagucuucugccaucuggguuccuguccaaauuaaacccuggcuccucuucucccuucacugguccagcacgcgcacacacacacacacacacacacacacacacacacacacacacacacagaugugcgugugcucucauucacacacaggcacaugacccauucucacaacccauucacaagcauacaugcccauucacacacacacacacacaaacacacaaacacacacacacuggcauuuaggucuuugcucucaaaccuucucugcaaacaugcuguguuguccaguuuuccagcugucagcagguuauuaagaaggccugauagugaagaaggagacagaaaaacuacagaaacauaagcugagaccccagaaaacaccacaguucaaacucuguuuaguguuggugcacauaguucacugcaggcaguagccacugcauugcaucaauaccguccaugggguuuaggacaaugacuuuggguggccaucaagaagaagcaaaauacugcuuaaaaugcuguguuuaggaaggcaggauuguguguaauacguuuuuagaauguuauuaaaauugcuuugacagugugauacauuaaauugucaguuaucuggaaauucucugaugcugaaccagugaugacuuuaaagccaauaucuauauuccugagacccuuuguccaaaacauaaaacauuaacuugaggccagaagucuuucagaaacccuuccccacuguugcaguauucugaauuagcaaaucugcauaggccaacacugacugaaaggaccucuugguuuuguucugaggaaggagugaaauuuccacagccugcauaucacaauaggccuugugguucauucauuguuauuagauugaauuauaaugagaagaagccuuugugccucugggcucccugucuugguccacaggguuggaaccacaguaucagaaacaauuucuaagacacauuaguacacuuuuuaaaaguauauuugugucuuauacagaggagaacugaaauccuuuuaauauuugggggcuuuaaaguaguaauuaaaugccacagacccugucacgaauuuauuaaugaucuuugaaaaaucuaccaugucagcugcagcaccagcugccccuggggugcuuggauagagugaguuuugucagucgagcguuguugguagcuggauggauugaggcaggagaauguuggagugaagaacugggcagguguuagagauaaugccaccuggcugggcauagcgcccauggaauccauccccugaguagcuuuacagucuguccugccugaguccaucccacuccuguggaagcacccagaugucacgguuuuuuaaaacuuccuaggugagucuaauaugcagccagguugagugguggcugugccaccucccggcuugugaccuugggcacuuaaguuacacauccccucuaacccucuguuuugucgaagccuugugguaagaauuaacugaaagaaugcaugugacaccuaagugcuccauaaauaugaaugaauauguguguauuucaaugugauaauauuuauuaagauacacacauacauauguuacauauauagaaggaaaauuugcugugacccacagggucauauguguaaauaaauaacguaggucacaaggaaguugaaaccagcuucagagauuuuccaaaacaaaguacaaugucugugggagccuaucagaguucuugguaaagcagagugaaguuaaaccuucccugcaggaaagagcagcaaaacaagugcugacaguugccagcaguugagaggauccuagccccucaaguucuguucuggaucuagccccaccugggccuggugguggcucuuggugggugccacuuagucaggacauccaacuccuccccuuccuucuguuaaguaccagcuauuaccuaguggugaagaugaaggaaaguaaauuggaccgacuaucuuuauagacucauuguuuccuauacauauguauguacauugucagauuuaugcuguccuuucauucauuuaauggauauucauuauguauuuacugcauagcaggcauugaguuaaaauguggaacaaagcagaugcugucacugcucuuguguucuuuacagucuaaugggagagaugggcauucacaaccgagaucaagccaccccaaugaguggcagguauguuccuugauugccuaaaacagagagaaccugaucccgacuggggcuccaggaagauuuugcugaagacacugugauugagcugagaccugaagggugguuggguguauaguggugguaggggguguucuggaguagaaggaaggccuguguguuguugccauccaggaacugcaggaaagccagucuggcuggaaugagagagcgugcacaugugugugugcgugaugagggugagcccugagagguaggcaggagcagauuaaacauggcuguguaggcuauauuaauaauuuugguauuuuuacuuagaggagugagaagccauugaagggguuuaagcaagggguaagggugaaggcagagagagagagagagaaugggguagacagacagagcuggcaggcuccuccagagaguggaucagaaugacugagacuggauauguggggaggaguuguggucuagguggaagaugguggaagugaagagaagugauguguuugagagagauuuaggugguggcauugacaggacaugguuuagagauguguugggugcugcguucugguuugugcaaugggaugaugguugcaugcacugcaggaacaguggaggaagaccaaguugggaaaguacccugaacccacucuagggcagcaagccuuugggccccuuacuuagggcaaggcacaaguauucuuuuuuaaccuaaacaauuugaggaacaagcacauuauauuuaguuguaauaauuuuuccuguuauauuuguuuugguuggggauuuuaaaaauucguuuugcucaaaaauaauguguuucuagucaccuucuaccagaaucuuaccagguccuagcagucuaaccaggcuggguagugaaguguauucuuugacuuugugauuuucuucauauucuuguauuucaaucaaagcaacauauugaaacagauugaacgcugaagcagacaggggaaccuaguuguuuucucuuaagccagacauuugguuuucaaaaauguaaaacagcaucaucucaccaguuuuuguuuugagaaaguuauuuuuguagaaauagguuuuauuauaacauaaaugaacuuacuauuguuaucuuaaaaugaauaaagaaauaucauuaaaauuucucaguuuuaauuuccaauuucauaaauaccaaaagauagaacccauauaaaccauagcuuuuuggggucuucaauaauuuugaguuauaaaggaguccugagacaaaagaguuugaaaauauuugacaugugucauccuaggguuugugauaguaggcaaauuauuuaaacucuuaaccucaguuuacguaucuguaaaacagggagaaaaugggguugcugugaaaauggaguaugcagguaauguacuguaacgucccuaguucaguugcugguauguaguaacugguaaauugguagcugcauuugugguugcuguuauugggucauuucaucuacauugcaaacucuucuagguauguggccauguauuauaaaagaaauuucuguuguugcuacaacagguguuuaauaaaagccuuuuaaacaagugaauugcaaaauuucuagggaguaugauuuucugaaauaauccuugauuauucagccgcuaaccuugaauauuugacuuacaguucaguagugacuggcucuguuaguagcagauuuagcaugaaaugaaagaacagcuuuggaacauagaagacuuugcaugucccauuuguucuguuccuaagucccuccuuaucucaguuucaucauuacaaaaaaaaagugaugagaugccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaagugaugagauguugaaauccugccauagaguuucacauucguccauaguuaauuucaugguaauuuuuuuuaaagacacaggugaagggaagagugggaaaggaaagagggagaaugugaucaucgugugacugaaaaucagguuaucaaauggauaaauuaggagguaccauuugaauuucacaggcaucuuucacuuuagaaauagauuaaccacauaauaacaacuguaguguagaguauuaacuacuuaacaaaagaggauugaggguggaaguuuaacuguuauuucaauguccauuggaauugaggauaaugguuauuugaaauuuaacagaauuuaauaagaaaaagauuucuuugcucauguguaucacuagcauaacuauguaggugggcauaauuuuaugugguagggauauuucaaaaaauguuacguauauagaauuuuuaaaaaaauuuaauacggcuuggcgugguggcucaugccuguaaucccagcacuuugggaggccgaucacgauccgcggguggaucacaaggucaagagaucgagaccauccuggccaacauggugaaaccccaucucuacuaaaaauacaaaaauuagcugggccugguggugugcugcuguagucccagcuacucaggaggcugagguaggagaaucgcuugaaccugagagacggagguugcagugagccgggauugugccacugcacuccaggcuggugacagaaugagacuccaucucaaaaaaaaaaaaaaauuaauacuuacauuaaucuuuggucauaaaccuuucuggugaauauguuuauaaacuaagccugcuaauuucagagaagcauaauuuaaauuacuccauuacuguucuuuaaauguuuuccacccaugcuugaucuuggaagugaaauugcucacacuuggaagcauccuucacuccuccccuccuccucuccucccaucuuccccuccuccccccacaucuucccccccucccccucccccucccccuuccccuccccuccccuccccuccucucucucucucucucucucucucucucucucucucucucucucucucucucucucacacucacucaucccccuccucacaccacucugugugugguggugggggagagagagagaaacauuucuugagguuguagcacagucugucauugcucuaaccuuugaauucugucugaucuguccgucaaaugcuuuggaaaugaaugcuguauuuuuaacuucguuuucauugacugaacugucauucuuuagaguuuugauacguguucuuccugcagaauccaguaaagccaugcucguuuuguuggggaaaaagaagcacccuaagcaucgggucccaggcucaggcuuggagccucauaggcuacguuagaccucgguuccaccacucacaggguguggccuucuuagguugguuacuuagccuccuaguuuuuuguuguuuuuuucuccuagccucuaaaccaccagagauuagccuccuauugugauccucuguuuuuacaucuguaaaauaaagacaucauggauuuguugguauggaaguuuauaagguauucaguucugugucugagaaaaauuaugguucauuuucucuugucaaggaguggcaccagcaaagauaaggaggucauauuauggagcgaaugucagugcgagaaucaucuugcauaucaguaacuuaaauaguugauucauguggcguauuuuuauuaguauaagcuaacccagauugucuaaguguaggggaaggaucauuagauuugaauuguaagugcuguguuggaaucuuggcuccgugacuugcuguucugcuuugggaagguguuuuaauuucucuccacuucagugucuugauuuguaaaaugagaauaaugauagcuaccucuuaaugugguuaagaugacuguugagaugauuaaaugagauuauaccaaagaaccuaagagugcugauacucaguaagcacuaauaaauggggauucucuagauuuuguaaguaaaugaccaauauuucugucaaacugcuuaccuuugacugaaacuuugaacuuuagugagaccuucauauaauuuucaugacacuugacuuaauaacugaacauacugugcuaugcuuuggguauaagaguaugauacuuuuguguauuuuguaauauuuaaguacuucuuccuaauaagcuguuggguagagcauauauaucuguccaccagccaucuuauugagagagacaaucuguuccuuccacugaaagcuuaggaucacaagcugaaauuuccuuaauaugaaaacaaaaacaaguucacauuuuggguuucauaaauuuaauuaugguuaacuuuggaaauuaaaauguuuucugaaaaguaacuuuucuguucucccuaggaaaaauccauuauuagaauguaagagacaaaacaaaucuuuuaauuauacagcaaaggugccccagggcucaguguguuccuuugcugucuuuuuugccagcaucuuauuugauccuuaaugugucuggaaugugguuaagaauacuaaaaaauauuuugaacuagacuaacgugccauuagcauuaccaccuugguuuuaccagcugagugagcauucagauucuugaugugcauaugagguuaacaucucuuuaagauacugccuguaggcugggcacgguggcucauaccuguaaucccagcacuuugggaggcugaggugggaagaucccuugaacccaggaguuaaagaccagccugggcaacauagugagaucccugucucuacaaaaaauaauaaaaaagauacuaccuguaaacuaaggugggguuuuucauugauuaucucccuccuccuauuguaaaacguuuugaaugaaauaaaauacauuuuuccuuuguacucucuucucagcuuuuaaauuuacuuuuuucaaguccuagaauguuuuucagccuuauuuuuauuuaucuaauaaaaccucuauuuugggguuucuuuucauaccuucaguaccauaagaagauuucaggguaguuauuugacagguucuugucaaauaguauaacacaacagucaucaaagaaaagguguggaaaauaauguucaguguuccaaaguagaaaaauuagauauguuaguuauuguaaauaaaaagauaaaaacauggauuuucuaguguaugauacauguauuagucuugguucuaccaucuuaagaaauagugguuuuuugagaugaaguuucacucuugucacccaggcuggaguacaguggugcgaucucggcuuacugcauucuccgccuccuggguucaagcaguucuccugccucagccuccccaguaucugggaccacaggcacgugccaccaugccuaauuuuuuguauuuuuaguagagauagaguuucaccauguuggccaggcuggucucgaacuccugaccucaggugauccuucugccuuggccuccucaaagugcuaggauuacaggcgugagccacugcaccuggcuaagaaauaguuguuucugaaagugaugcauguuaccacaggaauuugacuaguaguggcaguauuuccuuguaugcgaacuuaagugcuacaaaucucaucagucauauuuacacacuugugagugacagggaaggggagcaagagccugccugugaauugucuuugcuggaaaauaaucuucuauuaauuuauucucuuuaggguauuaaaaaccagugacauguagcaugaaggcggaugaggcccauauugcuaaugugaugcagauguggacguucauuguggcuuugguuuuuacccacaaaggcuguaagucuggaaaagacuggcccauugccaugaguaauuauguugucucccucugucugaaauggggauuugggugugauggguucagggaaaagugauggcuguguaaucucuccacucacaaaugcguuaugacccugauggagugcccagcugagcgcacuguggaguggcgcauccucagggacagagccuggcuauggacaggagaguuuuguccugcucuuacuuuugggacuaauacuacacauauaugauuuuaugauuuuagagacuugcauuauuugacaaaugguauuuaaaaaaguuuucaaaugggaaguguuuaauuuugaacucuguuuuucuugguguaaauuuugcccuuaagugauccuuugucaaacacuuuuuacaaaacauuuaagagcaagacucuccuuuccacuuaggaaguaucacucuuuauucagagggaugcuuugaaugaaaccaauaaguagguauuuucagaaugacuuccccuguuugccuuguucauaucacaguucugagaaugacuguauuuuuugacccaugucuaggcacauuugcccuucucagcuggggcugcugcuuggauaagacucuuuucugcucucucaguuauuuauugcuucuguuuuucuccccuuuccucacuuugugccccuuauacuuucuuucuacuuaauguaucuccugcuucucgacuccuuuuuacuuugagaaugucagagaacagaaugaucugugcugagcgcugugagaugauggacuggugaagaaggcagggggcgaggaggcaaaugaggaaacccaaagccccccugccuugcagaggcugcaccuggauuggggcaaugaguugaggcaucaacauguggauuucaugagucugagagaugacuggggagagugucuauccagggccaauaaacagaagaggaugguuggaaacauggauuuuaaggcuaggaguuggaagcuccaggucccuaucucugccagggccuucaguagcuacaggguaagacacuuacacuuaccugguaaucaguuuccuugucugugagauaauggaaauaacuaucuguucuaccuauggacaggcuuauugugaaauugaaauaagauaggauguacauaaaggccccuuguaagggauuaagcccaauguguggaauaaaccugccccauacccuuggggaacaguguggccuagugggucauaucgggcugucucauaggcccguguggcccaucugcguggaggacugguucuaccugaggauaaguaauaugagagaugauuucuauacuaaaauaaucacacacguugucuuguacaauacaaugcuuaaccuuuauuuuaaagauaaaacauggcacagucaagcugccguuacagcucuguguucuuucuggguuaccuguuuacacacuuuuguauauuagacuauuucagucacagaccuugcgagcuguugguacaaucagaagcuuuuguguugaggacucaguggacaugugcucagaggcucucauuaaaucucucugggccucagguucuuccucucugcugugggaaccaaaugcuagguauuggugagaauuaaaugggagaacaucuggcacagauaauggcuaagauguuuaaguuccuccuccuaauuaugaugguaguagugacgauggauagugccuccuguaguucggaaggaggaaguuaauucugggugggagguggucagcagaaguuccagaaaggaaggaaguucgguuaugaaagagggaugaaauuuggauaguggacaagagacaguuucagguggagagagaagcccagacaugggagcuggagaguugggcagggguggggcagcagcagcagccaggccauggggaagugugacauggggacugggcaaggccaggagggaagcccaggagugacuugugggacccugagugccaagcagggauuuggacaucgccuuuuggaaaggcagggcuuuagaaaggugugugcgguggugggaugcaguguucacaauuuccuggugagcugauccuuaugggucccccaccccucagcagguaucuagaaagauuaucuugggcauaaagugaccucugcccucccuguuugucagaagcucuugcuccuggcucuugggguuagguuuucugcugcugcuggcuuuacccugcaguugguugaaggguuuccaguuagucuuuggaggcugacaguguaggaccugguuucaccugagcuuggggcccugcuccagggagagagcuguugugggggucaugauguuucugggguuguggaucucugacuuguggcagagcuucguggaaggacacuggaggcacagcacuugcucuuacccacauguugcucuuuuccuccaugacuuugagauccuuaaauacguuaccuuuuuagaacuggugguggcuuugacuucuguacguuggaugaaaaugaaaucuguacguuggaugaaaaugaaaucuucaaaaaucuuaaaaugaguuaauuuuuuccuguuucuuuuuuuccuucucuguuggugauuugguuuacagguucaugaucuauaauauucaguuuuaaguuuuauauuugguaacuguauuaaucuuuucucacacugcuaauaaagauauaccugagacuggguaauuuauaaagaaaaagagguuuaauggacucacaguuccacauggcuggagaggccugacaaucauggcggaaggcggaagacaugucuuacgugucagcaggcaagagaagaaaugacagcaggggaaaugucaaacgcuuauaaaaccaucagaacuugugagaacucacuaucaugagaacaguaugagggaaaccacccccacgauucaguuaucuccacccggccccaccauugacacauggggauuauuacaauucaaggugaaauuuggguggggacacagagccaaaucauaucagugucacuugacggaacuggguuugcaaugccaggauccuugagagucugaugucacauuugcugugucuucaggcaaaggccuaauaauuugaaaucaaauuuuucccuagguguggccuuaggaucaacauucauagaacacuuugcaauaaauuauuauuuggcuauuuaaaguaucauuuucaggcacuuugggagguggagaggggaggaucacuuaagcccaggaguucgagaucagcuggguaacauggcaaaaaccugccucuacaaaaaauacgaaaauuaaccagucaugguggcaugugccuuuagucccagcuacuugggaggaugaguugggaguauugcuugagcuggggaggcagagguuacagugagccgagaucacaccacuacgcuccagcacucuagccugggcgacagagccagacucugucucaaaaaaaaaaccaaaaaacaccaccaccaccuuuucgaugaagcuaguaugaauagagugagaaaagguuuuuuuucuagaauuuuauaaaaucuguagccauguuuaaauacauguaaacaccuagcuauccuggaagcacuguuuuacuguuuccccuuagcuuuagcugaaaccuuccaagucuugcuuuuggguugggaauuuuuuacuuucuuuuaaaaguuuuuaaaauuaacaauacuaaauagauaauaaacuggaaaggaaugaaaauaguguacaggaaaacuuguccccuucaccccacagccuacucugaucgcuggaugccaguucucugcuuggcagcaaauacucuuaccagcuucugugugucucucucucgagagucucugcaugcguauuuaucaucauacaaaugauagcguccaggagacacugcuguggcccugcuuauuguccauaaaaacauaucuucagaguucuuuuuuuuuuuuuuuucugaggcaaggccuuuucuguuucccaggcuggaguguaguggugcaaucacagcucacuacagccucagccucccaggcuaaagcuguccucccaccucagccuuccaaguagcugggauuauaggugcacaccaccaugccugacuaauuaaaaaaaaaauuuuuuuuuuuagagauaagaucucacuauguuucccaggcuagucuugaacucuugggcucaagugauccuccugccucagccuuccaaagugcccagguuacagucaugagccaucaugcuuggccuaaccaucuuuuuaagaguuauauaauauucuguuguauggcuguaucauuguuaaguuaaccagcccucuauuaauggacauuuauuuguaaucuuucacuauuauucagugaauauuuuuguuuauaacaagucauuugguacaugugggagcuauguaauugucguaaauguuucuccuguauacauuuagaaccacaguagacauuguuacacuguuugcuucaauugucaaauguaauuuggaaaauucaagagaaggaggaaagccuuuuacauuuuaccuuuguuuuuacacacccucuucuuccuuucuuccugauguuccaagguugauuuauuugauuuccuuuucacuuagagaacuuuguuuagccauucuuucaggguaggucugcuggugacaguuucucuuaguuucaugaaaauaucuugauuuccucuucauuccuuaaugauauuuuugcugauacaggauucuggguugucaccucuuuucuuucaaucccuggcaagcaucgugccacuuucuucuggcuuuuccuguuuucugaugaacaaucagcugucauucaaauuguuuuuuccuuauagguaggugucaucuuucuuuggcugcuuugaggaauuuuucugucuuuaguuuuucaaaguuuaacuagcuuuuugaaucuuggguuucuguuucuugccaaauuugggaacuuuucagcuguuauuucuucauauacuuuccaagcccugcccgcugucuuuucucccuugguacucugaugaugagaauguuaguucuuuuuucacagucccacaagucccuguggcucuauuauuagcuuuauuucauucuggucuauuucucgauuucucucuauuguuaaguuuggguaauuucuuuuguuccaucuuucaguucacugauucuuucuucuguucugcuguugagcacaucuacugagcuuuuuacuucuguuguuauauuuuucaguucuaaaauuuccauuugguacuuguuuauaguuuuuauuuguuugcugagcugagccucuuuuucuuugcugccucuuucucucucucucucuuuuuuuuuguuucaaguguguguguguguguguguccuuguucauugaagagucuuauuauggcugcuuuaaaaucugucagguaacuugaacaucucugucaucucagugcuggcauguauguucuucauuucguacagcuugagaucuagcuucuugguaggaugagugauuuuuuuuuuuuuuaauugaaaccuccuggacauuuuggaucuuauuuaaaccuucuguuuuaguugacuuauggcauugcucuggcagaggauggugggccacucccuuguuacugccagguggagacagaaguucagguuuuacuuagccgcuguugacacugaggggauguggcuggggcucuuuguuauaguuggugggagucucacuucuccauguuguuuucauugauagugcagcaguguagggagcugguuauuacuggcaguggaggaugaaaguccuggcccccuacuuggccuucuuggaccuagagguguuggggcaucucauuaccacuucacaauggcaaaaguuuaggccucacacucagccuuuguugguguggaugggacuggagccacagucguuuuuggcgccuguggaguagagugguuauuaucuaaaaauguucugucuugcuagacaggcuccuuucuguucuuuggacagagagagcagguguucuuuggucuguacccuucauguuugcagauugucuccuucuucagcuuuuaucugagauaagugaggcagaaaggaaacucagggaacucaccccugugcuguuucucauguccuugugucccuggccacucuggagcagagguuagcagagguucucuggaaagggccaaguggucucugaacugcucaacucugcuguugaaccucagaggcaagcguagaugagauguaagagaacaggccuggcugcuccauuucagcuuugcuuaugaaaacagccuggccuggaucugccuacccuccuccagacccuugcuucccaccccuccuagugcugacucuuugcuagaugucuucagaauaagcuucaaguuuucuucacugcagcguauucugcuguuuuagaccccuguccggggcacagcuuugugguggugaucaccugugggagagaacuucagaaucagcuccuagaaagagugauucugggcagcagaaaggacggagccuagagcaguuuccaaaguagaaugaaguguaauugcacacgugggacuccagucccugcuuaucuuuacuucugagaagcauuacauacauuuguuaauuaugcuacaagagagguagucuuaacucauaaacugagcugaaagaagucuagauuuucacgugucauugcuauuuuaagacaucucuuuucacacaucauuuuguuuuaacaaguguaccugggaaguuaaggaugggugcucuuauuuccauuauauugcuuuggguuuuucucuagaagagagaguauacaauugccaauucagaagugauucuauauuguuagcaccacuuauaagacuccauuugccugaaauggaaaggaagagucccauaaggagcuagaauggggccccaugugguaugagggucagggagagucuguagcacugacagguguuuuggccucuucugaauaccgccuuguuuuaccauguugcagaauggaaccauuguaagccaagaacaaguuggccuuuaaacuguuguuagcaaagaagcagaagcagucuucuuugaaaugacuuucauuuuggaaggaacagagacaagaugaauaagagcuuucccugauguuaaguguuuguggccuuagagagugguacagaguuuccuauguaucugcauuguguacguuucuuguuuucuuaauuuuagggcccuauuauuacuaugcuuuagcuuagcaauugggcuuuucaauggaaaaagcgguaggaggcugggcgcaguggcugcgaggccgaggcgggaggaucacuugagcucaggaguucgagacuggccugggcaacaugggcgaaaccucaucucaacuaaaaauaaaaaaggaaauagccagggaugguggugugugccuguaguccuagcuacuugggaagcugaggugggaggauugcuugagcccagaagacggagguugcaugagcugagauugugccacugcacuccagccugggugacagagugaggcccuguaugaaaauagaaaagaaaaagcaguagguuauuagcauaaacuugauaagaguucaugcugguguaucuuauuuuaagguguagaugucuuuaauaaaguucauuucauuaaaugaaguuaauuacguauuaauuguaaaauaaaaauguguuucucuggaaaacaaauuuggcuguaugauuuaaaaugaucauacuuaagagaauacccauuguuguaaagucuguaugaaaggaaaaguucccauuuauaguuuuaguuaaaacgaugacauaauuugaaagaacuuagauucauuguugcauuuuaaauaauagcuuaaaaguccuaguaaagcaauagugaaaguguaccuggguauaacacaugggcuggcuagaaaugucacuuagccugcaugacccacagaguguugccauaacuccugauguguagggcccuguuugcguuggagugaugcagaucucugaggcagugcugguugcccuccaagggcuuaugguggugguuggagaaauagaacuaaauaagggaaaauuagguaaccuugaaugcuaagcuuagaacuuugaagcagaagcaaugugagucauuaaaaggacauaaaauuaacucacaguuuauuagccaucugcugugcaucaggcucauaguguggugggagagauggcuuuauaauugaaagguagugaaauaaugagaccggagacucauacaaauugccuggauaggagguacuuuguugggaguuuaggguggucuaccugcaagacuugauauuugaaaauaguuuuuaaaaacaaguaggaguuugcuuguaggaugagaacuuuuuaguuaagggaaaacuguuugaaauacugagauaugaaacagcaugauguauuuggugaguagaagacauuuucauguuuggaacauauagaguaugaguaaugaauuugggaguaugaauaaagaaacuacuggggauggcuacgggacgggcuauugaugugguuuguguuauuuucucccuuuauuucauauacagucgugucacuuaaugaaggugguauguucuaagaagugcuuucugagaaaugucucauuaagugauuucgucauugugugaacaugagagaguguacuuacccacaaaucuagauggucuaaccuacuacacauguaggcugcauaguauagccuguugcuccuaggcuacaaacuuguacagcaucugacuggacugaauacuuuagguaauuugaacacagugguuaagaacuuguauaucuaaacaucccuaaacauggaaaagguacaguaacaauacgguauagaagauaaaaaauaguaugccuguuuaccaucuccaugaauggagcuuguaggacuggaaguugcucugggugaguuagcaaguggguggagagugacucugaaggccuagaacauuuguguauacuaccagagacuuugcaaacaguguacaccuaggccacacuaaacugauacaaaauauuuuucuucacuaauaaauuaaucuuagcuugcuguaacauuuuuacuuuauaaacuuuaaauuuuuaaaacuuuuugacuuuugaaauaacaguuauaacacaaacacauuggauagcuguacagaaauauuuuuuucuuuauauccauacucuguaugcuguuuucugguuuaaaauuuuuauugucuuuuuaaacuuuuuuguuaaaaacaagacacaaacacacacauuagccaggccuacacagggucaggaucaucaauaucacugucuuccaccagcaccucugucccacucuguagaaaaugaaguagagguuccucuucaaagggacuuuccucgcagucuaauugggaauaaauaguagccucucuuagaagcaaaauuuacucaaagaccugugcuaauauucuuaaauaucugcuagccguaauaaagaaaggaauauacuuuguguucuuagcccccaucuuuuaggcuagauauuuccccuggcauaccuguacaggcccaagaaagcauuaggucauagccuguuccucuuccuuauuuggagguguuuuugccuuucucagcauuccacaaguuacuuccuccuuuccuuuguucuccucuauguaugucucuuuugggauguucuaaguugcuagccaaucaggacaaguacagaaugugaggucccauuccagccaauggaaacuggacacagccauaggguggacgugucagacuauaaaugacccugucucuuuugugugugcucucuggcaaaacugcuagcgaguagcacccuuucugcagaaaguaaauuagccuugcugagagauccuuugucuuaggguugauuucugcgacauugaauacccauuuccaacacacuugaagggcuuuagaggugacagcacucauggagcuguuaucucccaugauagcaaggccuucuucugguaccuccugcaggcccugccugaggcuguuucacaguuaacuguuuuuuggcuuuuuuuuuuuuuuuuggagacggagucuugcucugccauccaggcuggagugcagugcgugaucuuggcucacugcaaccucugccccccggguucaagcuauucuccugccucagccucccaaguagcugggauuaugggugugcgccaucacgcccagcuaauuuuuguauuuugaguagauaagggguuucaccauguuggucuggcugguguugaacuccugaccucaagugauccacccaucuuggcuucccaaaguucugggauuacaguugugagccacugugucuggcuauaacuguuugacuggcagcacaguagguuuguuuacaccagcaucaucacaaacacaggagugauguguugcacuacauuaugaugucacuaggugauagcaguuuuucagcuccaucauaagcucaagggacuacugucauugaugcagucuguugaccaaaacguuacgcagugcaugacugaauuuuuguuuuaaaauuuuuugcaaaugaaauuagauuuguauuuugaaaagguaauccuaagaaagcaacguggagaauggauguagggguggaggaggcgagagguagagaugcuaggauauugaauaguccgggcgacagaugaugaggacuuaaaucaaggugguggaagcagugauggaaaugagaggagcuuccaaauagauuuggauauaugggaugagggaacaguagagaucagggaaauuuuuaguauuugugguuuggcuucagggugaucaguggugccauuaacucaguuugggauuauggaaagaagagcauguuuugguggcagaagaguucacaucuguggaacaguaaauggaacugcuugugggugguuggcacuguaggucuggaagucaguggaggagugucccuuaaaagguagauuuugguggguauuagaaauaguuggaauuaaaggaggagaugaguuuacccaugaaggagagccuuuagagaaggaagucaaguuccagguagagccaugcugccgcccugcucuucugccucccacucuccacccaugcagacauuacuaaaccauuacugcuguuucccacggagccugugggauccucagaaucuucucaaggcagugcacuggaaggcugacaggaacuggggcaaaauguaaggguuaggggaagagacugcauggagagacugagcagagaagcaggaguggaguccgcauuucugccaggaaggguggaagacuguuagagcuggaaugugcugauggauuugggaaguaggaagucauugaugacucuggugagaacaguuuuaauugagggagggagacagaagccauguuuugaggcuauuuggagccaggaguaggaggugagagacuacuuuuccuaggaucuugacuaggaaaggacggagguuguuuggaaaccagagggaaggagggguggagcauguguguagguguaggaaguaguucauaucuuaaauaauccuuuuauguaauaauccugcugauacuuguucuuuaacauuuuauuuugaaacaauuucaaacuuaaaguuggaguagaccuguaaucaccaguguuaacacugugccacauuugcuuuaucauuuuuuucuuucuuacuacuuuuuuuucugaaccauuugagaguaaguugcagacaguaaguaggugcuuuuacuucuaaauauuucguggucuuuaggcuucguuuagcacccuuuacucucauaagaaaagucguugggcagaucuauuaaaaauaaccagaguacucugccugccuccuuaaacauuuugugguuauuugucucacgggaggauuaaacacaggaaauuugggacuuggacuguacuggaaacuucuaaaauauaauuguucuuucagauuuuggucucuguugauuguuugcugaucaacagaaaagguggaaggaaaugauggcuauuucagccuuuuaaaaauaguacuaaauguucgauuccacaguacaauacuuuaucaucugagaaguaagguaacaggucagugagguucaaaaaucucuucaaaauacuuacaugucaaaugccuaaaauauucuccuugaugaagauacuggacacacaugcucagugaaaaauguggaguuuuuuuuccccacuaaauauagauuuucuuucauuuaaauaguacuuaauuguccuaaauuaacugaccuccagaaugcauuugugugcaagaaauuguuccuuuguccugucccugcuuuuaguaaaagugugguaguguagauuugccagggauagugugaauuuggacaugaacucauggacaggaauuguaauaagcugucauauccaguuuguguuucaugagcagcuucccuuugccagggucuuugugguuagugaugaucuucuuguugccaacccugccuugucacuggcucacuggauccuggauggagcagagacugacagugcuggguugcuccucuugccccuugugggaucuguggggcugauggcccucuggguaccaucccagggcuguucguuguucuccagcggaaguguaauaagcaauuugucucuucauuccugacaguuucaaaauugcaugucgagauaaguucuagauuuaaaaauuagugucuccuaauuucuaauguaauuuuuagauaaauugauuauacagauuuuggaaaacauauaguuaccauguagguuaaagaaaggugguuuaggucugggcacaguggcucaugccuguaaucccaguacuuugggaggcugaggcggguggaucaugaggucaggagaucgagaccauccuggcuaauacggugaaaccccgucucuacuaaaaguacaaaaaauuagccggaugugguggcgggcgccuguagucucagcuacucaggaggcugaggcaggagaauggcgugaacccgggaggcggagcuugcagugagcugagaucgugccaccgcacuccagccugugugacagagcgagacuccaucuaagaaagcugguuuaguuugaauucuagaaaaaccauaguuuaacacguggcuuuguaagcaggacuuucaaauguaaucauguuucaaaaagacaggaggcuuuacuagcgauaacgugguaagccagagagcaauuuuuauuuauauuuaggggcagaugauggggaaacaccacuguggucuugagacaguggggugauuaugaccaucaucaucauuaucucugucauuucucacacuucuugauuuuaccugcacguuuccauuucuuaagaaaaacuugcuaaacccuaaaauaauauaaauacaaucuuaauuucuaagauuucaagagguuugagguguuguuuaguagcagugucauugcaguagcuugaaauauuuauaaguaauaacccaaggguagcauuucugccaugaaaugccagaaauaaugggcaugucugacacuuuggggaguuucuuggcuuccugugauuucuguucucuggcuugcugagucuguuuggcacaggucggauguuugugcuuggucuggaauuugaaacacguggcuguaaaccacagauaguuugauaaaggcauaacaggcaggaaaacaaaagauaugcuuuuaaccaaaaaauguaggccugccccuggcauuucccgugaugaagguguuugaggcugugcuuugccguucaugguguagcuccucauucguuuucagcuaucagaaaggccacuuguucuggugcuccuuggcucagcuggcaccaggucacugucucauccuccagccagugaaggagaccgccuucacugugggaaccagcggcucgcauuuuaauugugaucuggugacuucuguacagcagcagauugaugacagcuuuggaggggaacagguggcucagugugauugaaucguucuuuaacucauucaacaaguaauggccaaguaccugcucucuguuggacaccaucuggggccccagggcagucacgaacaaagcagaccggagagaaaacaaagcaggaaguuaaggguggggacauggguagggccgguguagcagaaauucuggagccaggcugccugaguuggaaugcgaauucccauuacuugccgugugacuuuggcaagcccuuuaauuucucuaugucucuuuccucauagguaacaugaggguaauauuauuauuauaugaguuguacuaaauaaauuggcauguguaaaauucuuaaaauggugccugccauguaacuacuauguguuagguauuaggacagugcuuauauaaagggauguuaugguguuacuguuagguaaggugacauccuucagauaccugaaggauaugagagcugaaccaugugacuccuuggggaaggagccuucccagcagagugggcaugcgccugguggguuugaggggcagagggagugugggggauggaggggaguggucagagaggcagcaggggcagggcauguccaguccuguagccacugugaguacuuugcacucuagaaugggggccaauguggaguuugagcagacgugcuccuaaugcaguuuuggcaggauuccuguggcaacuauggagagaauggacaauggaguauccccagggggugcaguguggguuagacccugaggcaugucaaggggcaaggucaggggauuugcugguuggcugcauugggugggaauagcgaggguggaggaugagugcaggccuugaaggguggaguugcuccuuagugacugauguagacuggaaggaacaggucuugagccuguugauuuugauuuacauguuagucaacaggggagcugaacgggcagcaugggaguucaguggagucagugcuggagauaauagcaugggaaccauuggcauacugaggguauucauuacagucuuguggcugaggucaccacgcagcgaggagggaagggacaaggaagcagcagaggugugugugagaaggagcugaggaggggcagagauaggggcagggaggggggugaagagagagagauggucccggcagucagcgagggagacauuuugaggagaaagugggcaucucuaguaagauaaggacugagauguggccauugaauuagcaguggccuugguaagagcuggagaguugggggugggagcaauggcccuacugggcaggguuccagagagaacagggaggaggaacuggagcacgcaggagccuggcugaacaggaagcaaagaaauagagggaaggcugcagagggggaggcugguugagagcuguaguucgguuuuuggaaugagaguaauuacuacgcgugccugugcugaugggaaaugcaugaugcaggagagagagggugggaggggcagggauccauugccgaguaggggggccggccccagggagguaccuuuuuagggaccacaggucagagaggugcagggagcagagauggcagggugagcacaauggaggcaagaaggcugcagugcuucuccuggccucugucuucucagcugaacggacaguaaguugagagugccagggaguguuggagguugggggagagacaaaaagggccuuuccaaugaugcuaucucgcaccacucagggccuaccugaguagggugucaagaguuuacggugggaccagucagcaggauucugcaucuccuccagcuguguacagcugcuuggggcagaggagauggggaguuagauuuaaucagcucugggauuugccagaaagcgcuuuggagggcagaggaacgugguggcacgugagagcaccagggagccaauaugacuacaaggcuguggcucugagucggguagagaagaaagcaaggauguagcagggggagggguggcagagaggugguggaaucgggcuuuguggucuugguggguggaagaauuuacaggguugggaugucagggagugaguugggaagguaggagaugaggcucagaaaagggcugcucaacuuugagagcagggaguccuuuuggugacuuacagggagaggguggagguuaagauuaaaacaccaggccuugcagggcaguggcauccuggguuuuagcaguguguggaggauguaggacauugugcuggggaugugugcucccugggaugguuuuggaaguugggagauggcauuagaggcucuuuggaguuuucugggcugagagcuugauugcuaagggacagccugggaguugucagcuucuugagcugacagccaaguggggauaaagcguuucuucugauggaaagguugugguucugaggcugcuggcacauugggaagggcaucuugcggguucccaucauuguggagcuacaucuuuauuucugaauguuggacauggggcacuuggggaggccaguauuaccaggagauuuuucuuuuuuuuuuuucuuucucuuuuaccuuuuguguaucaguauuucuuaauaagaaaugccuauuuauuuaaauucggugggagauauuuuugacauaauuuuuucacuuucucucuguccucuguuuuggagaaugacagugauggagcagugggcugggagccuuccugucaccagcaccugugacuuuggagcagcuacuuccucugggacuguuuaaaagaagggguguggggcucagcuuuaagguccuuugguuuuagaauuaaacucuauuuuguugguuuaugaagcauguuuuuugugcccaugaucucaaauuucuuugguuuuuaaaacuuuaucuauuuauuguaccuuuaaaacaaauacauuuuauaccuaaugcaaauuaguauuuuuugaagaguguuaggcagaauaaauguguauuucccaucagagaaggaacuacugauaaguacuucaagaagacccagaauuagcauguguguuuauauaaauugugaaaucaucuucucccacuucuucccccuuuuuuacaaaaacaaguuaagagucagagaaggaaagaagaaaugggauuugcaccgucauggacugauacugccuggguguaguuguuuugcuuggugagcagaacuugcuguauuaucuguagcuuucuucauguauacuugggcacuuguaaauguuaccaagugccucugaccagaaugggugggucauuuuccaugucgucuuaaaaugacuggaaaguuggugaugaacagaaggcuuauuuugauaucugaguauggccugaaggcuaugcugagugagugaaacccagagcacuucugagcagguuuugguugguuugguuccucuuuuguuggugcuuuugugagggccaauucuguauggcacuagacagagcugguuaggcucaacaauacaguguuaccaggcggguugagaauggacacccacaagcccaggagccuccugaggccagucccccauagugccugggccacacggggcugggccuguuaaccagggcaggcucgggguucaugucuuuuacccucuacaacagugcagcccagcaggucauuaccaccucaccuccacgcauggcaggggcagggggagcggucagggcaugccuguccugcugcugucacccaggcgagccacacauuccacacuggcuugaauggcagugacuuugggccuggcaguguccucugccagucuccuucacucacaauuucauuucaacuuuguguuauagugaaguauuuaauaugacacuuuuuuuuuauucuuuaauaguucaaauaguaauguaugccaaggucagacuaauauuuuguuuacuagcuuaguaauuuucuucuuguuccuaccugaauuaauuuauaugggagcaagugcugccuuuuuugcuguugaguaccagagaacauacaguaaauaaugauuuuuacauauugaaguugcaguuguugacugugauguugaagaugucuucagacaguaguuuauacugcauuccacacuugaggcucaagugauuggagugauuucugcaauuacuaguuuguucuauaacuaagacuguuuguuggucucugcauauacuuucaggucauuaaaugcuacagaaaugagaaaugaaauacaaacuuuuuaacuccuacucagauguccaaacagcuucuuaguuccugucagaucaguaauaauacuggguuuggucuuucuuaaaccaagcauaauccugcuuaucuuagaaugaaacaguauuccuauucagagguaaauagaguuaaccuuuacucguguaauuuuuauuguuuguuuuaccauuucaugguguucauacuagccccuuuuccuuucccucuaagugacugcugagguucucaccauuucagaauaaaauucuuguccuuugagguuggaaauuuaaugauaauugaaaaacuguaugugucaguauacuuaaaaggaaagguuauaucauucucuucauuuuggauguaaaauuuaccuguuagagaaaauuuggaaauuauagaaaaguaaaaaaaaaaaaaaaaaaaaauggaaaaaagcuauugugcuugucuccuacaaagagaacuacuguggaccuuuuaugucucauuucuucuguuuuuuaaaagcuggguuugucuaaaaccacugucaccaaaacaauaaaacccauacccuccaaauuuguaugacauauaauuguggugacauugucuagaacauuuuaaaaaaaauauuauuuauuuuuagagauggaucuugcuguguugcccaggcuggacugcaguggcacaaucaucguucacuguaacuuggaacucuugggcucaagcauuccucuugucucagccacagcguccaacuaauuuuuucauagagauagggucuugcuuuguugccuaggcugaucucaaacuucugggcuuaaggagucuucccaccuuggucucccaaagugcugggauuacagaugugagccauuguggcuaguccuguauauaaaauuuauauauuuuucacuuagcaugauaaacagaaguauuucuccaauuacaaauguauugaacuguuuauaaaaacuauugauuauuauuuuugaucacuacauaauuuuucaugugggaaauuuuccgcuuauucaguccuuuauuacuagacauauagguuguuguuuucuuuuuccuuuauaaucaauaugguaaugaacaucuuugugucuaaagccuccucugaacaucagaucaucucagcaagguagaauccuagcaggcauucuaaugacucaaaaguuuugggugcagucuacaaaauuacuguaugacaagguauuaauacaugauacuaauauuugaguuagcaaaagcugcuuauuggauaucuaaguugggcagcauuugguaggcuuauuuuuuacuccuuuaaauuacuucuuucaagugauuagaaacuuuuaagaaucuuaaucaguaggugaaagaaaaucuggcuuuuuuaaggcucuuuguauauugaaauagcugggcaauauuucuaguaaccauauugauguuuuacugcuauauacaugauuugccaauuuuuaaacuaagaccuauaguaaaaaaaaaauuuauauuugaauccaguugguuucuuauugguaaacacacaugaaacaauauuugucuuuaugcauuucauaauguuauauucugaacuuucuguuucauuccauuuuuuaaaaaagaugagucaugauccucuaaauggauuucauaaucuccuggagguuccaacucauaguuugaaaaacacuauacuguacugugacaggcggcgaauccagaggaacacauggcuuauuucccugacugcuuuuacuuuuccugugugugggugggaaucuuguacucguucauccuggcaguaccugagugagaaauaaggaagcuaaguacccugcccaacggcacgcaacuaccaguggucaagcucggacacagucacuucuggguggcccccagguccaggguuucacaguccagcagcauagaagccguuucagcuucuguuguccuggaagacgcaaaggcauccagaagagaggcacaugaucugcaggaaagacuccgccguagcgguucagcgcagguuuaccaaagguuguucaccuggaauggacugugaaccccccaccaggaacuguggcacaggcagaagucaaccagggugaaaugcagcuuugcacucugacauuugccccuugaaaaccuggagccugguagaguuagggguggaaagcaaguuuuccaucagcagaggagcaucuuccauagcucccagaaggaucaguuaaaagugucaguccgauggcuuccuucggguuuugugaaccucagcggcuucgccugcccuuugccuuuaaccagccaguggggcccugcaugaggugcccggggagguggugcaugcauagcauccuuaguaagccuggaggcggguaugcucucuggcagcagcuuucuuccuggcuuucuuguggaauuguccuccuuaccaagaugcuucugccaggguaagaggaaggccagugagugcuugggaaggaaguuggcaguaacuuccaacaaaccuugccccacuguaacuucucagaagggugaugugaccagcugcaaauaccaaauggaaagagauuuugccuagagaguuuucaggagggccugaugaaccugaaaaccuucccugaaugcaguguaccuuccauuccauacaauaaccauugaagggcuucaucuuaauuaacucacauggacauuucuaauuguggaagaaaauacugccuccccucaccaggugaaaccaucauugaaaucaaagcuaauagcagacaacacucuguucccaaagagcagguucauuauaucaugccaacaaguagcauuuccuauuuucagccuagucacauugauugacuggagcuuaaaaauagaaaauaagaguauauuguugaucuuggauuucuuugaaugcugaaaaaaaugcugccuuuaaaaucaaauuuuaccaaacuuggcagauuacaguaggaaaacaacagauaaauguggauuuuucuacuccuguucucuagcacagggaaucuacuagagggcccugccuccacuuccaucaaacaagggaagagaaugcucuucaugaggucacuguuaacugagccagcauagggaggcucagcaggugagcuggcuuggugggagguggugguucugaaucucugcucuuuugcaauggccuugggaccuggggcaagugacccucucugaguuuuaguuuccucaagugcacaguguggccuugagagccucaggaucuucgacaugaccgaacauucauaaggcucagugcucacugucuccucuucccuuccucuccccuuuucucucugggucuugagagaacaugaaccaggaccacagugccacgcccauggcucuuggcauauuuuauugaacauuauuuaugugguuaacagaucagaaaaucuuagugauccucugauggcuccaagggaugcuuccuuuuuuuuuuuuuuuuuuuuuaaaaaaagaaaaagacagggucucacucuguugcccaaacuggaggguaauggcacaaucauagcucacugaagccccaaaauccugggcucaagcaguccucccaccuuagcaucccaaaguguugggauuacaggcaugagccaccaugcccagcuuuauuuuucuuuuauagugaugaugacuuaaaauagucaacuuuagguaccuugcugcaguaucacagcccaguauuuuucugcucauguuuuuccccaugucuuaauggcucagguuuugcaggagagugacaauuguauguacugguguguguguaauugcacucacacauguguucaagguuguaaaguuguguucaccauucaccaguguuauggagagauacuuccugucuucuugcucccauugcaucucugugucugucucccucaguauagcugagaccagagcuggauguggcagccaugugcuucuugagcacucacauggaacaaaaaagaaagagaauggagcuucuguugugcugggcuaauugccuuauuauugauucagcuguauaagugaaauggauuguuuaaacauuuuugguuuugugauuguuuuaauucagguuuuauuaagcugggcagcagaucauugauugcacaggauucggaggcacauucauuuguaucuuccaggguagcuuuucugaaugcaaaucuuguccaucugguugccuauuauccauccuuccaaagcucgacagacuugauuaaauucagaaccgcucugccuugauaguggcaucucaaauuuuaucauuaguuaugcaucacauuuccuugugucugaggugacccucagaggcuaugauauugccuuucuacuuucucaagaaccagaauguuugaagggcaguuuaaaguuauagaaugaaguaggaaauacauuuuagauuuuuuuucccuuaaaauauauaucaggucugaaaggaaaauacuguaggugauuaucuuacuugcagauaugccugugaacuuggccgucaggaaucagagacguggccuagaacaccauucacggaucaaaaaaauaaagagucugugggauauccauggcuauaaaaagagguugaauuguucugcuuucucugucacauguuaauauuaugccaugugauucaaguagugaaccagcucuuuauucuccucugaaaaugcgggggggaaacuaccuuaguauucacauuuugguuuagccauccaaucaaaguuuuguuacagauugguuccacuguauuuguccugaauuacauguucuuuuucauguuugauguauaaccuuuaaaaaucuuacuuaguuucuucaugugcuuucuccuuuucauucuguuugagcuaauuucugauuauguagccgugauuucaguguugauucuuuucaaucuaaaucucccucuuuagugaggauggcacccucauuaaagucuccgcagaugacugccuugcuucagucccgucgcagccuggugcugccuuucuuacuuguggucauauuguccacaggucucucucguguguacaccugcccguccuuucuugcuggaugggcagaacucagcccagggaggccuugccccuccguguuuccugugucuggacagaagaugcaccuuacuugaaaucaguugcaaugguaccauaaaacagauuuauauguuuaaucuccauguuggauccugcacaguuacucuacuguaacccaaauucauagauguauuuuuuuuuuuuugagauggagucucacucugucgcccaagcuggagugcaguggcacagucucggcucaaugcaagcuucaccucccagguucacaccauucuccugccucagcuccccgaguagcugggacuacaggcgccugccaccacacccggcuaauuuuuuuuuguauuuuuaguagaaccaggguuucaccguguuagccaggauggucuugaucugaccucgugauccacccgccucggccucucaaagugcugggauuacaggcgugagccaccaugcccagcccauacuuguauuuuuaaauucucuuauagggaaaucaugaaugcagaaauaugaguuggauucuuucugaauuuuuuuccuucuguuguuuuaacuauuccucuuuuugguuucucuucucccuuguuuuuugaguuggggaagauguggaacaggacauguuauguacguguucuuuguuuaaaagaaaauuggaagcaguaccuuccucccugaaagggggaaaaagugguguuuuguguuuuccuacaagcuguuucugcauacuugugcuugacugcuguagaggaacugggcuuuggggguaugucagugucccaaggaccccacccauugcaccucagaguugcugaucccuaaggcagcauagcuguaacguguugaugugaugacuuggcccuuucccucuuccaaggguggagagaaucucagcuuucucccugcauccacaguuuguuggaauucucuuuuuucaguuuacuuguuccagcccauacagaguuuguaaagauucugaacugaggauauuguuuauagaagaggaauuuuaauaagaaauguuauucaguaauuccucauucaauaaauauuuauugagaaucugguugcgggguuaggguggcaccuuaguauucccauucuggguuagcuucugaccagcguuuucucuuaggcacugaggauuuugcagugaacaaaggagacggucccuuuccucagaaauuacauuccagugugggaggagggaagagacagaugacaagcaaaauaaguacuguaaucuuaccuuccgcaucuguagccucagcuguguagaaugccagggacaugugagggugugagccaagcccguccugaauugugugcacugaaacucuuaaccacugcucccacgccugcccaugcguuuuuaucacaggucuuuccccuuucagggaaccaaggcucuuuguuucccaagguggauccuucaggcuccucuuugcauucacuucuaaagaacgagagaguguccuuucucagcccuuaguugauucagagcagaaaauggaagggagagugaggggcagauagggaggcaggggacagaaagaccaaaccugagaagcagaagcuacuucuaucagcugaggaccucaaggcugagccacagagaagagaacaaauucugcuuagcauguggagggaagcccacgucauauuuuguaaaaaagcuuauuuuaacugaugauuaaaaugaagcuuuaguucagaagaggguaaaaauagauggaaaucuguucagaugggauuucuuaguugaaucuggagugaugcagauacaccgugagaggcagagcugagagucaagaggcucccgggccagcgcugcugucugagaggccacagaaucucuuccaaagguguagauagaccaagcuuguccagccugcagccugcaggccgcauguggcccaggagugcagcccaacacaaauuuguaaacuuucuugaaacauuaugaccuuuuuuugcauuuuguguuuuguuuuuugcucaucaacuauuguuaguguuacuguauuuuauguguggcccaagacaauucuuuuucuuccauuguggcccagggaaaccaaaagauuggacaucccuuguguagacuaaugaagugacgcuucuucccaggcaugaugacacuguuuugacagggcugcacccuguuuugacaaggugggacccugucuuauagggguauaaacaaaggaaguaaugugguaggggaugcagaguuuucucagaacuccuccuagguuaguaguagcggguuccaccuccuccaccagcucagccccuguagagcauacucucauugcaccaucaugacuugccuggagguugaggaaugggcagauaauuauuauaccuguuacuuaaucagaugugcacuggaugagcaccugcuuggggcucuccuuguguuggguacuuggggggaauacauacuuggagggaguacuuuauaccaggacuaacaaguacagcuaacugaucuuccagucccuugcuaauuaaaaggaagggaaaaaaaggauuacuggcugagguagauauaaaugcagccuaaaacaacaucugauagccuggaaaucagauacaaaagcugugaagaccuccauugcaugcuaguggaauagcaggggauguuaacagcaucucuuccuuggugagguagcauggugucaugggaaagaauggccuuuguuucagguagagcucccugauaucccugaccuagugucucccugccgcuuggcagcugugugaacuuaguaauguucuuuaacaucucugagccucuuuuaaaaaaucucucucucucguauaucucuauuuaguuauugagaaucaacucacuguaggcauugcauaagagaaacacaguggugaugcccccuggcccucagggucccaccuuguugaaacagugucaucauaccuaggaagaagcaucacuucauucaucuacaccauggguguccaaucuuuuggcuucccugggccacauuggaagaagaagaauuguauauguacacacacacacacacaggauaauuauuagaaguuucaagguuuuguggaaauuggaauuuauguaggugaaaugccuggauacagugccuggcacauaacauucauucaguaagcaucaagcuacuguuauuauaaauaugauuugaacaaauggaagagaaaaaagaaaauaccuuuagcaggagcucagaggaaauaaucagcaugaaauguucguggaacauauuuaauguguuaucuauucuguugcauaagguuuucuaaaguguccugaauguggcagcacaguaccuauggcacggcacaguaucauaauacuccucacucaguuauuuccuccuuucauuagcccagguucucuuguuuuauuuguuacucagucauuuauagagcauggaugauaagugaugcuccaugccaagcacuguacugugucuaagaugaacaggauacaguauuuguaaucaaaggaacuuguauguggagguugggcuaggacauccacuuauuauaaacugagggagggaugugaagaguggggagcagugggcaggggugggaggggcugaugauccacccagcuggccugaaauaggagacgauggcauggacagcucccaggcccaccacugggcuggcugaaggucuccuguuuauggaagcaagugggggaucugaaggaugacacuuuccauauccugugccugagguuugguuguguuaaagagaaaauuauuccaugagucuuguuaaagcacaguaaggcaaacuugacuaaggaccaucucgauagguagagggacugcagcaaugggguuuugugaugggggaaagagauuagguucaagucuaaauauagcaugggcaagugggaauuuauggccaaggagcaagggaugugguuagugaauggaaaauuacuaagaggaaacaucaggaguaaggagaauucuggcuaaaucagucugacaggauucuugcugaaggcagacagggaggaucaccugagggugaucaaggacaaggagcuugauuagaugucgagggucagggguucuugcuaaucugacuuagcagggugcuuugcuaaaaguggaguuuauaaggaagugcacaguugggcccaggagaagguucagaaacccgaccaaagcuuggccaagcaaagacucuuucuuuagagucaucccccagcaucuuggggaucuuuuucagaauacuugggaccacuugaugaaaauuugaacccaaggucucuuuugcugcccuuuuucuaguguucauggcuucuauguguauuauucauggcaaaguaugggcccuuggucuacugaaugauuuuguguuugaaaguggaaaugucugauuuguuauugagguaucucaguguuagcaucuucauuugucccugauguuauugaguccagccugcauacguaaaugcauaaauaaaucucucuguggauuuucuguuuuuuuuucucccggcacaucccacucuuugcaccucuccuuacacucaauauaguuauauuccaggcuccucuaaucuccaggcauuugcuucaaugguggccacacucuaaggcacucaauucaguacuggaguuugauccuaacucuagaaaaucaagucuuuacaugucagccauaaaccucuggaaguggauuaaauaggaauuuugaugauuaaaugugaauauuaccacaauauaauaaaauugauguuuuucacuaaaguaacauugugacaccuuugcauccacagaaacaguguuucuucaaagcagccauguuagguggagcucguuuugaugccucuuuaggaauggcgguaguccuggcucaccaguggcagaaggaccccgucuugccacuggauaguguauccgcucccuuucuccuguauuuugcuccuugagauuuccugcacuuagcaucucugcaucuucacccucaucucacccuucugguauugcuuugccauuaugaucugagaagauccucuucugaaaaucaggaaaccauggugaacuagcuagacagugagaccaugcugaggcuggaaccaagagccuuacucugaaccuaacaggaagcgauugaacuuucagaaacacagagggcaaggaccucucugccaggaccugucuuauuugcuuauuugcacucacugcugcugcagcugcucucugugacagcuucucagagugugcggguggaggggucauuccagagcagaggggcuggugcuggauuggaaagcugcccaccacuccaggucagaaacacuagccgucccucuacccacagccugcacaaguugugucccagaucucaguguggguggugccccugucaggagggcucuuuccauugagcgccucugcagggugcacugcugugcugugaggaaggcagagcagaggacaaugggaucuuggcauucccagcauuguauuguguaucagcuacguuaggccuuaguuagagauauuuggggaaaugguugcagcggcacuuuuggaaaguauaaacugcugguaaauggagguucuguacacugaaagugaaggugugucuccuugacacugccuuuuggcagauggagguuccugaucuucauggcuucuaaggaagugacuucuuucacuagagggauucaagcuaggguucugcauucagaugugcuagauguggaaccauaguugugcuaugugcuaggagucugacuuuguaugauuuaccuuaucugguucuccuuauucaucuaaaaaauaggauuaguaaugucuguuuuagagagugucugugaggauuaaauaaacaugucuggcacaugguagaugcuuacuaaacauuaguuucuuccuguguucuugguuacccacagaguuaacguucagaaagcaucuguuaccucaguaacaauggacguagaauaugcuaacucaggugauccagaguauaugcauauauguauauaaguuacugaaucugacagaaggaagagucaaggauguuuuggugacugaacucuaaagcagcauaagcucguggaagguaauaaauagugaaacucuggaagcaccaaguuuaaaaggaaaaagagucaaugaagcuaagagauuacaauuugauaacaaaugacaucauauaccaacacuuuaggaaacaacugucaggcagaacuuuaaaaaaagauuuauggaaauuguuuuaaaacucauuauuaaauuuggcagcacauccucaacuuggagagaaaggaagaggcaaagaaaucaaaggcucugacaguaauuuauggauguaggcaaaugauaaauacuuccagagcuugaaauuuacaccaucauuugcuugaaaguaaccacuuguuaacuggauuugggaaguaaguuuaugacauugaccuacuuccugaucaucagcaaagaagcugcauuauggaagguccugccuggccagcauuaaagcuucagaguaacagugggcagagaaggugcaggaagcugcugccucuagagcuggagaugguaacaggcuaucuuuaucuuacugagccuggaggaaaagguucuaggaaaugggaaagaggagcggugucaggcauuuggcacagcugucaguggauggggcuuaauuggauugaugggcugugguuaucccacagauagguuaaacccagcagcauauccaccgccgaacugggucuuccagcucccuccucugugccuuagcccagugcauggccccauugucaaccacugcuugucacucucaucugccuccuuguccucauguuccagcuuucauuacuuaccaggugcaucccgucuccuccagaucuucaaauccaucuacuuuuuccaaccccuuucccacguggaugaugaccacagcucccaacugacaacuuuuacuccuugggcucauuuuuuucaccagcgugcggucauaaugguguuuuuaaaguguguauuuggucuggucacuccacuccuucaguaacucccugguucucuggggauaaaaauccagacuccuucaccaauuuuuucucacugcuucccccuucuuauggugcgucucaaaugcccaguaugcuuuuuuuuuuuuuuaaauuaacccuugugucuuugguguacuuugcuucuuaugcccuucgccugcucccuuguuagccuggguaacuaacccauucuuccuggaggcacuuaccuggggcaaaagccucugacuugucugccucaugccccacccccagccuuuaacccugggggccacagggccucaccaucguguuucucuuaaggaacaccuacaucgaguugauucuccauaaauauuuguugaguguuuaauggaguaaugauaguggacucaaaugccuuuuuucuagcuuucaggguguugucauuucauaugcuuuucagcugucugcaacagcagauuucauaaauauugccccauaguuaaaagaccuagucauuugcuggguauuaaaauaucagcaauccaagugguauuuuucccguuccauugauagugcuaauucaugccucucaggagaggcugguugcuaggagauucuuucuuugaguucauuugcauuugaguuaaugguugguccuugccaguuuuuccuuuucuuuccuuaaguuguugagaagagguauuucauuugaucauucuuuuauguuccuuucauuauucagcuuauuuguuaaugacuguugaacauuuggacuuuaugcaugguagggcgaguacuguucguguccuaaugugguacugauuucacugaccgauggccccuccccgccccgccccugccuuugugcugggguccgagcaccgauaguuuuaaccagcauuguugcucugaucguccuaggacccagugaggucgucacguauauuucucugauacaugauuuuucucuucuccuuucucugaauuuaaacuugucacuucaccuucacauuuucuuuuaaugaauauccuucuaaacauaaacaccagcagucaaauuugaacuguugagaugucaucagugguuugucccucuguccucaggaaaaguacaacuucuuguucuggcacccagggcuuuccaagguggccugaauccaccuugcaugcuuuccuuacccacagcuuuucuucuucaacugucuugccuugcgugucuacuggcaguucccuaauaagcuuuucucuguccguuaugugcuuuggccuguccucuuccuucuagcugagaugcaccuccucugagcaguccuccaaauaaaaauccagcucugcgugaggcccgucgaaaucucaccugcucugugcagucaucucuccaccaguuagacuuggagcacugccuaucauugcuguaugugugauccuuacugcauucugccuugcuucaggauuaucagcaggguagggggaagagagagagagagagagagagagagagagagagugugugugugugugugugugucugugugugugugugugugucuguguuugcuguggaaagaagcuccuugagagcgaggacuggaucugaaauaccucucugcaguccauucaguuccauuccuuaguggcauauagaagacauuuuaacuaauuuaccggcucauuucuguagucagcacacauuuuggggguauggggggcacacauucaaaccagugguuauagggauauaagaaguacacaggcauguaccaggcuuggugggagugggagagaggcacggaagugagccuaggagggucaggaaggcuuccagggcuuaggaguuugccugacacuugaggugagagccaguggcuuccccuagagaggauauucagggcagaggggcuggccuggucaagccugggaaaaacugaaagaagauugugugguggcaaaguugcuggagcagaaagugugcggugaagagauacgggaaacaaggccagacuggaggagcaggccagcucuguaggggugaugaucagguauggcagcuagcgagagcuugccagucccaguguugugaauuggagagaguucucagguguguccgccugugccugugcuucuaucaagccucacacagaagggaacaggcacuagcauuuauccuguugcucccgcugucccucacccucaccuggacuuuccguaacccucuuuaugguuuuccuuaccuggccucuggugaauguggcagugagcaguagagugcucaaaagggagcaguguuagggugaagcaagguuccuggcaaagccgcaacuaaauuuuaagguuugguuuugugguguuuuuuaaauagagacagggucucgcucugucacccaggcuggaaugugguggcacagccacagcccacugcagccuugaacucauggggucaagcgauccuccugccccagccucccuaguaguugggacuagacgccugcaccagcaugcccagcuaauugaauuuuaaaucuuaaaaugaaaguagguuguaaaaugaacugugaccagacagugauaaucuuuaaacuuuccaaaaggauugauaauucugugagcaggggccauaccuguuguguuuacugcugugugcccagcucagcaugcaccccauggcuugacacagggcaggguauguuuaggugugaauaauuguauguacagaugaguauauacgugaguagaauguauuucuauacauuauagauguauuuuggcuuuuuauaaucuauauaaggucuuuacacaucuuuuguuaaauuuaaugauguuuuguuuguauugcuuaguaaauggauuauuuuuuauugucauuauuaguaugcuaauuguuuauugcucugggccauaguguucucagugaauacccuguuggccuugggagguacaguuucucauugugugggacacugguguggaaaaauagcagccacuugacaugugacaacuccacacauugcugaauacccccuagggugaagaggaugacauugcuccuuuaguugagcacuauugcugggauaaaggaaugaaauugauuucuauaugucaguuugugucuagcaccaauagauuuuuaaaccaucuuauauuuucuguguagaggauuauaugcaaauaacaauaauuuuguuucuuuccauuucaauaaauuccuuguauguuacguuuacuuguuguuuugcauugacuagggcccccaauacaauguugauaguagguggaucccaguuucauuccugacuugagaaaugugucugauguuucaccguuaaguauacagauugcuguaaguuuuuggcagauagccuuuaucagauuaagauuugcugagaguuuuuauccuaggugguuauggaauguagagccccuguuaguuggacuuaguucauucuauacaaugccuaacucuguucucugugcuccauucuaagugauuuccucagaucuguuuuucaggucaccaguucuacauucaggaauaucuaaccugcaguuuaacucaucuauugaauuguagauuucauugaccauguuagccauuugggcugcuauaacaaaauauuauagacugaguagcuuauaagccguagaaauguauuccuuacaguucaggaagcugguagauucaagaucaaggugcuggcagauuugguaucuggugaaggucagcuucccgguucauagaugaccaucuucuuuuugguguaaccucacauggcaaaaggggcaaggaaacucucuggggccucuuucauaagggcgcuaaucgcauucgugagggcucugcccucaugacccaaucaccucccagaggugccaccuccaaauacugucacacugggagcuaggauuuaacguaugaauuuuggggggacacaaauauucagucuguagugauuguguuugcaugcauguauagacguguguguauaugugugugucucuaugugaauccuacaaacaugguucuuuuuuaaaacucccuuuuauuuuuuucagaguaucuuuucccccuuauuuuaaaauuuauuuuguuuuucaccacugugcacaaauucauucuauggucuuuaguuaguuuuauuaucucaaguuuuugagggucugaucuugauauuuuugaguuucuugacucuugcucaagagucaugagacuauuuuuuccuccuguguguugccauuuuagauggugagccugucaucggaggacauaaucugguggaauucugggagacagccugcuuuagagugguuuauaauuuggccaauuuggugugaauuucuuuuccaggaguuuucugggcuacauguauaaaguagaaugucaaaaaccacauuagagauacagacagacugacaguuaccaguugcugggagauugggcaguugcucccccugccagcccagccuccuuuucauuuggguucauagauacuuuuucuuaauucagguuuuugcuaagaucauagcucucugaggguucuagcuauauguaaaagugucaguuccaacuccuguguuauauccuguccugcaggaacguuaaaauaauagugucuucaaaccaagauacuucugagaguaaaggggguuagaauucuuuauuaugccagaucacuggugugaacccgcaugugugucaccuuagucaaaacccaagaccagcucacacaacuggauagccccuguccugccacagacuucaguucucucuuugauucgggccuuaggccguugacccugcuuucuugccacacuuauaggcauuuaaaaggcuguauuauauuuuaacucacauuacaaagugcauguagcaugagagcuuuuagguuaucuggucuguguauuggcagaauaaucugucuuuagucuuaacauuagcaucuuuaucuccuugauuaaucuuaagauagaauauuagauacauuaagauagaaaauuagaaauaggacagcagagaggaacuggggagggaagaagggaaaacggaaacaguuauagcuaggaaaagagaaggaggagaagagagacugagagauggguuggaaagaggaagauggagaggcagaacgggagauggagagauggacagacagggagauggagagacagacagacagggcaguggagagacagauagacagggggagauggagagucagacagggcaauggagagucagacgggagauggagagacagggagaagacagggagauagggcacuggagagacagauagggagauggagagacagggaaauggggagacaggaagauggagagacagacagggagauagggcacuggagagacagauauggagauggagagauagggagauggagagacagggcgauggagagacagacaggaagauggagagacagggagauagauagggcaauggagagacagacagggagguggagagacagacagggagauagggcaauggagagacagacagggagauggagagacagacagggagauagggcaguggagagacagacagggagauggagagacagacagggagauagggcaguggagagacagacagggagauggagagacagaugagauagggcaauggagagacagagagauggagagacagggagauggagagagaaagauagggcgauggggagacaaggcaguggagagacagacagggagauggagagacagagagggaaacagagauagggcaauggagagacagggaguuggagagacagacagggagauggagagacagacagggcgauggaaagacggacaggcagguggagagaccgacagagggaaggagaggcaaacggggagaugcagagauggacagggagauggagggacagacagacaaacagagcagaugacugagggcuggaugugugugcacagagagcugcacacagagacacauccauucaguuagcaacccacuugcggagagacugcccuggaggcccacacauguagacguguggacacagagacacacacuugcaaagacauacacggagaucaccugcaggggcaccaguggcugaaagagagugaaaauaggaaacaacuaaauauaaguguguuaugauaguccagaaaauaaacuugaagucagugggaguagaaaagauggcuuuaggugggauuaaccagaacugcaguagcagcacuuggcugcggcagccacagcaggagcuguuguucucgugggaaugcugaugugggcugcugggcucaggcuucccuggugacagccuccuggagcaaaccagccuggucagcuccugauuucauccuguugacacuaacaaauggagauaaucacugauugugaggcaguggcagggacaauaauagcaacaaaagaaacaaucugauuuaaaauuaacaggcuuuguugauuucauaauugccucccacaucauagccagauuuggaaaugugacuaccuaaaauugaaauuagggguuugagauuuuaaccauaucaaauauugcucaaaagacaggaaauagaacuagugaugucuucggaggguaacuguggggcuguaccacaguuggccucccaguugaaacucacuuucugugcaucuugaaguuccagaaccuaucaaggaaucacagaacccuugauuccuuugggcucugcucacugacacugucuagaccuaaguggacagcccaucuuguggagaugauuuauuggagugauuaucaguuuggggcguggcagugcagagaaagggggaugcgaggggcuugcgagggggaggggauaguuugacuuuacaggcuugcuuuggcgccuccucuccauccagugcuguuuaggucuuacugugcuuuucugcuuuacuuuuuacuaguuuuucagaccauuaaugauagcuuaugauggcugcuuuucuuagccacuaucuuauuaccuggauccuuuauaacacuggaagguaaacuuggugcugguuuaaaagccaagaugagcaauuguggaucacuguuacugugacaucuguggaaaagacugaagaaaaugagguugaccaguauaagagaauacugccgaauuaaacugugccacaugccguuugauuuaucuuuaguuuugaauaaaggcauuguauuuuacuuugugcucagcugacacauggacugaaagcagugugaccgaacacucaguugucaccucagagucuggcaggaggcccuuagaauaaccauucuuugaauauuuuaauucagcugugugucuuaauagguaucaacaucauaaacaaaaaauaggcuaagacucugcuuccuaaauauuagauugaagucagcucaggggauuccaugacauuccuuaaaacugccuuuuccucuaaagcauuacuuccucagguuaauuuauggauuaucuugccauucuuuuaggagguaggagacucuaagucaggaguaugcaacaccaaacuuuuaaacaucaauuucaagccagcacuccuuagagaacagaaauuguguaaugaaauuuaacaaucuuuagugucucuaagccuaacauuuauguauugagaguuuuguuucuuuagcccugaucuaagugcuguggcuuaauguuuuuaauacccauuauuucuggggacccuauugugugguggacauccugcccauugcgcuaguaccugacuccuaaucgucauagcaguucucgaagcuagguguuauuagcccacuuuguagauaaggaaaaugagaucagaauaguaucacaauuugcccaaggccauagagcuagcaaaagugaauucaaaucuggaucuuuuacauuuuaaaauguguaauucuuuuucuacuguuugagcaucucuuuggggaaugaaugauuccgagaacuccuggagagucuuauuuucagcuuucugaauguggguuauagagucagucuugauggguuuuucauucuuuuuguuuucuccucuaguaccuuauaccuucaacuuagaaggaugcucuuguagggcugggacuugaucucuuucguuacuucuguauccucaguaccuguaacucagcauuacuuaguaccuaguagaugcucagugauuauuuguugaaugaauggaugaaugaaugaaugaaaaccauggcagaauggacuggcccugacaaccucucaguauauacucgugacaucuaaugaaaugcuaauuuauccuaucacaguauaaucgugaagguaaaugugauagaaaugucauaggaugcauuuugaagucagcuaaauacauguuuugucucaccauuaaucgacuguagcccuuugaaaaccaagaaugcuuucuuaugaccaugaaauaggucauguagaauaggaaaguuaaugacacaagugguuacuaccccaaaguaguauuucgauacgaauagaauugaacauaauaccuagcauauaguggagacucaaugcauguugguccauuuaacugaauucaacggaauugccuugcuaggaaaaaaaaagcaauauuuauuuuugacucaaaaaauuaugaguccagugcuuuguuuaagcuauucucuuguaagcaugcuauucugugucucccaggauugggucacauauuuuauucuucauuguucccuagcugguucugcacucugaugugucauguacuucaucuugacucccugaaucaauuguaauuuuguguaggauaaaccaggccguacaugucucugucccucccggaggccggccacaugcccaccugccucguggcagagcucucggcuucuguguggugucgucuuuucucagggauggaaaugcucugguggggcuucacucuuucaguaaggcaguaguuuguguuacaaugacacccaguagaguaacuauuuaaauuuuauaaguucuucuucuucuuggugaguuagcacaugagguauuucaagagcuuggugggagcaggugggaagagucagagcucucugcacgcugcaaaggcgggucuaagggaggcccagcugugugaaguuccaagaggggcuuugugaggggugagggauaugugauuuugggguggauugagggaggaucaugugaacaauuaguguuuagauuauuacuuuaaaaaugaauaauaaacuguuagagcugacuucagcaaaguggucagcauacuuuagcagugaaguguauuuugucuauaaucucuaauuuuaagcucaguauuccauuaauuuauuacuuuuaauuuuugucauugaaaaacaucauaaaaauguguuccuuggggggaggagccaagauggccgaauaggaacagcuccugucuacagcucccagccugagcgacgcagaagacgggugauuucugcauuuccaucugagguaccggguucaucucacuagggagugccagacagugagcgcaggucagugggugcgcgcaccaugcgcgagccgaagcagggcgaggcauugccucacucgggaagcgcaaggggucagggaguucccuuuccuaaucaaagaaaggggugacggacggcaccuggaaaaucgggucauucccacccgaauacugcgcuuuuccaacgggcuuaaaaaacggcgcaccacgagauuauaucccgcaccuggcuuggaggguccuaccccacggagucucgcugacugcuagcacagcagucugagaucaaacugcaaggcggcagcgaggcuugggggaggggugcccaccauugcccacgcuugcuuagguaaacacagcagccuggaagcucgaacuggguggagcccaccacagcucaaggaggccugcgugccucuguaggcuccaccucugggggcagggcacagacaaacaaaaagacagcaguaaccucugcagacuuaaaugucccugucugacagcuuugaagagagcagugguucucccaguacgcagcuggagaucugggaacgggcagacugccuccucaagugggucccugaccccugacccccgagcagccuaacugggaggcacccuccagcaggggcacacugacaccucacacugcaggguacuccaacagaccugcagcugaggguccugucuguuagaaggaaaacuaacaaacagaaaagacauccacaccaaaaacccaucuguacaucaccaucaucaaagaccaaaaguagauaaaaccacaaagauggggaaaaaacagaacagaaaaacuggaaacucuaaaaaucagagcgccucuccuccuccaaaggaacgcagcuccucaccagcaacggaacaaagcuggacggagaaugacuuugacgagcugagagaagaagucuucagacgaucaaaauacucugagcuacgggaggacauucaaaccaaaagcaaagaaguugaaaacuuugaaaaaaauuuagaagaauguauaacuagaauaaccaauacagagaagugcuuaaaggagcugauggagcugaaaaccaaggcucgagaacuacgugaagaaugcagaagccucaggagcugaugcgaucaacuggaagaaaggguaucagcaauggaagaugaaaugaagcgagaaggaaaguuuagagaaaaaagaauaaaaagaaaggagcaaagccuccaagaaauaugggacuaugugaaaagaccaaaucuacaucugauugguguaccugaaagugauggggagaauggaaccaaguuggaaaacacucugcaggauauuauccaggagaauuuccccaaucuagcaaggcaggccaacauucagauucaggaaauacagagaacgccacaaagauacuccucgagaagagcaacuccaagacacauaauuuucaaauucaccgaaguugaaaugaaggaaaaaauguuaagggcagccagagagaaaggucggguuacccucaaagggaagcccaucagacuaacagcggaucucucggcagaaacccuacaagccagaagagagugggggccaauauucagcauucuuaaagaaaagaauuuucaacccagaauuucauauccagccaaaguaagcuucauaagugaaggagaaauaaaauccuuuacagacaagcaaaugcugagagauuuugucaccaccaggccugcccuaaaagagcuccugaaggaagcacuaaacauggaaaggaacaacugguaccagccgcugcaaaaucaugccaaaauguaaagaccaucgagacuaggaagaaacugcaucaacuaacgagcaaaauaaccagcuaacaucauaaugacaggaucaaauucacacauaacacuauuaacuuuaaauguaaauggacuaaaugcuccaauuaaaagacacagacuggcaaauuggauaaagagucaagacccaucagugugcuguauucaggaaacccaucucacgugcagagacacacauaggcucaaaauaaaaggauggaggaagaucugccaagcaaauggaaaacaaaaaaaggcagggguugcaauccuagucucugauaaaacagacuuuaaaccaacaaagaucaaaggagacaaggccauuacauaaugguaaagggaucaauucaacaagaagagcuaacuguccuaaauauauaugcacccaauacaggagcaccuagauucauaaagcaaguccugagugaccuacaaagagacuuagacucccacacauuaauaaugggagacuuuaacacccacugucaacauuagacagaucaacgagacagaaagucaauaaggauacccaggaauugaacucggcucugcaccaagcagaccuaauagacaucuacagaacucuccaccccaaaucaacagaacauacauuuuuuuucagcaccacaccacaccuauuccaaaauugaccacauaguuggaaguaaagcucuccucagcaaauguaaaagaacagaaauuauaacaaaguaucucucagaccacagugcaaucaaacuagaacucaggauuaagaaucucacucagaacuguucaacuacauggaaacugaacaaccugcuccugaaugacuacuggguacauaacgaaaugaaggcagaaauaaagauguucuuugaaaccaacgagaacaaagacacaacauaccagaaucucugggacgcauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaaaucaaugaauccaggagcagguuuucugaaaggaucaacaaaauugauagaccacuagcaagacuaauaaagaagaaaagagagaagaaucaaauagaugcaauaaaaaaugauaaaggggauaucaccaccaaucccacagaaauacaaacuaccaucagagaauacuacaaacaccucuaugcaaauaaacuagaaaaucuagaagaaauggauaaauuccuggacacauagacucucccaagacuaaaccaggaagaaguugaaucucugaauagaccaauaacaggaucugaaauuguggcaauaaucaauagcuuaccaaccaaaaagaguccaggaccagauggauucacagccaaauucuaccagagguacaaagaggaacugguaccuuuccuucugaaacgauuccaaucaauagaaaaagagggaauccucccuaacucauuuuaugaggccagcaucauucugauaccaaagccgggcagagacacaaccaaaaaagagaauuuuagaccaauauccuugaugaacauugaugcaaaaauccucaauaaaauacuggcaaacugaauccagcagcacaucaaaaagcuuauccaccaugaucaagugggcuucaucccugggaugcaaggcugguucaauauacgcaaaucaauaaauguaauccagcauauaaacagagccaaagacaaaaaccacgugauuaucucaauagaugcaaagaaggccuuugacaaaauucaacaacccuucaugcuaaaaacucucaauaaauuagguauugaugggacauauuucaaaauaauaagagcuaucuaugacaaacccacagccaauaucauacugaaugggcaaaaacuggaagcauucccuuugaaaacuggcacaagacagggaugcccucucucgccacuccuauucaacauaguguuggaaguucuggccaggucaguuaggcaggagaaggaaauaaaggguauucaauuaggaaaagaggaagucaaauugucccuguuugcagaugacaugauuguauaucuagaaaaccccauugucucagcccaaaaucuccuuaagcugauaagcaacuucagcaaagucucaggauacaaaaucaaugugcaaaaaucacaagcauuccuauacaccaacaacagacaaacagagagccaaaucaugagugaacucccauucacaauugcuucaaagagaauaaaauaccuaggaauccaacuuacaagggaugugaaggaccucuucaaggagaacuacaaacugcugcucaaggaaauaaaagaggauacaaacaaauggaagaacauuccaugcucauggguaggaagaaucaauaucgugaaaauggccauacugcccaagguaauuuacagauucaaugccauccccaucaagcuaccaaugccuuucuucacagaauuggaaaaaacuacuuuaaaguucauauggaaccaaaaaagagcgcgcaucaccaagucaauccuaagccaaaagaacaaagcuggaggcaucacacuaccugacuucaaacuauacuacaaggcuacaguaaccaaaacagcaugguacugguaccaaaacagagauauagaucaauggaacagaacagagcccucagaaauaacgccgcauaucuacaacuaucugaucuuugacaaaccugagaaaaaccagcuauggggaaaggauucccuauuuaauaaauggugcugggaaaacuggcuagccauauggagaaagcugaaacuggaucccuuccuuacaccuuaugcaaaaaucaauucaagauggauuaaagacuuaaaugugagaucuaaaaccauaaaaacccuagaagaaaaccuaggcaauaccauucaggacauaggcaugggcaaggacuucaugucuaaaacaccaaaagcaauggcaacaaaagccaaaauugacaaaugggaucuaauuaaacuaaagagcuucugcacagcaaaauagacuaccaucagagugaacaggcaaccuacucaucugacaaagggcuaauauccagaaucuacaaugaacucaaacaaauuuacaagaaaaacaaccgcaucaaaaagugggugaaggacaugaacagacacuucucaaaagaagacauuuaugcagccaaaaaacacgugaaaaaaugcucaccaucacuggccaucagagaaaugcaaaucaaaaccacaaugagauaccaucucacaccaguuagaauggcaaucauuaaaaagucaggaaacagcaggugcuggagaggauguggagaaauaggaacacuuuuacacuguuggugggacuguaaacuaguucaaccauuguggaagucaguguggugauuccucagggaucuagaacuagaaauaccauuugacccagccaucccauuacuggguauauacccaaaggauuauaaaucaugcugcuauaaaggcacaugcacacguauguuuauugcggcauuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucgcaagaacaaaaaaccaaacaccgcauauucucacucauaggugggaauugaacaaugagaacacauggacacaggaaggggaacaucacacucuggggacuguugugggguggggggaggggggggagggauagcauugggagauauaccuaaugcuagaugacgaguuagugggugcagcacaccagcauggcacauguuuacauauguaacuaaccugcacaaugugcacauguacccuaaaacuuaaaguauaauaauaauaaaaaaaaaagaaaaacaucauagaggugaacugaaaccacuacgcucuuccagauguauucuaccucaugguaaacauuggggauaucauuuuuccugacucugcaaugaggggaucuuuuuccuucauggcuaaaauugcaguguuugucaugcuuggcuucagugugaaguuagggugauaaagcagguucauuuugcuuggcuucugagaaugguggcuuuuccccuuuuuuuuuuuguuccccaaggagguagaguucccaugauagaacacauauuguaauuaccauaguuuucuucaagaucuggccuguauucaccucauccgugaauuucacaucagacacuggucuugaagucucugaacucugcaagucacuugcugugugucaccgcacuggggagagaugacaccuggccugucaucauuagggaccacuuguggcccagggagcauucuugucagacuuagaguuauaacuuggccaugaaggaaacgugacaggguuuucuuagccucccacuuggugcucaccuuucauagggagagugugagacauaauccugcugcuuggcuucccccacagagaacaaguggucauuccgccuuuccucgcugcagcccucuugaggaggagcggagaggcacgggcugcugguggagggcgagggugccaucgcucaggagugccucugagcuggucaguuuucacccugagcuucuaugacaguggacacugccgaggggagacucaucuuggugacucugugugaaucuccucugaauucagggagagcuucagggcaucuucugggaacaccacccuguguuggagaggcaguccagccacucagagggucaaaucaguuuucacaaguaguuuuuaaacaaaaguuaaaaaaagcaaaccaauaggcugggcacagugacucauaccuguaaucccccagcacuuugggaggcugaagcaggaggaucacuugagcccaggagcuugagaccagccugggcaacacaguaagacucuguagcuacaaaaaauaaaaaaauuagccaggcuugugguacaugccuguagucucagcuccucaggaggcugaagcaggaggaucgcuugaauccaagaaauugaggcugcagugagccaugauugcacuacugcacuccagccugggugacagcgcaagaccccaucucaaaaacaaaaaaacaaaccaaugaaaguguuuacagugcauaaaacucagaaaacaaucacauuauucaaagauaaccaaauauugguguauauucuuuugauguauuuucuaugccuacacauauuuucccccaaaaggguaucauaaugcuuucgucaccuaaugacauacgguacaucgguuuccgugucaauaaaauauucuucaugugauuuuuagaugguaugauagcauuucaccauccaaaugauaguacuauuauuuacuauuaaaagugucccauuauuggaggcugucccuuagaaucugugauauccccauuauuaacaacuuugagggcuugugaacauaacagcauagaaccccaaucugcaggcaguuaggggauugucuuccaggacauucuuggacuuaggagcaggaucucaauucuccaagaaaugacagucuuguguuauuuugguuccaaacaggaaagcuucacauuuuuugauugugguguuccauaaaccucuacugauguauuuuaguaauaaaagugggucuuaaagaaaacuggucugguagaugagucucaguugggcaugaagggaauaagguaguagucgcuaguccagaugcugucugaggccaaggauugauuuucuggugucaccuugcuggcaugugggaacugcaugcaugauguguuuccacugcugcuuuucuaggggacuauguguuaaguuucuuggacauuaaaagcauccauccugguuaggauuuuauauuugcccucauuuugauaugcaaaagcccucaaaacauuuaguaacgcauuuguuauuuaaccccuuuuauauccuaguugagcaggaaaccuccuugcagagucauuuucaccaugaaauuucuugacuaacuguaguucaaauugaagcaaauucaaaaaauucagugucucuuccacccaucuuucuccuuccaucaaacccccuuaauagcuuugacucugaaauuauuguguaauguuaacagaaguuauauaauacaagaaggaucagauaauugaaguagcaucuguuuaagauucaauagauguuucuuuaaucagguacuccgggagaaguuaggaacuggcccaguagccauuggcugauguaggaaaaaaaucaccacacuucagaaguuugcucaggauaaaucucuuuguggauaagugauuagguguugccuccaguguauauuuauuuuaccauccuuuucuuucuuucacuuuaucuuugauugauuauuaacacuaaggauagccccuucuguuuuucuuaguguugauuagguuucucugcaaauuuauugaaauaauugaacccaagaaguuuuauucugacucucuaaguugguuugaagaccauucuggcuuuccaguaauuuugaucucuuuccuucccuaacuuaauucuucuguuuugcuuauuuucuauggaaucaguuuuuuguuuuuuguuuuuuaaacuggaaaaacucuucugugauggcauucuaaguuguuuauaccauccugacaaguuguagaccuuggagcuuguucuaagaguucuaagauugcaaaaucaaaugcuugugaagaccugccaguaaagcagagagggguggucacuggggagcuggagucuuaugucccauaagggacacagccacugugaaggggucacagcugcuuggcuucagccaguuguguccacuggggugggggcucaguguugccaaacgaucugauuucucaagggaagcuggaaauagguguguguguguguguguguguguguguguguguguguguguguguguguguuauguguuugaaaucucuugauuuuuauauguugucuuaaauguuuuuuaaaaaguagggaucaaacaaaacaugucuggggcccagauuagguccacaaauggccgauguguagcuuuugcucuaagggacaaguuuugcuuuuucagaaaauaauuaagcagaguauguggaugcugauucgcccuaacgaguugagauauuccuauuuuaaucaccuugaauaaggaacuaccauguacuugacuguaauguuucgaugaaucuguuguagcacauaacucucuuuaaucacaugccauaacucuguccugcuauuuuauaguauauugggugcagagcagaauuuuuucaggagaaaguggaguuuuucuuaggcuaauagaugucuagccaacugucuaauuuuuauguaugacuuucauauuucuaaauagcaguguucugaauugaaccaaaagaaucuauuaacauaauagcuauagguuuccagaauccuugaauguauuagcaauuuaaaguugaaaaauaauugagucaaucuugauuccucuuaguuaucagaugguuuauucauauaauuuauuuuccuuucuuuaaagauuugaacauggaauucaauccuucagaucauccucgggccagcacaauauuccucaguaaaucucagacggacgguagguccuuaauuuauguuucuuuuuguaaaaaaggcucauguugguacuucgccuaguguugauuucccacaggauuuaauuuucaauaugaaauagagucccuuuagugacccacacauauacuguuuaaugguaguucucuugggauuuuuuucuuuugcaguguuauguuuuuagaauuuccuauuugaagcaucuauccucauuuugucaaucagcuauauuauuucuacauacauugugucaugggaguuucugcccuaagagucagaaauuuuccuuuuagaauugauauuugcauaauuucucauaagaucagaaguauuuguuaauuuagacaguauguaaaagaaagcaaaauauaauccuuaaauaaaaguaccaccaacuagcucuguugugucaguugagagcugaauugaacccauacuguaggugcagauguuuucuuucucuuuuuuuuuccaccucuauaauaauaacaaccauaucuaaguuuauucuuguagaucguaccaucuuuaugguucaucccaggugugugugggauuucuucuaggaguuuucucucuuuucagcccccucccugggcauuggcugcagaggagagagaagauaaaacuuauacaauguggcaaacacacaucuucauuggauuccuauagaaaaagguggcaggagaaacucguuaaaugaugauaucaugaccaggauauuacuuuaggaugcuggaguccuacaugauucuaucccuaacuuuuugggcaauugcuaagcuuuaauucagagaagauccuaaauggacuagaaaauaaccaaacauguuuaagauaguaaguucauaaaugagaauugauaacacuucaguaacgauuagguaacaauuuuggcaagguauagugcugauuuaauguuauugggaaucuuuaguuaggcaagccacugacuggauuugaaaguuugauguguuuaugaaaaguaaacguuuccaagaauaaauuaguauaggcaucuaguauuuagguuggugcaaaaguaauuucaguuuuugccauuaaaaguaauggcaaaacugaaguaaguuuuuggugugcuggauacaaaagaaacauuuuuuuccucuggugaagcaggaagccauugggaggggugggauaauacaaaggaaggagagugguagugaagauggguguuuggaaccaugaaaaaagagggucaaaaccaaguuuugcagacacugauaguacuauaaaaacaagaaacauaguacuauaaaaacaagaaacaaagcuggcuuacuuucggguuucauucuugcuucuugugaacucagagugcagaccaacuucauucagaagaugugcuaacaagauucccaugaaauugcauuaggccucuaaguggauuucccauaccuugguuguccugguagaaggaaacuugaccuaagucaggguuguuccagacuuagcuuagggaacuguaucuucccucgucaccuuugcacuagauaucauucccuuuccucuucuggaacaucagggcaucaauuacucugaccccucuguuuauugcuucaguuucucuuuaaaugcuugaucuuucuacucaacauguaaacauaaaugagucucauagaaaaagggaaaguaaccaauaccucucuucaggugaaagcuucuaugccauuucuaccucucucccuguccacucucccauugggaucuuccuccuaucccugccauucuguggagcauagcaguagagugaccuaaggacauuuucucuucuugggcuauugcccauguauguggcacuugcugucaccaagaauuccgugcuuuuuaaaaacuuuuuggccuucuguuuucagaugggcaguuugcugaaauuaagugcuucuaaugaacaauugcuuuauaaauaauuagaaaaaaucaauuuuaaaaauagguagauuugggcugggcgcgguggcucacgccuguaaucccagcacuuugggaggccaaggcggguggaucacgaggucaggagaucgagaccauccuagcuaacauggugaaaccccgucucuacuaaaaauacaaaaaauuagcugggugugguggcgggcaccuguauucccagccacucaggaggcugaggcaggagaauggcgugaauccgggagguggagcuugcagugagccgagauugugccacugcacucuggccugggcgacagagcgagacuccgucucaaaaaaaaaaaaaaacaaaaaaaaaaaacacguagauuugguaacuuuaaugaauucuuuagugacaugauaaucagagaauuggcuacuuggugaauuggcuuuuggcaaauugguccuaagaaauccugcccuucugaaagcuccucagacaucuucauaaacuucuauuugucccucuaauguaguauuucccagggucucuuguuuacccucuuaucuuuuugguuugcacacaguuccucauggcauuuaugucaacugucgugucuaaccauauuuuucucuguacuguucaaaacccacguauucagcugccugcuggacaucuuuacaaugaaggcuguagguuccccugacucaguaugucccagacagaacuuaagaauuccaguuaacuuucugcauuuucuacccugcccaggucccuaagccaaggagggcuuuggauuuucguagacucuccucuucucacaggugggcagcggugcuggagauacauuucuucccagcuccagguucagugacaucauauuggcggcuugaaauagccauaaucagaguauuuacaccauggaaauugguaaaugcugcaaaucagagcauuuuuuaaacagaugacuguuaaacauuuacuaguacaccauugcauccaggcauuccaagguguacucaguuucaccucuuacccagccuugaaccugaccacuauuuccuauugcaguugcugccaccuuaguucagacucacaguuccccacuuguguuacugcagcagccucuagacuggacucccugcccuugaccuuaucccucucuagucccuggucugugcugccgcuagcugacaggacuucccgugaaucagauacgauugugccacuggcuuccuuaaccuuucucaagggcuccccaguugcuuuagaguuaaauuucaaacaucuuagcauggaauaugaggcccaucgugauccagccucugccuuccuucccagccaacuuccucucuucuuuguguacuucugugcuuccgccauacauacugaaucacuugcuuccucaagucugccacuugccucacaccuggauuucuccuucccuuuuucacacagcugauuucuucuguccuccaggcuccuccugcugucacuuccuccuugaggguuucuuugaucccucagccuggguugaguggggcuuuggugagcucccauaggaguagccuguggaucuuucuucaucaucagaaccauacuguggaauuuaaaacgaccuuuuugucuuugccacccgcuagccccuagaggaaaaggaucaugugauauuggaugucaguauuccuugugccaaccugacugguugaaagaaggaagaugacaaaaccaggaaacauucuugauuugauugugauaauucgucacuuggauaaacuuauauuuccauuacaagaccacaacugugggucuucuacccuauuuuuuuucuaguuggaagaaauauagucugagacaguaaggcauacuucuauuagagucuuuucuuuugaaucuggugauuucuccucuuuccuucauucagguuaauauacuuugacaguaguuuagauuugauuuguggauaggaagccaugauugggaugaggacagucauguuagggcagcugcugcuuggaccacagacaugcagcuccugggucuugacagcuccguguuucugcagaccccacauucucuuuccccucagcacuucaugaugugggaaacaaguugucggccaugcaucccaccucccagcuguucacuagacugauuuagauggcacuugcaugaugucaucagaguuuucgugauugcugaauuccuuuuccuucuggauauccaagagauuuaggcuggacguggaacuuuuuucuuguuccaagcaggagacuaggaacuccaacaaaacugguuaaguagccugcucaucagaccccuccagaggcugaagguaaggguauuuuauccaaagccagagugacugcuuucuuucuucacacaaagaggaugacauugcagacuuuguacaggagccacucagcagagaagggaccaagaguuccucauggggguagagaaguuugccaggccagagagaaguuagguugcgagaccugccaugguuuuucaugcuacuaucauuacuuguggggaagaauuguaguuccucauguccuuuccuuuucuguacuuauuuuaguucaucauuuucaaagaugugagagcuuaauauucuuaaauaauaugagaaagcagccaagccacaucuuuuuccuuuuaauuagugugauuuuuagagauuuauugucuuaacaaagaauuuggaggaaaaaacccuaaguuugcggaaucuguguuucucaggagucccuugaaauaauuaaaggaauaaaaacuauccaucccuugaguggcuugagccaaaguagaaacauuaaaauucagaaauaaaaauaugauucuuaguuuuaguugcacaaccuuuuagaaauacugaaauugaaaaaauauucuguggcuguccucauuggggucguguuuugguuaccgggcaguguugaacuuuugcguggugaaacaaccacccuuuuuguccuccucuuaucuagcauuuaggagcaacuuuccacugcccugucgggauugcuuuccuccgagcgcugccauggccuugcuguccucaccucacuugcauucccagcugucuuuggcucguucgugugugcaggugugcaggugcuggggugccccuuucuccagcugcccucaguugcucggugugucuccuucagggcaugucaagugccauagggaagaccuaagcuuacaccagugauuuucaugcuuuguuccuuugcuuacauacuauggaaaacaauuuugaaaaacugaagucccucaagcauuuuuacguugaccuuaaaauuuuuuuacccuaucaaagcacauaauuucugauggauuauaaacguugauauuuuaaaauaaacuggccuucuuuaacaaauauuucagaugaaauuuuaauaccagagugauuugauacccaccuucaguccuuuaaaaauguaugaacaugcuccuaacaguuggaaauuucauaucacuccuuuaucaucuugaacuuguauuuccauacuauuuucuccauaaaauguuauacuaguauaauguauuuugauuuugaaaagucauuuaucacacuaucauauucuuuucuauaaaaauaugaccuaggccgggcacgguggcucacgccuguaaucccagcacuuugggaggcugaggcaagcggaucacgaggucaggagaucgagaccauccuggcuaacagugaaacccugucucuaccaaaaauacaaaaaacuaacugggcgugguggcaggugccuguagucuuacauuuuaccggauaauuauuaaacaaaaaaaugaaauauuuuuuggaaaaacauuucuuggugagaugccucuauggguugauauuacuuauuacugaaaugaggcaguauucaucaucaaagccuuuguuuuuuguuuuguuuuguuuuguuuuugagacggagucucgcucugucgcugaggcuggagugcgguggcacuaucuuggcucacugcaagcucugccuccuggguucauaccauucuccugccucagccucccgaguagcugggacuacaggcgcccaccaccacgcccagcuaauuuuuuguauuuuuaguagagaugggguuucaccauguuagccaggguggucucgaucuucugaccucaugagccacugcacccagccaagccuuuguuuuuauagauguaagugcugaggaacuuuguucaucuauauaaauagauggaaauagaaagauuuuuauuauagucauaucauugaauucuuucuacucugucuaguuuauaugucgaaaaaucuccaagggauuugucagccaaaauaauuccuaauaaucagcuacaguucaguuuuguucuccuucuauuuuauugacaguagagaauuggaaucuauuugauuugcaaaagaauuacucaguuagaggagucccucauuuuuacaguuucugggaaguacaucaaaaaagguuuaccaaauguagcacaugacuuucaauuauaucuacuacucuuuacauuugguggcaccuaguuuaaccugauauccuugggagcuuugggagaauaaaucuaggccuaaucucagaacaccuucccugacugcugccccaccgcauucugcaugucccucugucgccgcagaggucuucagcguaucgugauuuauuccaagucuucauguuuauacaucucugccauucacagugccaggcccauagaaagaacucaaauauauguugaauggaggaacccccaccugcucuuuuccucugaacuaauguuuucagcuucucuuuugauuuaaauauauuuuccucagaaugcuacagguucuucauaugacuuuguuggcaaagccaggcaucauagucaauccagucagucaaaucagucuuacauuauuuuuaauuauguauuucuuuauuuguauuuuugccuaucacaccuguuucuuagaaucagucuuaccuucugugagaaaaagucugauuuuauuuuugcaauucacauaacauguuaaugugcaugcccauggcugccuuugugcuucugaucauaaauggccagacaggcgcaggggagugcacaccuaggcagcagucugcgguccacugcaccuucccgcccuucccuguguccuccugcacugcugcccucgcugcuccccgagcuuugcuugggggucuaacgccugaagaggcagguccuguuggaaaccauccucacugugauaucuguaaacccagagccggaagucuuuccagcaccccuccagggaaaguccauaggacaaagaagccuccagguugugccacaggaggcuggcaggagaugaaagacacaugaaccuggauugaaggugguuaccacaaccccaguggcugcuugucuuuccaucuggugccccuggagguuuucacaccaggucagugcaggccucagcucaggugugccugccuuucuuugugaaguugugagggaggaaggugguuccugcaucacaccucagcccauuugaaggucucuuugaauacuugguuugaggaccuuugcucuagucuagcccuaaguuacuugugacagaccauuucaauaaaagaauugcaaaaacuacuaccucaccugucuuucccucuaguuugggguguguggaggaggguggguacucaaaagccaugaguaguugagugugcagacagguccauuugugcgugcugggcugcccaugcccuugccaaccuguggccaccccaguggcagggaaccagccucuggccuccaguuaggcaaggcucuaggacccagcucugcguuaggccuuugucuuccauuagugggauuuauagucacauaaucucuugggucauaacuuccuauaaauugacaauggacacaccugucuccuuagaagauugcucuccugaagcaguagggugagucccaggcacacagcgagcccucagcaaugucugcucauugacuugugauguaacagguacuuugggauccucacuggggaucucuugagccagccucuuccaggaccccuggcaagaggagccaccccguccugccaguguaagcauguguuccagagauguuuucugccgccugguagacagccagucuggaaaucguacaugcuccuugggguuggcauguccaaaucagaagucagcgucuuuccucuccugccagcuuccucucccuugucaccuaauuuuuuauuuauuuauuuauuuuuuugagacgcucugucgcccaggcuggagugcaguggcacgaucucggcucacugcaugcucugccucccggguucacaccauucuccugccucagccucccgaguagcugggacuacaggugccugcccccacaccuggcuaauuuuuuguauuuuuaguagagaugggguuucaccauguuagccaggauggucucgaucuccugaccucgugaucccacccgccucggcccuccaaagugcugggauuacaggugugagcgaccacgcccggccucauaaccuaguuuuuaagaauaaacccauugcuugucugggucuuaaugggcacccccagaguccuguagucagugucuaagcugcaccuauaugcccugaauuucucccauccuccccuuccugccuggacucucguuuccuccuuccucacccagucuguggcgagccccuucccagucuccugccuccaucauguccucucucaaaccuuucuuccaccugucugcaaguggagcuucucuuaggccccucccugccugaccgucugucuccucaccacuggaacagugagacaccagcacacacacagagcccuuuucacccuucuuguggguccccuccccuccaggccugagaggccaucaucuguggcaugcucugcccgcagcaccugcccucuguccaugcuggcccaauggcugccucauaggugaugcuucccuguuucucuucauuccauugauugugauagacaccuuuccuuggcuggaacaccucugaaaucagcacagucagugacuugccaaaauuuaauuggcagcauuuuuuuuuucuuucuuagugacacauagaguaaugguuuaucagaaaaucaguggcauuacguucagugcaguuugcauauuccucuguguggaggugauuauuuuugugguauagaaauaaauagcuuucuguuuaucugcuggauugcaucuugcucauggauaggaacugugccuuucacauuccgcagucucugcaguggcuagcacauagaagaaacucacaagcauaggggaaugaaggaaugaaggcagggcaucaugacccacccugggcagacuugccguggcacgguggcagucuucccugaguaguggcuuucuguuuuguguugcagcuuuaccuucuccuaccuucccuagcuuuguuagaaaacgacacauccauuauuuagggacaggaggauguagguuuuuuuaggcucaggugguguauuugggcuuuccuauuccgggucagaacucagcaugaccgugccacccucaggccagcucuccccucuccccucugcagucuucucuugaggugcaugggggggggagggcagguaucagguuucuuggccaggccucgcccuguaagucagaggcgcucuuugggugccguggcucacuuuucuugggugcaucaccugacuccaguauuucaucccuugggcuuuccaguguggagaaagcugcugauauaguacaaacucagaugaaaucauuuagacccagaaugucaguuuucuccguaccuuuuaucauauccucucuccugaccugcgcuguucccagucagaacauugcucagugagcacagauccagaauagagguuagcagggauaauucccccaggcuggggggaguuugaugccccgucuaccacagccuuguccuacuguuagacagcaccuguggccugcugguagccauaaacuuacuuuucaauucucuuuuuaaaaacucugagcaccugcauuuccccuucaguuggcacagacugauaaccuuguaaauacuuuucauagcuuaccauguuuauagcuuaccuuacguggcuuauguuuuuggcuggcugccccgugacaucuagggaggcagcugaauuucaggauaaucugaugcagucaccauguaagaauaguuaaugccuuggaaugauugccugaagauagcgauccucuggaaucagacugccugaacuggaggcuuagauccaacacucuccacauaaucuuggugcauaugauccauuuccacaugauuucccucaaucucaauuuuaucacuguaaaauggaguuaguaccucuuugugagauugucaggaggacuaaaugcauaauccaucaaagcaccgagcccuguacguaagacaacacaaguucucaguaaauauaauccuuacccuagaguguagguucucauuugcucagcuggauugaguuucuucccugacuugggucugugccaucuucuagcuugucugugcugacagcuccucugugcugacugugacaccuugcaccagaacacugggccugaccaggaggagaagggauggauaccaggacaagaguagaggguggcuucugugcacugcugugcccagucccaucuuuuucuguguuuuccuugauaaagauagaucguggacccccacaucuuagaguugcuuccagguuaggcacaguggcucacuccuguaaucccagcauuuugggaggcugaguggggaggauugcuugagcccaggaguucaagaccagccuggacagcauagugagacccccccccccauuucuacaaaaaaauaaagauuuuuuuuuuuuaaagaaagaguugcuucaacacaccuuggaagcaaaccagaaagaggccaggucugaaauuauaucagccagcauuugauagcagcucauuauauuagaauacacagcacuuuaagucucacuuaaaaaauaaaaugauaacgucaccuccaccaugugucaggauagauuucugauggauugacuagugguagaguaaauguaacaaauacaaucauaaucaucuagaaauaguauacgugaauauuuagugucagaauggggaaggggcauguaaguuuguagaagcaaugaaggaaguugccuaaaaaugaaaacucauguccaaaugcaucuaacaaugaaaucaucagugauggaaauaucacaaucuauaggaaaaaggauuaaugccuuuauguauuaaagaauuauuauacaaucagucaaaaugcuaacacaccaauagaaaaaugggcauauuucuguuggcauguucauauaugagcacauguauacuugcacauacuuauauacaaauacauucauaugcaaaaguacacaucaugcuugcuuuguauauaugcgcacaaaagagacucaaaggauacacaucagaauauuaauagugauugucucuggauuguuggauuaaacagguugggccucucaaauucaaaaauuugaaaucugaaaugcuccaagauggaucugcaacuuacugagcaccaaccugauguucaaaggaaauacucauuggagcauuuuggauuucacauuuuuggauuugggaugcucaaauaaugcagaauuucaaaaucugauaaaaaauauccuaaauccacaauacuucuggacccacgcauuucagauaaggggugauaaggauacucuguguguguguauguuuuauguaucucuguguuuuccaagcaagcuuuuaauuuuuauuugcaguugcauuuucuucuuuauauggcucuguauuuuccaaauuuucugcaauaagcaugcauuucuuuucugauuagcagaaaguuuuaaauggaugccacuuagcugaaguuucugugcuucugaagaaauccuuuggccuuagauauucucugugagaaacagaaaaccucucaaguguguuggcagcuuagguggauauuuguucuuugaauaguuuucuccuuauguucuuccuucgucuacuuccuauucucuucccuggaauuuucuccucuccaugacuggcugugcccucaacaucuuagaaauguuucuaugucuuuucauuuuuguuucauuggcuuugcuuauuuagauuucacuuugaaugcacagaaugucacguuccucugugcccagauuucgaaauaagagcagguccuggacaguucagagcaggccagaggucuaauuggaagcucccuuccugcagcacaggaggugugccuuggggggaaauggccacaccaggaugcuuuguucugggcuccaaagugugggugauguuccugcuacagugcacuuuguguccuggccguuuguguucaugacgacuucccugucagggcaggagcucagcagggcaggagccuccaugugcauucugaacaggggcucaacaguuguuuugaauugagugagugagugagugagugagugaauucacugaauuauugaaaacuguaggaacuguguggucaucucaaauuuacuauaagaaaaguuaauaguaaacuuuuaauuuuauuguucaaggccugaucugugcuacccacaggaaaaaggaaagggaaaugaaaccuuuucuuuucaaccagaucuuugugaucugcauuggagcuaucucagcaaucagcuucguauauccaaacaaaauucugucauucuuuaguugaagccugccucuuguguggccugccaguccuucacauccagaguaguuaaucaguuaaguaaauuuucuuuguagaauagcacagcucuauucauaccugguucuaauugucauucuguuuuuaaaugggacucguuuuaugcagaugccaaggaugccugugcacaccagugauguucuuguuggagggcggauguauagaggaagggguccuacacgcggucuccucucuucuucuucugggccuucccuuccuuggccugcuugggcucuucccuaguuugccaaagaaagaguaucuuagguaucuuaggaccuuuuuaguaccagcauccuauggcuuggugguggcuaacacuugccauuggaaggucggucuauuuuagaaauggaagaggagagucaggugcgguggcucauaccuguaaucccaaaacuuuggggggugcugagacaggaggauugcuugagcucaggaguucaauaccagccugggcgacauagugagaucucaucucuaaaaaagaaaaaaauuggaaauggaagaggagaaaccaagguaaucuuuuaaaugccuaccuaugacaggaaucagcugaaaugguguuuagauuguuaacaaauccucauuaauaaucacacacuagguugaaaguuguauuuuaaagagucacuugugugacauuguggcaagagagugucccauagcaacuuaaguguaauuuuguuugucccucagauugcaaacacugccuuuuacucucuucacuccccauuuuaucaggagaagacuuuuaaugccaacuguauuguuuuugcugauuuuagauggcuuauuuuuaaagccucugguccauuuucuguuuacaucuuuauggacugucacuguagccaauuaaaaauccucuuaacuaucauagauugugucaaaggagauugcuguuauuccucucccaggaaagaaaaaauuuaugauccauaucaauuuauugccuguuuucucuaaagaagcaaaacauaauuauuaguuaauucaguuagacauuaacucagaaaacuccagagauuuugauugauuguuauaguaaccaaaaauauugaaguguuaaagaugacuaaaaccaccuauuagaaaugaguuggcauauugcuuauaccauuacauaaaauagcuaaagcauuuugaauuucagagcuguacccacaucagccucagugguuucaaauuuauuuuaaagacagauuuagauuugggcaauucugucagucuuuucaggugauacaccacuguaaaauauucugcuuaucacuggguguggugguucacgccuguaaucccagcgcuuugggaggccgaggcagguggaucacuugaggugaggaguucgagaccagccuggccaacauggcaaaacccugucucuacuaaaaaauacaaaaaauuagcuggaugugguggugcaccccuguacucucagcuacuuaggcaggagaggcaggagaauugcuugaaccugggagguggagugagucagcucacuucccuccagccuggauuacagagcgagacuccgucucaaaaaaaaaaaaaaaaaaaaaaauucuacuuaucuuauucccccuaugguaaugucuugguugugcuccugcuagcuuaggggaaaaggaguaauuaauuuuaagggcacugaggguaucucagacagcucaugaauugguggaacuggguacuaaaagcuguuaggacuaaggcagcaccugccuucugcccaucucccucugccguguuucucugcauggcagagggacaccacugcuuuauggggguccaggaaucauaagacacaaaauacagucacacucaugacuguaacuuauuacagugcaagcacaugaggcaaacucaguacagggaagaggugcacagggcgaguccucucccauggagccacacagguugcacuuuauccccccauucacaaaugaguugugaaaacaccuguggaauguugucagccagggaaacuccuggguagagacccagcacccaggauuuuuauggaggaccacucauguaagaaggcucugccuguuaaguaccaaaguuccagacucccagaaggaaauaaaccauacugugugcggcauagagcauauuguuugugcagacagcuuaggcacagugagccacuccuaccaguuaggaaaugaugggaaggaacccuccuaaauccaaguucccagauaccagccaagggccagccuugcaacaggcccuuuaaggauggcugucagaucugcugcuucacucuuuccugcacagcggagucccaccccagucugaaguuuacacaucauacccucaguuaagguugagcagagcccuuugaguaugucccaacuccagauucccaggagaaggaguuagcccagagaggguaaaguuaccccccaauccaggcaggauggucagaguaaugggucacauggucuaacguggauaucaggcauucuucccaucuggguagggacagguuguugguuugggggcgcggaagacgcuccagaagcaagucggccauagagaugcauguguggaaaaucuucucagaaacugugcagacuucaucugccaaagacccucuuauguuaggaggagcauuacaaaaccauacaggaaaguggcaccugauucaggccccaggagccccagguugcucugaggaaauaggguaguguguagguguucauuugcauagaagcagugaaugccugagagauucuguaauagauucagauagcuuauccucagguguucuguaauagucuuagugaacuuucguuuuucuucaccauucugauugcagccaguuggaguucaugaaaauagccugauuccucccugagauugauccuuguaggugguggacaaaaauggcauauguguuuauaauauucuucugugucugcuguaguuuuuuuuuuguuuguuugaaagcuuuuguauuaguauguuuucacacugcugauaaagauauaccccagacugggcaguuuacaaaagagguuuaagggacuuacaguuccacguagcuggggaggcgucacagucaugguggaagguaucucaggcacgucucacaucgcggcagagaagagaagagggcuugugcagagaaacuccuguuuuuacaaucaucagaucucaugagacuuaucacuaucaugagaacagcaugggaaagaccugcccccaugauucaauuaccuuccaccaggucccucccacaacaugugggaauucaagaugagauuuggguggggacacagccaaaccauaucagcuuucuuggucggacuuauagucagaacuauugaagguuaugcaucucagccauuacuucuacacgugaauaauuccuaaucuucucaauaguacccauauaggaagugcugguauuuuuugaggcauggauaucuuucauuugcugaaggcaggggcugauguaggguguugaggugaccuuaguauggguggugguucccacaguugggagacuugugucucuuuugcacaaaccuaucacuggguugcucugagaaggguuaagugucaucucagaauguagugggaacccugucaguucuguggcccauguagaaaggguuuccgggucccuucagucagugggaaaucaccauagaauuaucaucauauccccauccuuggcuacauguauaauaguuuaguaugaauuaauuuaauucacacaugugcaugcacacgcucuauauauguauguauguaugccaggaaguuaaaacccagagcuuccagccagaccauccuguuuguuuugcuaugguuuucauguggauucuuccuuggagucagguaaaauguaaucccucugccuccaugcugugcauagcagaccaguuuguugcugcugucugugcacucgugcucugugugcgcuagucuggccucaugcauggccagggugcccuguccugugacagcagggggcugaucgccugcacaugcguccauccgauggcuugauggagcugccuucuaugugucagucucucuuuuuaaaguacucaacaguauccucagacuaauuuuugcuuuugcauuuuugcuuuuguuaucuuugagauaucaagaguggaaggcagcauucauuccagagaggacaagacuucuaaggaaaagagaaguguuuuuuugugagucuaagaacagcauaugagugauagaaaaacaguuccauagucccuucaacagaucagcaggaaggcuuuugaaaacaguagugaaucuucuuugcagaggcauggacuguaaggagaaaaccuucuucuaucuuuuguacacugcuguuuuaggguaccccaagauaacauuguugauuccuggggaccuaggauguuaucuccuugaaugaaaccuauucuucaugucuuuuacaguaacgaauaaauguguugauggauucaucuguacccacaaaaugagccuucagaaaagaaaaugcaaaguucagugauacuagguuauuacaagcucuucguguucccugugacugacccuucuaccucucuggggcagcaggcucccauucugagaaacacugguaucuggggacacugcaggcugagcugcucagcacaggccaugcaugcagugugagaagccaccuuguuagagcaguaucaauuauggugacuguuagagcaguaucaauuauggugaccucugucagccuuaugggguugggguugggugccacaaggagcuccaggggcucccagacagaagcccagcuguauucaccagcacccagcauggagaauaauggguuuccaugauaaguaaugcugcugauguacaucgucuuccuggaucucaaugcuuucuagauauuauuguuauuuauauuucccuuauauacuguggagcuuuaugggucugguaggguugggaauaaauaguccuaucauuuguuaauuauguuaaacuaauagaugcauaugaguuuuaugaggguuacuaauuacuuuuuuauucaguuaauggaaaucuguuaccccuuaauugauuucagcugcaguuauuuuguuagggugcucuuguuuaaauggauguauauuucccucugugagccaaguucauucagaucugcauuugugcagguccuguauucuuauguuugauaaaugagcaaguggguauguugguugguggaaggacgggaccacgacacagaggcccaguccucauccaccugccagggguuggcaugcaggcauauaacauuucuguugcaucuuuuguuuucacagugagagaaaaacgcaagagucucuucauuaaccauguaagugaagcugucucccuguguucuucauaaugacuguacaguguaaagagcuaaaauaacugucugugauggaugaaaauggcucaugugcuuuguagauacuuggaagaauguugcaguguacuuaugcuuaguuugguuuguaauuggacaagcaucacucaguauuuguccacugucccaaauauuuuuccagaagcccuagaccacuauuguucaugagaugaugugugugaacaauaacauaucaaacaucacccagcaaguccaagcgaaagccacuucuuuuuaauuuugaauccuuuccuuucucuacccucacccccaaauuauucuuuuucucuuguagcucaguuccauuugaauaaacacauaguuguuuuccaugaggcucucugucuccacacuugacucuucccauuuguuguuuguggguccaguagagucugcguguucuucugaugcuccaagaaaggauaaacuugauaacacuaaauuuaaaaaagauguucaaacauuuggcuggagucuuuuggccauucuuagccaugucucccuccccugguggccaggugcaggugccccauugagauacuucaucccucuuccuuccuugagcagagauguagcuggcuggcuccagcaccuacuccacacccuauauaccaggcaaguccuagccacaccuucuucuuagaaauauggcccuuuaggaaagaaaacucuccgagagggauggaaugaugaaacagguguaaauuaucaaaauaaguaugcucuaaguccucauucuaaaaacagaaccacacaagggucuuucucaggauuuuuagacugucugcaucuguguauuugaagaucuugaaauaguccuaaagcuguguauuaaagagacuuaaagccauaauguuguauucucugcccuuugaaaauauggacaaaaugcaguugggaagaaauucauaagcugggcccuuacacucaagggacaugaugcuacgcccuuaggagacugaugacuucuuuguagucaguguuaauauauaugcacauauacaguuuucuaggggucagagggcuuauuauuuuuagcagauucuuaaagcaaucugugaccuuuucccucggccccuuaaauuucaaagcaucuguuuaaagcaccuuugaaauugcaaucugugucaugaggaaaauaugaaaauugccaugccuuuuuuuuuuugaaagcaguauauaccuggauauaaaaauuugagcgauuggaacgaauucucuaaauccuugcuuccauuucuuugccugcugggugcacuugaaugcuuucccacucauuacacucauuagcaugccugccaaggagcuugcaagggaaggagaagagcuggaacugcauccaggccaucuuuccuguucacugcagcuccauggaaggugcauugaagaaagaggaggauaggaguuugugucgcucuguuaucauuguagcugaugauacagaggugugcucccacaguucuaaccugcauaccucuuuuaacaucccugcacgccccacccccccaacaggcacacaccuaaccuugccauuucguguccuguauagucugagcaccugccacacacuugagaacacaucugcugcacccagcacauggauuaguaugggaggccaugcauucucaugcacaguaucuucuaacgcccagcccagcauucaaaccucuguaaaaucacaucugcugacacagagugaaaucacacaguuguugagaucucugcaaaugcaccuguuccuauagaaaagaaaucugggugcuaaguuucuuacauaacagaugacccuguaacaagcagcgugacccucuaaacugugaacagaccucgcugcaaaugagcgccaucaguccugccacgcuaggaaaagccgugggagugugccagucccaccagcugaaauaucauuugagugaaauuaccugcagauucaauuaggcuaauaaagcagcuguacuuuucagguuuugaaacuuaggaauaguaaguuagaacaguggagaaaggacgagcaauaauaauaaucggucccaucugcugagugcuuuaaagugugugugccaggcucugcuguaauugguuuaauggacucauuuaguuagcacaauggccaugcuagguaggcacaauucaguauuacuguuuuacagaugaggagaugaggcacaaagaaguuagccaaguagacaguggagcccggguugagucccagguggucugcuucaagcacgccacuuagcucgcacccucuguguuccucagauaauaacaccaguucccaugugacagagguuguuuagcuugcuuaucugaacuuagagauaacauuuauaauuaaauuuguaugggacagucucuaggguucauuucugaauauggaucucaacugaaauuuaucauuuaguuuguuacugaacucuggagugauaguuauuuuucgcccuuauuauaccauuucauuuuuuauuugcuuuauugugagggauguuguuucuuuaauuucucuuucaaguuuugaagaacccacuuaguacauguugcuaaguuaaccuacaaagaggcuacuauuuaagagaaaugaauacaguuguguagguaagccauuuaagacaaggcgaguguucaccucuacccccaggaccaugauaacugcaggggaaauaaccuccuccagguggagaaaaguaaggcuuuccugguuuccagcaaacaacacacauaagcaagugaaaagaguggacuaugacccaggacauucuccagggaauggggcaguagagaauggucccccaggcuggaaaaugagaggggccuuuaacuggcucaaaacagccaagagagacucagaggauuaagugaaaggagaccacuucucaaggaauuauuccagguuuugaagcuugaagccauuugaaaauaaaccacuuuggauguuuugacagcagguucaaucagggugaauuauaaagguuaauauuuuaaucagcaccuauguuuuagauguaauuaaagugaacagguauaggaagguuuuuguuguuguuguuguuguuguuguuuuugagauggagucucgcucugucacccaggcuggagggcauugguacgaucuuggcucacugcaaccuccccaacccggguucaaacuauucaccugccucagccucccaaguagcugggauuaaaagcaugcgccaccauacccggcuaauuuuuguauuuuuaguagagacaggaauuagcuauguuggccaggcuggucuugaaccccugaccucaggugauccacccgccuuagcuucccaaagugcugggauuacaagcaugagccacugcguccagcuaggaaaauuuaaugcauaugaaagauacacguauuuuuaaaaggcuguguaaagggauuuauguaaaguuuauuuaaaauuugcugacauuuugacuuugcuuuuuuuuuuuuaagguuagcuguuuuuaugaaucuuuuaauuaaaguguaaaaaucucugauuauagauugugggugacauuguaggugguuggaguuaagaaucacuccugaaaaaaaaaaaucacuccugaaacucagaauguaugcuuuuuaccuuagccucacuuuucuaugauuaucuuccugccaccuggugauagcacaccaaaaaugaauggguuauucuaagaaguuaaaaaaaaaaaaaagaugugaaaacagaaugaaugaggaguugaauagccagcuuccuuugucuuguuugccauaggugcacuuugaaacgagaaagccagacugggaauucuguguagugugauccucaaaaaaaaaaaaaccaaagcauuugucucaacacugagucuggugauaguugaggaaacuuugugaggaaguaaagcaacuagggagaguuacuuaucagcuaagcaagagucacauuauuauuagugggacuuggagccaaaagaacuuuguucaaacccucguucugccaccugcuaauugggcaaucuuggaaacaucuugaaaucucaguuuucuuaucuccuagggugggucauaauuccagaccuacuugacucaaagguagugauuugcagccuaauuauaacaccauauacguauguuguauuauuauuguccauuggaauuuagguaaaauugauuuaauuuuccaaguucaauaucaaaacugaugaaagucuuucugguauuuugaguauggauauaguuuuuucauaaucauuaagaccaggauuuucugggaggaguauauucuguucagcucccuuuggagaauacugacuugaaucauuugcuccucuuaacacaguucaguuccaaaucaguuucugccuuuuagcuuugagugagguaggaauaggaguccuuguaaaaaggugucuauucugguuauaggcuucaucuguaagucauaaaagucaaguaauacagugagcuacaucuaggaacugaaauuuaaaacauuuuaaaucuugcuuuugccucuggaauagaaugagaguuuauugagcagcugcuguguuagcaucaaugccauaugcuuggaggaugugaaagaagacuaaguuuuuaaaauaucaguaaaaauuuuaaaaauccaauaagauuaaagaaauccagcuuuuacuuugaaauaauuucaaauguauagaaaaguaacagcaauaauugagaguacaggauuuucaugugacuaaaggaaccuuagaugcucugguucucagacccccuguucugcuucacccagggauguugacaugggguagguguuuuguuauuuucucucuucuuuuuguuuuuucuucuucuuuuugcggaaugucuagaaaugauaaugauaauguuacacacacugguacauugagaagcuuggguaggacaucaauuccuuaaguguauugguuaugucuguggaggacuuucucuuuucuuaccucuuucuguuucuucuucaccccuucuucccuuucuucaugcugucacucuuguaaugaggcacaaaggaaguggcacuuguaaaguguaaugguccauucaaauacagggcagccgacagguggaauugcuucccuagugccuuuguggaaggucauuuugaaagcuacauuguccuuguuaagacacacaagugacggggccacugagcuguuguuaugauuuagccugguaacucaugguguguucuccauggaaguuccuauguuggaagcccugaucuuuuguauauaguguuaggauaucaucccuuaauuagccagcacaaauucuugaccacagcugccugguuuucacauugcucugacacugcuacauguggggaaggagcuguucucauuuuagucagucacugacucuugguuccauugcugccauucccagaguuaggggaagcacaaccacuccugcuagcugggcaggcacugagggccucuucacugugcauucuacuugucacuucauugcucuccuaaccuccucaguuuucaacuccaucaccuugcucagggacuucuggaguagagagaagaaaggaaugaagugaagccuugaaggagcauucuacuugaagcaggaacuuugucagaaaagcccuuuaagaagcagacuuuguaucccuuagccuuguguuauaaucuguucuuugacuuuauauauacauauauauguguguguauauauauguguguguacauauauauguuuuaacuuuuauuucaaacuuacagaaugauuuuaauaguaguaauacagaaaacucucaucuacccuuuagccagauucaucaguuuuaaaccaauauucucucacauucugcacauccuuggucauugucuuuuauuauuuuuucugaauuguuuggaaguagguugucugcauucugccuuuucucccuaauacuccacuguguauuuccuaagaccaaggcuauucucuguguaaccacaauauuaucaaaauaaagaauuuaacauugauauguuucuucuaauuaacugaucauauuccagcaauguuaaguggcuccguaauguccgcuacagcguguuuuucugugguauggguuucacuccagccugacacauggcauuuaguuggcaugcacgcucuauguccuuuaaucuggagcagauucucagccuuucucagucuuucaggacauugacacuguugaagaauacagggccaguuuuuuuuuuuuuuuuaaauaauaauguaauguuucucauuuuggauuugcccgaaggauucaguuaaacauuuacagccagaauacuacauggaguguucccuugcccuuuucaagacaucaaaucgagaggcaggcaguuucaucugacucuuguugcugauguugauuuugauuaccgggcaaggugcugccuggauccuccacugucuguuuacucguuuucccuuugcaacuaauaagcagucucugggcagguacuuuaaaaccauguagauauccugcacuuuauccccacccccagauuuagcaucuguugaucaggcuugaccgaaucaaucuuuauuauuuuugguuacaaaauggugguuuuccagcccuaccauacuucucucccuuugucaguagguguucugcuuaagagagagccuucucuucccaucuguccaucugucuguccauccagccauuuucaguacagauuccuggauuucugcuuuucuaaugauaccuaguucaugcuugugcuuaaauauuucgauguccuagauuuggguaguggcagucuuuugauacugguuuuguguucuugugacaugcuccauccuuucguuuuguuuugcgaacuccuuugcuuucuggcacaauaagauauuucaggcucaucuuguaccucugccucaacccuggauagccauuucuccagggaguccugauuccuuuuaguggcaaacagugcuagaaccaaggucuggacaccaugugugcucauugcugcuggggugcuauugcuucuaggcccauuuagcagguguagcuaggaaacagacauuucagaaaucaugaauucauacuguuacuuuaaauuucccauuccagucuaucccauaggguuuuuucuugaccuuggccuuugacuuuuuaauuucuacugaaaaacuuauuuuucaauuaaguuuuauugauacauaauuaacauguaaaauucaccuuuuaaaaauauacaguucagugguuuuuaguguaaccacagaggugugcaacugucaucacaguuaauuuuagaacauauucaucacccccaaaagaaacccuguacccauuagcagucauuccuacuccuuccccucccccacuagucuacuguuuguagauuugucuauuuuggauauuuuauauaaauguaaucauauaauacauggccuuuugugaguggcuucuuucacuuagcauaauguucucaagguucauccguguaucucaguacuucauuccuuuuuauggccaaauacauuucuacagagcagaauucuaccauaaaguuggcauuuucccaauuuuuguucugagauccaaaguuggcuuauuuucucgcuuucauagagaaugauuugguucaccuggguucuuaacuccauggguauuugccuucugcuuuagucuugcuguaaauaauugauccugcuaaaagcuguacccuuuuuugggggcuggggguagggggucagagucuugcucugucacccaggcuggaguacaguggugugaucuuggcucacugcaaccucugccuucccgguucaagugauucuccugccucagccuccugaguagcugggauuacaggcaccuuccaccacgcccagcuaauuuuuguauuuuuaauagagacgggguuucaccauguuggccaggcuggucucaaacuccugaccucaagugauccagcugccuuggccuccgaaagugcugggauuacagccaugagccacugugccuaaccuguaccuucuuuuucuuucuauggaacauuaguuugugaacacuuugaggucagagaggaagauuuuuuucuuauuuugcuuuuugucuuugugucucugugaccccuggugguccuggaaaagugaugauggugcuuuccucucucccagccgggugccuuccccgcaugggcaucccccugugagcacaccugcucuugcugaucagugcucuggguuucacaggcuucagaaucccacacaaaguucuugaauuccacuccacccuguauuagcugugugaauaaggcaaagacaguucugcaaaaugaguggccuuuaugguuucguggagacugucugugagcugggaguucagcagguggcaggugugauccugcaacccagccuccccuccacuucugcacuccagcaggccuuucguucauuccuagucaaggaaugccagugcaaguggccaguucucuguggcccgaggaggcugcagaccaaaaccugccuccucuaucaaggucauaguuugcccuccuuaagauuaaaaaaaauuguggagcuuucauauuuagagauuucauuuauaucacuucuuuucacaaacuuuuacuccuucuuuuccucuaauaauaauacuucauuuuauuuauuuauuuauuugugagacaagguuucacucugucacucaggguggaguguaguggcacaaucauggcucacagcagucuugacuuccugggcccaaccgaucuuccugccucagccuccuggguagcuggcaccacaggcaugcaucaccacaccuggcuaauuuauuucuauuuuuuguagagaugaggucuugcuguauggcucagguuggucucgaacuccugggcucaauugauucucccacuugggcuucccaaagugcuggaauuauaggcaugagcuaccaugccugggccuuacauuauuuaaugcuuuuuuuugauccuaacaaaccuuucuaagaaguaguaagacagucauugaaaaugggaaguuaaagccuagagacucuuaaguguuaaaugacuuaauauuuauucaguucauguacgugcuaggcacuuuacagguguuauucuucacagcaccacaaugaaggacagguucuguaucugaauuuuauugaugaagacauugaagcuuggggaggcuaagccuaaggugauaggcuuauacauuuuaauuaauuacgaaagggguuacuauuauugguuauucuaggacaacagggacaaacuacggcuguccugaucaagccaggaugugugauuguccucuguaaguaacuugcccacauuuacacaacucgucaguggcagagcugcagccaagcacugggcuuucugacuccacugugcuccugcccugccugucuggagugucucguccacaugaacuuggcuccuugaucugccugccaugccucacuucauguguucggaacgugucagcauuucacugcccaauggugcaggccccugcggccagcucauugccacacagcaugccccuuucugccguaacacagcugcuguggccacacuguggucucccucacagaggauccugugccauaauggaggcagacgacuucccacaguugggggcagugagcacucuagucccgggauggagcuguucuucauuugcugauucaagaaaauaccagucuguaccuccaagacaccugcagucuagaccccggagacauauagaaaagugagccagaaaugacaauggagagugacuggugcuguggagggugaacacgggcauagaacacacagagggguacccagcccagguggucuggugguaggaaggcaucuagaggaagcacugucagcagagugcugaaggaugaguggagucagggaggggaaaaggucuguaggguauuguacaagaagguuuaggaaugaacagcucaagggaagggcugcagaaccccagagagggaggcacggacuugguagucagacaaacauggcuuuaagcucuggugucuuagauuugguguuggaaaugcuacuucauuucucugaucuccuugucuguaaaaugggaauucuacccugcagugcagggcucugaauguuugugagcucuaagugaauacacguaaaguaacccagaacacuguggguucaucuuugauggccauuaaauaaaaguggccguuguuccuuucaucuuugaauuauguccaaguguggugugcagggaaagaggaagugaaccgugaaccuggagagauggagaguugacucgugugucucuccccaguggagaacgucagaaccaucuaggcagggaggcaacacgaucugauuugcuuuguauuaaggugacaguagcacuugaagaagaaugguuuagagaggagugagccucgaggcaaggugguuacuguagugauacaggugagaguccacguggcuuucauauaccagauaguggcuagaggggugcaagggaaaggaugauguggaaauguacuuggaauagaaucgauagcacuugauacaaggaaaccaacagaaaggaaaacaaaauucaagaauauuuuguggauuucugguuuuaagccauuacaguugauuagaggaacaaauuaguuuggcauuugagguacccaugaggaacauugagauggaggggucaaccaggcaaguagugagcucagaagagaaguuggggccagaaaggagagauuugggacccaacagaggggagaaggaaguugaauuaaugagagugggugagaguccccugggaaaguguuuagaggaagaagaaaagaccauuacauuugaggaaauucagagaagcagaguccacaaagggacugcgacugaguagccagaaagaugggggaaagcaaggaggaaaccccagaaagaaaaaagcuucaguucaaauaucaaauugguaggaggacugcagaggacccaucugcauagcggacuuagaguuuuuugugaauggggagggaguguggagguugagcgaauucagaaagacauuuugaagaagccgagggacuaauuaguucuggccugaagagaguuagggcuucuacuccagguagggggagggaugaccgauuugccaagaaagaggcaagaagguugaggggacgcugucugguggccucuggguucugugacucaaacucccuguggggagcucagcauggugauggguggaggauuugaggaggugucgcgggugggagcaguugaaauaguugggaggaagauuuggggucauuguggaagguccaguggaagucuuaucccugcuuccuccuccucaucauccugcgcuuugaucguauguuugugugugcauguacauguguguauccauguaucuuuguaucugacagacaucaguauuggaauuaucuaaggggauaaucucauuauuugggacacaugauaacucuucaauaaaaucuucuuaaauauaucauucaacaauuuuuguauauuaauggaccuugauguaaaucauauuuuguacuauagacauugugugaauacauggacuaaaugaccuugcuucagucuagcucuaaaauucgauuauucugcauauucauagcuuaaucuguaagguucacauuauuucaaagauauaaauuuuauuucuuuagaauaauucauaauugggcuucucacucaucaggcuccccuucuaagcaguucgugguuaacucuguaguaucugcgcucucaccaagacacuuacuguauuugggacaaucuuucuaaauuguuuauagggugaugcccauccuuugcaaguaaaacauugccuuagacauuuccuuuuaugguuuuccaaaauguugcaggcauuaggcauaaagaacaucccuguugcuuuuuugaccuguuuaacgcaguuucuacuuaacgauuaccugcaggugcuucccacacacucgcccugcucaaggugcuuuacaaauacuaauucaugcacuccuucugauagacccaugagguagggucugucauuuucaucucuguuuuacagcugaggaaacugaggggcagagagggaggccagguaacuugcccaggccacgcagcuaguuauguccaagucagauuaacuaccaagagucaugcccugcuguuucuccagcacaucacuuugcugugucauuuacuagcaaagaugggaaccuaagugggagggucugugugugcaugugcacgcacauguacaagcauaccaguguuucagaaucauggagcaauacauuaacaaaaauauuuugagugacacugagaacuaccugacacacgugugcuuaugaaaacuaucgaauuagaaugcucuguucugugagugauacaccucugcugcuuccagaggccgagcaucagucaguuguuggaugguaccacacagcaggagguguuguacuuuccuccaccacacccugagaggaccaguucaaaaaaaaaaaaaaaaaaaaaacagagacaacccuggggucaagagcauuucuaguagaaggauuacagcuauuucggcuuuuuagugaugugggguucagaucaagagaaguucacauucuaugagucuuguaguccugacagucaauaaaugacuuagugccuaaauggucuuuagaguguugagauacucugaaacuaaaaucuuuauaacucaauacuugggaucuuuauucaguuucgaaguuauuaaauaguuuaaaagcuggguuggcaucccccugggaucgagggcuuuggcagaucagcccuuaguucuggggugcucagacccgcagguggggcaguccucaggccagggcagggucccuuuguguggcuggcuuugaguuaacccucugaaccuuagggauggugcacacagagggguggugcccucccugucaacucacaaagguuacuuccuagauuaugaugggacauucucuguauucugaggguucccaugaccccgugcaucacucuucuuucccugacuuuguggcuuauauuuucuuagggaaaccauuuauucuuugcaagcccuguuacauuuuaaucuggaaggaguuugcaucagaggaaacaauugaaacccacaagaaacacaaaugaaauauuauuguccuuuuccuucauuguugggauuucuaaaguuaucccauaucucuaaaaguuuauuaacaccagaaaaaauuuaauuaauuacugacuuuuaauguuaaauaugguaucuguguuaaacauagauuuuuuguuuguaguagauuuuacaucuguaggaaaaauuccuuaagcauuuuuaguuuaucaccuaugguaauagcuguuauuagagucugaggcuuuagugcgucuucugugacuuacaugugauucuacaagaguuuaaaaagaggaagagaauugguuuaaaugucuggauuuucuuaaugaaaugugauucauuugauagauguuaaaugccaugugaaaacugacauuugacuucagacuugaauuucacaagcguucucuaugcccuguccccacauaggcacuugagaguguaagccuaaggaaagaacccuggggagaggccucagcuucugaauuuuccugguugugguucuuuccuucuaaccuguuugcuguugaugugagacuagggcuccgagggucaggaugcuucagcagcgcagugcuaacugugauuuaagaaauuggaaccccaaagaaguaacuaguaucauuuguuaucuaguuuugagaagagauucuguuuauaacauuguuuauauauuucucagacugccucacauuuuccuuacuuuauuacugaggaaaccuuauuaaaugagaaauaaauuuuaagauauugaacagggcauuuggucucuaacguugaggcuuccuuuacuaaauuugugaacuguguacacccaggguguguugcaggcgggcaggucaggcagaagacauugugauccccaagggauuauuaaguuuuuuuguugcugaaaaugacacuuagacauucaacauagcaucaggcacguggaaacuuguuugcauaauuuaacuuuuuuucuaguuugcuuuugaucaggaacuauccagauugauguguacuaaucauauugcccgauuguugccagaaaucuauuuaguguucaacuaggugucaucagugugugcuauaaauucuauuuacuucaccaguaccuucuagaaggaauucuguucuaaaguucuccaaagagcccaaaaguuguacaguuaugaaagaaccugucauaagaccacacaaagaacuaucuaaaggucauucauugguuguauuuucaaaaguaucagauaaucuuccccuuuaaaacuuacuuuguccuuaacaaagcaauauuuuuucauuauaacuuuaccugcugaaauucaagcagauuaaccaggagauucuaaauuaacauuggcugcauuuuccauggccccuaaaucaacuguauuucaagaguaaggaaaguggguacaguggacacuugucuugaucuuagugcguaaaaccaggccaccaucuaaauugcaggcuuuuguuaguuuaguagaucccauguuucauacaagccauggggcaggugauuuuuguggacucugaaacaugcuuuuugaugcuugauugcaagaguuuacuguucuccugaugcaggaaguuagggacuaggugugguccuggugacuuuuauauauggaagagcaaggaaguucauuuuaugaauaaaguguuuuuguacuguucuuggugguaauguugacauuucuugcuaagacauuuuuccucuguggucuuaucucaaguuaagcgggggugauguuucuuggaagaauucugagcccuguguaauugccuuaaucuucuugcuguuguuuucuagcauccuccaggacaaauagcaaggaaauacaguuccugcuccaccauuuuccuagaugauagcacagucagucaaccaaaccucaaguauacaauuaaaugguggguauauggauuuauuuccuuccuuccuuccuuccuuuuuuuuuuuuuuuuuuuuuuuuuuuacuuaacugaaugcuuuuucuguuccuuaaccugacagcuaagcugguugguuguggggucugggagugauaagauuggaugggugggaguagggguagcacugauaauucaggaaaucuuuuuaaaaaaugauuuugguaguuaagugugggguauugaaauauuuuuacauaguacuauuuacauuaaaagaccagaaucuuaaaguauuuuaaauguagauuacuuaaaauauauuuuuuauuuuuguucaugcuuucuacccuugcacuuuuuauugaagccauccuggcauaacuccacuaacuuuuuaccuucuaaauaaaaugagacuccuauguucccaguuggagacccggggcuccaguagaaagccugccuggccuagugaagguacacuugccuggggucuggagaucugaguucugaccauggcucucucaccaacaaagagaacgugggugggauccuuucuguggggccuuuaauuccauauuuuuaaauggaguuuauaagggaggaaggaagggggagucuugggauaaacuucuuucccuuacggugcuucaguuuccguacuuuaaagagggagggaacacugguuuuuccuuuauuguaccacuagcauuaugguaauaaugacccuuggcaaguacuauagagaaccugaugugcuugggccuguggucagcagcucaguuuuaaaaaaucugaauuuuaucucuauacuuguuucagaaagcacacauuucacaauacaugucagcauaugaaauaaguguuuaaauuuuaaauaaggaguauucguccauuucagugggccagguuuucaggccuagaagcccuguucugaguaugaccacaugugaugaugagucaggcagugaggacuauagccaucuguagucagugucugcucuaggcagaagguggaggacaaggccgcuuggguagaggcugccuguuggcacugcgcuugucagguuccgugcuuccaggaucuaaguggcaaugcagccucuuccuuacuuccucagcaccggagugcacgggaagugacuagugggcauaaacucacacuggcagcacucacagagcucugucuuagcuccaccacgcaugcccuugccugagccacguuuacccuugggcugugguuuacugaggggaaauggggugugcaguaccuuuggaaguauuuuccagauuagguuauuaggacucgcggagagaaguggaaagcccugaagaucuguguaccacaugacuguuggcuucugcucaaucucugaggagcccagaacagaagcugcuaacuucccuuuaauccuggacuccucucauuggaagccagggcagaguagcacaguuucccauccuggggcagcgggagcucuugggauucacagguggcucugucuuaguugcucaacacuuucauccuuggaccacuuaaaauugccacuggcugugacacagacacuuaggagccuagugagagaacugugugacaauuugauaguucaucggucaacucuaggaggcacaaacaccuaaguuagaaauauguugucuguguaaaucacuguuucuggcccuggcugcaccuaggagucaccugggagcuuaaaaacacacugaugauugaggucuccuuacagaucuugauugaaucuggcugaggcauacuguggguaucuggacuuuuaacagacuuugauugaaucuggcugagguauacuguggguaucuggauuuuuaacagcucuugauugaaucuggcugaggcauacugugguuauuuggauguguaacagcucuugauugaaucuggcugagguaaauugugaguaucuggauuuuuaacagaucuugauugaaucuggcugagguaugcugugaguaucuggauuuuuaacagaucuugauugaaucuggcugaggcauucucuggguaucuggauuuuuaacagaucuugauugaaucuggcugagguauacuguggguaucuggauuuuuaacagcucuugauugaaucuggcugaggcauacuguggguauuuggauuuguaacagcucuugauugaaucuggcugagguaaauugugaguaucuggauuuuuaacagaucuugauugaaucuggcugagguaugcugugaguaucuggauuuuuaacagaucuugauugaaucuggcugaggcauucucuggguaucuggauuuuuaacagaucuugauugaaucuggcugagguauacuguggguaucuggauuuuuaacagaucuugauugaaucuggcugaggcauacuguggguauuuggauuuguaacagcucuugauugaaucuggcugagguauauugugaguaucuggauuuuuaacagaucuugauugaaucuggcugagguaugcugugaguaucuggauuuuuaacagaucuugauugaauuuggcugagguauacugugaguaucuggauuuuuaacagaucuugauugaaucuggcugaggcauacuguggguauuuggauuuguaacagcucuugauugaaucuggcugagguauacugugaguaucuggauuuuuaacagaucuugauugaaucuggcugaggcauucucuggguaucuggauuuuuaacagaucuugauugaaucuggcugagguauacuguggguaucuggauuuuuaacagaucuugauugaaucuggcugaggcauucucugggugucuggauuuuuaacagaucuugauugaaucuggcugaggcauacugugaguaucuggauuuuuaaaccuccccaggagagucucacaggcagccaaaguugaagaccccagauggaaguggacagcuacccuccccucccccaccaaugucccccugccacuuuuaaaugaacugcggguuagaauguagagaacagagaagcugaagaguaggaacaagcuaugagacuucaguguagauucugggcuucccugauccgaagacauggucucugcacugcacacaucugaaacuucuucagucuguaauucaguugcuuuaaaaaguaucuucuuuuucuuuucuuuucuuuuuuuuuuuuuuuuuuuuuuuuugagacaggaucucuguccccaggcuggagugcaguggcaugaucucagcucacuguaacuccgccucccaggcucaagagauccucccgccuuagccuuccgaguagcugggauuacagguacacacuaccauggccagcuaauuuuugcauuuuuuguagagacauuuguuucaccuuguugcguaggcugggcucaagcaaucuacccaccuuggccucccaaagugcugagauuauaggcgucagccacagugcccagccaaaaguauccucuuuuuaaaaugcacacugggagcugggcagggugggaccaacugaaguagagccaucagaauccuucccuggaaauaccagcaucucacacuugguguagcuaaagagucaaaaacauuuagagacauuagcagguccaguugaguucuucagcuagaggguugacaauaugagaggaaagggauacucagaaggaagaguagugaaaaagauaggaaguugugaaauccacaugccaucccauucuaaaauuuugccuacaucuugcccuacuccuguccaaagaaaacuccuauuuucuuuuuugcuuucuuugccucccguuaacccagguccucuugcacccuacuccagacauuaaaacugauaacacaaucauuaauauuguaguucagcuucauggugggcauaagugagcauuuaugggccagaguugcuaucugaaauccaguuacaagguuguaacugugagaagaaugcccuagguucuaaacagcgauuuauaagcugauuuuuggaaaauaauccaccuguaaaguggggauugccagaaauaaacguauuugcaaauucuagcuggggauggguggaggguugaaugcuaaucuaacagugaaagaaaagcuauaaaaaaguuggguacucauucagugcucacucuuucuguagacauaauuuuuuauuuugagaacuugauuuuccuauuuuuccccuaaaugccaacagcugugguaugaauuuagaguuugucagccacacuuugugccucugcagccaaccccuccccaccaaguccucugacaagcauaagaugaugaucaaagaaaagagcggagggugguggggagccccuuugcgcacuuggccauaccaucaggguccuuggccuccagggccagggaacagcuaaugcccgucacagcccugucuauggcucagccccacugugcugcuagaacucacccccucuugcccuucaaagguuuuaggauugucauauacauugcuaauuuagcucuggguaagaagacaaaugaagugccaaaagucacaaauccauuuuguuuucuugugcaagaaaauagcauuuacuuccuccccagcuauguggcaaaagcugcugagcaaacccuauaguccaaauguuuuguucccugauagggcucuggcccuuccuuggugaaacugcaccauuuucugaggucuuggcagagcugaccaagccucugaaguugggcacuccgggucccccagguccccugaguucuuucuguguccuaaccgauaaucagagugccuugaccgcucuuuggccugguaaacuuggauuugauaagggugguaagagccgguuaacucuguggcucgccaggguuaauugaucugguuagccacucugggcagaaacuaaaggaggccuuaggcacuugucugguaggguagacacugguucugucuggaggugaggcagaaaaaauuagcagugucacagcacuccuccgucggacagcaccuacauggcuccugggcuguucucugagagacuggaucguucuggcccugcgaaggggauaugccuugggguccuucaccauagaagccuauaaacaaggcacaggcuuuguugcacagauugacagugaggguggcuaucuaugccccugcuuuccaggggccggauggcaccccguucacugccagcaugcacgguaagccccucaagacugcuccaccuggauggaaggacacuguuucccaucuuaggucccuuggauggggcuucguggcugaaauaggggaaguaaaaacaaugaccggcacagcuaagcugaggagugcugcaaaaacaagggaaccugaaaagagaccagaaaaaaagggagauccaacaaaacgggugucaaggagccaaauuugacaagaccuucuaaagacagguccaaaaacaaaauagacagcccaguacaauucuccuuagacuuuuaaaagucccuaaagccagagcgccaguuuaccacuaggguuaauccuaaacccugggcacugccucuagaaaaaaacccaaggacagaagguggugagcaccgccaccucuacacugacaagaaagcaaaguuuucuucaauguggugccauucauugguucccucuaaacaaagaguuuugacucugguggcuccagggcugagcguacuccaugccugcugauccucacaguuucugggccccugacuuauaaauguggauccagagauccauccaccugccuuugcgagaugagcacgccuccuguuacaaauuagacaugcuccucuuaccccacugugggucuacauaucagucucaaaacacaguuuggggagaaacauucuccugggagcugccuuuagaggaacgcagacaaauuccaucucugggcaagggcaauaagagccacacuccagggggaggccaaaugagagucaguaugugaccccacccaagauagauuguauagauacacgucucccaggaagacucagaaagguaacagcagcuacuccaaaacuaaagagggugaggauugugcauccuacacagaacccauacaacagcucuguguggccgaugcaaaaauguaacagcacccgaaggaugaugguugauuaccaaaaacuaaggugacucuggccacacaugcugcggucccaaauguuagccccaaaagacuaacugcuuguuuaggaauaugaaagauuguccuauaacaaaacuuucuugaacauacccuuagacccagagucccaggacauguuugccuucaccggugaggcccccaguggacccuucagguuuuccuccaggggugcucacaaaaccccacuacugccuuggcuugauggccagagaccuggcuguucgggugaaugccuugcaggucgccuaaaacauuguauagauaauaugucacugacuuacacagguuugagucuuuuaaaaaaggcuacccaaaagguucuaaaacaccuacaauucccagaggauagguugucaaccaacagaaaguccaggaaccaggggacaccauaaaaguccugaacauggucuagucgggugaagcugguuuuuccaacagccguauuugacaaaagacacagcugcaagcaguugaaauauugcagaccuuuguagagccacaaagauaugaaaggaccuucauuuccacuuggcccacugucucaggccaucuuacugccuaauuaaaagggggcgcaguggggcagagaugcguuuuuggggugauuccagccucagguuugacaaaagagacuguguguagagugaagcuacaagccugggccugauucaguugucagcugauggccucuuugggcagucacuuccuucaagacgacugcuaaacuaguccauggagcuguacugugccugaacccucauccugguggucucacuucugggauauaaccuugaguggaaauuggccuacagaguggcucuacuuuuccuggaggucuuaagccgugauaauauccaaucuuggcuuuagcuugggagauagugaucuuggggcccugaagauucucgcccauucggcagaagccagaggaccucuuacuaggggaauaucaauaauaguaacuuuucuuuuaaaaguuaauauaagaucaugcuuuuauauacuuuuuuuauuugaucauaauuacaacuccaugauguggguuguauuguucuaauuuuauaaaugaggaaaugaaagcucugagaggugaauuagcacuaauaaggaggaaggagccagguucagaacccaggcugaugugacuucagucuagugauauuucuacugcuguaugcucccucacaggggaagcaggaacaucuucuuucucaaagacauuaaacuaaucacaugaaauauuccuuugaaauguaacauuagauuagaagaacagucaucacagcaugacuaguaaacgaaugaaacuaauuccucccuuucccagaggcuacauggucaaaacagaagggcacacagccuuauacaagccagaaauccuggcagcuaccgucugaaccugaguuuuucccauuuauaaaauagaaucaauaacaucuauuuuuucuugcaggacuguuaacauacgugaaaacacuuugaaaaccuuacuauuuuuuauaaauucugaagcucuuuuauaccccaguuacaauuucuucaucagcuucaaugcuuuucaagauguuaggagaaaaaggauguauuagcacuuauuugcucaugaguacuuucaacuaggcugaagucauuugaaugaagagcucuggaaagagagagguuuggaagaauauaagagagugagauuagcuacugucauguuaagucacaggaaaacaucugagugcuuuggaauccaaggugcgugcucaugucucuaagccgguguggcugaguaagcggaaauguucgggccgagucgguacccugagaggaucagaacaccgucuguugcagccaguuaccuauguucuuagaggcuuaaaaauaauuuuuuuggccuccucaauacauuuuaauguaaaacacaaauaguggaaguaucuagacaguuuuugaaagaggaaauuuuaaaaaauuguccagaacaugaauaacccugccaaccugauaggaguuuaaagaaacucagauagaaaaaggaaaacuuuuuuguuugcuuguuuuuuuaccuguccaguuggagaccacuuggucaaaacauucgggucagugucagugagugugaguugaaacagaugcuggugggaaguccacugguguagacuuuccgcaaagauguuuggcaauauguguugagagccucaccauuguuaaugacuugaggucaagugauuccaauuauaggauguauccuuguggaaauaauauaguuguagauggcacaaauauugggauguucauuaugguauuaauuauaauugcaaaguauuagaaacaaccuaaauguucauuaguaggggaauaguuaaguaaauuauucgacaaucauaugaaggaauauaaucagccauuuaaaaucauguuuuuaaugauaaaaaaaaguuaacaugaaaaaaguuaaaaguaggauggaaaccugacuccuuacacacauaauuuauagaaagcuauauaucuuaagcuaauaguuuuauuugggcggaauauuuuucuuacauuuucuaaauauguucuccaaaauuucuacaaugaauauguuuucuagucagaaaaaaauuguuuuagaaaagaaaaaguucagggaagggaauguaauuguucauuaaauucagaccuuuuaaaauguaaaauaaaauguuaagguagugcuacaaauaaaaguuacaguaccauuucagcaagugaaugaauaacuugagcggauugccaagagguuauuaagggaaaaauagcagacuucuugggugauauucacauuuuucugguauuuauaaauaaaccaugaauuuuuuaaacuaguagguuaugaguuggagauuucuaaagguguuuucuuuauaccaccuauuuuuuacauagcgcuuuuuuuuuucccacaagugaggaaagcugaaaauuucugaauagaaagagcaguuuguuucuaaauaucacuugaaguucuuuuguuucuagaagagauguaauaauuccugggaauuagugccacauugauuuacucagaagaggacauuuuccuaaugagcauugugaaugagaugggacuguucagaaagauuguuagacuuuuacuucuguuuaaauauuuauguucagacuguggccagguaauguguaaggucuugaauaugcucauggacacugaaccucugcauucuauuuuuacagugucgcucuugcaauauauuaucacaucaaaaacagguauguggaugguugugugcuaaaaacaucauacguuaucuucuguuauguuguuccuauuuuuucauauucuaguugcuuaaaccuuugaauuauacuuucuuaacucauauuuucauagaauuucuaaagguaauauaauuuacuaaaacuucccagguaagugcugaacugcuuuagaaucaguggaaaccaaaugagcgugguugaaaccagcaaaacagacaaagcuucucaacgauguuuggcuuccuuuuucuucuuuauuuucugaaaaauuuguugaaacauucugucuuuuguaaaaugucacuuuaaaaguucacugggugcaacuuuaacaggaaaaaauguuuaauuuauaguuugaauucaguagaggcaauuuugguguaaauuuaggcaugaacuauuuuaauauagaagcccucucugauguaaguguaucuggcaauaguugguuaauuuuaaaagucaguuaaaacagggagugaaaaaaaacucuaccuuauacauuuuauuucaacauaaaacauguaagaauacauucauuugccaguuuuuaaaaaugcaacuucaagacauuugcuucaagcacaggacauugauuggagaaccaaaauguauuucuuucauaagccacagcuaucauuaaugcauccuuuccaaguuuuuuuuuuuuuuuugucaguagugagaaagcuugaagacauuuacauaacagaugaguauaaaauuuuuccaguuuugaccacaccuaaucuacagcaaauuuauuuuuagugauuuccuuuuaucggaucuuuccaaagcguccuccuucguuuucaugaggacauagccacucucaugguaaucauauuucaugcauaaugugacauucauguauguuacacgagucugcuaagcacagcuggugugaacuaguuugggaacaagcagagccaccacaugcuaagugcagagcucagcccgugggagccccacacguugucgguuuacaaagcgugguuagucagugcaggggagguuggaugacagcuucuaaugaacaguauuggagaaaacacgaauauccagaagcagacaccuagaaagggauucucuaugaucaccuauuuccauacuguaauugugauucaugguucuuuauggugcuugagaauuuuggauuuaagaacuuacaaaacagugcaacuuuggaacucuaaaucuugaauuagaguaauguaucagugaaaguguagauuuuaucuuguugccuauuucuauacuaguucaaaccuuuuaaacuuguaaggcuuaagaaacaguguaaucccauugaugaagcucaguugugcuuucaagacaauuuugcauuagaaucucuaagauauuucucaguacuuacuuagacuaugauggauccugaagugaauguagccagagcugauaauaaugaguuggcuuugugaagcaccuacucugacugcucuggucaguucuuuacaugcuuuaauaacaacuccuuaaggugauacugguaucuucauuuuacagauaaagaaauugaggcacagagagauuaauuugacuaagaugauacaacuaguaaauuggggaauugggaaaugaauucaaucuaccacucagaccauuaaucuauugcucuccuagauuaaugaugauaaauugcaccaaaaguaagugaguggaaguagagaaaguccagcugaaaaauugagcauuuguaaacaagcaagauuaauguacagauugccaccugcaugucucuagguaugaggagggaugcccgucugcaugccuucucuucgcucucauacuaggcuggccuuuggugcuggugauagaccuguuagcuugauaaaggugguguggugcuguucaguugggacacacagcuuuuagaggaaguaaggaaacagucuacuucucagaggauucuccagaauccccuuuccugagucgucuuagcucgagcucuuaauucucauuuauauuuuuagacucuguucucauuuuaaaaauuacuucaggcgaauguuucucuagggugcuggaugcuuucaggggcucucauucuccaggaaaauugaauggggcucaacugcugaggaaugggguccugggccagguucugucucuccuguagcaucuugaaugccucauagagauucaagauuugguuuauuugaaaacucaguaaauaaggugagggaauccgcugauucuuuguagcccagguugguaucagaguguaaccacgugcacccagaagcugcuuuuugcucacagacuaccugcuggguugaaccuuucuuucgcuuggguugaucugugucugugcugccuguguucaugcaggcaaauguaaaugagcacaggugugaaugcccagagcuuuaaaaauaauugcuguggcugagcgcaguggcuuacgccuguaauccuagcacuuugggaggccgaggcaggcggaucacgaggucuggagauugagaccauccuggccaacaugcugaaacuccgucucuacuaaaaauacaaaaaucagcugggccugguggcgcgugcuuauaaucccagcuacaagggauauugaggcagccucuacaaggaggcugaggcaggagaaucgcuugaacccgggagguggagguugcagugagccgagauugcaccagugcacuccagccuggugacagagcaagacuccgucucaaaaaauaauaauaauaauugcuguugugcaaauguaggaaugaaaauugagcuguuuuguuaagcucuuucucuuuuauuuuuacacagaugguaaauuucuaaagcagaaauuguaauguuugucaugauaaguguguguuagggacaggucuguagccuucugaaguucugaagccugacacugaagcacagacuauggaaauuacaugcagcuagccaaaagcugucauuuccaaguuugguuguuuaaagaaaauuuuuuaggcaaaacuuaaauuucauauaacagaugaaaguagagcugucacucgugagguacggaggguccccgcagagcccagcggcccacgguacuguguucacagugaaagcuaccucuuuaagugguucugugcacguaccagccugguaagagcuaacuguucacauauagguuauugacuaaagacuuuuuaucugucaccuguuguuuuucaguauaaaauugugaaacuuaaaugaaguagugacguugcguguugugaauaaucagacugaucucuaggauacauugauauucauucuuacccuggcgcuucuuuccuaucacccacaguauguugauggcuuaagcagauccaacaaccuuugcuuggaaauaagaugucaaauuuaagucauuugccuagauucgauucauuugaaaacucaaaaaauuaaaauuaaauuuuuacuuaauuuagcuaagugugguuuauaaccuuuauuuccuugggcuauuuuaaucauaagugauuaaguauugcacccaagaaaaaucauuauucaugaauaaccauuuagcacugacuuguguuucuugaaauaguugaauuggcugggugcaguggcucacaccuguaaucccagaacuuugggaggacaaagcagguggaucuccugaggucaggaguucgagaccagccuggcuaacauggugaaaccuugucucuacuaaaaauacaaaaaaaaaaaauuagccgggugugguguugugugccuguaaucccagcuaauuggaaggcugaagcaggagaaucacuugaacccaggagguggagguugcagugagcugagauggcgccacugcacuccagccugggcaacagagugagacuccguaucccaaaaaaaaaaaaaaagucauugaauuaaaauguauuuuuguuuuauuugaaugacauucuugcagaaaguaaguuucauuuucuauuauuuucccuaccagggacccagauggaaggaugcucuuagauauuuuugaugaaaaucuucacccucuuucgguaaucuccuccguguguuucaugagaugauuuaauuauuucucuuuugcuccaaucgggagaucagucaucugaaaauauuuucuuccccagaaauccgaagugccaccagauuaugacaaacacaacccagagcagaagcagauuuaccgguucguucggacacuguucagugcugcucagcugacggcugaaugugccaucgucacccuggugagugcccucaggauggccacacccauccccagccgaggugguccagggcccguuccuguuacucagcggagugagguuggagcagggaauccucaccagguuacccuguggacaccguggcauaagcuucaguguugucguucuccugggagaauagaggauagauaucccggaagagauugugaagauuguucuguagcccccaccuaaagucauuugugaaaucacguucaaauccaggaaaugcugaaauuaaaaaugcagguaaguaaaacaguagggcuaagagagugguuauauggccaagguacucccuguauacgucuagguuuccugguguugauucccuacaaagauuguaauaguauuaguaagauaugaugaauacauucaucuuauaugaacacuugucuaggaaggaguguguauauuccuagcuucuguuuugugacuuuugaguaaaugugucugcaggauauucagagacaguauggagguaacguauauuuuaagacucaagaaaaaauaaaaauuuguuuuuacagcugggcuccauggcucacgucaguaauuucagcacuuugggaggucaaggugggaggaucacuugagcccaggaguuugagaccagucuggacaacauagugaaaccccgacucuacaaaauuuaaaagucagcuggccaugguggcacguaccuguggucccagcuacuuggaaggcugaggugaaaggaucacuuaagcccaggaggucaggcugcagugagcuaugaucaugccacugcacuccagcccgaggggcagagcgagacccugucucaaaagaaaaaguauucuuacuuggauucuuaaaauguuaugcacuauuuaggucaaaucucacuugggaaauagauuuaacaauggaacccuuuuugucacugaccuuuuacauuguguauaacuuagaugagaaauuagcuuugccugugcaugagcuauccuggagaucagaauaccauuuccuguaguuucugagaagagacaauugucuaguagaagcuuuacaggcgaccgaaggacucuuugugucuccgccacaugaagagcugugugcuccgaggcuaacugaacagaaacccuguuggcuuguugcucauucauucaucuguucaucuguuuguucauuccuucucauugaacucacagccugaaggauaauagaacagacaaucaaguaaucauuagaugauuaggaaugauugcagguuccuaugucauaauugaguaauguauguacugcccagcuuuguuccucaaagggauuuuaaguucuaaccaaaacacgcaacagggcaacaggguugagauuuuuauguagggaaauucagugaagggaaaagaagauuaagaaaagcagaugaaaccauagaugaaauuaguacuggaauacaugccaugaggaaggauuuauuuugaaguugcuguagauggaaaguggcggggauuuuuucuaccuuuaauuccuaagaaaaauauggccuggcugugaaagauagugccuuccuggucgggauuauuauuuagcuugaaggauguucagggccagcauuuaaaccccacagcucacccagugucugccuugagagaacaucuaacaggcaucccuugcugcccucugcaucacucaccaaaggugacagggcugaugaguucauuucuuuggaguaguguaggacuggcacuuuucuugugaauaauuguaacuauugaaaucuucauuuguccuaugaaauagacugguguugaccaggauaccaguuuguaugggggucuuguugguugcagcuggagaggagcagccuuggaggccuucgugguaggugcagcccugcagcccauccucuggucucugcugucugcugaggcucaucagcgcagcugcaugcuuguggguagagggcacagagacgugugccuugagcaagacucuuguaggauuguucuucccuccucguguucccuagaguuagaaacagucauucaggacaagucuggccuggaguugacagagaugcauucauuaagcccuuauuuucacugggcauguguuuggcaucuuggcaugcugcucagcaggcaauggaggaggaagagcaguuagcccuggccgugcuucccacacggaguaggacugcagccugcuguggacagagagccuacaggcccuucaaacacccaaaccuacuucacccaaagcaaauauuucacagcuuaaucaacuuccuuuuaaaagaguaacaauaacuuagaucacuaaguguauuuuuuagccuccuagaauaugcugaaagcucuccuauggauacugccacaugaggaaauuugaaagggagugagguaauugauuugcaccuugaugaguuauguagaggccuuugugguguaccugcagcagcuggaggaagccaggccugcagugaagugggcagaaaggccuuggcauccagcugccccuccacgaggcccuucccuucccucaggagucacccaagcugacugauccugagaaccaugcauggcacccacuuuaguccuaugcgguacuucgacaacaugaaaagcucauugccugucugaacugggaucuucuguuggaaggaugagaaagccagaggccaaggcagaaggagauauauuggaagguccaggcaggucucgcauaucccuuguccuguaggucuggaaggacaucaggcuguagaaugaggcccacugcagguuucucuuccuuugggcugcuucucucaccuuugcgcacugcuguggcucuggggccuuaaugugcaggucggcuuucuugcuucggaugggauguggcaggacaguauuaauagcuuuccccacccuucaucaccucuccguuuaaggccgcacacccucuaacccagucuccucuuucaguuuuggagaggggagauuuugacuggccccaguuccuuuggggucagauguucaucuguagaaaaaucagucaugacccagaguugaaggagcuugguccugcucuuuuuuuucucacuuugcacgcuccucuguucagaaccuguggugguucccaucuuccucaaaggaaaacacaaagcccuuauguuacugacggggccuagcaagauuaagccucccaucucugcccagcugccuccacucuccucagugucaugcugcagcugcucuguucccuggauguaccggacacacaccugccucgggacuucugcaccucaggacuuccuccaccccuuggcacccagcucccucugucccagguguguuugagaugcguccugcccuccuccuccccaucuuugcucaaagggcacaucagggggcuguugccuggccaccauaucugaaguugcaaccucccuccugcaccgcacucccugcucaucacuuccugcuuuuucuccacuugcuuaucaccugucagcaugcuuuagguugaagucauuaauuuuauuguuuugucaguaagccccaugcguaagaaaugucuggucuuuuuguccaugugguuuacuacaauacgaccaacaucuggaacacagcccagcucauaaugaaugcucaguaaguauuuguugaacauguagugagcacaguaauaacugccuacuggcugaaguacaugguggugaugugccugaaacauaaggaucauuuaauaccuauuuauuaucuuccccugccccaguaguuuuagaacauugacacauuucauuucauugcuuaacuuuuuuuuuuuuuuugagauggagucucacuuuguugcucaggcuggaguacaguggcacaaucucagcucacugcacccugcaccucccaguuucaaacgauucuccugccucagccuucugaguagcugggauuacaggcuugcgccaccaugcccugcuaauuuuucuugaauuuuuaguagagaaggggguuucaccauguuggccaggcuggucacuccugaccucaagugaucugcccaccucagccucccaaaguucugggauuacaggcgugcgccaccacacccagcccugcuuaagcuuucugaagggacagaaaaaaacucgucaacuucggggacaucacucaacugaaccuugauugagcauuccgugugagguuaguucugucuguagagccacagcaaugggagagggagaaagagaggaaguuggugauugauggagggauuccggcauaagggaaggggaaccaagaagagaucgagguggcaaagugacagcugaccagacaggaggggguguggucccuuucuuuauuuccuauuuuuuaauagcuuuauugggacauauuuuauauaccauacaauucagccauuuaaagugagcauuuuaguggguuuuaguacauuguacaaccaucacuacaaccuaauuucagaauauucccuucaccccauagagaaaccccuuacccuuuggcauucacuccucguucuuagccuccacccaggcccaggaaaccacuaaucaaauuucuaugucauuugccuauucugaacauuucauaucaauaguaucucauaugauaguucaugauuggcuucuuuuacuuagcauauguuuuugggauucauccauguuguagcauguauaguauguccuuuuuuauugcaaauaauauuccauugaguggggauacauacacacacacacacacacacauauauauauauagaucuauauauauguguguguguguguguguguguguguguguguauguauauauagaucuauauauaugcugcagcccuaaucccuguuggagugaacaaaggaggaugaacgugagaauaaagacaaagacaaaagaauguauuuggaagaaggggucagggggcuccuugcuuuuagugaacaagggcccagagcuucuauagcccuucguauuuauugaguaaaggagauacagagaagggggugguugucagucagcugcuugacuuagagcaggccugcacagcugcauucucugaacaguagucucuagauguuccaguagauaaccucaaggagcacggcaccagggagugauuacacucaacaaaccuucugguggcaggugcaguugugaguuugcccacauccugcauucaugauaaacaguuugcuguuugaucauauagccuccaguggaaugcugaguuggucacaacccacaggcuuuuggcucucucugucucucucccuauauguguauguauauguguauguauacguauauguauacauauacguauauguaugagagacagagugaguguuggcccuccuuguacaagggcuuugcaccugaagauucagccaacuguaaaaugaaaaugugguuaggccugugaugguugcaucugugcugaacauguacagaauuuucuucuugucauuauucccuaaacaaaacaguauaaccacaauuuaccuagcguuuacauuguauuagguauuauaacucauguagagaugauuuaaguauacaagaugaugugcauagguuauaugaaaauggcucugccauuuuauaucagggacuugagcauccucacauuuuaguaucugcaggggccccuggaaccaaccuuccacagaugcugagggucacugcacuucauuuuguuuacucauucaucaguugguggacauuuaacuuguuucuacuuucuggcuauuaugaauccugcugcuaugaacauaaguuugugauaagauuuguauaaguuugugauguaguuuggcuguguccccacccaaaucucaucuugaauuguaugucucauaacucccauuauugugggagggaccuggugggagauaacugaaacauggcagcaguuucccccauacuguucuugugguaguggauaaguguuaugagaucugauggguuuaucagggguuuccauuuuugcauccuucuuauuuucucuugcugguaccauguaagaagugccuuucacccuccgccaugauucuaaggccuccccagccauguggaauugcaaguccaauuaaaccucuuuuuuuucccagucucggguaugucuuuaucaucagugugaaaauggacuaacacaguaaauugguagcaguagaguggggugcugcugaaaagauacccaaaaauauggaagugacuuuagaauuggguaacagacagagauuggaacaguuugaaaggcucagaagaacacaggaaaaugugggaaaauuuggaacuuacuagagacuuguugaauggcuuugcccaaaguggugauagcgauauggacaauaagguucaggcugagguggccuuagauggagaugaggaacuuguugggaacuggagcaaaggugacucuuguuauguuuuagcaaagaaacugguggcauuuugucccugcaguagagauuuguggaacuuugaacuugagagagaugauuuaggguaucugguggaagaaauuuccaagcagcaaaguauucaagaggugacuugggugcuguuaaaggcguucaguuuuauaaaggaagcagagcauaaaaguucacaaaauuugcagccugacagucugauagaaaagaaacaccauuuucugaggagaaauucaugcaggcugcagaaacuugcaggagagaauguuaauccccaagacaauggggaaaaugucuccagggcaugucagaggucuucagggcaaccccucccaucacaggccuggaggucuaggagaaaagcguuuuguagccugggcccacgguuccugugcuaugugcagucuagggacuuggugcccugcaucccagccacuccagucauaacuaaaaggggccaaggcacagcucgggcuguugcuucagaggguggaagccccaagccuuggcaccuucuguguggcauugagccugcagguguccagaagucaagaauugagguuugccuagauuucagaagauguauggaaaugccuggauguccaggcaaaaauuugcuucaggggcggggcccucaauggagaaccuuugccaggacuguguggaagggaaauguggggucagagcccccacacagagucccugcuggggcacugccuaguggagcugugagaagagggccaccauccuccagaccccagaaugguagauccaccagcagcuugcaccaugcaccuggaaaaauugcagacacucaaugccagccugugaaagcagucaggagggggacuauuccuugcaaaaccacagagguggagcugcccaggacuaucagaacccaccuuuuggaucagcgugaccuggagucaaaggagaucauuuuagagcuuuaaaauuugacuucccugcuggauuucgggcuugcuugggcccuguaacuucuuuguuuuggccaauuuuuccccuuuggaauggcuguauuuacccauuaccuguacccccauuguaucuaggaaguaacuagcuugcuuuugaguuuucaggcucauagguggaagggacuugccuugucucagaugagacuuuggacuguggauuuuugaguuaaugaugaaaugagggacuauuagggaggcaugauugguuuugaaaugugaggacaugagauuugggagggcccgggguggaaugauacgguuuggcuguguccccaccaagaucgcauuuugaauuguaucucccauaauuccccuuguugugggagggaccuggugggagauaauugaaucauggcacugguuucccccauacuguucucaugguagugaauaagucuuacgagaucugaugguuuuauaaggggaaacuccuuucccuuggcucucauucucucucugccugcugccauccauguaagacgugaccugcuccuccuugccuuccaccaugauugugaggcuuccccagccauguggaacuguagguucaauuaaaccuucuuucuuuuguagauugcccagucucagguaugucuuuuucagcagcaugaaaauggacugauacaguuuauaugugggcauaugucuucauuucuuuugguauauaucuagaaguggaauugcugggucauaugguaacucuguuuugaggaacagcagauugacuguuuuucaaagugacugcacaauuucagauuuccuuuggcaacauaaugagauuuucaguuucuccacaucgcauccuuaucaaugcuuguuagugucugucuuuuucauguuagccauucuaguggguuugaaggguuaggucauuguuuuuauuugcauuucccugaggauuaaugacgguugaacaucuuuucauguguuuauugaccacguuuucuuuggagaaguaucuauuuacauucuuugcccauuuuaagaacggguugucuuuuaguuguugcauuauaggaguucuuuauauguucuggauacaaguccuuugucagguauaugauucacacacauuuucuugucuguuuugucauuucuuuuuuguaaugguaucaguuugcaacuuagguuuuuauuuucacaaagcccaauguauuucuuuugucacuugugcuuaucuaagaaucauugcauaacccauggucaugaugauuuaccccuauaucuuccuuuaggaguuuuauaaauguagcucuuaaauuuaggucuaucauucauuuugagcuaauuuuugugaguuagggguccacauucguucuugugcauuuggauauccaguugucccagugccuuuauccuuuccccauugaacugucuugucacccuugucaaaaaucacuugaccauaaacaugaagguuuauaucuggguuuucaauuuuguuccauuuaucuauauguauuuccuuauaucaguacuacacuaucuugauuaccauagauuugaaguugaaauuggaaaguaugagucuccagcuuuuucucugucaguguuguuuuggccaugccauccaugauccuugcauuucccuaugaacauuagaauuagcuugucaauuucugucagcacccaccaccucaaaaauuuugggauuuuaguaggaauugcauugacuauguagaucaguuugggaaguauugcagucuuagcaauauuaagcauucaaaucucuucuaacauggaauaucuuucuauuuauuuagauuuucuuucauuuugucaacguuuuucuauaguuuucaguauacaaaucugacacuucuuuuguuaaauuuauuccuaggggcagggugcaguggcucacgccuguaaucccagcaguuugggaggcugaggagggugggucacgaggucaagagaucgagaccauccuggccaauauggugaaaccccaucucuacuaaaaacacaaaaauuagcuggguguggugacaugcaucuguagucccagcuacucgggaggcugaggcaggagaaucgcuugaacccgggaggcagagguugcagugagccaagauugcgccacugcacuccagccuggugacagagugagacuuugucucaaauaaaaaagaaaaggaaauuuauuccuaaguauuuaacucuuuugcaugcuguuauaaauugaauuguuuucuuaauuucauuuuuggugguuuauugcuagacuauagaaauacaauuuauuuuuauagauugaucuuguacccugccacauugcugaauucauuuauucuaauaauuuuuucaguagauucuuuagaauguuacaugggaagaucaccugcaaauagagauaguuuuacuucuuccuuuucauuauggaugccuuuuauuugguuuucuugccuaguugccacaguuaguaccucuaguaaaguguugaauagaaguaucacgagugcacauccuugucuuguuauugauauuaggugugaagcuuuccauucuucuccauuaaauguucugugugcugugugcugugaguuuuuuguagauguccuuuaucaauugaggaaguuuccuuguauucuuaauuuguguaguguuuuuauuuugaaaggguauuagauucuguuaaaugcuuuucugcaucuauugugauugaucauguaguuuuugucuuuuguucuauuaauauguuaaaucaaccccgcauuccgggauaauucccaguuggucacaguguauaauucuuuuuauaugucgcuggacucaguuugcuagucuuuuguugauaauuacauccauauuuguaaggaauuuggucuugugauagcuuugguuuugguaucaggguaauaguagccucauagaacaaauugagaaauauuccuucuacuuuuuuuuuuuugaagaguuuguggaagguugguauucucauuuaaauguuugguagaauuuaucacugaagccauguuggucaggguuuuucucuguuggaaguuucuacauuacuaaucagucucuucgcuuguuucuuauaggucuauucagguuaucucuucuugagucaguugcaguaguuuguguuuuucuaggaauuugugcauuucaucagcauuacccaauuuguugucaugcaguuguuccacaguauuccuuuaugauucuuuuuauuucuguaaagucuauaauguccucuguuuuguuucugauuuuacuuauuugagccaucucucuuuuucuugguuggucuaccuucagguuuuugaauuuuguuguuuuuuccaaggaaucgacuuucaguuucauugauuuucucucguuuuaguauuucuauuucauuucuuuccacuuuaaugucgauuacuuccuuccuucuacuuacuuugguuucaguuugcucuucuaguugcuuaauguggaaaguuagguuauugauuugagauuuuuuuuuaauacaggcaucuacaguuaugaauuucuaagcuuuaguugcauugcauaaauuuugcuggguuauacuuucauuuccauagauguauuuuuuaauaaacuuuuguuuuaaauuaguuuuagauuuacauaaaaauugugaagaaagcagaguuccuauaaaucccacauccaguuuauuuuuaacaucuauaauauuauaaaauuauauaauguacauaauuuaguaucuuagugugagcuguuuguuacacuuaaugaacugauacugguuauuauuauucuauuauuuuugcgacggaucucauucuguugcccuggcuagagugcauuggcaccauucauggcucucugcagucucaaacuccugugcucaagugauccugucccugcagccuccugaguaacuggaacuacagcugugcaccuucauacuugcuuaauuuuuaaaaauauuuuguagagacugggucuugcuguguugcccaggccggcuuugaacuccugucgucaagugacucuuccuccucggccucccagagugcuaggauuacaggugugagccaccauaccugcccauauauuauuauuaacugaaguucauuuuuacuccaguuuacuuaguuuuuacccagcaucccuuuucuucuuuaggaucccauccaagacaccaucuuguaucuaguugucauuacccagcaucccuuuucuucuuuaggaucccauccaggacaccauguuguaucuaguugucauuauccagcaucccuuuucuucuuuaggaucccauccaggacaccauauugugucuaguugucguuacccagcaucccuuuuuuucuuuaggaucccauccaggacaccauauuguaucuaguggucauuacccagcaucccuuuucuucuuuaggaucccauccaggacaccauauuguaucuaguuguuauuacccagcaucccuuuucuucuuuaggaucccauccaggacaccauauuguaucuaguugccgugucucccuagucuccucuuggcugugauaguuucucaggcuuuccuuguuuuugaugaucuugacaguuuugaggagugcuggcuaguuuuuuuguagaaugucccuaacuugggauuugucugacguuuuugucaugauuagacugggauuguauguuuuuuuggaggaaaauaacaaagguaaagcaccauuuuuagcacaucacaucaaagguacauuugaucaacaugacucaugacuauugaugauaaccuugaucccuggcugagguuguguuugucagguuucucugcuuuguagucacucuuuuucuccacuuucuguacuguguauccuucgaaugaggucacucugugcaaaccacacguaugcaggcaguuguguuccaccucccuaggugaugcauucugagaagagugcuuguuacaucagccugucaggaccacuggucaugccaagugggguugggucucagccuggggaggccuuggcagggcccagccauugcagcacggcuguccgaugccugccauucaaccccugaacugcagccuccaaaucccuucucagagucuugugcucugauggugaagugacuguggaaucaauugagucugacccugaaagacuuccuuuaugggucacuuuuaauagauucugaggaauucaaaagcuguuauucagguggcaucuauucagugaugaguccagacauauucaguuguuccuucaauugcuggcaaauaauaagugguggucaagucacuaguuaucuaaacuuagugacagggagucuaagaguugccaugccuaugcaaauucaguaaaguuaaaggcaagugcaauacaaauuauauucaucuuagcgcacaucacugcccaggauuucauaaacagauaccucaacuuguuagaucuacucuuuaacaucuauuucauuuuuuaaaaaauuucaguaaagaaugcuguucauaaucuuguauauuuguuuaaaaccccacuaaucgggugcagccugccauuuguaaaauacuguguguguugggaguccccaagaccaccucagguuugauuauucacuaaaaggacucacaggacccagcauauaguucuacagcugugacauauuacaaugucaggguacaaugcaaaaucagcaaaaaggggagggcccaugggucgaagucugaaggaaaaagaguccucucccaauggagucauacaggacacaguugaucccccagcaaugagcuguaacaauauggucaugugccacauaaugguguuucagucaacgauggaccacauauaugacauuuguccagaagauuauaguggagcucagaaauuccugucgccuagugacgucauaacauccuagcguauccuagguuucagguguuuguggugaugcuaauauaagcaaaccugugcugucagacauguaaaagucuagcaugugcacgguacauauaauacuugauaauaaacgacucuguuacuguuuaauguguuuacuauacuauacuuuuuauucuuaacuuuagaauguacuccuucuacuuauuuuaaaaaaaaaaaaguuaacugugaaacagccuuaggcagguccuucaggagguguucuggaagcaggcaggagaccacugcuuuguguguauuauugccucuggagaccuggcaguggggcaagauauggaggcggaaaacagcgauauugaucauccucacucuguauaggucuaggcuaauguguguugaugucuuaguuuuuaacaaaaaaguuuagaaauuaaaaacuaacuuaaauauaaaauagcuuguagaauaaggauauaaagagagaaaauauuuuuguacagcuguaugauguauguuuuuaccuaaguguuauuacaagaguccaaaguuuaaaaaauuuuuaaaguuuauaaaguuauaguaagcuaaguuuaauuuauuauuacagaaaaucuuuuucauaaauuuaauagagccuaaauguacagcauuuaucaaguccacaguaguguacaguaaugcccuaggauucacacucacucaccacucacucacuuauccagaacaacuuccaguccugcaggcuccauuuacuguaagugcccuguacagguggaccauuuuuaucuucaauaccauauuuuuauggugcuuuuucuuuguuuagauauauuuagauacacaaauacucaucauuguguuccaguuaccaacaauauucaguacagucaugugcuauacagguuugcagucuuggagcaauaggucauaccacauagccuagguuaauaguaggccguagcaccugcuuuuguguaagugcacucuaugguauucccacaaggauugaauugccuaaugaagcauuuuucagaauguacccauuguuaaaugacguaugacuauacuuccaagauguuguccaccagcaaagcccauuagagacagcacccaagguuuguguugaguguugguuacgcagacauccucuguuuagcacauaucaaaauuccagagucccagaaggaaagcaggcucagcauaaaccaccuuguuuguacaccuugugugcauagugagcugcucuuaccuguccugggaaugcuaggagcccuccugaaauggacacucuucaaaugccaacugaggucagccccagaagcagccuguucugagcauggcagucucaggcuugcuguguucacucuuugcugcacacugugcuguuuuguucuuucucuucugcuuauauacauuuuuagguagaugaucaggaucauuuccugggcugcaaaggccuccuuuuagagggcagaggggguuguuacugauggcaaaugcuaagcaagcauguguucaugugugugcacgcauguacacucaguaacauuugaaaaucacaacaugacuaauccuugccauguagaaaugaggggcuggggccuuccaguguucaaagaaacccagacuuauuuuugaacguucccuguuguuagcugagauuuuuaaaagaaaucuccaagccaaacgaaaccugucugugagcuacucccggacuguggauugccagcuuugcuucaggugggagggagccgucaaggucuuuagacagauauucuguuaauucccuggggcugccagaacaauguacugcacacuggguggcuucaacaccagaacuucauugucucccaguccuggaggccagaaguccgaaaucaaggcacuggccggguuaguuccaagggcugugagggaagguucugcuccaggccucucucugacguauuacaaugugugggugcccagccucaugcucacgcagcguucuccugugugcaugucugucuccaaguuuccccuuuauguaagggccccaaucauauuguguuagguccugcccuaaugaccucguuuuaacuccacuacaucuguaaaggccuugucuccaaauaaggccuuauucugaggcacuugggguuaggacuucaacauaugcauuuuggaagaggggacacacuguaacccauauccacaggauaccaacagaaucguguaagauuuguauuaagaucucuccagggauaccagcaaggagguuauugcuguaguuuaggguaaagauuauacuuuauauuaauuuauuaaccuauauuaauaauauaaauguguauuccaggcuauuggaaaaucuuccagcaucagguacaaaaaagaauccaaaugugaaacuggcagaaauuuuauaaacagaaaauaauaauuacuuuuuuaaauuauuuuuguuggccauaaaagugauaauuuauggagcauugcugaauacagggaguuuagguagcuacccccauucccucaaaauaguauguuuaugagacagcacucuggaauuaggguguaauugagaauggagugaagcuaccaacucacuucacagucuucacccguaugauuucaaccucagccguauuggaacaugcucuaaucauccaaaccaaacagcugaaagacggcagauuuaaaguccagaaagaaauuauaucugguacagauucagacaauuaaccggccuaguauuacucuuuaaaauuggauuggaauaauuucagcaucauugggaucucauuugcauauauccucaauuccacaaguuuuauccccuccaaaugccucugaacagcuuugugaugugcagucagcugaugccucuuuguagcuccauaguugcucauuaaccugugguuuccagagagacuucuuaggauagucauucucaugaauuaaaucugaaaacuuaacugaguaagagugaccuguuagcaauggucgugggauauuguuuagaaaaaucaaccguguauuauuuuacuuggcagagaguuaaaauauccaagugggaguuuacuaaagaaguugcagcugacccuugacuauaguuuuauuggcaaguuuugcuaaauuacauauuuuuaagucuagcuuaccaugaaugccuuaucucccaauauagcaacugcuuucccucuguuacaggauguauuguguugucugauugcuucaguuagccguaauggaauaucacaccugguucaugacuguuuguuuuuuucccaaacauuaaguauucucuuaaauauuacuaauauaguuauuaauauucaucaacuaagguaaguuaaaagucagaagaaaacauagucagcuuuuuguauugagccagugagcacugaccucugcggagagcuugggagguugcagcgccucaugucuguaaaggaguggaaucucugggaucugggugaagauugagucacagucuucuuuuucugcugcuuuaaugaucuggagguuuacuuaggcccagucccuguuuucugcucucagcacagugguauugcacauuuucugguugucucuuuguuggagaguaagaggauuugucaucagccuuuguaaaauacgcagccuggggcccuaagaucagugccagcuagaauuccacugagccucaccuagaucuuuaucugaagaguuacgauguucacacagaggacaauuaugaucuaaaacauuagcuuauucuuucuguucaaacuuaauauaauaaaugccguuaaaaaugaaaaucuccaaaaauugauaagguuauucagcucucuugagugacuuucuuuuuuccaccaacaguugucacacucaaaugcuauuguugagugaaggacccuuggaaacccccacaaaggccuuuccagugcaguuacaaugccgugcuucaugacuuccugggccuuauuugaaggucucuuuggcuucccgugugcccauagcugccuccucugaacuuuguuguucaccacugcaccugucucacaagccaaggacucaguuucccuuaauucacuacaccuugucgaugcaguucucuuuccugaaugccauuauuuguggucguuuuacuagcgaaucacucguauguagucccgcugacuuccuuugggcuggaaaucugcccuuucauagcucuuucaagagccugccggagcccuguguggaugcggucccuugucgucccugcaggaccccauaugcccaugaugcauucagggagcacgcucugccggccccugggcuagaugcugcacauacuggggaugagaugaggguuuauccaggcuuccuauccagggaagaggcccuuacacuacugagauaaaugcagcauugggagcaagcagagggucacccaacuaauuugggaaggucaagguggucuuucccuguaaugguuuuccauuuuauuaucaguauacuuagaaccucuuacuacagcuuauuggcuauuugccuuugggauuugaaacauguuacuccacuugacccaugaacaacuccaggguuagaggcauggaacccugcacaguugaaaauccacauguaacuuuugaccccccaaaacuuaauagccuacuguugacugaaagccuuaccuguaacauaaacauuugauuauuauuuauuuuucguguuauauguaugcuauacuguauucuuacaaugaaguaagccagagaaaagaaaauguuaagaaaauaaggacaaauauauauauacauaaauauaaauauauauauuuauguauauauauauauauauauuuuaugagacggaaucucgcugugucacccaggcuggagugcaguuucacgaucuuggcucacugcagccuccgccucccggguucaagcaguucuccugccucagccucccaaauagcugggaucacaggcgcguacaccaugcccagcuaauuuuuguauuuuuaguagagacgggguuucaccauguuggccaggauggucucgaucuccugaccuugugaucugcccaccuuggccucccgacgugcugggauuacaggcuugagccaccgcacccagccaagaaaauauauuucccauucauuaaguggaaguggaucaucauaaagguugucauccugguuguuuucgcguugaguaggcugaggaggggaggagggguuggucuugcugccucuggggcuguggaagcgaaagagguggagaagguggaagggaggcaggagaggcaggugcauucgguguaacuguuaccgaaaaaaucugcguauuaguggauccacacagcucgaaccuguguuguucagggguuaaccguacuuucuuuuuaggauuuuuacuuugucuucaguacagugcccugauccauucuaaggaacaucugauaagccauaaaaauccagguuuuuaagauuuaaaaaacugcuguuucauuaguaaagcacugaacacagaaaaguaaucugaacacagaacaauaaucuuuuuaagcaagaaaccauuagucauggauguuuucauucagcaaacaguugggugccaacuccgugccccucaccacccaccccacccccccccgccccucaucaugccaaaccccuucucucgaagaggcagagaagagucugaccugccccuccccaccucaccaguuucucaggggcuucacaacugcaccuggcaaaauaagccacaaggaagcuucugguugcuuuggggagcauuagacccucucacucugacugugguuuagggaugaggggugggggguucugcagaguagcuggucaagccacgugacccuaugcuguaugugacccugugcugcucauggcuuaugacccuacagugcucgugacccugugcuccucauggcccaugacccuacagugcucgugacccugcgcugcucaugacacaugacccuacagugcucgugacccugugcugcucauggcccaugacccuacagugcucgugacccugcgcugcucauggcccaugacccuacagugcucgugacccugcgcugcucaugacacaugacccuacagugcucaugacccugcgcugcucaugacacaugacccuacagugcucgugacccugcgcugcucauggcccaugacccuacacuguucgugacccugcgcugcucaugguccgugacccuacacugcuugugacccugcgcugcucauggcccaugacccuacagugcucgugacccugcgcugcucaugacacaugacccuacagugcucgugacccugcgcugcucauggcccaugacccuacacugcucgugacccugcgcugcucaugacacaugacccuacagugcucgugacccugcgcugcucaugacacaugacccuacagugcucgugacccugcgcugcucaugacacaugacccuacagugcucgugacccugcgcugcucauggcccaugacccuacacugcuugugacccugcgcugcucaugacacaugacccuacagugcucgugacccugcgcugcucaugacacaugacccuacagugcucgugacccugcgcugcucauggcccaugacccuacacugcuugugacccugcgcugcucaugacacaugacccuacagugcucgugacccugcgcugcucaugacacaugacccuacagugcucgugacccugcacugcucauggcccaugacccuacacuguucaugacccugugcugcucauaguccgugacccuacagugcuugugacccugcacugcucauggcccaugacccuacacugcucaugacacuguguugcuuauggcucaugaccuuacacugcucaugacccugugcugcuugcugauggucuuuuuauccuuaaucugcccggaguuuugcuuccauuaaggauuguucuccgucccccucuucugcccugucuucccuccccacuccuuuugucccucuacccuuacucccuugcccuucucucccuggccucccugcugaaucccccaugccugcugcuucuccugccccuccaccugcacagucacugccucuagaguccuugcucguccaauuuaauguuuucuugugcaagaggacacuucaguuuccuucucaaaugccccauauguuguaagccuaguuuaggcacuugcaaacacagcuuugccuuagaaguucuuuuccaaacuauuacaagacucaaacaagagcaccacauaccagguuuuacuccccccucuucuuuguuaccccuucauccugucuccagccuuaaaauggaaggggcccuccagucucaggaccagccccuccuuuucuuaguucuuaagccucccccaggucccuugccccuggcuuugcucugucugccugucacagacucucaaacuggcaccccaguuugagcuccagaccugcauguucacuacuuauguggcauccgcugggacauuucaagacagaaagcguccagagucaggccugugaucuuuuaccaaccucuuccuccccagugcacccugucccagagaacacaccuaccuagcugugcaagccgggagcugggggucuuccagagcagcccaccuucugugaucguuggguccccuuuacaggccuugugcauucgcaucccguaagagaccucucccaaucaguguuaauuacccuuuuucucaagaacuuccuaaaguucagccgccuccucaaagacauccuaaugaaguaacaagugugaauucuuccuuuucuuaaaaaacaaaacaaaacaaaaaaccuuucccauuccauuugggaguguugguaucauuuaacugaaaauaaucuguauuuuauuuauguguaaacauuuuccuuuccacauguaccuuuuugcguuuuguaauauuuaagacuuuauggacauuauauacugugaauaauuauaacauuaauggguuuuaucugcaaguucuuaaaaauagcauggauggugucuguuuaauuuuguuuuuuuuucuguuacauuuucacuuugcaaaugcauuugauaaaaacuguaguaguaauuucauaguucagagaaguguaagacguacuaucaauaauaaacagaguucuacuaugggaaacuaaaaaagacauucuuaccucguggcccaacuuaaugggcuuuguagauauuucugaugucugucuucaaccuaaacucugucaguuuagaaauccuguauuacuugguuuuauuuuccaaucauuuuaaugauuuaaaaauagguauauaaaauccuaaucgcagugauauacgacuucacacacauuaggaugacuauuaccaaaacaaaacagaaaauaagaaauguuagggaggauguggagaaauuggaauccuugugcauugcugaaaugugaaauggugcauacgguggaaaaugauauggcagcuccucaaaaauugaacauaggauuacccuaugauccagcaauuccaccucuggguauguacccaaaagaauuaaaagcacggauucaaacagauacuuguacaccaguguucauagcugcauuguucacaauagccacacagggggaacagcucaaauguucauugacagaagaauggauaaacaugaugguguauaugcauacagcugaauauuauucagccuuaaaaaggaaguucugacccaugccacaacaugggugaaccuugaggucauuaugcgaagugauaauaagccagacagaaaaggacgaauauuuuauuauucuaccaauaugaugugccaagaguagucagauucauagagaauggugguugcccggagcugcggagagggaggaaguggggaauuauuauuuaacggguauagaguuucaguuugggaagaugauaaaguucuggagauagaugguggugaugguugcacagcagugugucaggugaaugugguaaccaccacacugcagaaacaacacaacagugugaauguaccuaaugccgcugaacugaaaaugguuaaaugguaaauuacauguuguguauauuuuaccacaauaauuaaaagauaggcuuaucaacaacugcauguauaucuauaguuaucucaaaacaaaaagcuuaauuuaaaaaacccuacaaacaaaaaaaaaguguauucucuauacauucucuguccuuucuguuggaacagucauuaacauguauggauaucacaguugauagagugagaaauuagccugugcuuccuggaauuguuuccuccacagagucuguuuaagauccagcugcacccacacuguccacuaauggagugggacuuuuagcccacguuucaucagacucauugagucauuuggccuuuuaaaaauaaaugugauuggguaauaaauucccauuuaaagguggauguaauacauauuuuagcauuucuugaggugugcugguguuuaggagaaaacaaaucacuuagcucuggcauugucuugucuucccagguguaccuugaaagacuuuuaacauacgcagagauagauaucuguccggccaacuggaagcggauuguuuuaggggcgauccugcuggccuccaaggugugggaugaccaggcuguauggaauguggauuacugccagauccugaaagacaucacgguggaggacaugugaguuggggggcagaggguguuggucaucagagucuuggccagaccauuuggaaagaaagcugccuccuuuuuuaauggucuguauagcgcagaaugcaugcauuugacugaaugucuguugugagcuguuacaacaggggcauggcuguggaauauuacauaugaaaaccugcauuucucaucauguggaucuugaacagguacugguaacaccuccugguuuugugaaacugguuuacagaaacuauauuguaggcaaacacuccuuuaauuagaaaggugugguccagcacugauagcagccugugaugguuuauauuugggcuuuguaucucacugcagacugaucacagagagguaaugccgccauacaguccuuuguggucaauaaggcaauccaaaaagcacaaaagcuaaaauauuuuacauuuuuguuuaguuucacagagaaaacauccacugcuuugucauguuuugcagguucaguugcuucaggucagccucgugucccuggggcucccacuugcagcaugaacagggcucggggagggcaucgcccuuggggguuguggggacugagagcuguccacuccccucacucucugggcagugucaggguuucucagaugggccagucuucaauuuaggugaggauuauuaguaggacaccugcagacuguugucuggggggucucuagggacugggaauccaggaacugaguucagagcccuuggggaagaaggaauuguagaaaacaaucagauagcacuacuugacuuacaguuccuuaugauuuguagucacuucugacauuauuguugcuaaaacuuuucucauacuuuuuguuuggcaaaccuccucaagggggcuuuaagcuggaggagguuaccagcucugucucagucuacacccacaucccugcccccaguaauccucagaugcaggaccuucccagugccugugacaacuaccacugcaggggugucccugggcugcagacucgugggcauguggguucuggauuccgcagcagccuagggcccuccuugccucugguuacugacuccccaggcacccauuguuguggcacccuuugaagcacugcuuguuuauguucuuagggcauuuguugcagagccuauuccugcugcagaccuauaaaauuucauccugugucuuuaguucuuuauuacauaaaguaagaaacacauaaagaaguuuuuuuaaucagaacuauauaguaagaaaaauaaaauucuugacuauauuucauggugaaaacagcuacuaaaauaguugucauucauaucauaaaggagguggacauuugggugcgagguauaagaaauucuggccuguuuucuuuauuggggauuaucuuugcucagcugcuugguaucauuugacacugaacagcacgucacaugaugacuuccuggcuguccccuccuguuagaugauacaugaccagugacuugguuuagguggugcucagguucugugagagcacagagggccccccgaccaugacuagguguguccacuuaaagccagaauaccuaaugaaauuagacuaggucuuaaauauuuugauuuguauccuaacuauauuuccaaaaggaagugagagacaaaugcaaauugcagauaccacagaagcaugaaaacaaaagagaacagagaaaaaugaccagugaauaacauuagagguguggaggagaugccuuuuguacucuuauccuuaacccaccagguuuaauucaccaaaaugccagcaaacugaauuuucauggaaacuuaagaucaauggaaaauccucuuaguugauuucaaauuuugaggaaauguuuauaaaauauuugucaggagguacacacugcccaguucaugcauaugucaguugaauccucucagcaacccugugacauguguacugauguccauguuacagaucuggauacugaggccuagagagguucaauaaugcuccaacaaaauaaccaaguggggagguuuauccccagcugauuaagaaaggcucaucuuucuuaaucccagugaccauucauuauacaguagucaaaugaaaaugauguguacugguccucaguuacgaagauguuuuaaacauucauuuuuaauuuuuccuucucucuuuaaauaaaaagauaggaggguaaaguaacaggucauuuggaauucuagguacuuagguuguauucauugaagguuuaaauucaagucaguaaaacccaauuaccaggaauauuuauaaucacaauaacaacaacagcagcagcagcuauccuauauugaguacuuccuagcucaaaagaaaugauuuuucugcguuaauucacaucucacauuuauccaugaggugguacuauuauucccauuuuacagauggaaacgaggcccugagaauuaaguaagaugcccaggugacuugacuaguaagucagucacaaucuauguuucuucuaagcaauuggagcuacaguuguuucauuuaauacuuaauuuaaaaaacaacuguuuuuuguaagucaacucuuuuucuacacagagaaguuaaaacaguuggccaguguucauucagcugaaauuaacuuaauaucaagaauuguuuugauaaugauagccuuaaugucuguucuuuugaugggcagucaauaucuuaaaaaauuauacauuauaauaagguuggauuuuuuuucaagugcaaaauacuaauaguuacuguauugaaugaagcugcugcuuuacucauuaagauuuugaaagaaccagcacuaugguuaguagaauaguaggauugauguuaaaacucuauuccauauuuuguccaaagaaaauugaucauuuuuuagccuguuuucugucuuuuuugaaagcuguuggugcccaggcuaccccauugccaucugagccacuggcugaaccuuagugacucaugcagcauuugaucagugccccacaugccuguagcugggcaaaggaaggaggcauucaggaagaccugauguuucuaaaaggucugaccauaaauaguucuccugaagaaacuggagugccaccuuuuuccacugcccucugucaggcuggagagcagaucauggggagaugcagcucaggugccuugugcuccucugcuuuccuugcagagcucugaggacugcaggcccugaguaggcaaaguuguaaccuggccagacugaguccuugcguguucagauucuugcauauuuuauucuacuguuuguuuugagagccacugugauccaucuauaauauacuguuuacucuuugguuauaugauuaccacacuauaagacucuauauguucucuguagaaaagcugaucaaacaauugcguauauggauauuuggggaggaauagacacguuuucccccugacagaagauuggagggagcauggagcuuccuucugauagggguaauagcugaaaggaugcucugaaccacacauaaaucaggaauuuacaguuccugauuacgcagagguacuuggcacgguugugucuccauuccuuucuggaggugccagccagugaccacaauaguggaggucuuuauacauuuuggccuguuuaucccuagaaguaguuuggaaaauuuuauauccucacuacauuuuuuuuuuuuuuuuaagacagaguuucauuguuguugcccaggcuggaguccaauggcgugaucuuggcucacugcaacuucgcuucccggguucaagcaauucuccugccucagccuccugaguagcugggauuacaggcgcccgccauuaguccugacuaauuuuugguauuuuuaguacagaugggguuucaccauguuggccaggcuggucucaaacuccugaccuuaggugaucugcccaccucggccuuaauuugaaaauuuuuaucccaaguuuuaguuguuguaaaggauguuauuugcaauauauuuuauauaguaggguuuuaaaguuaaaaguauucauuagagacugaauauaccagaguaauaugaaacucacaguuacccauuuucuuagaggugaaaauuuuacauugcugcuuuuucuccuugaacucauuauuuucuuucuaguuuccucacacauuagccucuucuucaaaauucuccauaucaaaaauguacauuuaagucaaaauugcaguaguguuuucuggaugauaauguucuaauuuauuaaaaacacuuucaggucugaguugucauuaguacacaguugaucaaaauauagacauacuaaagcugggugcaguggcucacaccuguaaucccaacacuuugggaggccgagguggguggaucacuugaggucaggaguucaagccagccuggccaacauggugaaaugccaucucuacuaaaaauacaaaaauuagcugguacugguggcgcucaccuguagucccagcuacucaggaggcugaggcaggagaaucgcuugagcccaggaggcggagguugcaaugagccgagaucgugccaccgcacuccagccuuagcaacagagcaagacuccauuuuauauuuaaaaaaaagucaguauaaauuauuaaauauacaaaaaguaaaaccuuaugggaaauagauuucuuaaugagaucaguaguuuguucuuucauuaguuuauauuuuuguguaugaugauuauugaaaccaggcugagcaucaguuuuauuccccuuucucuucuuuugccucuuuggugugaguucagagcgcauguucagaugaguaggugaaauuuugaggaguuuuauuauaguagugucacucaagucuuaaaacaguuuuugaauuauaugcuaaaauuacacagccaucuauuaguaaaggcuauuuaaaugagccuaccaaccccugcuucaguuuguugaaagcaaaaacuggaaaccaucuaaguagccugucacuagagucauucacuuuuccagcaccacauguugggauauagucccuuuccuggguuccucagagggaguucccccugaggcagugaaccuuaguaagggcaggugagcagccugccuuucccuuccaggguaggagaagagcaacugggaaagaagaagccagaaggagaaccugcacacacagauuuguucuccagcaagucaguuuuaggagagugaaaugaaaguuacagaucuagaaaucucuuuccuaaugcuguguucucaagcaugcuuagagacacuuucuguacuauaaauugaaugcauaucccagcuugaaguccagagucccgcugaguccuguaacagaugcuauucaugacaugggcugaauugucuccucuaaaauagaugugugaaguccuaacccccagacccucagaaugugaccauauuuggagauauauuuuuuaaagaggaaauuaaauuaaaauggggucauuagggugggcccuaauccaguaugucugauguccucauaagaagagauuaggacacagacaacacagagggauggccaugugaggacacagagaagguagcgucugcaagccaaggagagaggucucggaagaaaccaaccccacuaacaccuugaucuuggacuaguagccucuagaauugugagaaaauaaauuucuguuguugaagccacccagucugugggacuuuguuaccugugcuagucuguagcccuagccaacuaauacagauuuugguacugggaagugaggugcugcuguagcaaauaccuaaaaauguggaaguggcuuugaaaguugguaaggaauagaggcaggaggaguuuugaggugcauauuagaaaaacccaagacugccuugaagggauuguugguagaaaugugggcauuaaaggugauucuggugaagacucagaaaagaggacagcuguagaaaaugccucuaccauuuuagaugcauucacaugucaucaugaacagaauguuguuggcaauaugaauguccaaggugcuuauggugaggucucagaaagaagugaggagcauguuccugggagcuggaggaaaggugauccuuguuaaaaaguggcaaagaccugaccaaauagcguucuaguguuuuguggaaaguggaauguuuaagaaaugaauguggauguuuuagccaaggagauuuccaugcacaguguggaagucacagccuagucccucuuguugcucguaguauacugugagaggagagagagaaacagaaggaggaggaauuauuuaguaacaaggaaccaaaucuucuagcugaagauuuagaaaucucaaaucuucuaaucucagucuauccauauggcaaaaaaaugggaaagugugcucuggaggcaacacaagggugcugggacagcauuugcuaaagagauuacagaugugacagauggauccagucagccagccaucucagcagaagcgcugccggcuugcaccaaagggcccagagacaggacaggugaagcaaggcugucguacucuggcauuccacgggccagcagaacugucuggcaugacuugugauauccuccaaggaaaggggugaaugauccugagaugguaccgaggccagcaggucugccacugccaccaugggcccagcaggcacagccuggagugaggcuguuuccuccuuggcuccaggggguuaggccaaggcagggcugccuaccugggggugggugauggcgcaucagcagagaggacuuaagucuucaaucccuggagcuugcccugcuagauuucgggcuugcuggacacugugaccucuuucuuucugaguuuucuuucuuuuggaaggaaaggggaugccuguccuaugucuguccuaugccugugccaccauuguauuuuagaagcaggucacugggucacagcuggagaggaauuuugccuuaggaugaaucauaccucaaucuucacccauaccugauucagaugagauuuagauaggauuugggacuuagagauggagcgggaaugcauuaggacuuuggggcuguuaggaugaggugaguguguucugcauguaagauggacaugaauucugaagggcacgaaggcaguguugcggggcugaacuuugucccccucaaauucacaugcaaagcccucccaaccccuaguguuugagaauguaaccaugucuggagauaagguuuuuaaagaccuaauuaaauuaacauugguucauuuggguggguccuaaccuaauaugacagguguccuauaagaagaagagaucagaacacagggaacagacagaaggaugagcaugugagacucagacagccaccugcaagcuacggagagcagccucaggagauaccagucugcugacagcuuggacuuacagccacaaacuguggggaaaaaauucccguuguuuaagccccuagcauuuucauuacagcagcucuugcaaacuaauacacccuguaaacuuuauuaaaagaaggaaugaaaucuacauucuaggagcugcuggagauaucuguggacauagaugcugguggagcuagaggcuccaagugauuuuguggcaccugcacaguaaaauagauuuacuauuagaauuuuuagaaaugaauacuucauucagucuuucccaguaaaaccgugugagcccaggaauugguggaauuggacaucacucagcugaauggcugagggaaaaucaugacuccucgguagcccuuuauggggagaggagguagcacaaggcucacuggaagcugggggcccugcaccaagguaaagaugagcagaggcacugccggugaguuuucccagcauaacuucaggaauagagcugagaugacacagccuguagaacaggggccuggacagccacccaagcugcacucccuaccugcaguaccuuagaugaacaauggguuccuuccacaaaucccacuugggugucccagaaugagggaggugcgugccaggagcuuguccuucuuggcacgcuguggaaguccccaagauccuagaauccucuuuuucauccccaagugggaaaagagucaguggcuugggccugaggguggggugggaggcguuugggcaggagaagucucagauauccuggggugggcuccauccuaucaagggcugcccugcugcauuuuucuauaaucccaucacucagaaagaauauugcuaacauuuuuauuauauagaacuucccaguguuuacauagauuuuauuuuuacaaaacugggcccauacuguacgcguuguuuuaaacuuuuugccauuuagcaguguguuaaucugugguuagcuggucucaguuuccuggcagaggcaaacaacccgagcucucccuuggagcuccugagcagggagagggcucacagguuucagcuggaaaccuuuucaaaugggguuuuugguagugcuuguucuucuagguacccuucuuccuggccuccugugucccagcuuccugaagugaccuuccugguauuuuugaccauaggcuaaucuccugcucaagaauuauccaacagugagaacuugacugggagucuccccauguaccuuuggacagagggguucuggcuuggaaggcagcugacugugcagcugcguaucugugggcgcaggcugaagaacacuguacgacgagugucacugagacuugcaggcagaauagucagggcaccaggccauguggauagucaccagcaccagucagauguuagcuucaggcagaccucaugugggaagauggggccaagggccagccuuucucccacucucaccaacaaucaguggucacagcaucacaggccagcuuagagcaagaaguggcaaccgcuguggauggggaaaggacagugaaauuucaccaugcagaguucuguaggcaaaaauacuguuaaaaaaaauuacaccucgagguuugucuguuucuuguuuuuguuuugcacuguucccguaaaugucauuuucauguguagacaaauccaaauaaggagaaaucaagugacuuguccaagcauugcauggcacagaaggucacagagaaagaacuucaguuccucuguagauaccugguuucuggugguguuuuguuuuuaaauuguaguaaaauguauguagcaugaaauuuaugauuguagccauuuuuaaguauacauuucuguagcacuaaguacauuuacauuguugugcaaccauuaccaccauccaucucuagaacccuucauuuucgcaaacugaaacucucccccuguuaaacacuaacuugccauuccuccuuccuccagcuccuggugaucacuguccuacuuuuugucucugugaacuucacuacuuucaggaccucacacaagugggaucauacagucuguguccuucuguguccagcauauuucacuugccaauaauguccucaggguugauccauguuguagugugucugaauuuccuuucuuuuuagggcuguauaauacuucacugggggucugugucccauuuuguuuauccacucauccacccauggacacuuggguuaccuccacauugggcuaguaaguggaggcuguaaguguggcuaugcagauaccuuuucaagacuuuguuucuccuucuuuugggaagugacccuaguuucuagaaaaguaggcagcauauuagaugauuaaaacagcucuuuuuaacaucauuuuagaguucuauuuucaaguugcugaauuguaccaaauuggguuuuuauacaguguugaucuagugugacaaauauuucugaaaugugguuuuuguuggucgacuugaauauauuucuuacaacguuuuacaccaaaacuguuucuucauaguuaucuaaaugcagauaguaaauccaucaggcccauucuuggcaucacguuaguuuucugauaauuuaucacauagcaagcugucagugucccuguaaaagaugugcugcugcaguuuggaaauucaaguuuuggaaauuauuuuuauuuucuaaaucuuuagaaaaaaauucauuuuuugaaaauacaacagcucuaaaaucuauuuucccaaagcuuaaccagaaacucaagcuuggagaagguuguucuguuuuccagggaacccugggaaaauaccgccuuguucaaaagcagcuuccucuugacuuugcucguagugucugccuccaucuggaaccauggugucuguauaucauuuugggcaggauuaucaggcuguucucuuagacuuuucuucuuacuauugggagaauacgcuuugcagugacgccuguugaccaccagacggcgguguguccauggcagcucccagguucacuugggauuugcuccuuugacguuugacaguucuggccuuagcagggccucugacgcuuucguuuuguugaagucuuaccuggauuccaguauuucacaggaugaucucuuauuaaaucucauuuaaaugaagcauaaauaaaaguuguuuuaaguaaaaauuaucccaaaucaaaguaaauuauuauuuauuuauuuauuuuugggacagaguuucgcucucguugcccaggcuggagugcaguggggcaaucucggcucacugcaacuuccgccuccuggguucaagugauucuccugccucacccuccugaguagcugggauauuagaggugcccaccaccaugccugacuaauuuuuuuuuuuuuuuuuugagacagaguuucgcucuuguaguccaggcuggagugcaauggcgcaaucuuggcucgcuucaaccuccaccucccggguucaagugauuccccugccucagccuccugaguagcuugaauuauaggcaugugccaccaugcccggcuaauuuucuuuguauuuuuaguagagacgagguuucacccuguuggccaggcuggucucaaacuccuaaacucaggugauccacccgccucagccucccaaagugcugagauuacaggugugagugaccacacccagccuaaauucuuaaaacuaugaaauuuaguacaguaaauacauuuggagcuuguuaucacucuuuucacgaggcuguguggaaacaagcagugacgcucuucaucugaugaagagaccggaaugggccuuccucgggccuccuuccuugccgccugcccacaggucccagugcuccuuuccccagcagcuucaugucuccccagagccacuggccuugcucagccccagccuccccacccgccuccuuacuguucuuguccuuugucacagcaacuugagcugguguggagcccuccucaguccuucauagcugagugcuaugagucaccgggaacagccauaggggucucgggacaucacucaggacaggauggugccugcaugugaggcucagacccagacccucagcguucagcagaguuggcaggacaugacuuagaaugccgaggcugggaucagggucaggagggugaggcccugcacuagggcccuggcuucacucacaggaaauggugacuguguguuuuggcugccugcagcagguuggaggggacccacucugccugaaacacccccuccucagcccugguuccucuccgccagagcuccaugcuucccucaccucaguucagcucucacugcugugggaagccuucugagaucaugugcugggggccaggcaugcaaaagcagauguugcacuuccugacuaugaggagaacagcccaagaggcugaguucagcagccacaugcugcauagugugggcaaggacaggagguuuccuggagggugugcagugggugggcacccugugggugggcaccccugggggcuuccuggggagaacgugcugaaucugagugcaugacccaggaccagugcuccacagauaguucccucacugagaagguuccccccacccagaggaacuaucuagaaauaaaccuaauuugaaagauagcugacaugagaaguucuuaaaguagaaguuuuugaauuucucccagcauuccaucaacauguagauggguuggcaggguggaucuuagcaccuccucucccaaccuaccuuuuuaguugagugguucucagagugugggcccggggcaagagccucagccucaccaucaucugggaguuccuuagaaaugcacauucucaggccccacugcagaccuacugauccccacagugugaagguggagcccccugucuguucuaacaagcccaccaggugauggggugcgugcucaaguguggaaacuacugcuuccauucuucccggcuugugaguucucuuuuuaagagacugaggcagagacuggacacccuccccccauaaucccugccuuuugccuaagaaagccccuacacaguuccucccuucuuuucucccuggagguagggaggggccaccgaggaagccaauguccucuaggucugcagaggcugaguguuuuccucugggccccugcggaagggcccucacuggacuccacguggcagcucuuggcugcugcauccacccuuuguuagcagccuguccucacggagaccugcagccagagccugcuguguguguguuagaucucagugaagugauucgcccugaaacgcuuccuggugaugaucccaguuaaccaguccucauccuucugggcaccagaucaaguggauuuggcuuuuaaucccaauaugguggucuaaccagacauuuacuuagaucacuggucuuccuggaggaugcaguuuucuggagucuggucuccagcaacuugccuuggcaggccacguggccugguguggcagcuaagcauaggcuauuuuugucuuugcuuugcaggaacgagcuagagcgacaguuucuugaauugcugcaguucaacaucaauguuccuuccagugucuaugccaaguauuauuuugaucuucguucucuggcagaagcgaacaaccugagcuuucccuuggagccccugagcagggagagggcucacaagcuugagguaagaugguuuaaaacagcguuuuguggugcaguguugccaauacaucaucugaguaccagagaugcauguggucacauugaucauuucccccacuacaugauguaaaauaaagaugagcuacuaggauauauagcugggcaguugauuaugauuuguucugcuucuuuuuucuuugagacggagucucgcucugucacccagccuggaguacaguggugcgaucuuggcccauugcagucucugccucccgaguuaaagcaauucugcuucagccucucaaguagcugggauuacaggugccugccaccacacccgguugauuuuuuguauuuuuaguagagaugggguuucacaauguuggccaggcuggucucaaacuccugaccucaggugaucugccugccuuggccucccaaagugcugggauuacagacgugagccgcugugccuggccagccacuucauauuuuuaauaaccaguuuaauaucacuuuauacuuaauaagcaaagguuuuuuguuuuuuuggguuuuuuugagauggagucuugcuguguuacccaggcuggagugcaguggcacgaucucagcucaucacaacuccgcccccuggguucaagugauucuucugccucagccucccuaguagcugggacuacaggugugcaccaccacgcccagcuaauuuuuuuuuguauuuuuaguagagauggaugggguuucauuauguuggccaggcuggucuagaacuccugaccuugugaucugcccaccuuggccuccuaaagugcugguauuacaggcaugagccaccacaauucuauuuugaaaucaaauauuuuuuaaaacccuuaccuuuacggacagguuuaagaaaauuauguccccccaaaaagcauuucccgcaauauaagccccucaaaaagauacuucucagcaugcgcuuucauaggaaaaagcugccaaaugauauuaacaauugggaauccaaaaagauuugauucugcuuuuuauuuuuuuuccaaaauaccuuuuccauagcccaguuagagcugagggcagcaccacuggucuuggucuggguuuugggccgucauuauuaagcuguguaacuuugggucucaucacagcauauuuguauguggcuccgccucauauguucaccaggcucuucccacuugaccuuuuggcaggaggaaaggggacggggugguaauuaagcaggaucccuggggagagaccccuccuccagagagggugugccccagccuuucuccucugcaccuuuuuucccaauccugccuuggucucaucccauagaguguuuccgagugguggauggcacugucauguccccagcuugugaggucuucgugcugcccacaccacugcccaucccaggugggauguugucacucagugcagaguugguguggcaucaugauggcuuggccacacggugaucuagaacugggagaagaaaccuguuauggauuacacgcuuaagaaagaaaaauguuaaauaaaaauuuaaaaaguaauauguuaauuccaagaaguaaaccauagaaaagacuggaugcauagcacugguuagaaauaaaaauccagugagaguuucagaacucagccaugccccugugauugugugccagccuuuggaauggaaagcccacccagucucccaguuaucaucuauucgaggaaaaauggaaaacccucccucugcaggacuuccugaaggcaaauguugugaaaccuucgcaagcacagaugugagguagaaucuggcuuucccugagagcaugagcccccucucagccugugcuguggucccuggucccccucgucaccagcuauggcucuaguggcugcuucagugcuaaugagacaagccggagcuccuggcagcuacacagcucugcaggaaagugagucuuguguucucugcugaagaauaucuggggcucugagucagucacccugagagcacaggccgagguugguggaguuggcaccugcuguucccucagguuucuccgagugccgagaagggagagcucaccugcuucuggggcugcugugucacgggcccuagggguucagcagggcaggagaaaaggccagucauauccugacaaggcugcucuuucucuucuccaaauaaucaaagccugggacagugggcucagcuuuuaccaucagccaguucuagccacacccaguggcagcccugggagaguuguugccagaguagcauggucccccguccuuaucaccaaaguguugauuaucugcacaucucauauuuuugugaucccccugggucccucuuucggcaacccucuagaggugacuuaaguccuccauccuuuucuguggagucccuagcugguggucuggcugcagcugucuuugccgccagcggccgagcucuccucucugugaggcucagcuccaagcccgugcuucaugccagcccugccaggauggugcuguucuugccccgcuugcaggugaggacgccaaggauucaaaacagcacgcguguggguggggcccgucccacaccccuagauggggagccagcguugacccuggucgggccgacugugaggugacacuguacuguuauuucacauccugagagucuuuucucagacuguaagcucuugggaaacaagagcugaguccacacucccuucguaucucccugcugccagcagagagcugggcucugggccggagcuccacaggggcaggggcucugccugucccucaugcagcgcccucggcgcccaggacgagugagcaauggacgcagauauggcccgcccugacccacacugucuuucuugccccucaggccaucucucgccucugcgaggacaaguacaaggaccuaagaagauccgcgaggaagcgcucagccagugcagacaaccugacucugccccggugguccccagccaucaucucuuaacuacggaggcccgccggaggccacaccaucccuuaguuucuccuuuaguuugagaaaagacagacuugggguggguuuguuuuuguuuuuucuuuccuuuucuuuuuuuacgcauagcuccgucaagcugccuggaugagcgcccaugcagcaaggcuuggaggaagcgucagugcccuggagaucccagcucgcucuccccacugucagcaacagcacuuccuucguggaggaaguggacucgaauccuggaggaggaaauaaagggaaagggaagucguggagaggcagggaaaaugguuaagcagcccggcccucuggaguccccaugggggcgguagcugaaguuggcgagcgcagcgguggaugcagagcuggcugcacccagggcugggccaguguguccuguaagacuucuugcauuccuucugcugcuuuuuugggauggggguauuuuuguucauuuguuuuugcccuguuuugauuuuggucccacagagcaggggauguaguuuguacccaccauggcgcagacuuccaaauaaauaguacuggucauuucucucugcacuauuucugcgcgcugucuucugagcuuucuuccucaccagugggcugugcuuguuccauuucuguacacccuuauuuuauaccguuuuucuucaacaauggcgaaauugacuguagugcugaaccaaaaguaucccuuucccuccuuauuccucaccccaagaacauucuagaucacaugggugcuugugccuuccgauuuucuugcauuuguuuuuuuccugaccugaaguuguuguuacaaaaucagucagacuuugugggcugaaggacacggugcagcagagggugucccugugagaguucugcagagugcugggcaugugccuggaacuaccgaguaggagccauuucuuuguaccccugccuaauccauuccucuccuuccaaguccauuguugcaagcaauauucuucucaauuuuuauauguuuacuuuaaaucaaaguuagucuauuuguauaaaauuuuuaaaaaaucuaaaagaaaaagaaaaaaaacaaggguggguuggguauuccagugggaagaucauugaagggaaaaauguuacuauuuacugagguauuuuucacagaaugauugaauuaaaaaaaacucaacuugcauuuucauugugggugcuuagagaaguucuacaaaauucaaacugugaagguuuaugcuucauuaauuaugaccauacuuuuucauuuucugacgaucccugauuuccuuauggacucaauaagaaucuuuuauaucaaguaaaaugaaaguugaugauagaauaucaaauagugaauuugauaugaaaucuaagagugugagucacuugcauauguaaugcuuuggguuuuugcauauuuucuuaggucacagugacagguuucugaguuguuucccuuuucaagucucugggaggccaguggcagcagcaggucuguguuucaccuucuucccaugugagcuuggaaaacuuuggcaucuuaauuagucuugaaucauacaccugauccccaaacauugccugcucucaaugaaacaugcuuuggaaauggaagggacucagaaagucgaaaucccaagaacuccaagccaaaaguguuagguuuuagugaaauuugugucagguauaagcauaccuguuugggccagaauuauuaucacagccuuucugacccaaacuuucaaaagcaaauaaacagcauauaaaacguuaauuaucuuuccauuguaauugugaugaucuacucuguauggguaccaaaaucaccuucucucuucaagucaaaguugaauuuagaacuuugaauacaggucaaaaaauguagaaaauaucauuuuauauucccuaaucuauauagcugaaaaaggguuguauuuucuuagcugaauaugaauaccucuuaaacauaaauuaguuccucuccagugaaguaucuuauuuuaccaauccauuucaggaaagagguucugcugccguaaaggcagaaauuuuauuuuuaucccuuuuauuugaaugagagauuugaaaaucgaauuauguaaauauuucaaugcaucugcuauuauuuuguggaguuuauuaaacuacuuuaaaaaaauuguauagucuauuuauuguauguauguacauacagucugauaccuaaaauuuaaaguggauuccauaaaaccagacucaagucuuguuuagacuacugaauacuguuuuagccugugcccuggauucuaccucuguauaggaaaauuuuccauauucauuaauuaguguugaucuguauuaauugguuauguuucuugcacuaaggauguuuaaaacuccgcuguaaguguagauuuuaguuuuacuggcaggaugaaucacuugacacauagguagauacuugagguucauuuucuuuucuuuuucuacaugaugaugaauaguuauguuuucuucucugauuuguucaaaguuugccaaaagaaaacacaaaaccaguacaguacuuacugauaaaucguagugacuguaauuuguuuguaaggcgaauuaaugcucuacaauuaaagcuggauuacuauugaggaacacauugucuuaguguaguuuuugaauggaaaguuuuugucauuaaggaugaaggaaacgacacaauuuguuacuuuaauuuuauauuugauuuaaacaacaaauaaagucauugggacaauaa
